United States Patent 11,882,838 (BACTERIAL INOCULANTS) - sequence listing, part 8

SEQ ID NO: 2798 - DNA, 30865 bp, Unknown
  Kingdom: Bacteria, Phylum: Actinobacteria, Class: Actinobacteria, Order: Streptomycetales, Family: Streptomycetaceae, Genus: Streptomyces
gcccgcgacggcccgcgcctggccgctgcggcgcgcggtgcccacgatcggcttccgccagtgagcgggcgcacgcccgagtcgtacacacgggcgtaaaagcgctctgcgttgtcaccgccaggtcgtaggcttggtaatccggaggttgtcgagcagcgagaaccctgcaacgggaggtatgtgcaggcccgagggccggcccatgactcagacacccacacagccgcaggcgcgtgcccagatcaggatcccggccgcacaccccatggtgatgctcctgggatcgggtgactcgctgttgcgcgtgatcgaagaggctttcccggcggccgacatccatgtccggggcaacgagatcagtgccacgggcgaggccgccgatgtcgctctcatccaacgcctgttcgacgagatgatgctcgtgctccgcaccggagcgccgatgacggaggacgcagtggaacggtcgatcgccatgctcagggcggccgccgacggcctgggagaccctcagggggagacgcctgccgaggtgctcacgcagaacatcctctccaaccgcggccgcaccatccgccccaagacgctcaaccagaagcggtacgtcgacgcgatcgaccagcacacgatcgtgttcggcatcggtcccgccggcacgggcaagacctacctcgccatggccaaggccgtccaggcactccagtccaagcaggtcagccggatcatcctgacccggcccgcggtcgaggcgggggagcggctcggtttcctgccgggcaccctgttcgacaagatcgacccgtatctgcggccgctctacgacgccctgcacgacatgctcgaccccgactcgatcccgcggctgatggcggcgggcacgatcgaggtcgcgccgctggcgtacatgcgtggtcgcacgctcaacgatgccttcatcatcctggacgaggcgcagaacaccagcgccgagcagatgaagatgttcctcacccgtctcggcttcgactccaagatcgtcatcaccggtgacgtcacccaggtcgacctgccgagcggaaccaagagcgggctgcggcaggtccaggacatcctggagggcctggacgacgtgcacttctcccggctcacctcccaggatgtcgtccggcacaagctcgtcggccgtatcgtcgacgcgtacgagaagtacgacagccgaaacggtcagcaggacggtcaggcggaaggccgcgaagacggccgacgcgaccgccgtaaagggaagtagtcgcagcgcaccatgtcgatcgacgtcaacaacgagtccggaaccgaggtcgacgagcaggcgatcctcgacatcgcccgctacgcactggcccggatgcggatccacccgctgtccgagctctcggtgatcgtggtggacaccgacgccatggagcagctgcacatccagtggatggacctccccggtccgaccgatgtcatgtccttcccgatggacgagctgcgtccgccggccaaggacgacgaggagcccccgcagggactcctcggtgacatcgtgctctgcccggaggtcgcgaagaagcagggcgaagaggccccgacgcagcactccatggacgaggagctccaacttctgaccgtccacggagtgctgcacctgctggggtacgaccacgaggagccggacgagaaggccgagatgttcggtctccaggccgccatcgtggacggctggcgcggggagcacgggctcaccggcgcgtcccccgcccccaccgtctcgtgagcgcgcccctgatcaccggggccgtgctgctggtcgtcgtcggctggctggccgcctgcgcggaggccggtatcgcccgcacctccagcttccgggcggacgaggcggtccggtccggccggcgcggcagcgcgaagctggcgcagatcgcggccgacccgacccgctatctcaacgtcgccctgctggtgcgggtcgcctgcgagatgtcggccggcgtcctggtcacctacgcctgcctccaggaactgcccgagacctgggaggcgctggccgtcgcgatgggcgtgatggtgctcgtcagctacgtcgccatcggcgtctccccgcgcaccatcggccgtcagcacccgctgaacacggccacggcctcggcgtacgtcctgctgccgctggccaggatcatggggccgatcccgcagctgctgatcctcgtcggcaacgcgctgaccccgggcaagggattccgcaagggcccgttcgccagcgaggccgagctgcgcgccatggtcgacctcgccgaggcggagtcgctcatcgaggacgacgagcgacgcatggtgcactccgtcttcgagctgggcgacacgctggtccgcgaggtcatggtgccgcgcaccgacctggtctccatcgagcgctacaagacgatccgccaggccctcaccctcgccctgcgctccggcttctcccggatcccggtcaccggcgagaacgaggacgacgtcgtcgggatcgtctacctcaaggacctggtccgcaagacgcacatcaaccgggagtccgaggccgaccccgtctccaccgcgatgcgccccgcggccttcgtccccgacaccaagaacgccggggacctgctgcgcgagatgcagcaggaccgcagccatgtcgcggtcgtcatcgacgagtacggcggcaccgcgggcatcgtcaccatcgaggacatcctggaggagatcgtcggcgagatcaccgacgagtacgaccgggagctgccgcccgtccaggagctgggacacggctgctaccgggtcaccgcccggctcgacatcggggacctcggcgatctcttcggcctcgacgagtacgacgacgaggacgtggagaccgtcggcggtctgctcgccaaggcgctcggccgggtcccgatcgccggcgcgtccgcggccgtcgagctgcccgacggccgcaggctccggctcaccgcggaatctcccgcgggccgccggaacaagatcgtcacggtgctcgtggagccggagcaccagcagaccgaggagaaggaagcggaatgacgccggagcggctgcgggccttctgcctggagttcaacgcgagcgtggaggagttcccgttcggcccggagacctccgtcttcaaggtgcgcggcaagatgttcgccctcaccgcgctggacggacggccgctcaccatcaacctcaagtgcgatcccgacgaggcgatccggctgcgcgggacgcaccccgcgatcgtgcccggctggcacatgaacaagcgccactggaacacggtcaccgtctccggcgtcccggaccggctgctgcgcgagctggtcgaggactcctacgacctggtcgtcgccggactcccgaaggcggagcggctccgcctggaccgcccgtagaagaagcgcgtacaagaccgggcccgctcccttcgtgggggcgggcccggtcccgtgcggtcagctccgccgcagccccgccgccaccgccgcgcccgccgccagcaggatggcccccgcgaccgcgaccaccgtccgtacgccgtcgaacagggtgtcctgcgtcgttgccagcacgcccagcagcgggatgccgaccgtgaggccgacctgctgcgtcgtggtgaccaggccggtcgccaggccctgctcctcgttcgggactccggacgtcacgatcagcccgtacgagatgatcgcgcccaggtggaacatgctggacagcgacaccgcggccgtcgcgagcaacgcccccgtgtccgaccccaggcccagcagcgcgccgatgaacagcccctgcccgagcagcgacagcgccagggtccggcgggcgccgatccggccgatcaccttgggcgcgtacatccccgccaccaccgacagcacgccctgcacgccgaagaccagaccggtggagaacggtgagaggtccaggacctcctggaggtacagggtcaggacgaagacgacggtgctcatcatcgagaaggtcaccagaccgcccaggttgccgaacgccaccgtccgccgccgcagcatcggcagcgacaccagcggggccgccgagcgggactccaccacgacgaacgccgagagcagggccacgccgaggaccagggtgaccagcacgtccacgccgccgaagccgcgctccgccgccgtcgacagtgcgtagatcagcgccagcagaccgccggtgacgctcaccgcgcccggcacgtccagccgctgccggtccgtcgtccgcgactcggccaggaccttcggggccggcaccagcaccacgatcgaggccaccgccagcaggcccatcgtggagcgccagcccagcgtctcggtcagcacgccgcccgcgaccatgcccaccgtgaagccgagcgacatcagcgttccgctgatcccgagcgcccggtcgcgcagcggcccttccgggaacgtggtcgtcagcagggacatcccggtcggcacgatgaccgcggcgcccagaccctggagcgcccgtgcggcgaggaaggaggccgggtcccaggccagtgtcgccagcagggacgaggccccgaagagggtgagtccgatgaggaacagcctgcgccgcccgtacagatcggcgatcctcccgaagagcagcaggaagcccccggacggcagcgcgaacgcggtgacggcccactggaggcccgtggtgctcagcccgaggtccctgccgagcaccggcagcgccacgttcagcacggagaagtccagggccaccatgaactgggcggcgcacagcacgaagaggaccagccgggcccggccggatagccggggcgggccggcctcggggagcgcgggggacagccgggcaacaggggaagcaggggaagcagcagaggtggaaggggattcgatcgccatgggtcccaccctgcggcggccggaataaccgtggggagcgggaacttatcctgttgcccgcaccaccaggcaggcgcacgcacggacagcagggggagtacgtggccacaccggcccagcaggcgacggacggcacgaaggcccaccgcctcgccgaactgcgcgagttcctcatgagccgccgtgctcgcatcaccccggacgaggcgggcctgcccgggggagcccgccgccgcaccccgggtctgcgccgcgaggaggtcgccgtcctcgccggggtgggcgtctcctggtaccagtggctggagcagggccgcgacatcaccgtctccccgcaggtgctggactccgtcgcccgggtgctgcgcctgaacagcgccgagcgccgccatctgtacgtgctggccgggctgaacgcgcccccgcccgaggtcgatccggccgacgccgacatgtgcgagggactgacccggctcatcgacgcctggatgccctacccggcccacatcatggaccgttactggaacaccgtcctgtacaacgacgcgtccgccgcggtcctcggaatgcgtcccgggatccggcagaactgcctgatcgccttcttcaccgacccggtctaccgctcccgcaccgcgccgagctgggacgcgctggccccccgggtggtggcccagttccgggcggcctgctcggactccccggacgacgacggattccgggccgtgatcgaggaggcgaaggcggccagcggcctcttccgcgagctgtgggagcggcgcgacatcgtccccgccggccagaaccgcaaggaagtggagcacccgctcgtcggccgcctggccctggaatccacccagctgcgggtgcccgcccggccggacctggcgatcgtgctccacaccccgctgcccggcaccggctgcgaggccaggctccagtggctcgcctcgcccgaggggcggcgcggctcgatgtacccggtgccggggtgagctgtccgggacggccggacgctcccggtgccggggtgacctgcgagggcctccgcccgcttcgtatgctcgtgccatgaccgacaccacggagctcgacgccgaggaccgcaagatcgtcaccctggcgcgcagcgcccgtgcccgcaacggggtgcccgagggcgcggccgtacgcgacgagacgggacgcacgtatgtcgcgggcacggtggcgctggagtcgctgaagctcagcgccctgcagaccgccgtcgccatggcggtggccagcggcgccacctcgctggaggcggccgcggtcgtttccgccgcggagaccccctccgacgacgaccgggccgcggtgcgggacctcggcggaccggacaccccggtgctgctcgcgggcccggacggcacgctgcgggtccgcgtcacggcgggctgatccggccgtgtgacggcctgcccgagcggggccgggtgacggcctgcccgagcggaagactcaccacaggccgatcttgacaccatctgatgggccatcagtcaccgcatttcgtctgcattgacttctttttcgcccgggtcatcaatggccccctgccggtacggaagagccgccgtaccgctttccgcaggagggcaccgaattcatgcgaccgaccacgcgaagatccaccgaaccgcggcgccgctgggccgccgccctgggcatcaccgcactcgtcgtcaccgggggaggactgctcgggggtccggcgcaggccgccgcgacggcctccgtcgcggtggacttccccacccactgcatcccgccgcccatcgcggggatcccgcccatcgacggcaccacgaccgcgcagatcaccgtcgacgacacgaccccgcaggtcggcgacaccgtcgccgtgacctacaccgtggtcgtgcccgccgccagcaacccggtcgacctggccctgcccgccgacatcatgacgccgaccgggaaggtcaccctcggcggcgcgcagagcggcgacgtcaccgtcgcggggccgaagaagaaccccccggtccccggcaagggcgccttcccgtcgttctccatgacggggacgttcaccgtcaccgcacccggcgcgatcaccctgtcgcccggcgactacaacatccacaccagctacatcatggagttggacactccctgcacggtgacgggcccgcccgcccccgtgtcggagaccgtcgtcgccaccggcggcggccaggtcaacgaacgcgccgtccagctctcggccgcctccgggcaggcgggcgacgaggtcaccgtcaccggcacgaagttcaccccgggtgcgggcatcaccgtggcgggccgcgacggcgacgcgcagaccggtgacaccaccacggccaccgccgacggatccggggccttcaccgcccggctcgccgtcagcgacccgggcaccaccggcatcgtcgcctacgagggcggcgcctgggacgccgcgaagggcgcgggacccctggcgtacaccgtcaccggaggtggcgagatccccgacggcagccagcagctcaccacgacggtccgtgcgggcacgctgtccatgacccaggccggcgacatcgtccagttgtccggggtcgacttcggccggggcggcgcctccaccggcgacctgcacgcggtgaccgtcgaggacttccgcggcggccccgccggctggtccctcaccggcaaggtcaccgacttcaagggtccgggcggggcgcggatcagcgccgacgccctcggctggaccccgtcctgcgccacgaagcccggcagtccgagcacctgcgcggcgggcagcgccggagcggtcggcagcgccggggccaccctggcgtccacgcccgacggggctgccaccggaggggagttcaccgtcgacgcggggctctccctggacgtgccggccttcaccggggccggttcctacgcgggagtgctgaccctcaccctcacgtgaggtctgctcctgatccaccgtgggccgggcgcgcacccggccggcccactccacccggacgcgacctgggggtcccgtaccgtgcgcaagctccccgtactcctcctgacggccgccctgctgctcctcggcacgcccgccgcccacccggccgacaacggcagctggtccgtccggccggccaccggcccgtccggcgaacgtccctccctctacctcttcgccgccccgggcaccacgctcaccgaccgggtcaccgtcaccaacaagaccgcgaaaccgctgaccctgcggctgtacgcggccgacgcctacaacaccccgcgcgacggcggcttcgcggtccgcgaccggaacgagaagcagcgctccatcggcgcctgggcccgcaccgaccgggacaccgtcaccgtgggccccagggcctcggtcaccgtgcccctcaccatcgaggtcccggagaacgccgagccgggcgaccaccccggcgcactgatcgccctggacgaacgcgtcgaggccacccgccgcggcgccctggccgtaggagtccgccgagccgtcggcgcccggatccacctgcgggtgaacgggcccaccgtccccgcgctctccgtcgaggacatccggatcgagcggcaccgtccgctggtcccgggcaccggcacgagccgcgccgtcatctcgtacaccctgcacaaccgggggaacgtcaccctcacccccgccgtcgccctgcgcgccgagggccgcttcggccggaccctgctgaagcgcggcctgacgaggctgcccgccgagctgctgccccgccagcaggttcggctgaccgagacctgggagggcgcaccgcagctggaccgggccgaggtcgaactcaccgcgaccgcgaagggcacccgggagtcggcggccgtcgccttcctggccgtgccgtggctcctcgccggagtgctcgccgtgctcgtcgccgcgggaaccgccctgtgggcacgggcccgccgacgccgtacgcgtacggcctgaggcgtccgtgacgagcctcgcccggcccactgtgcggcagcgccgccgggatcggggagaatggtcgccatgagcgctcgaccgaaccaagaatccgctgccgcgcaagcggagaccacctccccccaccgggccggcttcgcctgcttcgtgggccgtcccaacgcgggcaagtccaccctcacgaacgctctcgtcggtcagaaggtggcgatcacctccaaccgcccccagaccacccggcacacggtgcgcggcatcgtgcaccgtgacgacgcgcagctgatcctggtcgacacccccggcctccacaagccgcgcacgctcctgggcgagcggctcaacgacgtcgtgcggaccacctgggccgaggtcgacgtcatcggcttctgcctgcccgccgaccagaagctcggccccggcgacaagtacatcatcaaggagctcgcggggatcaagaagacccccaagatcgccatcatcaccaagaccgacctggtcgagtcgaaggcgctggccgaacaactcctcgccgtctccgcgctggccgacgagctcggcttcgagtgggccgagatcatcccggtctcggcggtcaaggaggagcagggggcgggacgcagtccctcgggcaagggcggtggtgggagaggtgcaggccaggtgggcctgctcgccgacctcatcgccccgctgctcccggtgagtccgccgctctatccggagggcgacctcaccgacgagccggagatggtcatggtcgcggagctgatccgcgaggcggcgctggaaggcgtacgcgacgagctgccgcactccatcgcggtcgtcgtcgaggagatgctgccgcgcacggaccgcccggcggacaagccgctgctcgacatccacgccaacgtctacatcgagcgtcccagccagaagggcatcatcatcggcccgaagggccagcggctgaaggacgtcggcaccaagtcccgcaagcacatcgaggccctgctcggcacgccggtcttcctggacctgcacgtgaaggtcgccaaggactggcagcgcgacccgaagcagctgcggaagctcgggttctaggcaggcccgcggaaggcgcctgtctcacgtgcctccggcagaaggagccgatctcacgcgccctccttgaggacgcgtgagatcagcgtgcgctgcgccccggtcagatcggggtcagcgcagtacacggtgcggtccccgacggtgatcgcgtaccggaagccgtccggtacgcccgtcggcggggtgtcccgcgcggagcggagcgcctcctcggcgagcgcctgccactccgcggcgtccgcccttcccccggtgtcgacctcatggcggcgggcgatgccggcgaagccgccggtcctgctgacctgaatacgcatggggtcctgtctatcgggggccggcaggggcgctcaaccccgcctcctggggccggggtcacgccttggtcggcacgcccacctccgaccaggccttgaggaccgcctcccgctcgtcgcccgcgccgaagcggtcgcccgccgccgcgaccgtcagccgggcgaactccgcgaagtccgcgttcgccgtcagctcgccgccggtcagcacgtcgaaccagatctgcccggcacgctcccaggagttgccgcccagcgcggtggccaggaggtggaacgcgcggttggggatgccggagttgaggtggaccccgccgttgtcctcctccgtctcgatgtagtccgccatggaccccggctgcgggtccttgccgagaacgtcgtcgtcgtacgccgtgcccggggccttcatcgagcgcagcgcgtccccgctgacccggggcgccagcagcccggcgccgatcagccagtcggcctgctccgcgctctggcccagcgagtactgcttcaccagcgagccgaagacgtcggacaccgactcgttgagcgcgccggactggccctcgtagcgcaggttggcggtgtgctgcgtcaggccgtgggccagctcgtgggcgatcacgtcgaccgcgacggtgaagtcgaggaagatctcgccgtcgccgtccccgaagaccatctgctcgccgtcgaagaacgcgttgttgtactcctcgccgtagtgcacggagccgatcagcggcagccccttgccgtcgatcgagctgcgcccgtacgcggagagcagcagctcgaaggtggcgccgagaccggcgtacgcgcggttgacgctggcgtccgaggtgggcttgtcgccctcgtcgcggacctggcggccgggcagggtggtgccgttcccgcagtcgtacagggtgcggtggggcttggtggggaccgcgcccacgccgggggcggtcgggacggcggcgagggccgtcgtccggcggcgttcgcggcggaggccgtcggccgccagggtgcggcgggcgggatcggcgagccgggcgtcggcggaccgggacaggtggtcgaggacgtggggcggaacgatggtgcagaagacggggtggagatcgccgtcggttcgaaggtgcatacaacgactgtggcactccgtcaccgcgctgtcaccggttgcgacgatgattgacgaaatggagtgatgagtcactgtttacccgtcatcgatgtccggtcccgcatactgatacggaccgacaccacgggccacactcggttacgctcgtcgcatcatgcgtttcgggctgcttctccttagctgccgcggcgagggcctgtagtcgtaggccgaccccctccccgcggagtctggtgctgcagcgacacagtcggccgatccccgctggaccgaggagccctacgccatgaccaccgtgaatcccgccggtaattctgtcggccgaccgaccccgatcaccaacgcgacgcagctccagaagccgtccgggatgccggtccacaagtaccgcggctacgaggccgtggacatcgccgaccgcacctggcccgacaaccggatcaccgtcgcgccccgctggctgtccaccgatctgcgcgacggcaatcaggcgctgatcgacccgatgtccccggcgcgcaagcgcgagatgttcgatctgctggtcgcgatgggctacaaggagatcgaggtcggcttcccgtcctccggcgagaccgacttcaacttcgtccgctccatcatcgaagagggcgcgatccccgaggacgtgacgatctccgtcctgacgcaggcccgcgaggagctgatcgagcgcaccgtggagtcgctggtcggcgcgcggcgggccaccgtccacctgtacaacgccaccgccccgaccttccgccgcgtcgtcttccgcggctcgcgcgacgaggtcaagcagatcgcggtggacggcacccggctggtcatggagtacgccgagaagatcctgggcccggagacggtcttcggctaccagtacagcccggagatcttcaccgacaccgagctggacttcgccctggaggtctgcgaggccgtctgcgacgtctggcaaccggaggagggccgcgagatcatcctcaacctgcccgccaccgtggagcgttcgacaccctccacccacgcggaccgcttcgagtggatgtcccgcaacctgacccgccgcgagcacgtctgcctgtcggtccacccgcacaacgaccggggcaccgccgtcgccgccgccgagctggccatcatggccggcgccgaccgcatcgagggctgcctgttcggccagggcgagcgcaccggcaacgtcgacctggtcaccctgggcatgaacctcttctcccagggcgtcgacccgcagatcgacttctcgcagatcgacgagatccgtcgcaccagcgagtactgcaaccagatggagatccacccgcgccacccctacgcgggcgacctggtctacaccgccttctccggctcccaccaggacgccatcaagaagggcttcgacgccatggagcgcgacgccgccgcccaggggaagaccgtcgacgacatcgagtgggccgtgccgtacctgccgatcgacccgaaggacgtcggccgctcgtacgaggccgtcatccgggtcaactcgcagtccggcaagggcggtatcgcctacgtcctgaagaacgaccacaagctggacctgccgcgccggatgcagatcgagttctcccggatcattcaggccaagaccgacgccgagggcggcgaggtcaccccggcccagatctggaccaccttccaggacgagtacctgccgaacgccgagaacgcctggggtcgcgtccagctgcgctccggccagaccacgaccgacaccgacggccgggacaccctgaccgtcgaggccaccgtcgacggcgcggacaccgtgctgagcggcacgggcaacggcccgatctccgcgttcttcgaagcgctgcaggccatcggcatcgacgcccggctgctggactacaccgagcacacgatgagcgagggcgccagcgcccaggccgcctcgtacatcgagtgcgcgatcgacggcaaggtcctgtggggcatcggcatcgacgccaacaccacccgcgcctcgctcaaggcggtcgtctccgcggtcaaccgcgcggcccgctgacccgtccggcccctcccgggccttcgcgtccccctcctcgtacggacgtccggttcgaccccgtacgacggcattgacggaccccgaccacccgctccgggtggtcggggttcggccatatccgagggttgtgacgtcccagaggctgacgccacatcacgcgtgtggctaacatcacgtccaacacacggcaatgttgccggagcgttacggaggtgtgcgacgtgcggtcagccaaaggacaacgcgctctgaggccggtcctctgcggcgttcgcaccatctgggacgccgtcggcgacggcgccttcttctgccccggctgcgggggagaccgcaactaccgccggctcaccggccgccgccgcctcaccgtcctcggcgtcccgctggtccgccgcggcgacaccgagccggtcgtcgagtgcgccgcctgcctcacccactacgctcccgaggcgctggaccaccccaccacgacccggttctcggcgatgctccgtgaggccgtccacaccgtcaccctggccgtcctcgccgccggaggcaccacctcccgcaccgtcctggaggccgccgtcgccaccgtgcgcgacgccgggctcgacgactgcacccaggagcagctgttcaccgtcgtggaggtgctggccgccgacaccggccggggttccggttccgacccggctgccgaggcctgcggcccgaccctcgccatcgagctgcacgaggtgctggccccgctcgccccgcacctggccgccgccggccgcgagtccgtcctcctccagggcgccaggatcgcgctggccgacgggccctactgcgccgccgagcgccaggtcctgaccacggtcggcagcgccctccagctccccgccgacgacaccgcccgcctgctggcggcagccgcccgcacaccctcctagagccttctccgcagccgacccgccgcgggtcccgggtgggcgacaatgggcccatgagcttgttccgggacgacggcatcgtgctgcgtacgcagaaactgggcgaggccgaccggatcatcacgatcctgacccgcggccacggccgggtgcgcgccgtcgcccgcggggtgcgccgcaccaaatccaagttcggcgcccgcctggagcccttctcccacgtcgacgtgcagttcttcgcgcgcggcagcgagctggtcggccgcgggctgccgctctgcacccagagcgagacgatcgccccctacggtggcgggatcgtcgccgactacgcccgctacacggcgggcaccgcgatgctggagaccgccgagcggttcaccgaccacgagggcgaaccggccgtccagcagtatctgctgctcgtcggaggcctgcgcaccctcgcccggggcgagcacgccccccacctgatcctggacgcgttcctgctgcgctcgctcgcggtcaacgggtacgcgcccagcttcgaggactgcgccaagtgtggaatgcccggtccgaaccggttcttctccgtcgcggcggggggcgtcatatgcggtgactgccgggtccccggcagcgtcgtaccctcggcacaggccctggtcctgctgagcgcgctgctcagcggcgactgggcgacggcggacgcgtgcgaggcgcgtcatgtcagggaggggagcggactggtgtccgcctatctgcactggcatctggagcgcggactgcgctcgctgcggtacgtcgagaagtgacgcggtgcgtagagaagtgacgcggtacgtagagaagtgacacagggagactgagaagctcatggcagtacgcgggatcctcggcggccgtaaccggcgcacgtacaagacccccgagccgcacccctcgggagcgacgcctccgaagatccccggcgagctggtgccccagcacgtcgccgtcgtgatggacggcaacggccgctgggccaaggagcggggtctgccccgcaccgagggccacaaggtcggtgagggtgtcgtcatggacgtcctcaagggctgtatcgagatgggcgtgaagaacctctcgctgtacgccttctccacggagaactggaagcgctcgccggacgaggtgaagttcctgatgaacttcaaccgcgacgtgatccgccgccgccgcgacgagatggacgagctcggcatccgcatccgctgggtgggccgcatgcccaagctgtggaagtccgtcgtccaggagctccaggtcgcccaggaacagaccaaggacaacgacaggatgacgctgtacttctgcgtcaactacggcggccgcgccgagatcgcggacgccgcgcagcgcatcgcccaggacgtggcggccgggaagctcgacccgtccaaggtcaacgagaagaccttcgcgaagtacacgtactacccggacatgccggacgtggacctcttcgtgcgtcccagcggcgagcagcgcacctcgaactacctgatctggcagagcgcgtacgccgagatggtcttccaggacgtactctggccggatttcgaccgtcgggacctgtggcgggcctgcctggagtacgcccagcgcgaccgccgcttcggcggggcggaggcggtggaggcggcgaaggcggcgaaggccgcgaaggccgcggagagcgccaagaactgacgcgagaagtgacgcgaaagtgatgcgagaagtgacgtgaaagaggcgggcccgggacgcgtacagcgtcccgggcccgcctcctctcgtccgttacgccttgatcgcggcgcactccgcgcacgtgccgaagatctcgacggtgtgcgcgacattcacatagccgtgctgggcggcgatcatctcggcccactgctcgacggcggggccctcgacctccaccgccttgccgcagagccggcagaccaggtggtggtgatgatcaccggtcgagcaccgtcggtagacggcctcgccctcggtggtgcgcaggacgtcgacctcacccgcgtcggcgagggactgcagggtccggtagaccgtggtcaggcccacggagtcgccgcggtgtttgaggacgtcgtgcagctcctgggcgctgcggaactcgtcgacctcgtcgagcgccgccgccaccgccgcccgctgccgggtggaccggccgcgtaccggcgctgcgttcgtgccactgatcggcgccgtggccacagctgcctcctcgtgtcgcccgtacatgtgtcgggccattgtgccagcccggccgggcgtcgccggcgaacacgtacggtgcgacgccgtcacacccgtacgtcgtccctgtcccggcgggcccccggtacctcaagggtgcactcggcccccttcgcctcgctcgcccgcgcccggcgtctcgcgagcggagcggcgagcacggtcagcgcgacgaacaccgcgatggccagcagcacgatcgtcgcgccgggcggaacgtcctggtagtacgaggtcacggtgccggtgagggtcacggccgtgccgatcacgacggccagcacgaaggtgaccttgaaggacttggtgatctgctgcgccgccgcgaccggcaccaccatcagcgcgctgaccagcagcaggccgacgacccgcatcgcgacggtcacggtcacggccgcggtcaccgcgatcagcaggttcagcacccgcaccggcagcccggacacccgggcgaactcctcgtcctggctgaccgcgaacaactgccgccgcaaccccaccgtgaccagcaccacgaaggcggccagcacgcagatcgcgatgacgtccgactccgagaccgtggccagcgagccgaagaggtacgaggtcaggttggcgttggagcccgagtcggacaggttgatcagcatgacgccgcccgccatgccgccgtagaacagcatcgccagggcgaggtcgcctcgggtgtgtccgtaccagcggatcagctccatcacgaccgcgccggccaccgcgacggcggtggccatccagaccgggctggtggagagcaggaagccgaggccgacgccggtcatcgcgatgtgcccgatgccgtcgcccatcagggcctgccgccgctgcaccaggtagatgccgatggcgggcgcggtgatgccgaccaggacggccgcgatgagcgcccgctgcatgaagggagggttcaggaattccagcatcatcaggtcagcagtcccgtccgtacgggctcggcggccgcgtgggggtgtacgtggtcgtggccgggcagagcgtgctggccgagcgcctcgggtggcggcccgtcgtgcgtgacgcagccgtcgcgcaggacgacggcccggtcgatcagaggctccagcgggcccagctcgtgcagcaccagcagcacggaggtgccccgcgccacctgctcgcgcagggtcgaggcgaggatctcctggctggccaggtcgaccccggccatcggctcgtccatgatcagcagctccggctcggaggccagggcgcgggcgatcaggacccgctggtgctgtcccccggacagcgcgctcacggagtccttggcgcggtcggcgaggcccaccagcgcgatggcccggtccacggccgcccggtccgccttcccgggccaccgcagccccgtacgggacagccggccggaggcgacgacctcacggatcgtggcgggcacaccgcccgcggccgtggtgcgctgcgggacgtacccgatccggccccaccggcggaagcggcgcagctcggtgccgaacagctcgacggtgccgcccgtcagcgggacctgcccgatgacggaccgtacggcggtggacttgccggaaccgttggcgcccagcagcgcgacgacctcgccgcggtgcacggtcaggtccaccccgcgcagcacggggcgcgcgccgagggtggccgtggcgccgcgcagggcgatgacgcgctcgtggccggtggccgcgggctcgttagtggtgctctcacgctccggcatgagcgcctccgatccggggatacgggtggtacgggtcacttcgcgccgagtgccttctgcagcgcggcgaggttggactccatgacctcggtgtagtcagcgccctgggacttgtccgtgattccctccagcgggtccaggacgccggtcttcagcccggtgtccttcgcgagggtcttcgcggttttgtcgctggcgagcgtctcgaagaagaccgtggtggccttctccttctccgcgatggtgtggatctcctggatccgggcagggctcggctcggcctcggggtcgatgcccgcgatgccctgctgggtgagcccgtagcgctcggcgaggtagccgaaggcggagtgggtggtgatgaaggtcttggtggaggtgttcttcagtccggtctcgaacgccgtgttcagcttgcccagctcggcgacgagggcgtcggtgttcttcttgtagtcggcggcgtggtcggggtcggccttctccagcgacttgccgacacccttggcgacctcggcgtacttcaccgggtccagccagacgtgcgggtcggcgccgccctcctcgccgtggttgtgaccgtcgccctcggagtgctcctcgtgggcctcttcttcgtggccgtgctcgtccccgtgctcgtccgcgtgctcttcttccccgtggtcgtggccgctgacctcggatccgtggttctccagcgtggtgagggtcgcggcgtcgacggtgttcttcagaccggactgcttgatcgcttcgtccacgacgggctggatgcccttgaggtacagcacgtagtcggactcgctgatggagccgatctggcggggggtgagctccaggtcgtgcggttcgacgcccggcttggtgaggctggtgaccgcgacgtgctcgccgccgatccgctcggccaggaactgcatcgggtagaacgacgccgtcaccttcagcttgtcgccgttgcccccgtccgctgcgtcggaggtggaacaggccgagagagcggtcagaccgagggcgactgctccggcgacggcggtggtgggtatgaggcggcgtacgttcatgacactcattttcaactaaagtggaaacgattgtcaacaaggcagatgagatgcccggaaggtcacataggggcaccggggagatcaccgggaagatccttcacgtcccaccgatttgatccgaggggtgcgcccgccggtaatctgaagcattcgccgttcgtcaccgtcgtaatgaagagagcaccgtggccgccgacaagatcgacaccatcgtcagcctgagcaagcgccgtggcttcgtctacccctgcagtgagatctacggtggccagcgcgccgcctgggactacgggccgctgggcgtcgagatgaaggagaacctgaagcgtcagtggtggcgctacatggtcaccgcgcgcgaggacgtggtcggtctcgactcgtcggtcatcctggccccggacgtctgggtcgcctccggccacgtcgccaccttctcggacccgctcaccgagtgcacctcctgtcacaagcgctaccgcgccgaccacctggaggaggcgtacgaggagaagcacggcaagccgccggtcaacggcctcgccgacctcaactgccccaactgcggcaacaagggcaccttcaccgagcccaagcagttctcgggtctgctctccacccacctcggtccgacccaggactccggctcggtcgcctacctgcgacccgagaccgcgcagggcatcttcaccaacttcggccaggtgcagcagacttcgcgcaagaagccgccgttcggcatcgcgcagatgggcaagtccttccggaacgagatcactccgggcaacttcattttccggacccgcgagttcgagcagatggagatggagttcttcgtcaagccgggcgaggacgaggagtggcagcagtactggatggaccagcgctggaactggtacacggacctcggcatgcgcgaggagaacatgcgctggttcgagcacccgaaggagaagctctcccactactccaagcgcaccgccgacatcgagtaccgcttccgcttcggcggcagcgagtggggcgagctggagggcgtggccaaccgcaccgactacgacctcaaggcgcactccgaggcgtcgggcaccgacctgtcgtacttcgaccaggaggccggcgagcgctggacgccgtacgtcatcgagcccgcggccggtgtcggccgcgcgatgctggcgttcctcctggacgcctacgtcgaggacgaggcgcccaacgccaagggcgtcatggagaagcgcaccgtgatgcgcctcgacccgcgcctggcgccggtcaaggtcgcggtcctgccgctgtcgcgcaacccgcagctctcgccgaaggccaagggcctggcgaccgacctgcgcaagaactggaacatcgagttcgacgacgccggcgccatcggccgccgctaccgccgtcaggacgagatcggcaccccgttctgcgtcaccgtcgacttcgacaccctcgacgacaacgcggtgaccgtgcgcgagcgcgacaccatgaagcaggagcgcgtctccctggaccagatccaggcgtacctcggctcgcgtctgctcggctgctgacacccgcacacgtgcgtgaggcccccggttccgggtacggaaccgggggcttcgtcgtacagtccaccggagcccccgccgccgttccgggaggtacgcgatgccgtccatcaccaccagcaaggtcagcagatgggaccagcacggccgtgaacacgtcgtgcaggtaaggaagtcgggcatgacacgccagttggcctgctccacctgcgcgtggcgccgctcggcgcagttcctgccctggctgaaggccgaggagcatctggccgaggcccatcaggcgacggtcgacccgacggcctgaaaacccggtgcggtgcgcttcgggagcggggtacggtttccgcatgtcttcgttcttccagatctacgagtgagagcgcggcgggtcgcgaacacccgccgcccaccggatcgatctcgatcacccgatcacttccttcctcacttctcaccacgaatgggagaacgccgtggccaagagccgcaacaacctcctcggtgtcggcggacagcgcaagaagctgtcccgcgccgaacagcagggcgcgggttccgcgcgaggcgccgaccgcaaggccgccgaggacaagaagcaggagctggtgcgcaagatgcgcgagcgcgccgaggcccaggccgccaccaccgccgagcccggcgagcaggacgctcccgcgcagagctgacccccgagcgctgcctgaggggtagcgcgtacgtcccgtacgaccgtgggcccggatcatccatgatccgggcccacgggcgtatcgggccctatgagcggcagggggccgcgaaacggtcgccggcccggaccaggcgcagcgtgatgcgcgtgaccttccggccggccgtgcccgcgtggcggccaccctgcgtgtcggcgttccgaatcagtcgtggcggcctgtcgcctcacggatccagctcgcgtaggcgggtgcgctggtgtagagccccggcccctcgctgcagggcacgcccggggcgccggggcccgaggtgacgcctatgagctcccagcgccccttccggtccctttggagctgggggccgcccgagtcaccgttgcacgccatggccttgggggtctggctgatggtgcacaggcgagtgctgtccgcgtagcccggtgcgcagtccgtcaccgcaccccggcgggtgtcgagttcctggagccggtcggggaagacccacggggcgtcgggtgcgtcatcggtcctgccgaagcccaggatccgggtcggggtgccgggccgtcccggacggtcggcgacgcggacgggcttctccgcgaccgggcggttcagacggatcagggcgatgtcgtcgcggttggggccggcgtcctcgccgctccggtagccggggtgggacaccgtcttcgcgacggaccggaccgtgcctccggagtccttccactcgctgccgatccggacggtgccgtccagggtgaccagcctcgggtccacacagtgggcagccgtgagcacccatcgggagtcgatcaacgatcctccgcagacccccttgaacgtcgggtcgtccgcgcccgtcacggggatcgacaccatggacgggtaacgctgcgtggagtcctttccgttgacgatggctccggcgctgccggtcatcgtggcggcgcacgccgctccggccaggacgactgcggcggcgcgcgccaccgtacggcgtgaggacttcagacggaacactggttctccgatcggctgagcatgttcgacgtgctcagcctccgcgatcaagaggaactgatccatccggccagcgggcctgtccgaggtcgggccagcgggcccgtgcggggtggggagaccccccgaacgaggtgggggtctccccggcggacgcctgaccgaccgcctgggcgccgtaaccgtcatccgcgtggcccccggccgacggccgggacagcgccgccgtcgcgctcatcgggcacagcgctcggcccggccgcgtggagccgcgagcacctggttcccggtggcacgcgaacgcgacggccgtgtcccgcgccggtcctgccctacttcaggtgccgggcgaagaaccgggcccccgtgtccagctcgaactgcgggacgccggtgtgcccgccgagattggcgtgcagggtcttctccgtggagccgaaggcgtcgaacaggtccagggttgcctgtcggtcgtttccttcgtcgtcccactggagcaggacgtgcagcggaatggtgacccggcgggcctcctcgaacatggcggccggcaccagactcccggcgaagagcccggcggccacgatgcgcggctctaccctcgcgaggcggacgccgatggagatgacccctccctcgtacccgaccggcccgtcgatcccgggcagcgacaggagcgtgtccaggacggcccactcccggggagctcgatggtggccgcggcgaagccgtactccgccgcgtagtgacgggcacgtcctgccagcggggggtacatcctgcgcagcccgcgcgggccgggattcctgcgacctcggcatgccgtccacctcacggggagagccggaccggacagtcgtcccgggaccacggcgcggggtgattctcggccgtcccggtgggcgggtcagactaggggcgatctcccgcttcggcttcgcccgccatgcctcctcgctcctctctccgtcaggaatcgccgtgtcccaccccaccgccgccccccggacgagcagcgccgctccgcgtgccgactcgcaccgcttcagcgctgtcatcggccgcatcgccgaagagatgggcgcactccccgaccacggcactcccgccgactacatcccgatgctcgccggcgccgacccccgtcgcttcggcatggccgtcgcggagccggacggaaccgtctacggcgtcggcgactggcagcagccgttctcgacgcagtccatatccaaggtgttcgccctggccctggcgctctccctggacggcgagcagatatggcggggagtcggccgcgagccttcgggcaacccgttcaactcgctggtgcagctggagtacgagaacggagtgccccgcaacccgttcatcaacgccggcgccctggtggtgaccgaccggttgcaggcgctgaccggggatgccgccgggcaggtgcgggagctgctgcgttcggagagcggcaatgccgtcatcgacttcatcccggaggtcgccgcctccgaagcggccttcggcgaccgcaatgccgccctggcccacttcatggcctcctacggcaacatcacgctcccggtccccgaactgctcgccgcctacttccgccagtgctcgatcgaggcgtcgtgcgcggacctggccctctcggccgggtttctggcccggcacggcattcgggccgacggctccgcgctgctgacccgcagccaggcgaagcaggtcaacgcggtcatgctcacctgcgggacgtacgacgcggccggggagttcgcctaccgggtcgggctgccgggcaagagcggcgtcggcgggggcatcatcgccatcgtgcccggggtgtgcaccctgtgcgtatggagcccgggtctcgaccggcgcggcaactcggtggcaggggtgtcggccctcgaccgcttcaccacgctgaccggactctccgtcttctgacgcgtcggccgggcggcgctgctctgcggcctgcggcccgcctcctgatcagatgaccaggacacggcggccccgcgtatgtcccgcccggctgtcggtgtgcgcggcggcggcctcggcgagtgtgtaggacttctccaccgggatgtgcagtctgccgcgtgagatcagcgccgccgcctcggccagcgcgtccggcacgctccccgccacgccggagaaccggacgccgaactccggtgcgtccaggtccgcgatggtgaccaccctccgtgggtcaccggtcaggtcgaccagttcgccgaggacgcccgagcccgcgagatcgagcgcggcgtcgacgcggccgagcaggcgcacccgctcgacccagccctccccgtacgtcgtggcgagcgcgcccaggccgcggaggtactcctggttggcggcgcccgccgtgccgatgaccgcgataccccggtcgcgggcgatctgcagcaccgccgaaccgaccccgccggacgcgccgttgaccagcagtgtctgaccgggacggaccccgacctcgcggatgacgcgcagcgcggtctccaccacggacgggtagcccgccgcctcctcgaaggtcaggccctccggcatccgggcccaggccgacagcacggcgaattcggcgtacgtgtcggagccctcgccgaacacgtggtcgccgatcgccactccttcgacgccctcaccgacctcgtccaccactccggcggcgtcgaggcccactcctgacggcagttcgatgggatgggcacccaggacctggccttcgcggatgcgccagtcgacggggttcactccggcggcccgtacccggacgcgtatccggccggggcccgcgtggggcctttcggcatcgatgaggcgcagtacgtccgggccgccgaacgcggcgaagctcacttttttcatgctcctcgtgctcttcatggtccgaacgtaacactaaccgttagcttttactatcggttccatgtttgcatttgctagtgtcagcgcatgaacgagcccatcgggcgccgcgagcgcaagaaggccgcgacgcgacagaagatcgccgacaccgctctgcggctcttcctggaacgcgggtacgacgccgtgggcatccgcgaggtggcggccgaggcggatgtggccgtcaccacgctcttctcccacttcgcctcgaaggaagcgttggtcttcgagcaggatcagggcttcgagcagggccttgtccgggcggtcaccgaccggacgtcggacgagccgctgattcccgcgctgcgccgcgagatccatgccctggtacgccactgcgcggctcccggggccgcgccggtccggaacatgatcgagtcgtcgtcctccctgcgggagtacgaggagtcgatgcggctgcgccacgcggagtcgctggccgccgccatcgccgccgacctcggcgtaccggagacgtcgacggcctgccggaccatcgcgaggttcgcgatcgacgcctacgcgttggcccgcgaggcggccgatccgcaggccgcggtggacgagatcttccggatgatcgaggcggcctgggaggcctcccgcctcggctgagaagcgttcgaactcaggcgtccggccggggggtcccgccgcgagggccctgccagtccagacacagggcggtggcgtcgtccttcggtggccggccgccataggcgtcggccaccgcggcgaccaaggtgcggacgacctcgcgcgggtgctcggccgccgtccgcagcaggaggccgggcaggtcgaccgtctccgcttcgcgttcttgcataccgtcggtgaacagcacgagacggtcgccggggcgaaggtcgatgtcctgtacctgataggcgtcctgcggggggaagccgaagggcatgttgacggccaggcccagctcctcgaccgtgccctcgcgcaggcggagtggcccggggtgtccggcgttgaccatctgggcaccgcttccgtccagggcgatgcggagcaactggccggtggcgtaggtgtgacgcccgtggtcgagcagggcctgatgcatgtggcgggcctgttcggcgaggtccgctccggcgcggcgggcgccgcgggaggcgttcacgaccagggtggcggtgagggaagcgtcgacgtcgtggcccatggcatcggtgacggacagatgcagggtgtcgtggtcgaggctgtagtcgtaggtgtccccggcgatgtcggaggccggtaccagggctccggcgagggtgaactcggccgcctcgcaggagggggccgacgggaggagctgccgctggatctccgccgccaggctgaccgtcgtggtgcggtttccccagtggtagaggtcggtgaagcgacggtcggtgacgatgatgtacgccagcgcgtgcgcggcctcctcgacctgctccagcacgctctcggtcacgacgtcgaggtacagctccagcacgccgatggtgtcaccgcggttggtgaccggcgcgagcacgcgccgccccagccggccctcctccgccagtaccgtcttctgggcgcgcagaaccttgtcgtagatgccgctgcgggccagggggacccgctcggcccgtctctcggtccggtgcttccgggagacgccgtccgtgtcgttgacccgcagcagacggctgccgaccacgtcgacgaagaggaacgacacgtaccgcgcaccgaaccgggtgcgcagattgcgcgccacgacatcgatcgattccaccggggccgcgctctccgccgccgccagcacttcagccagtcccatccggtcacacgtcaccacagcctccaaaagttgagactgcttctgcccgccgacgcctatctcatggctccggtcgaggaatcctgtggtggcggcgtgcggttccggccggggtgcccggtcacaggtacgcctggaacgagccgagttcaccggcggtgttcagctccgcgagcagggccggtgcaccactccgccggtgacgatatgggccatatcgcaccataaagttgttagctttccctggttggccgatgaccgcatcgacaggggaacgccatgacgcacgtcgaacctgaggccgaggcgcgaccggcggtgaagctgactctcctgacgctcaccgcgatggtcgtcggctcgatggtgggcgccggggtgttctcgctgccgcgacgcttcgcacaggagaccggtgtcgcgggggcgctgatcgcctgggccgtcgccgggaccggcatgctgatgctcgccttcgtcttccagaccctcgccgtccgccggccggacctggacgccggggtctacgcgtacgcgaaagcgggattcggcgagtacctcggcttcttctccgccttcggctactgggccagcgcctgcgtcggcaacgtcacctactgggtgctcatcatgtcgaccgtcggcgcggtggcgccggcactgggcgacggcgacaccgtgacggcggtggtgatctcctcggccggactgtgggggttcttcctgctgatccgccggggcgtcaaggaagccgcggcgatcaaccggatcgtcaccgtggccaagatcgtgcccatcctcttcttcgtgatcctggcgctgttctacttcgacgcctcggtcttcgcggacaacttcggcggcgccgactacgcgggctccctcttcaaccaggtccgcggcacgatgctcgcgacggtcttcgtcttcctcggcgtcgaaggggccagcgtctactcgcgtcacgccaaacgccgcgaggacgtggggcgcgccaccgtcctcgggttcctcagcgtgttcgccgtcttcgcctccgtcacgatcgtcagttacggactgctgccgatggccgagatcgccgaactgcggcagccctcgatggccgaggtgctggagtcggcggtcggcacctggggcaaggtcttcgtcagcgtgggcctcgtcgtctccgtgctcggcgcctacctcgcctggacactgatggccgccgaagtcctgttcgtcgccgcgaaggacaaggacatgccccgcttcctgggacggtcgaccggggcggacgtgcccgaggccgcgctgctcatgaccacgtgcctgagtcaggtcgtgctggtcgtgacgctgttctccgacgacgccttcaacttcgccctcgacctgaccagcgcgctgagcctgatccccttcctgctggccgccgccttcgcggtgcggatcgcctggcggcccggccggtccgacgtggtggggcgcagtacccggcgcgagctggtgatcgccgtggtggccacgctctacaccgcgttcctgctgtacgcggcgggtccgaagttcgtcctcgtctccttcgtcctctacgccccggccaccttcctcttcgtcaagtcccgcagggaacagggccgcaggctcttctccccgggcgaggccgtcatctgcgcggtctcggtcgccggagccgtcgccggggtcgtggcgctggccatgggctggatcgaactctgagcgacccccgcacatcctcgctccgggccacccgccccccgcgcgttcccgttccgagcgaccccgcacgtcccctctgccgtcaccgagcgaaaggcccaccgtgaacagcaccacccccgcttccgccctcggcgtccactccgaggtgggacgtctgcgcaaggtcctggtctgcgcccccggactggcccaccggcggctgaccccgaccaactccggcgacctgctcttcgacgacgtgatgtgggtggagaacgcccagcgggaccacgccgacttcgtcgaccagctcaccgggcgcggcgtggaggtcgtcgaactgcacgaactgctcgccgccacggtggccgaacccgaggcccggacgtggctcctggaccggaagatcaccgccaacgaggtgggtctcggcctgatcgacgacacccgtgccttcctggagaccctgaccccgcagcacctcgcggagtacctgatcggcgggctcgccaccgccgacctccccgacgcgttccgctcggggtacgtggcgctcgcgcgcgagggggccggggcgcgggagtacctgatgccgccgctgcccaacaccctgtacacccgggacaccacctgctggctgtacggcggagtgacgctgaacccgctctactggtccgcccgccgtgacgagaccctgctgatgaaggcgatctacaccttccaccccgacttccggggcagcaccgtctggtggggcgaccccgagaaggactggggccaggccacgttcgaaggcggggacatcatgcccgtcggcaacggcgtcgtcctcatgggcatgagcgaacggacctcccgccaggccatcacccaggtcgcggccgccctgttcgagcacggtgcggccgagcacgtgatcgtcgccgggatgccgaaactgcgctcggcgatgcacctcgacacggtgttcaccttcgcggaccgggacatcgtgacgctgtacccgcgcatcatggacggcgtccgcgccttctcgctgcggccgtccgacctgccgcccggtatcgagatcaccgacgagggcagcacgccgttcaccgaggtcgtggcccgcgccctcggcctcccccagctgagggtgatcgagacgggcggcgacatctacgcctcggagcgccagcagtgggacagcggcaacaacgcggtggccctggaacccggcgtggtcttcacctacgaccgcaacacgcagacgaacgcgctgctgcgccgggccggggtggaggtcatcaccatcgtcggcgcggagctgggccggggccggggcggcgggcactgcatgacctgcccgctgatccgcgacgcggtgacgttctgaccgacgttctgaccgcgagggactcgacggggcggcggccggcagtgcagcccccagctcctcgcggcgatgacgcatgagccggcggctcctcgcaggggaagcggaaccccgcgcggccgtcaggccaccgtacgcggcagccgcaggctcagcc

SEQ ID NO: 2799 - DNA, 14012 bp, Unknown
  Kingdom: Bacteria, Phylum: Actinobacteria, Class: Actinobacteria, Order: Streptomycetales, Family: Streptomycetaceae, Genus: Streptomyces
cgcggagatcggcgacaccgcgtaccggcacggcgtccccgtgcaccggctcgccgacgagatcggcgacaccggacccgccgccccggcggaggccgggagcggggagcggggcgaatcggccgtcgctctgtccgagctgccacccccgatccgggtgcgccccgcgcgcggccccctgcgtccgctccggtacgaactgcggcgctctctgggcgtcaggacaacgaccatgatcatggcggccgttctggtggtgtcggccgcggtctccgtcctgctcgcgcgcacggacggcaccgcactgccccgggtgctcgccgcgtggcccgccctgttgccgctgcctcccgccgcgctcggtgcgggcctgctcggtgcgctgtccttcggggacgagttccgatatccggcgctcgccgccgctcgcggcaccgtgccccggcggctcggtctgctgctggccaagctcgccgtgaccgcgagcttcgcgctgctgctcgcgggcctcacggtggtgtgcggggcgcagagtctccggctcgtgtacggaccggacttgatcgagagcccctcgaacgcctttgctctcggcgcgagttgggccggtctgacggtcggctgcgcctgggcggggttgctggccgccggcgtcttccgggtggcaggagcgggcatcgccgcggtgctggccgttccggtgctggtcgtaccgctggtgcagaagttcttcgcggctccgtccgcgcgttcggtcgccggactcccgggccggctgcgtgaactgatcgggtggcagctgccgcagcaggcggaccactgggtcctggccgtcgcgcgggtggtggcgcagccggtcggcactgcactcgccctgtcgttgtcagccctgatctgcgcgtatctgttcaccagccttcggggaaaggcgcgttggtgatcaccgtcgttccgcgtcgaaggcagaggttcgcaactccctgagaaatgactgatttgcgggaatatggcgtcaattgcggggcgagcgccgatcaccctttcgtgtgcttttcaccaaagacctcaaggggtgggcgagccgcgccgacaaaggatgcgtgagtacccttgcgcacaccatgatgaccgccgcccgcaccgtcgattccggcctggccggctcgggcgaactcgaccgctatccctatacggaggcgcaggccggcgagcgtgctgcttcccgggcctggggcggttccgattccgagctgggacgggcgagccgacgggggtcggccagccggggacgcggtctccatggccaactcgtccagcagctcggccagatgatcgtttccggtgacctcggcgcggaccgccccctcgtacccgaggagatcggccagcggttcgaggtgtcccgcaccgtcgtacgcgaatccctgcgcgtcctcgaagccaaggggctggtcagcgcgcgccccaatgtgggcacgagggtccgcccggtcagcgactggaacctgctggatcccgacatcatcgaatggcgggccttcggtccgcagcgtgacgaccagcgccgtgagctggccgagctccgctggaccatcgaaccgctcgcggcccgcctcgcggccgggcacggccgggacgacattcagcagcggctcggcgacatggtggagatcatggggcacgcgatgggtcagggggacgcgatcaccttctcccgcgccgacgcggagttccacgccctgctgatccaggcggcgggcaatcggatgctcgaacacctttccggcatcgtctcggccgcccttcatgtctccggcggcccggtcaccggctgtgaccgtccgggtgaggcctcgctcgcgcaccacgcgcgcatcgccgacgccctggcctcgggcgacgccggggccgccgagacggccatgcgtcagctgctcgtcgtccaccccgacgtcgagcgcgtggttcccgcaccgcgcgagcactgaccggggcgcggtcgggtgtgtgggcccggtgccgccggaccacacgggtccggcggcataattgtggggggatggcacccttggcccatttcgtcgcgtatgaggtgtgactcgggccacgcggattggccgtaacactcctcgaagcagcgcgatgacttaagaggtgagcgtcgcggaaggaatacagcaacccttgggtgcgctgtgcagttctgaggccaaacccgcgccgtcggcgacatccccagtcgacggtcgtcggttccagccctctccagggcagggccggaagccgtttccatcgttccgagaggttgttcgtgtcggccagcacatcccgtacgctcccgccggagatcgccgagtccgagtctgtgatggcgctcatcgagcggggaaaggctgatgggcagatcgccggcgatgacgtgcgtcgggccttcgaggctgaccagattccgccaacccagtggaagaacgttctgcgcagcctcaaccagatcctcgaggaagagggtgtgacgctgatggtcagtgccgcggagtcgccgaagcgcgcccgcaagagcgtcgcagcgaagagcccggtcaagcgcaccgccaccaagaccgtcgcggcgaagaccaccgtgaccaggaccgtcgcggccaccgccgccccggcggtcgagagtgcggacgcggtggccgatgacgccgtcgcggccgctcccgccaagaaggcggcggccaagaagacagcggccaagaagaccgccgtgaagaagacggcggccaagaagacagcggcgaagaagtccggcaagcaggacgacgagctcctcgacggcgacgaggcagccgaggaagtcaaggccggcaagggcgaggaagaggagggcgagggcgagaacaagggcttcgtcctctccgacgacgacgaggacgacgcacctgcgcagcaggtcgccgtcgccggcgccaccgccgacccggtcaaggactatctgaagcagatcggcaaggttcccctcctcaacgccgagcaggaggtcgagctcgccaagcgcatcgaggccggtctcttcgccgaggacaagctggcgaacgccgacaagctcgccccgaagctcaagcgcgagctggagatcatcgccgaggacggccggcgggccaagaaccacctcctggaggccaacctccgtctggtggtctccctggccaagcgctacaccggtcgcggcatgctcttcctggacctgatccaggagggcaacctcggtctgatccgcgcggtcgagaagttcgactacaccaagggctacaagttctccacgtacgccacctggtggatccgtcaggcgatcacccgcgcgatggccgaccaggcccgcaccatccgtatcccggtgcacatggtcgaggtcatcaacaagctcgcgcgcgtgcagcgccagatgctccaggacctgggtcgcgagcccaccccggaggagctggccaaggaactcgacatgacccccgagaaggtcatcgaggtccagaagtacggtcgcgagccgatctccctccacaccccgctcggtgaggacggcgacagcgagttcggtgacctgatcgaggactccgaggccgtcgtcccggcggacgcggtcagcttcacgctcctccaggagcagctccactccgtgctcgacacgctctccgagcgtgaggccggcgtggtctcgatgcgcttcggtctcaccgacggccagccgaagacgctcgacgagatcggcaaggtctacggcgtgacgcgtgagcgcatccgtcagatcgagtcgaagacgatgtccaagcttcgtcacccgtcgcgttcgcaggttctgcgcgactacctcgactagatcgcggaagattcaccggccgagggcccggaacccccaggggatccgggccctccggcgtgtccacgggtgcgtacggtgaccggctggatcacgctgggtggaccgttaccgcctcagcgtcaggagcctccatgccccgttccgtcgtccgtgtcctgaccggggtgctcgccctgaccgtcgccgcggccgtgatgcccctcgcctcgccctccgcggcggtcgcggacagcatcatcgtcggcggacagcccgccccggtggcggacagcccctgggtcgtggcgttgtcgagccgggaccggttcggtggggcgcgctcgggccagttctgcggcggcgtcgccgtggctcccacgaagatcctgacggcggcccactgtctgagtgacgaggcgctcggtggaccggcggagcgggtgagggacctgctggtcatcgccggccgggaacggctgagcgactccggcggccaggagatcccggttcgggacatctgggtgaacccggcctacgacccggcttccaacgccggcgacctcgcggtgctgaccctgtcccgcgcgatgccgaagggcggtgtcatcccggcggccaggggtggggacaccgcctaccgggccgggaccgcggcggccgtctacgggtggggtgacacgacggggagcggcgcgtacgcctccgtgctccgctcagcgcgcgttcaggtcctaccggacagcgactgcgcgcgggcctacccgggcggccaggaggggacgtacaaggcctcggcgatgctctgtgcgggcgatccggcgggtggcagggatgcctgccagggcgacagcggcgggccgctggtggcccgtgggcggctcatcggcctggtgtcctggggcagcggctgcgggcgcgccggcagccccggggtgtacacacgggtctccgccgccctggaatgggcagcgggccgcatctgacccgcggcggggccgtgtgcgggcagtgactccgcagtgtgtccgtgcgcggtcctcgcggacgagaacgggcgactcccccgtgggggagccgcccgtcggccggtcatggaccggcccctggctcgtcgtggatgcgaggtatcagtgttgttcctcgtcggcggcagccgcctgcacggcggtgagccggtccgtctcatcctgtatttccgcggcgatcttcttgagttccggctcgaacttgcgcccgtggtgggcacagaagagcagttcaccgccactgatcaggacgacgcgcagatatgcctgggcgccgcaacggtcacagcggtctgctgcggtcagcgggctcgcgggggtcagaacagtagtcacgtcgcctcttctctagctcgacgagctgtcgtaccagggtcaacatccaaccaggccgaaaacgttcccgctcgtggcttttcttcgaaacttcttctcggtgtggctgtctgttgccggttggcggcgaatgtgccgtatgcggagcgctacggtttcgcattgcttgtcaggggtgggtcccgccggccggcttgccggtttgttcatgaggacgtgcccggagcctaaatggttcatgcgtcgaagggaacgtgatgtgcacgtcactccaacgaatgatcgaacactcatgcgagcctggatgaggctcgactagcatgaggattccccgagggtggcgttacaaccgctctaccaggcctctgtaggctctcagcggcaaccgaagcccagcccgatacccacgggggccccagatgaaattcagcgaggagcgaaccgcgtgaccgccgaaacgtccgtgccgtccaccgcgatgctgaccggagcaggcggcgaccgggacagttccaactacaccgcgcggcaccttctcgtcctcgaagggctggaggcggtccgcaagcgccccggcatgtacatcgggtccaccgacagccgtggcctgatgcactgcctctgggagatcatcgacaactccgtcgatgaagccctcggcggctactgcgaccagatcgaggtcatcctccacgacgacgcctccgtcgaggtccgggacaacggccgtggcatcccggtcgacgtcgagcccaagaccggcctctccggcatcgaggtcgtcatgaccaagctgcacgccggaggcaagttcggcggcggctcctacgccgcctcgggcggtctccacggcgtcggcgcctccgtggtcaacgccctctccgcccgcctggacgtcgaggtcgaccgcaacagcgcgacccactccatcagcttccggcgcggcgtccccggcatgttcaccgaacaggggccggacagtccgttcgacccggcgaacggcctgcgcaagggcaagcgcgtccccaagacccgtaccggtacccgggtgcggtactgggcggaccgccagatcttcctcaaggacgccaagctcaacctggacacgctctaccagcgcgcccgccagacggccttcctcgtccccggcctcacgatcatcgtccgcgacgagcgggggctggacggcgagggcaagaccgaagagacgttccgcttcgacggcggcatcagcgagttctgcgagtacctggcccaggacaaggccgtctgcgacgtccagcgcctcagcggcaccggcaccttcaaggagaccgtgcccgtcctcgacgaccgcggccacatgaccgccaccgaggtcacccgcgagctggccgtcgacatcgccctgcgctggggcaccggctacgacacgaccgtacggtcgttcgtgaacatcatcgccacccccaagggcggcacccacgtcagcgggttcgagcgctccctgaccaagaccgtgaacgaggcgctgcgctccgccaagatgctgcgggtcgccgaggacgacgtcgtcaaggacgacgccctcgaagggctcaccgccgtcgtcaccgtacggctcgccgagccgcagttcgaggggcagaccaaggaggtgctcggcacctccgcggccaaccggatcgtggcaggcgtcgtcgccaaggagctcaaggcctttctgacctcgacgaagcgggacgccaaggcccaggccaggtcggtgctggagaaggccgtggcggccgcccgcacccggatcgccgcccggcagcacaaggacgcccagcgccgcaagaccgcactggagtcctcctcgctgcccgccaaactcgccgactgccgcagcgacgacgtcgagcgcagcgagctgttcatcgtcgagggggactcggcgctcggcacggccaagctggcccggaacagcgagttccaggcgctgctgccgatccgcggaaagatcctcaacgtacagaagtcgtccgtctcggacatgctgaagaacgccgagtgcggcgcgatcatccaggtcataggagccgggtccgggcgcaccttcgacatcgacgccgcgcgttacgggaagatcgtcctgctggtggacgccgacgtcgacggcgcccacatccgctgcctgctgctgaccctcttccagcgctacatgcgcccgatggtcgaggcggggcgggtcttcgccgcggtcccgccgctgcaccggatcgagctggtccagcccaagaagggccaggacaagtacgtctacacctactccgacaacgagctgcgccagaccctcctggagttccagcgcaagaacgtccggatcaaggaatcgatccagcgctacaagggcctgggcgagatggacgccgatcagctggcggagacgacgatggacccgcgtcaccgcacgctgcggcgcatcaacatcggtgacctggactcctccgagcaggtcttcgacctgctgatgggtaacgaggtcgcaccccgcaaggagttcatcaccagctccgcggccaccctggaccgctcgcgcatcgacgcctgacccctgccccccttcccgggcacccgccggcccccgctcccgtacctccggagcgggggccgcgtacgtctccggccggagttccggagttccgaagtcccggggttcgcgcagccgtccgggacttctgtcacctgaaggggtgaagtcgggcgaatgacgcgcccgggatcttcccgaaccgcccatggttggccatgcggccgaaaaggtccggggatcaggggagttgtgcggtggagaaggaagcagggccggaggccgcgggagtgcggctcgacgacccgtgggacgacgtgccggtctccgaccggtgcggccaggacggaacgggaggcgtcgcgcacctcgacgcacccgccgcggcggagccggaccccgagcccagcgcggccgacatctacctggaggtgcaccgcagcgccgccttccgcgaggtgcgccgacgctaccgccgcttcgtggcacccgccgccctcgccttcctcctctggtatctcgcctatgtcgtcgccgcgaccaccgcgcccgggctgatggcccgcccggtcgccggagcggtcaacgtcgcgatggtggcgggtctcggccagttcctcacgaccttcctgctcacctgggcgtacgcacggcacgcgcggctgcgcagggaccgggccgcgctcgatctgcgctgggacacccaggagatgacgagagggctcggacgttgagaggcgaccaccagacactcgccctgctgctgttcagcgcgttcatcgcggtgacgctcttcatcaccacctggttcggccgccaccggcagggctccgccgaggagttctacgccggcggacgcctgttctcgcccatggagaacggattcgccatcgccggcgactacatgtcggcggcctcctttctcgggatctccgggctgatcgccctcttcggctacgacggcatgctctattcggtcggcttcctcgtcgcctggctggtcgtcctgctcttcgtcgccgaactcgtccgcaactgcggccggttcaccctggccgacgtggtcgccggacggatggcggagcgtccggtgcgtaccgccgtcggcacctcgtccgtcaccgtctgcgtgctctatctggtcgcccagatggtcggcgcgggcagcctggtggctctgctgctcggcggcacgagcgacgccgcccgctcctggacggtggtcggggtcggcgcgctcatggtgatctacgtgtcgttcggcggcatgcgcgccaccacctggatccagatcgtcaaggccgtcctgctgatggccggggccgtcgcgctcacggtgctcgtcctggtccacttccacgggaacatcaacaacctgctcaacaccgcggccgaacgcagcggccacggcaagcacttcctcgcgcccggcctccgttacggcggggacctcacctcacgcctcgacttcatcagcctgggcgtcgccctcgtcctcggcacggcggggctgccgcacatcctgtcgcgcttctacaccgtgcccaccgcccgcgccgcgcgccgctccgtcgtctggtccatcggcctgatcggcagtttctacctgatgacgatcgttctcgggttcggcgccgccgccctcgtcggctccgccgaggtccgcgcctcgaacgcggcggggaacaccgcggtcccgctgctggcgctcaacctcggcggtggcgaggggtccaccggcagaacgattctcttcgccgtggtcgccgccgtcgccttcgccaccatcctggccgtcgtcgcgggcatcacgctcgcctcgtccgcgtccgtcgcccacgacctctacgcctcgctccgtcgtcccggccgcaagaagtacggcgaggtcgccgtggcgcgtaccgccgccgcgggcatcggcgtggtcgcgatcggcctcggactgctcgcccaggacctcaacgtcgccttcctggtgggcctggccttcgccgtggccgcctcggcgaacctcccggccctgctctactcgctgttctggcgcggcttcaccacccggggcgcggtctgggcggtgtacggcggactgatcccggcggtcgtcctcgtgctggtctcgcccgtcgtctcgggcagtcccacctccctgttcccgggcgtcgacttccagctcttccccctggagaacccgggcctggtctccatcccgctcggcttcctggccggctggatcggtacggtcatctcgcccgagcagcccgacgaggccaagcacgccgaggccgaggtccgggccctgacgggggccggggcggcgtagagcgggctcctgggagggcgggagggccgggggcctctgtgccgtccaagcgtgatgccgtacggccctctgggcggctcagccggccgcccaggcgtaccggtgttccgggcggcccgtctccccgtagcgcagcgtcagccggaccttgccggtgcgttccagcagcttcaggtagcgctgggccgtctggcggctcatccccgcgctgtccgcgatctcctgggcggagagcgggccgtcggcgccgcgcagggcccctcggacgagctcggcagtggtgggggagtggcccttggggagggccggctcgtccgccgcccacagcgcgccgaagagccggtccacctgtgcctgctcggcctccccgcccccgtcgagggcccgtcgaagggccgcgtaggcctccagcttcgagcgcagccccgcgtacgtgaacggcttcaccaggtactggagcgcgccgtgccgcatcgcgtcctgcacggtggcgacgtcccgggcggccgtcaccatgatcacgtcgacctgacggccgaggcggcgcagttcccgtacgacggtgaggccgttgcggtcgggcaggtagtggtccagcaggatcaggtccaccggaaccttctcgaccgtctccagcgccgcggccgccgagtgggcctgcgcggccacccggaagccggggaccttggcgacgtacgccgcgttgatctgcgccacccggacgtcgtcgtccacgatcaggacctggatcacggctgttctcccgtcgtggccggatgcgtggagggtggcaaagcggcgggatcggcacctgcacgcggctccggctcggccagcgcctccgggagtacgaccgtgaacaccgcaccgcctccgtccgccccggacaccgtcacactgcctccctgacgctccgcgagcctccgtacgagggcgagcccgaggccgcgcctgccgtgtgccgggacgtccttggtggaccagccctccgtgaagatcgacgcgtactgctccggggggacgccggggccgctgtcgcgcacctccaggatcaccgtacgtccctccgtgcacagcccgacctcgatccgcgccccgtccgatccggccgccgcgtccgtggcgttgtcgacgaggttgcccatgacggtgaccaggccccgggggtcgaccacccggtccggcagcaaggtgccgggggcgagccgcagcgatacgccgcgctcggcggcgaccgtcgccttgcccaccaggagggcggccagcagcggatcctggaccttctccgtgacctgctcggccgtcgcccggtgcacgcccaccacctccgtgacgaactccatcgcgtcctcgtgcatctccagctccagcagtcccagcagggtgtgcagccggttcgcgtgctcgtggtcctgggcgcgcagggcgtcgatcagacccgtggtggagtcgagctcgcggcccaggtgctccagctcggtccggtcgcgcagggtcaccacggcaccgccgtcgtccgtgggcatccggttggccagcagcacccggctgccgcgtaccgccagcaggtcgtcgccgaccacccgcccggccagcacgtccgaggtcctgccgtcgcccagcacctcctccagcgtccggcccgccgcttccgggcccacgcccagcagccgttgggcctcgtcgttcagcagccggacgcggccggccccgtccagggcgacgaccccttcgcggatgccgtgcagcatggcctcgcgttccgtcaggagtgcggagatatcggagaacgccaggtcgtgggtctgccgctgcagtcggcgggagatgaggtacgcggcgagcgctccgaccgccagggctccgcccgcatatgcgagcaggcccgggatcgccccgaggagccgggcgcggacgctgtcgtaggcgatgcccaccgacaccgcgccgaccacgtcgccggacgggccgaacaacggcaccttgccccgcgcggagcggccgagggtgccgctgtcgatctccatcacctcgcggccgcgcagcgcctcgccggggtcggtcgagacgatcgcgccgatccggtgggtgtcggggtgcgaccagcgcaccccgcgctggttcatgacgacgacgtactccgcgccggtcgcgcgccttacccgttcggcggccgactggacgggaccccggtccgacgggtccgtgctggtcaggtccttcacgatccccggctgggcggcggtgctctgggcgatcgcgagggcgcggcgcatcgcctggtcgtcgagctggtcgccgaggggggccaggaacaggccggtgaccaggatcgtcacgccggtgatgatggtcagctgcatcagcaggacctgggagaagacccgctgtggccagccgaaccggcgaggtcccctgccgggtgtcggtggggcgttcatcgtagagacggtaagggccgggcggccggggtggaaattctgccgctttccggcgtccgtccaggcctcctccgtacgcaccccttgcttcgcggcgctgtgtctgtgagcgttccggaggagttcaccgtcaacgcaatctgcttgcacttcttgcgctaatcttgcgcgcatgacgcgacgacttgctcaagtggcccagaaggtgggagtcagcgaggcgacggtcagccgggtgctgaacggcaagccgggcgtctccgacgccaccaggcaggctgttctctccgcgctggacgtcctcgggtacgagcgcccgacccagctgcgcggcgaacgggcccggctggtggggctggtcctgcccgagctgcagaacccgatcttcccggcgttcgccgaggtggtcggcggcgccctcgcccagcaggggctgaccccggtgctctgcacccagaccaagggcggcgtctccgaggccgactacgtcgagctgctcctccagcagcaggtttccggcgtggtcttcgcgggcggcctctaccaccaggccgatgccccgcacgatcactacaaggtgctcgccgaccgcaagatcccggtcgtgctgatcaacgcggccatcgcccacctcggcttcccgggcgtctcctgcgacgactccgtcgccgtcgagcaggcctggcggcacctcgtctcgctcggtcacgagcgcatcggactcgtcctcggcccgtccgaccacgtgccctcgcagcgcaagctcgccgccgcccgggtgctcgccgaggaagcgggcacgaccgtgcccgacgagtgggtggcccgcgcgatgttctccctggagggcgggcaggccgccgcgatgcgactgctggaccgaggcgtcaccggcatcatctgtgcgagcgatccgctcgcgctgggcgccgtgcgcgccgcccgccgccgcggcctctcggtgcccggcgacgtgtcggtcgtcggctacgacgactcggccttcatgaactgcaccgagccgcccctgaccaccgtccgccagcccatcgaggccatggggcgcgcggccgtggagctgctctcggtgcagatcggcgggcggaccgtgccctcggacgagctgctcttcgagccggagctggtggtgcgcggatccaccgcgcagccgccgcgcgagaattccctgtgatccgtagctaatttgcgctgtccgggcctctggtccggacctagggggcctcctggaggccgggcaatggttgtggcggcctggggcccgtgtactgcccgctggggcggatgcggagcgggcgctccccgtactcctccagcgcgtgggcgatccagcccgcggtgcgggacaccgcgaacacggtctcgcccgcgtccgccggcatcccccgggagacggacaggacggccagggccaggtcgatgttggcgtgcagcggagcgtgccgcgccgtcgtgccgaccacctcgcgggccgccg

SEQ ID NO: 2800 - DNA, 5525 bp, Unknown
  Kingdom: Bacteria, Phylum: Actinobacteria, Class: Actinobacteria, Order: Streptomycetales, Family: Streptomycetaceae, Genus: Streptomyces
gccccacaccccggcccgttccgcaccacccggttcgttccccgcaccacctggcccgttttccggcaccacccaggcagacaacggcgtcttccaaccccaaggagtactcccgtggccatctcggtcttcgacctcttctcggtcggcatcggcccgtccagctcccacacggtgggcccgatgcgcgccgcccggatgttcgcgcgccgcctgaagaacgagggcctgctcgcgcacaccgcctcgatacgggccgagctgtacggttccctcggcgcgaccggccacgggcacggcacgcccaaggcggtcctgctcggcctggagggcgagtcgccccagaccgtggacgtggagtccgccgacggccgggtcgaggagatccgcggcagcggcaggatcaacctgctgggcatgcacgagatcccgttcgacttcgacaaggacctggtcctgcaccgccgcaaggcactcccctaccacgccaacggcatgacgatcctcgcgtacgacaccgagggcgcgcccgtcctggagaagacgtactactcggtcggcggcggcttcgtcgtcgacgaggacgcggtggccggggagaacccgatcgtcccggacgacaccgcgttgaaacacccgttccgcaccggcgacgaactgctgcggctctcccgggagaccggtctctcgatctcctcgatgatgctggagaacgagctggcctggcgcaccgaggcggagatccgctccggactgctggacatctggcgtgtcatgcaggcctgcgtctcgcgcggcatgtcccgcgagggcatcctccccggcggcctcaaggtccgccgccgcgccgcgaactcggcccgccagctgcgcgccgaaggcgacccgcaggcccacgcgatggagtggatcactctgtacgcgatggcggtcaacgaggagaacgcggcgggcggccgcgtcgtcaccgcccccaccaacggcgcggcgggcatcatccccgccgttctgcactactacatgaacttcgcggccggcggctgcaccgagaccgagaaggaggacagcgtcgtccgcttcctcctcgcggccggtgcgatcggcctgctgttcaaggagaacgcctcgatctccggcgccgaggtcggctgccagggcgaggtcggctctgcctgctcgatggcggccggcgccctggccgaggtcctcggcggctcccccgagcaggtggagaacgccgccgagatcggcatggagcacaacctgggcctgacctgcgacccggtcggcgggctcgtccagatcccctgcatcgagcgcaacggcatggcggcggtgaaggcggtgacggccgcgaagatggcgctgcgcggggacggcagccacaaggtctccctcgacaaggtcatcaagaccatgaaggagaccggggccgacatgagcgtcaagtacaaggagacggcgcggggcggactcgcggtgaacatcatcgagtgctgacggaaacggagcgggccccttacccgagcccccaccccggtgtccgcatcccgccggccgggccggttcaggcgggcagggtgggcggccagtccggggcgaggttctcggagaacaggggacgcagggcgccgaccgccgcgccgatgcaggtgtcacgcagctcggtgcgggtgcacgtctcacgcgtgagccagtccacgcacagcacctggacgaacaccagccatgccttcagtgccgcggagacggcggcgtgcgttctttcgtcgtcgagcgggagtacaccgagcaggcgtgaacgcagggcgtcgagctcgtccgtcatgatcgtctggatcacggggtcgcccgccagcacccggttcgcggccaggacggcgtggcggttggcgatgaagtagtcgaagtgggcgtccaggccctgggtgagctgctcgaccagcgtggctccggggtcgaactcggtcgcctccagcagccggtcggtcgcctgttggtagaccgccgcgaagagggcgtgcttgctcgggaagtgctggtagagcagtgcgcgggacacgccggcctgccgggcgacgtcctccatcagcacgtcgtcgtagggcgctgcggagaagagccgggtgccgacggcgagcagctgggcacggcggtcggcgggggtcaggcgtcggcggggcggcacgcacccagattactacttgacatgcgtctaccaaagcgggctaccctgaagctaagtagacatgcgtcaacttagtcgagggggagtcatggccaaggcgctccgggtgttcgcatgggtgatgggcgtcgcctgcacggcgatcgggctgttccacgtgggcggcggcaatgccgcgattccgggcgaggccgacgccggcccgaccctggacagcctgggccggttcttcggcgcgatcttcgccgggtacgggctcgcctggctgtgggcggcacggcaggaccccgtcccggcgaaggtggtgcggtggctcgcggcggtgttcctgctgggtggcgtgggacggctgctgtccctggcggtgcacgggtggccgcactcgttccgggtggcgctgaccgtgatcgagctggccctgccgccggtctggttctggctggcggacgccgacgagcgagcgtcccgggagcggcggcccgcaggtgcgcccgccgccgggccgtcccttccggatcccatgtgacccgcgccgccgggcaccgcacccgtcgcgccggagacacctcggtgcgactgctccccgcggagcagccgcaccgtccccggccgcgggacggccatggcacccccgcaacggcattccggctctcccgcaccggggttccacccccgcacggcccgctgcggtcccacaccgactgcgggcgagcatggagatcagccctgggggcaaggccggccgcggcgcggccgccccgcggtcagcagcaggtgagcgcggcgcgacgggaacaccccgcccgtggcgccgcccgcccccagggtgctacttcgccgcgtccagcgccgccagggcctgcgcccagccgacgtacttcaggtccgcgaggtcggccaccgtcgtgatgccgaacgcctcctccaggaggtcaccctgccggtccgagacccccttgagcgccgacaccggcgccgccagtacctcgggcacgctcttgtccgcccacgccttgtccagcaccttgcccaggtcgatcgaagccacgttcgtcccctcctcgtgccacgctccccacgaagcgcgcgcgtactgcgggagtcgcgcggacttccgcaccaccccgctcatctctacagacatgtagagcataggagaagggagcgggtccgagaggcagggagggaagatcggcccggggttgtccgaaagtccacgcagcgcccgcgacgggatcagtcggcgaccgcgagttcgggagcctcggccgggaggtcgcggacacccaggcgcaggtgctcgacgtgatagagcgcctggtcgaggagttcggcgacgtggttgtcgtagagggcgtagatgatcgagcggccgtggcgttcaccggtgacgaggccgagattgcgcagcaggcgcagctggtgggagcaggcggaggcttccatccccacggcgtcggcgaggtcgctcaccgagcaggggccttcctggagccgggcgaggatgtgcagccgggagggcgtggcgagggcctggagggtggcggcgacgtcggcggcgccgaccgcgtcgaggcgttcgcgggtggtggcgctgctcctggcgtctgctccgtggcccatatcgccatcatacgcgcgacacatgaagacctgttcaggtattcctgtatggtgagctcgttgcccgtcgtccacccgtgaagggttgatttgtcatgtcttctgtcgtggatcaacggcccgagccgatgaccgccggggctccgcgcccggtgccgccgaggcggcgtacgcgcctgttggccctgccggaggctcggtgggcgctggcttccctgctgctgttcctgctggcgctccccgtgtatctgctcggtgctccggcgtgggcgtggggcccgttgttcgccgccagctacgtcaccggcggctgggagccggggtgggagggcctcaaggccctgcgggacaagacgctggacgtggacctgctgatggtcgtggcggcactcggcgccgccgcgatcgggcaggtcctggacggcgctctgctgatcgtcatcttcgccacctccggcgccctggaggcggtcgcgaccgcacgcaccgccgattcggtacgcggcctgctcgatctcgcccccgacgtcgcgacccgactccgtgcggacgggtccgaggagacggtggacgccgaacacctggcggtgggggacgtcatcctggtgcgccccggtgaacgggtcggcgcggacggccacgtcctggacggggagagcgacgtcgatcaggccacgatcaccggtgagccgttgccggtggccaagcaggcgggggacgaggtgttcgccggcacggtgaacgggaccggcgctctgcgggtgcgcgtcgagcgggatccggcggactcggtgatcgcccggatcgtgaagatggtcgaggaggcctccgagaccaaggcgccgacccagctgttcatcgagaagatcgagcagcggtactcgatcggcatggtcatcgccaccctggccgtattctgcgtcccgctcgccttcggcgacgccctccagccggcactgctgcgcgcgatgacgttcatgatcgtcgcctcgccgtgcgcggtggtcctctccaccatgccgccgctgctgtccgcgatcgccaacgcgggccgccacggcgtgctcgcgaagtccgcggtcgtgatggagcgcctgggccaggtcgacgcggtggcactggacaagaccggcacgctgaccgagggcaccccacgcgtcaccgacgtcctccccctgccaggaccgggcctggacgaggaccggctgctggccctggcggggtcggccgagcaccccagcgagcatcccctcgcccgcgccgtcgtccgggccgcccggacacgcggcctcgtcctcgccgaggcgaccgggttcgcctcctcccccggagccggcgtcaccgcgaccgtcgacggacacaccatccggatcggatccccggcccgtctcctccccgaagggagcccggagctcgacgtcatggtccgctcgctcgaggacgagggtcgcaccgcggcactcgtcctccgtgacggcgtcccggtcggcgtactgggcatcgcggaccggctgcgcccggacgcggcggcgacggtggccgcgctcaccgaactggccggccgtaccccggtgttgctcaccggtgacaacgagcgcgccgcccgccgactggccgccgaggtcgggatcagcgacgtgcgggccgggctgctcccgcaggacaaggtcgctgccgtacgggcatgggaggccgagggcctgcgggtcctggt

SEQ ID NO: 2801 - DNA, 3110 bp, Unknown
  Kingdom: Bacteria, Phylum: Actinobacteria, Class: Actinobacteria, Order: Streptomycetales, Family: Streptomycetaceae, Genus: Streptomyces
ggagctgaccgtgatgccggtcgcggaggcggccgcctcggcgaccggcatcacggtcagctcctgctggtgctgatcgagcgtccgggccgcgtccagtccgtacggaccgacccgggtgcggcgcagcgctgtcaggtggccgccgacgccgagcccggctccgaggtcgcgggcgatggcccggatgtacgtccccgaggagcagacgacggagacgaccaggtcgaggacgggggtgccgtcctcggcgacggcttcgcggacgtcgtagacgcggaaggaggagacggtcaccggacgggccggaatctcgaactcctcgccgccgcgcacccgcgcgtaggaccgtttgccgtcgatcttgatggcgctgaccttggacgggacctgcatgatccggccggtcagcgccgccaccccggcgtcgatgccctcgcgggtcacgccggaggcgtcggtggacgaggtgatctcgccctcggcgtcgtcggtgaccgtgtcctggccgagccggatcgtgccgagatactccttctcggtcagggcgaggtggcccagcagcttggtggcccgctggaccccgagcaccaggacgccggtcgccatagggtccagcgtgccggcgtggccgacccgcctggtgcgggcgatgccgcgcatcttggcgacgacgtcgtgcgaagtgaagccggacggcttgtcgacgatgacaaggccgtccggcgtggtggtctgctcggtcatgcggaggccgggccctcgttcttctcggagggtccgtcggtcccgggctcgtcgtcctcgtcctcgggcttgcggtacgggtcggcctcgccggcgtacttcgcgcccgtggacacctggcgcacctccgcgtccttggcccgcgccttgtcgaggaggtcctcgatggtgcgggcgttgtccgggagggcgtccgggacgaaggccaggctcggcgtgaacctgaccccggtctgccggccgacctcggtgcggaggacgcccttggcgctctccagcgccgcggcggaggccgcgcgctcctcgtcgtcgccgtagaccgtgtagaagaccgtggcctcccgcaggtcgccggtgacccgggcgtccgtgatcgtcacgaatcccagccgcggatccttgattcgccggtccagggtctccgcgaccacgacctggatgcgatcggccagcttgcgggcccgcgcgttgtcggtcaccggtccgtcactcttccttctgatttcgctcgactgtcagtcttcgtcactgtgcagccgccgtctcaccgacagcagctccacctcggggcgtcccgcgaccagccgttcgcagcggtccagtacgtccgtgaggtgtccggtgtcaccggagaccacggcaaggccgatctcggccctgcggtggagattctgtccgccggtctcggccgcgctcaccgcgtacttgcgctggagctcggcgacgatcgggcggacgacggaacgcttctccttcaacgaccgtacgtcgccgaggagcagatcgaaggacagggtccccacatacatgtgtgtccggatgtcccgccggttcgggttcgtgccccgccagagcttgccggggacatcagaaccgtaccggaacggccggagccgatcgacggaaatacgacccgtcgaccggccccgaccctggtggaggggggccgggagcgaactcccggaccccttccgaattccctgcggatccttgcggatccgaggttgatcagcctcgcggcttctcgcgcatctcgtacgtcgcgatgacgtcgtcgatcttgatgtcgttgaagtttccgaggttgataccgccctcgtagccttcgcggatctcggtgacgtcgtccttgaagcggcgcagaccggagatgttgaggctctccgcgatgaccttgccatcgcgcagcaggcgcgccttggtgttgcgcttgacctcgccggagcggaccagcacaccggcgatgttgcccagcttggacgagcggaagatctcgcggatctccgccgtaccgagctcgacctcttcgtactccggcttgagcatgcccttgagggccgcttcgatctcttcgatcgcctggtagatgaccgagtagtaccggacgtccacaccctcgcgctcggccatctgctcggcacgccctgcggcgcgcacgttgaagccgatcacgatggcgtcggagccggtcgccaggttgatgtccgactcggtgaccgcacccacaccgcggtgcaggatccggatgtccacctcttcaccgacgtcgagctggagcagcgaggactcgagagcctccaccgaaccggacgcgtcgcccttgatgatgaggttgagctcctggaccagaccggccttgagcgcctcgtccaggttctccagggagaaccggacacccttgcgggcgaagttggcgttgcgctcacgagcggcacgcttctcggcgatctgacgggccgtacggtcctcgtcgaccaccaggaggttgtcgccggcacccgggacgttggtgagacccaggaccaggacgggggtcgacggacccgcttcctggacgttctgaccgttgtcgtcgagcattgcccggacccggccgtacgcgtcgcccacgaccaccgtgtcaccgatgcgcagcgttccgcgctggaccaggacggtcgagacggcaccgcgaccgcggtcgaggtgggactcgatcgcaataccctgcgcgtcctgctccgggttggcccgcaggtcgagcgaggcgtcggcggtgaggacgacggcctccagaagcgcctcgatgttgaggccctgcttggcggagatgtcgacgaacatcgtgtcgccgccgtactcctcggccaccagaccgaactcggtgagctgaccgcgcaccttggtcgggtcggcgccctcgacgtcgatcttgttgaccgcgaccacgatcggcacctcggccgccttggcgtggttcagcgcctcgatcgtctggggcatcacaccgtcgttcgccgccaccacgaggatcgcgatgtcggtggacttcgcaccgcgtgcacgcatggcggtgaacgcctcgtgacccggggtgtcgatga

SEQ ID NO: 2802 - DNA, 8702 bp, Unknown
  Kingdom: Bacteria, Phylum: Actinobacteria, Class: Actinobacteria, Order: Streptomycetales, Family: Streptomycetaceae, Genus: Streptomyces
cggcctcggcgacgaggtcctcggactggttgtagtcgccgtccgcggcctgcacggcccagaggtggacggcgaccccgtgttccttggcggacatcaggccgggcagcagatcgccgtcaccggtcaccagtaccacgtccgagcaggcccggttcctggccagttcggtcagctcggcgtgcatggcggcgtcgacgcccttctgcgcccagcgtccgtcgctgcgggtcagggcgccgagccggacggtcacgcggggcatcacgcggagccggcggtgttcgggctggggtacccggtcgggggcgccgtcgaaccagtagatacgcagcaggggctgttgggtatcggcctcggcgcgctcgcgcagtccctggatgagggccgcgtggtcgacggtgatgcgggaacgggcgggctctccggccagcagactcgcggctgcgcccagcaagtagccggcgtccaccaggacgacgcaacggtccacgcgttccaccctcttccgaattcgggaacggttcagcggcccgctcctcgatgaccgggtccgcttacccagggtttccttcgagtctgcccgaccgcgcaggggttaacggccggaactggatcatcggcgtggcggatccggaaaggaagaggggaggccgggagaagggaagcgagaagacgcggaaaggccgggcggaggcggcggaacgggacctcactgcggaaaccactacgcacggtaatgatccaacatgcggtgtttgcggcgctatgtgaatctgacagcggtcctggccccccaggattccccacaggaggcattcaccatggccaagaacaagaaccgcaagcagggcagccagcacgaccgcgcgtccgcgtcggagcgtagcgcggaggaggccaagtcgacggcgtacgagtcgcagaaccagccgcaggcgcaggcccagggcagcccgtccgacgtggcgcgcaagcatcagcgacgcttcggccacaactgacccgtcggccgctcgcggtagtgacaggcgttgaagaagcgagaggggcgtcccgcatctgcgggacgcccctcctgccgttctcgtcgtcggcgcggttcagtcggccgccgcgtgctcagccggccaggcaggccgggccgagcagcaccttcagatcgccgaagagcgccgaatcggccttcacccggtgccggtcgagccggagcaccgtggtcttgcgggggccctggagcttgatgcgcacctcggtgtcgccccggtggtggctgagcacctcgccgagccgggtgaccatgggcggggtgatcttcacggtggggatggtgaggacgacgggcgcgttggtcccggcgttggagatgtccgggacctgcatctccatggcgaccagccggggcacgtcctcgcgcttgtccaggcgccccttcacgaagacgacggtgtcctcgacgagctgggtggagaccagctggtaggtggcggggaagaacatgcactcgatggagcccgccaggtcctccacggtggcgatggcccaggcgttgccctgcttggtcatcttgcgctggaggccggagatgatgccgccgacggtgacgatggcaccgtcgccgtagtccccgctcatgagctgggagatcgaggagtcggccttgtcggacagcacgtgctccaggccgaacagcgggtggtcggagacgtacaggccaagcatttcccgctcctgggcgagcaggtaggccttctcccactcgacgtcggagaactccacgtcgagcccgaagcccggctcgtcgctctcctcctcacccatgccgccgaagaggtcgaactgcccctcggcctccttgcgcttgacctgcaccacgttgtcgatcatcggctcgtggtgggcgacgaggcccttgcgggtgtgtcccatctcgtcgaacgcgccggccttgatgagcgattccacggtgcgcttgttgcagacgaccgcctcgaccttgtccaggaagtcggggaagctgctgtacttccccttcgccttgcgggaccggatgatcgagtcgacgacgttctggccgacgttgcggatggcggtcaggccgaagaggatcacgtcgtcgccctgggcggcgaagttggacaacgactcgttgacgttgggcgggagcaccttgatgcccatgcggcggcactcgttgaggtagaccgcggacttgtccttgtcgtccttgaccgaggtcagcagcgcggccatgtactcggcggggtagttcgccttgaggtatccggtccagtaggtgaccagcccgtacgcggaggagtgcgccttgttgaaggcgtacccggcgaacgggaccagcacgtcccacagcgccttgatcgcggcgtcggagaagccgttcttcttggcgccggcctcgaagaggacgaagttcttcgccagttcctcgggcttcttcttgcccatcacgcggcgcaggatgtcggcctcgcccagggagtacccggcgacgatctgggcggccttctggacctgctcctggtagacgatcaggccgtaggtgaggccgaggacctccttgaggggttcctccagctccgggtggatcggggtgatctcctggcggccgttcttgcgctccgcgtagttcgtgtgcgagttcatgcccatcggacccggccggtagagggccgagacggcggagatgtcctcgaagttgtcgggctgcatctggcgcagcagggagcgcatcggcccgccgtcgaactggaagacgccgagcgtgtcgccgcggcagagcagttcgtacgtcttggggtcgtccagcgggagggagagcatctccaggtcgacgcccttgttggacttcaccatcttgatggcgtcgtccatgatcgtcaggttgcgcaggccgaggaagtccatcttcagcaggccgagcgactcgcactgcgggtagtcccactgcgtgatggtgacaccgtcggtgtgccggacccagacgggggcgtggtcgacgatcggctcgctggacatgatgacgccggcggcgtgcacgcccatctgccggaccaggccctcgacgcccttggcggtgtcgatgaccttcttgacgtccggttcgctctcgtacatcgcccggatctcgcccgcctcgctgtagcgcgggtgcttggggtcggtgatgccgttgaggtcgatgcccttgccgaggacgtcggcgggcatggccttggtgagccggtcgcccatcgcgtacgggtagccgaggacgcgggcggagtccttgatggcgttcttggccttgatcttgccgtaggtgccgatcatggcgaccttgtcggcgccgtacttctcggtcacgtaccggatcacctcgacgcgcctgcgctcgtcgaagtcgatgtcgacgtcgggcatggagacgcgctcggggttgaggaaccgctcgaagatcagcccgtgctcgatcgggtcgaggtcggtgatgcccatcgcgtacgagacgatcgatccggcggcggaaccacggccggggcccaccgcgatgccgttgttcttggcccacatgatgaagtcggcgacgaccaggaagtaccccgggaaccccatctggatgatgatgtccatctcgtactcgacctgcttctgccggtcgtcggggacgccgttcgggaagcggcgggccatgccggcccggacctcctcctggaaccaggtgacctccgtgaagccgtccgggatctcgaacttcggcatgaggttcttcgcctcgaacatgccggtggtgtcgatctgctgggcgaccaggagcgtgttggcgcagccctgctgccaggcgtcggaggagtcgacggcgtacatctcgtccgtcgtcttgaggtagtaaccggtgccgtcgaagcggaagcggtcggggtccgagaggttcttgccggtctggatgcagagcagggcgtcgtgggcggtggcctcgtgggcgtacgtgtagtgggagtcgttcgtcacgagcggcgggatgtcgagcttcctgccgatctccagcagcccgtcgcggacccggcgctcgatctcgatgccgtggtccatcagctccaggaagtacttgtccgccccgaagatgtccttgtagtcggaggccgcctggaccgcttcgtcgaactggccgagccggagccgggtctgcacctcgcccgaggggcagccggtggaggcgatcaggccttcggaccactgggagatggtctccttgtccatccggggccacttctggagccagccctcggcgtacgcgtcggaggagagccggaagaggttgtgcagtccggtcttgttggacgcccagatcgtcttgtgggtgtaaccaccggatccggacacatcgtcgcgcttctggtgcggctgtccccactgcaccttgcgcttgtgtttgcgcgactccggggcgacatacgcctcgatgccgatgatcggcgtgacgcccgccttcgtcgccgagtggaagaagtcgtaggccccgtggaggttgccgtggtcggtcatcgcgatgtgcgacatgcccatctcgttacaggcctcgaacatgtccttgagccgcgccgcaccgtccagcagcgagtactgggtgtgaacgtgcaggtgcgtgaagggcggcttggtcacggcgtcgggcctccgggatgtcgggcgatgacggacggggggacagcgtggaagtctacgacgtgacggagtcgaacgacgggcactcccggcttccgccgagcgttggagaaggcgggacacgtgcccgttttgtcatgcactcggtcatggctcgatcacgcgggcccacggttcggccagacacggcagctacagcaggaggcagcaagaaatgtcggaaacgcagaccggcgcggcgcagcgcggggagcagattctcgccgttttcgacaccgccttcggggagctgctggccgccgatccggccgccttccgggtcaagttccgcaagatggcgggctcggccttcgccttctaccggggcacggcctgcctgttctacggcgacctggagcgggagcggcacggcggcccgttcctggacgagcgcaccggccgggtgtggatccacggcgatctgcacgcggagaatttcggcacgtacatggacgccaacggccgcctcgtcttcaacgtcaacgacttcgacgaggcgtacgtgggccccttcacctgggacctgaagcgcttcgccgcctccgtggcgctgatcggctacgcgaaggcgctggccgacgagcagatcagcgagctggtgacgatcttcgccgtctcctaccgcgagcggatccgcgcgctggccacgggcgcgaagaacgacgaggtgccgcccttcaccctggacaccgcggacggcccgctgctgggcgcgctgcgcgccgcccggtcgcgcacgcgtttctcgctgctggactcgatgacggtgatccgggacttcgagcgccggttcgcggacggcggcgggtcgatcgacctggacgccgcgacgcgctacaaggtgctggcggcgttcgacggctatctggagacgctgccggagtcgagcctgacccgtcccgactcctaccgggtcaaggacgtggtgggccgccggggcatcggcatcgggtccgccgggctgccctcgtacaacatccttctggagggcaacagcgacgccctggagaacgatgtggtgatctacctcaagcaggcgcagaccccggcggtctcccggcacatcacggacgccgccgtgcgggagtacttccagcacgaggggcaccgcacggtgatctcgcagcgcgcgctccaggcgcacgcggacccgtggctgggctggaccgagctggacggctcgggtcagctggtagccgaggtctctccgtacgcggtcgacctcgactggaccgacatcgacgaggtggacgagatcgcggcggtcgtcgcggatctcggccgggcgacggccacgatgcactcggccgccgacgacgagagcgggcactcgctggtgccgttctccaccgagcgggcgatcgacgcggccatcgcggccgacgaggagaaattcctcgaccgctccctgacccgcttcctctactcgaccgaaagccagatcttcggctgagcaccgctgtccgcgccgacacgctccggggaacccgacgatcagccggacaacgcggtagtggtccgacacgctcgacaactcgccgaggagacctacccgccggccgcggccggcctccggcacgggtgggagcacttcgaggagtccgacgcggcggagcgggaaggccgcgcgagttccgccccgcctcccgggtgggtcaggccaccggtgcgtagcggacgacggtgtcctcgcagggtccctccgcgtacaccttcagcgcttccagttcgcggtcgtccgcggtgagctgccagcggagcttggtcgacacccactccccggtgtaccggcactggacctccggggacggcggcatccagtccgccgggtcgtgatccgacttccgccggttggtgcgcgacgtcaccgcgaccagggagacgtccgacgcctggtcgttggcataggcctcccgccgcccggcggtccacgcggacgcgccggaatcccaggcctcaccgagcgcgaccgtgtgggcgacgtccagggacccggcggcggtgacctcctgaccgtcgtagtaggacgtccacctgccgccggtcagcttgcagccggtccccacggtcggtgggacgaccgcttcggccaggaggacctcggcgccggtgtcgcacccgtccgtcgtgtcctcccccgcggtccagtgccggaaggcggcacgggtgtagccggcgcggtcctcctcggtcactttcagcaggcctaccgcgtcggccagggtcgtcacctccgccgccggagcggcctgcgccgcctgcgtgttctgcgcggcggaaggcgggagaaggggtacgagggcgagggagagtgcgccgagaccgcgcatcaggttcttgatcaccagcgcgttctaccggccgcgccccgccccgcgcagcccgtacgtccgtgctcacccgcccgggccggcgaattcaccggaggaacgcttccgcaccccgtcctccccgtcacgcgtacaccggccgcgcctaccggatggcgacgtagtccccgctcgacgacctcgggccggaggtggagttgccgtagtacgtccaccgccacgtccccggcccggtggccttcaccgtggtcttgagggctcccgtgctgctcgacgtcgccttcttcaccgtcttgtacgagggggagcccgccgccttgaactggaggctcaccgagcggcccccgtacccctggtacgtgtgggtgtcccagttcgcccggctgacctttccggtcacggtgatcgtctttcccttcacgaccggctcgggcgaggcgttgaccgtgacgcgcgtggcccgcttgacctgcagggggaggttctcgtcgtcaacgtcctgggagtccttggggaggaagagccgcgcggcggtcccccaggtgccggcgtcctcgtttccgaagtcgacgtggcgcgggtcgatgtacagccattcctcgaagtcgcaactgcccttggccttgttcacgaccttgcagtcgctggtgatgatggagttccacagggtgtccatgttgctcagctttccccggtaggggaacaccgtcggcccggacttgtgcttgagcgtggtcgtcatccggaaggtcgcgtacacctcgacctcttccttgacgccgatcacgatcggcttcccgccgttcaccgtgacccggctgaaggcgaccccgccctccgccgccccggccacgaacaggtacggcttccgccacgccgggctctgcacggccatgctgccggaacgctcggcgaggtaggagtccggagccggaaggccccggtgagccccggtgaagtcgcgtcccgcgggggtccggtccgcgtcacgcaactgggtctcctcggcgagggcgtcccgccgggtctcgatctgccggtcgacgaagtacccggcgaggtcgtcggcggtcgccagatcgtccgacgaggcctccagcgccagcgctccgaggtccaggacgtcctggttgctcacccgggcccggagcggcaggtgcaggacgtgccggacgaggtcggccagcccggcgcgggtcggacggccggccgccgcctcctcgaccagctcgtagagggcttgggaggtctcctggagccgggcccgcggagccttgttccactgcggtccgaacagggccgtcagccactccgggtccgcccagatcggggtgtcctcctcggagtcggagtcggttgcgctgtcggacccggtgtcggtgcggatgccggtgttctcgtgtggctgcggcagggggtggggccggggctccgcgccggacagcgtgctgagttcgtacgcctcttcctccccggacagccctggaagatcgccgtccgcgggcgccttcggtgtttccggggccttcggctccgggaccaggggctttgaggtctccggcgtcggtgtcggcgccttcggcttcggtgccggcattttcggcttcggtgccggggccggagtccgcaggagcagcggcacgaagtccccgccccggcggcggagtcgaa

SEQ ID NO: 2803 - DNA, 5657 bp, Unknown
  Kingdom: Bacteria, Phylum: Actinobacteria, Class: Actinobacteria, Order: Streptomycetales, Family: Streptomycetaceae, Genus: Streptomyces
tctggaagcgggtgacggccccggcctcgatgcggtcggggccgtcacccgcttccagaactgggccgcgacccggtacggcgccccggccgagggcgggtacgcggccctgcaccgctggtccgtcgacgagctcgacaccttctggcaggccgtcgccgagtggttcgacatccgcttctccaccccgtacgagagcgtcctcggcgaccgcgcgatgcccggcgccacctggttccccggcgccaccctcaactacgccgaacacgccctgcgcaccgcggaggacccggcccgcgccgacacccccgccctgctgtacgtcgacgagacccacacccagctccccgtcagctgggccgaactccgccgccaggtcggcgcgctcgccgccgaactccgcgccctcggcgtcacccccggcgaccgcgtcagcggctacctccccaacatcccgcaggccgtcgtcgccttcctcgccaccgcggccgtcggcggcgtctggacctcctgcgcccccgacttcggcgcccgcagcgtcctcgaccggttccagcagatcgaacccgtcgtcctgttcaccgtcgacggctaccgctacggcggcaaggagcacgaccgcaccgaaaccgtcgccgaactgcgccgcgaactgcccaccctgcgcgccgtcgtccacatcccgctgctgggcaccgacgcccccgaaggcgccctcgcctggaccgccctcacctcggccgccaccgagccggtcttcgaacaggtccccttcgagcacccgctctgggtcctctactcctccggcaccaccggcctgcccaaggccatcgtccagtcccagggcggcatcctgctcgaacacttcaagcagatcggcctccactgcgacctcggacccgaggaccgcttcttctggtacacctccaccggctggatgatgtggaacttcctcgtctccggcctcctcaccggcaccaccgtcgtcctgtacgacggcagccccggctatccggacgtcagcgcccagtggcgggtcgccgaacagaccggcgccaccctcttcggaacctccgccgcgtacgtcatggcctgccgcaaggccgacatccaccccggccgcgacttcgacctctcccgcgtccagtgcgtcgccaccaccggctccccgctcccgcccgacggcttccgctggctccacgacgaggtggccggagacctctggatcgcctccatcagcggcggcaccgacgtctgcagctgcttcgccggagccgtccccaccctccccgtccacatcggcgaactccaggccccctgcctcggtaccgacctccaggcctgggacccggccggcaggcccctcaccggcgaggtcggcgaactcgtcgtcaccaacccgctcccgtccatgccgatccgcttctggaacgaccccgacggcagccgctaccacgacagctacttcgacatgtaccccggcgtctggcggcacggggactggatcaccctcaccgaccacggctccgtgatcatccacggccgctccgactccaccctgaaccgccagggcgtccgcatgggatccgccgacatctacgaggccgtcgaacggcttcccgagattcgcgaatccctcgtcatcggcctcgaagaacccgacggcggctactggatgccgctcttcgtccacctcgccgacggcgcgaccctcgacgacgacctgcgcgcggcgatcaagcacaccatccgcgagaacctctccccgcgccacgtaccggacgaggtcatcgaggtccccgccatcccgcacaccctcaccggcaagcgcatcgaggttccggtcaagcgcctcctccagggaaccgagctggccaaggcggtcaacccgggctccgtcgacaacctcgacctcctccacttctacgccgaactggccgcgagccgacgccggtaggccacttgtcagtccccctgattacgctgagtgagcaaggattcaccgcgcacagggggagacacatggcgcagaccggtcgcaccgagaacagcaccacccaccacacgaagcacagcaccaccatgcgacgcacgctccgccgcgaagcacccagcacgatcggcctcctcgccgacgcacaggacttcgcggccatgcggcgctaccgcaccttcgccttcgacgaccacaccgtctatctccagcaggtcgagggcctgctcaaagcgctcgcggcccaaggcgtgcacaccaccgtcgccctcttcgacccggaggactaccgggagttctgcgccgaatcgggcctcgacgccgacaccgggaccagccgcagccgcttcaccgcggagatcgccgccgccggagccacggtcgcctacaccggccaacgcctgagcgacctcatccccgtcctcgtctcccgcgcggtccgccaggccacctgggagtacgccaccctcctcctcgccgacctcggcacctgcgccgactgcggtcaggacatcggccgcgcggccttcgaccgcgcctcgcacctcctcatgcggctgctggaaacggcgggaccgggcacccaccacctcgtgtgcagcaccccgacggagaacgaccagctcctggccgttctccacacccaccgcgacaccgcgggaccggcccgcctcgacggcgcggagggcgcggagttcgccaccgtcctcgccgtggccatcgccctggaatcacgcgggggagtggtcctgcgcaccagcgctccagacagcccggaccgcgtccacggctggcgcctggcccacggagccctcgccccgctcaccgcgggcgaggtcttcaacgcctactgcaccgacgcggacaccggagagcccgtctccccggaatccggcgtggagtactgcgcgggattcgacatcggagcagacccggcggagccccaccactgacacgccgcggccacacaacaggaggggcttcccgccccacggcggaaagcccctcctggacctactggatccgcctactcgccggacagcacggcctgagcggcgctgcgcgcctcgtcggccgagtccgccgcacgagcggcgttcgccgcccgctcgcactgcgccagcgtgtacttggccagcgtggcccgcacatagggaatggacgcggagcccatcgacagggaggtgacacccagacccgtcagcacacacgccagcagcggatccgccgccgcctcaccgcacacaccacagctcttgccctcggcacgcgcggcgtcggcggacagcgccaccagatccagcagcgccggctgccacgggtcctggagccgcgacaccgcgcccacctgacggtcggccgcgaaggtgtactgcgccaggtcgttggtgcccagcgacaggaactccacctcctggaggatcgaccgcgcccgcagggcggcggacggaatctccaccatcgcaccgaacttcgcccgcagcccggcctcgcggcacgcgtccgcgaacgccttggcgtcgatacggtcggccaccatgggggccatgacctccaggtacaccggcagaccctcggcggccttcgccagcgcggtcaactgggtacgcagcacctcggggtggtccagcaggctccgcagcccacggacgccgagcgccgggttcggctcgtcggccggcgtcaggaagtccagcggcttgtcggcgccggcgtccagcacgcgcacgacgacacgcccctcggggaacgcctccagcaccgcgcggtaggccgcgatctgcttctcctcggaaggagcctgcttgctgtcgtccaggaacaggaactcggtccggaacagcccgacgccctcagcccccgcctcgaccgccgcgggcacatcgcccggaccgccgacattggcgagcagcggcaccttgtgcccgtccgacgtggcaccgggaccggtggaggcggacagcgccgccttacgagcggcggcagcactctccagctcggcgcgcttctcgtcgctcgggtcgacgaagatctcgcccgtgctgccgtccaccgcgacgaccgtgccttcggccagctcaccggcgccgggcagcgccaccacggcgggaacaccgagcgcccgcgccaggatcgcgctgtggctggtcggcccgccctcctcggtgacgaagccgagcaccagcgtcgggtcgaggagcgcggtgtcggccggcgcgaggtcgcgcgcgatcagcacatacggctcgtcgctgtccggcacgccgggcatcggcacaccgagcagccgcgccacgatccggttccgtacgtcgtcgaggtccgcgacccgccccgccaggtactccccggcattggcgagcaacgcccggtacgcggcgaacgcgtcgtacaccgcacgctcggcggtgctgcccacggcgatgcgccgatcgacgtcggacatcagctccgggtcctgcgccatcatcgcctgcgcctcgagcacgtgctgtgcctcgccgccggccaggttgccgcgcgcgatcagatcggcggcgaccgcttccaccgcctgcctggcgcgcccctgttcgcgaccggcctcctcggcgggaatcgatttggcgggcggctccagcaccgccgtacccatgtgccgaacctcgccgatggccacaccgtggctcacgccgacgcctcgcagcgttgtctccatttcacccgtctccggttgtgcggcgacagagtcaccgcggtggttgtgcaactggcttgtcactgcgcccgaggcgtcactgccagccgaacagcgggtcgccgatcttcacgtccccgtcctcacggacatcggagagcgactcggcggtggcctccagtgcaacgatcgggcagatgggggatttgccggcggcctcgacggcgaccgggtcccagcgcacgatgccctggccccgggtcacggtgtcccccttgttcacgagaagctcgaagccctcgccgttgagctggacggtgtcgatgccgaggtgcgtcaggaccccgtgcccttccgcgtcgacgacgacgaacgcgtgggggtgcagggagacgacgatgccgtcgaccggggacacggcctcggagggctcacgcacggggtcgatggcggtgccgggaccgaccatcgcgcccgagaagaccgggtcgggaaccgcggcgagtccgatggcgcgtccagcaagaggggacgtcacgttggtcatggggagcctcccagggggtggagattcaggtgtcgccgccgcgactgatgggggacggcgtactgctcagcagagtaagtcatatgaagtcccggttccgcccgagacctaccgcttggcggacctaggggtgcaccagaaacgatttgcctcgactcccggcggcctgtactgtcgtactcctgcctgaccccaacgcgactttgagtcgggggtcggcggcgaccttcaagcccagatcctaacctcgaaccctccttcggcatgcccgtaggccgtggtcagggagacggaaaaggcctgatagagtcggactcgccgaaagggaaaacgcgaaagcgaattacctggaagcgaaatgcgagacccacttcgaccgggaatcggacacgaaagagtctgatagagtcggaaacgcaagacagcaggacaaagaagaa

SEQ ID NO: 2804 - DNA, 1134 bp, Unknown
  Kingdom: Bacteria, Phylum: Actinobacteria, Class: Actinobacteria, Order: Streptomycetales, Family: Streptomycetaceae, Genus: Streptomyces
  misc_feature (236)..(237): n is a, c, g, or t
gccctcggcccaggtctgcccggaggcgaggaggacgacggtcgcgccggccgcgccgaggagcagaccggccgcgagactgcggcggctccctgcggagtcgggcgcggcgccggacgcggagtcggcggttcgggcacggggctggggtacggggacagcactcacgccctccactatcccctaccggttcagcggtcgtggagccggttggccgtatggacggcgcggagcanntgctccgcgccgtccatacgtatggacggcgcggagcacggccgccgccttgttgcggcactcggtgtcctcggcgaccgggtcggaatcggcgacgaccccggctccggcctggacgtacgcggtgccgtcacggagcagcgcggtccggatggcgatggcggtgtcggagtccccggcgaagtcgaggtagccgacgcagcccccgtacagtccgcggcggctcggctccagctcctcgatgatctgcatggcgcggggcttgggtgcgccggagagggtgcccgcggggaagcaggcggtcagcacgtcgaaggcggtgcggtcctcggtgacgcggccggtgacggtggagacgatgtgcatcacgtgggagtagcgctcgatcgacatgaagtcgacgacctcgacgctgccgggttcgcagacccgtcccaggtcgttgcggccgaggtcgacgagcatcaggtgctcggcgcgctccttggggtcggcgaggagttcgtcggcgagcgcctggtcctcctgcggggtggcaccccggtgccgggtcccggcgatcgggtggaccatggcccggccgtcctcgaccttgaccagggcctcggggctggagccgacgacgtcgaacccgtcgaagcggaagaggtacatgtacggggacgggttggtggcccgtagcacccggtagacgtccagggcgctcgcggtgcacggggtctcgaagcgctgggaggggacgacctggaaggcctcgccggcccggatccgctccttgatgtccgcaacggcgtcctggtaggcctcgccgccccacagcgcggtgtacggcggcagttcggacggggggaggacggccgggccatggtccacccgatcgctgggacccggcaccgg

SEQ ID NO: 2805 - DNA, 7852 bp, Unknown
  Kingdom: Bacteria, Phylum: Actinobacteria, Class: Actinobacteria, Order: Streptomycetales, Family: Streptomycetaceae, Genus: Streptomyces
ccatcctggcggtgccgcgccccggccgacgacagcccggcgcgcggcaccgccaggatgggccagggcgtcatcgagcacgacggacagggcggcctgccgcgcgactcccgggccgcccagaccgagggggtcgacgtcagcagccaccagggcaacgtggactgggggaccctgtggaacagcggcgtgaggtgggcctacgtgaaggccaccgaggggacgtactacaagaacccctacttcgcgcagcagtacaacggttcgtacggcatcggcatgatccgcggcgcgtaccacttcgccaccccgaacacgacgagcggcgccgcgcaggcgaaccacttcgtggacaacgggggcggctggtcgcgggacggaaagaccctgccgggcgtgctcgacatcgagtggaatccgtacggcgcccagtgctacggcctcagtcaggcggcgatggtcaactggatccgcgacttcacgaacacctaccgggcgcgcaccggccgggacgcggtgatctacaccgcgaccagctggtggaaggactgcaccggcaacaacgccggcttcggcgccaccaacccgctgtgggtggcccggtacaacacgacggtcggtgagctgcccgccggctggggcttccacacgatgtggcagtacacctcgaccggcccgacggtcggcgaccacaaccgcttcaacggcgccctcgaccgcgtacaggcgctggccaacggctgaccccgcgccgatcgaccgttcgaccagccccggtgaccgcaccccaggtcaccggggcttctcgcgtccctggagcccactatgcactgcatgtatacgcactatgtatagtcctcggcgtaccgcacacctgtgcgggatttccccgcacagaggagtgatgtgtcgtgcccagaaagatgccgttgtccaggatggggttgaccgcggcgctggtgacggcgctcacactggcgttgagcggctgctccatggacaccacggcgccgggctcggcacgcggcgaggcggcctccgacgccaagggctcgttcgggccggtggactgccgcaaggccaagtgcatcgccctgaccttcgacgcgggtccgggcaaggacaccccgaggctgctggacctcctcaaggagaagaaggtgcacgccaccttcttcctgctgggcaagcaccacgtcatcaagcaccccgacacggtgcggcgcatcgaggacgaaggccacgaggtcgccaaccacacctggacgcacaaggtgctgaccgaccggaagccggacgagatacgcgccgagctggagaagacgcagctggccatcgagaagatcaccggcaagaagccccggctgatgcgcccgccgcagggccgcaccgacgacacggtctcggagatcagcaaggatctggggctctcccaggtgctgtggagcgccaccgccaaggactactcgacgaacgactccgcgctgatcaggaagcggatcctggaccaggcgagcaaggacggcatcatcctgctgcacgacatctacaagggcaccgtccccgccgtacccgggatcatcgacgcgctccagaaggacggctacaccttcgtgaccgtccccgagctgatggccccggccgtgccggagccgggcacgatctaccgcccctgagccctcccccgtggcacgcggaacggcccgcctcccgttgactcgggaagcgggccgtccgtaccggccgcgtgcgtgatgccgcgcccgtcactgcgtggcggtcaggccgcggccgggatcctgcccccggtcctggcctcgcgaccggccgaggccggggcgagggcgatctccagcacctggcggacgtcggtgaccgggtggacgtccagcttctccagcacctcggccgggacgtcgtccaggtcggcctcgttgcgctgagggatcaccacggtggtgatccccgcccggtgggcggccagcagcttctgcttgaggccgccgatcggcaacacccgtccggtcagcgacacctcgccggtcatcgccacatcggtacggacgaggcgtccggagagcagcgaggccagggcggtcgtcagggtgatgccggcgctcgggccgtccttggggaccgcgcccgccgggaagtggatgtgcacaccccggtccttgaggtccgcgaccggcagctccagctccgcgccgtgcgaccgcaggaagctcagcgcgatctgcgccgactccttcatgacgtccccgagctgaccggtcagggtcagtccggacgctccggtctccggatcggcgagcgacgcctcgacgaagaggacgtcaccgccggccccggtcaccgcgagcccggtggccacgcccggcaccgcggtgcggcgctcggccgggtcctgggcggactcgggcacgtggtgcggacggccgatgaggccgcgcagatccgcgtcggtcaccgcgaacggcagctcgcggtcgcccagttcgtgctgggccgcgaccttgcggagcagccgggccaccgcccgctccagattccgtacgcccgcctcgcgggtgtactcgccggccagcttgcgcagcgccgactcctccagggcgacctcgtccttctccagaccggcccgctccagctggcgcgggagcaggtggtcccgggcgatgacgaccttctcgtcctcggtgtagccgtcgaggcggaccagctccatgcggtcgagcagggcctccgggatggcgtcgagcacattggcggtggcgaggaagacgacgtcgctgaggtcgagctcgacctccaggtagtggtcgcggaaggtgtggttctgcgccgggtcgagaacttcgaggagggcggcggccgggtcgccccggaagtcggagccgaccttgtcgatctcgtcgagcaggacgaccggattcatcgaaccggcctccttgatggcccgcacgatacggccggggagcgcacccacgtacgtacgccggtggccgcggatctccgcctcgtcccggacaccgccgagcgcgacgcggacgaacttgcggcccatggcgtgtgcgacggactcgccgagggaggtcttgccgacgccgggcgggccgacgagggccagcaccgcgccgccgcggcggccgcccaccacgcccagcccccggtcggcacggcgcttgcgcaccgcgaggtactcggtgatgcgttccttcacgtcggcgaggccggcgtgctcggcgtccaggatctcctgggcgccgcggatgtcgtaggcgtcctcggtccgttcggtccagggcagttcgaggacggtatccagccaggtgcggatccaggaaccctcgggcgactggtcgctggaccgctccagcttctcgacctccttgagcgcggcctcgcggacgtgctcggggaggtcggcggcctcgacgcgggcccggtagtcgtcggactcgtcctccgggtcgccgttgagctcggagagttccttgcgcacggcgtcgagctggcggcgcagcaggaattcgcgctgctgcttgtcgacgccgtcctggacgtccttggcgatggattcggccacgtcctgctcggcgaggtgctcgctcagccactggatggcgagcttcagccgggcgatcgggtccgcggtctccaggagctggaccttctgggccgtgatgaggaacggcgagtatccggagttgtcggcgagcgcggagatgtcgtcgatctgctggacccggtccacgacctgccaggcgccgcgcttcttcagccagctggtggcgagtgctttgtactccttgaccagctcggcggcggatccgggcagggggtcgggggcggcggtttcgagcacggccccctcgacccagagcgcccggccgggcccactggtcccggcgccgatccggacccggtcacgggcccggatgagtgcgcccgggtcgccgtccgacaggcgtccgacctgctcgacggtgccgaggacaccggtccccgtgtacgtgccgtcgatgcgcgggaccagcagcacctggggcttgccgccgccgggacgggcggcggcctgcgcggcctcgacggcggcgcgcacctcggtgtcggacaggtcgagcggcacgaccatgccgggcaggacgacctcgtcgtcgagcggcagcacgggcaggtcgatcggtgtgaacgcctcggactcgttagtcatgatctccccttcggcaggcaagttgagctatgccgactcaatgctcctgagccgccgaatgttccccagggcttgttcgctctgagcgatcaggcactttccggcccggaccgcctctacgggagcgctgcgggacgggccgttgttccccgcctccggaaggagaactcgctggccttcgacccgggcgcgggacaggatgacggacaccgaccgctacgaccggagaccggagagccacacgatgcccgcgacgcccgcccctgacccgatgccgacgcgttccggcggcactcccgtcgtcctcgaccgccgcgagggaccgttcggcgaagtcgtgctgcgggagcgcggggagcacttcgagatcatcgccaacggctgcttcctgatggacacctcggacgggcgctccgagcggctgctgatcgacgccgcgctggccgccctgcccgccgggcggaccggcccctccgtgctgatcggcggcctgggcgtcggattctccctggtgcgggccgccgaggagcggcgctggggccggatcgtggtggtggagcgggagcaggcgatcgtggactggcacctggccgggccgctggaccggatctccgggccggcgctgaccgacccccggaccgggatcctgcacacggacctcgtcgcccacctccgcaccaccacggagcgttacgacgcactgtgcctggacatcgacaacgggccggactggaccgtcacggaggacaacggaagcctctactcccccgccggactggcgcactgccacgaccggctgaccccgggcggagtgctcgccgtctggtccgcgcagccgtcgccgaccttcgaacaggctttgcggaatgccgggttcagcggggttaggacggaagaggtggccgttgcccgaggtgtgccggacgtggtccatctcgcacttcggacggcctgaacccccctcccggtatgcgcggaccggcagtggcacgggccaaccggcacaaggccgacgatccggccgtccggtcggcgtgaactcgctcccccggggcaacaccctgcgtagccgggagccctccgctgcctttacgctgctgatcggcacacgggatcacccacgaaatccacgagcgaaaaccgtgcctccgggagaatggctcccgcgagaacgggcaggggcggggcgatggaacagacacacaccacccacaacggcgtcgcggccaccccgggggctcagcgccgggtgctggtggtcgaggacgacgccacgatcgtcgacgccatttccgcccggctgcgggcggagggcttcctcgtgcagaccgcgctggacggtcccgcggccgtggacgcggccgaggcctggcagcccgacctgatggtgctcgacatcatgcttcccggcttcgacggcctggaggtctgccgccgggtgcaggcgcagcgcccggtgccggtgctgatgctcaccgcacgcgacgacgagaccgacatgctggtcgggctcggggtcggcgccgacgactacatgaccaagccgttctccatgcgggagctggccgcccgggtccacgtgctgctgcgccgggtggagcgggccgcgctggcagccgtcaccccacgcagcgggatactgcgtctgggtgagctggagatcgaccacgcgcagcgccgggtccgggtgcgcgccgaggacgtccatctcacgccgaccgagttcgacctgctggtctgcctcgccaacaccccgcgcgcggtgctctcccgggagcagctgctggccgaggtgtgggactgggcggacgcctcgggcacgcgcacggtcgacagccacatcaaggcgctgcgccggaagatcggcgcggagcggatccgtaccgtgcacggcgtgggctacgccctggagactcccgcgccatgacgcggccagggtccggactgcggcccttctcgatcaaggccaagctcggcacgctcgtcgtggtctcggtgttcatcaccacggggttgctgatcgtcgcgttgcggacccgtacggagttccgcttcatcacggtgttctcggtgatcgccacgctgctgatcacccagttcgtggcgcacggactgaccgcgccgctggacgagatgagagcggtggcccggtccatctcgcacggcgactacacccgccgggtgagcggcgccgggcgacgggacgagctgggggacctggcgcagacgatcaatcgcatggcggacgatctggaggcggaggaccggcatcgaaaagagctggtcgccaatgtcagccatgagctgcgcacccccatcgcggcgctgagagccgtgctggagaacgtggtggacggggtgtccgccgccgatccggagacgatgcgcacggcgctgaagcagacggagcggctcggccggctggtcgagacgctgctggacctgtcacggctggacaacggggtggtggcgctcaaggcccgccgtttcgaggtctggccgtatctgtcgggcgtactgaaagaggccaatctcgccgcctcccaccgacgcctgtcgtcgggttcgggcaatcactcccgtacggacgtccatctgcatctggacgtctcgccgccggagctcaccgcgcacgcggacgccgagcggctgcaccaggtggtcgccaacctcatcgacaacgcggtcaagcacagtccgccgcacggccgcgtgacggtgctcgcgcggcgcggggcccaccccgagtcgctggagctggaggtcgtcgacgaggggcccggcatcccggaggcggagcgccaccgggtgttcgagcgcttcaaccggggccaggcgccctccccgcacggtccgggaagcgacggcggtacgggactgggtctggccatcgcccgctgggcggtcgatctgcacggcggtcggatcggagtggccgaatccgcgaagggctgccgcatccaggtcaccctcccgggaatccccgagccgcgcagttgacgctgcggttgacatagggtcgaaccggaagggcacgttcatccgtgtcctgccagcaaggggcctcaaaggggtgcggtcggatgaccgtatccacggccctgcgtacccgaagtgcagtggaacctcgcttgtttcccgccatttcctgcgccgaaacccgccttccgatgtgatgtgcacgacgaagcaccggcccggtctgcaaggaacggttcggggggcgtagccttgatttccgctgtccatcaccttgtgaagcggaagagggcggttgccgccgtgtcgtctcagtcccccagtaactcgagcatctcgaccgatcaagccggcccgggtacgaacccggccgccgcgttcggcgccaatgaatggctcgtcgacgagatctaccagcagtacctccaggatcccagttcggtcgatcgcgcctggtgggacttcttcgccgactacaagccgggtgcctccggcacggcggacaagcccgttcccggcgtcgcaccggtgaccgaggcgccagccgctccggccgccgcgcctgctccggcagccgctccggccccggcgaaggccgcgcccgcagccgctccggctcccgcgcagccggccccggtcaaggccgccccggccccggcc

SEQ ID NO: 2806 - DNA, 25155 bp, Unknown
  Kingdom: Bacteria, Phylum: Actinobacteria, Class: Actinobacteria, Order: Streptomycetales, Family: Streptomycetaceae, Genus: Streptomyces
cggcgcaggccgcgccgggggaacctctggcaccgtgtcagtccccgcggctaccttcgttccatggccagcagcagcgagcacggcgggcacggcccccggcgcctccatcagtcgatcggtgacgtactgcggacgcccgagcggccgcagccggcggccgggacgactccccagtggcctggccacgagtacggcccgacgcccgttccagcgaaggcgcccggcacgccggggctcccggaaggggtacgccgctcgcggcaggagctggaatcggtgcgggacgacgccgcccgccagttccacgccggcgacgacgcccgggtgcacgtcgaggtcgaggtgcgccaggcgaaggcggccgcccacggagtctgggccaccgcggcgtggctgttgggcgagctgcaggccgccccgatcagccaggagtggtacgcgtacccgtacaccaaccgccaggtggggctggaacgcacgcacgcccgggaccggatcgagggcaacgactggcccgacgtcgaccgggactatgccgccggggtccagtacacggtgggctggagcttctggccggacgaggaacgccccgtgccgcccgcaggatgacgtacggcacgcgaagaggcccggaccatcggtccgggcctctgtcgttgggcgagcggatcagctgagcacttcgcccgtccgcagcaggtgcaggtaccgcgccagctcttggcggtcttcctccaccttcttgttctcgaacgggttgggcttgtgaccgttgcccgggtcgcggccgttgccgccgcccttgcactcttccaggatgaacttgccctggcgaacggcgtcggggagccagcgccccagccactcagcgacccgcagcggagacgcttccttgtcgaggtaggcccagtggtggctcatcatcaggctggtgaggctttccaccatgtccgggtgctgccaccagcacgaagagggccgctccgtgtaccccagcatctccttgtaggagcggggccagcggacccggaacgtctcctccacccacgtcagcaggatctcccaggcttccgcctgctgctgcgggccgaagttcttccagttccagaccgccccggcatcgctcttgggcttgtccgccagcttcttgacgaccagggacagttcctggatgcggtccgcgaggttctgcccctccagcgtttcgaggcggccgttcacctcgtccagctgccgacccagttcgcgggtccgctcccagacggctttcgtctccttgggctggtcgatcatccggtctgcccccaaacgttctgctcagcggccggcgcctgtccagggatcgcccccgggtacgcggcaggctgctgcgggaccaccggagccgtggcgggcatctgcggcgggaggacgggcccggcgacctgcacccccttcttcttcatcttggcctccagcttcgcctgtgccttctcctgcttcagcagttccttgacgtccttccgctgccacaccggggtgaacgcgtaccggatcggcggaagatgccggtagaagaccaggcccgtcccttccttcatctgccggatggcatcctgcggcatgatccggacccgccgcaccgagacgttgcgggacttcttgtcctcgtccgtggcggacgaggaggccacttcctcgtccttctccccgcagagcagggagagttcttccagatcctgcgggatggacaggccaccgagggcgacccggacggagttgttcatgatggtctgcgccccgttctggccccaccgctcccgcagctgggacggggactggacgctgaccaggagctggatgttccggccgcccgcgtccgccgaccacttgtgcaggggaagcgggcagatcacggccgcctcgtccaggacgaagcgcacgtacgggtccatgcggccgccggggctgttgtccgcctccaggtacgccgcctcgtagatctcgcccaccagggcggtgaacagcggggcgacgctgccgtactgctggtcacggcccatcaggtacagggtgccgcgcgagcggaggaagtcctgcacgtcgaacttctgctgtccgggccggggggacacgatgtccatgacctgggggagcgacatgaactcgaacgagcggaccagcgtcaggtacacactgtcccgcgtcttctccggggcgttccgcatctgcgagaggccccgggcccagccggcgggcacgagttccgggtggctctccaggatctccaggggctcacggtcggtcgagtcggtcacccaggcccggacctgggccaggtcgtagccccgcaggcccgccgccatcaggtagcaggagagcaccatgaaggagtggccctcccagaaggaagcgtgctccatggcctccccgctggccgaggccgcgagcaggtacccggcgcgacgcagggccaccaccgggtcctggcagccctctaccaggttccagtgcagggtgttcgccgccccgctcacgcccgcgttgaagacccagacggggcggttgaaggtccgccgcagctggtgggtgtggtcgtagaggtcaccgcgggtcgaggtcaccacgcaggcgcccgccgcgtcgatgatggcgttgccgtactgcgcggacttgccggtacgcggaggggcgtacatcagcacgatgtcctcgcaggcgacgaacagccccttcttgtagagcagatccgtgccaaggtgcagcccgacctcgtgagggctgatggaacggcgcttcgccccttccagggacgggcggagggtgtccgcgcgggcccggagcccttcctgggacagccacttcttgagttccttgggattggcgaacccgacccgggccgcgtccttcccgttcgtggtgggaccggacttgcccaggtcccacttctgcttcaggtggaggtacccgaggccgccgccggccacgaccgtgaggccgaacccgggccagccgccgaggggccagttcgagcccacggtgttgatgaggtcgagggcgccgcccacggacggctccgggagtccgccgttctcggcaccggccgcgagcgccacggcgggcagtccggccgccgcgaacgcggtgccctggcgggacttgccgagcgcagagggcttgtgggtgtcgatgatgcggtgcagccagtgcggcatcatcccgcccggcaggtcggtggtggggggtgtgggattctcttccttgcgtgacacgagcactctcctctgtcgcgaagtccccgggttgggcggtaccagcgcctcccgggggcgcctagtgtccggtgacctcacgatcaccgtacgagccaggactgacattcagccccgggttttctcagctgtgcttgtcgatgatgggcttcaggtacttccgggccgtgccctccgtgaagccgcttccgtggtgcagggcctttgccagagcgctggccgactggttcgggtagcgcttttccgcaggaagccgcaggtagcggtactccagcagttccacgcccgtcaggtccggctcaggctccgggccctcgtccacgccgtcctcgtcctcgtccaggccctcgtccacggcctcgtcgatgacttccggcaccggctccggctcaggcgccggaacgggctcggggtagtcgccaattggcgactggacagcctcgtccgcgtacggcaccggctccggctcgggggtgaacggctccggctccgggtgcttctgcagccagtcggccccgtcgatccgggcctgcaccatggcgggccgtccatcgttgcgagccgcccacgggccgttcgcggccgccagctgcccctgcgggtcgggcccgtatgcctcgtacggcgcgggggccgtctgctgggggaccggtgcggagtacggctccgggtggccggccgccgcttcctgcggttccacctcgccctggccgccgtgctggtcggtgtcgacctctccgcgctccagctcccgtccgggggtagtggcgggcagttcctcgcgcccgtcgccgtcgaccgcctcgtggtcgacccgttccagctccgcaggcagtgcgatgccagcggcagccaggcccgccggagcagtctcgaagatgggcacgccgtacttcgccagccggagcggcatcagcgcctccaccggggccttccgtcgccagccacggccgaaccgggcctgcaggcgtgactggtagatcagccgggcctgttccaggctcaccgccttctcgtagctccggacctcccagagcttcatccggcgccacagccggaaggtgggcagaggcgagagcagccaccgggtgatccgaacgccctccatgtgcttgtcggcggtgatgtccgcgatccggcccaccgcgtgccgcgcggcttccacggagacgacgaagagaacggggatcacggcgtgcatccccacgccgagcgggtccggccaggccgccgccgcgttgaaggcgatcgtggcgcccgtcaggagccacgccgtctggcgcaggagggggaacgggatgcggagccaggtcagcagcaggtcgaggccgaggagcacgacaatgcccgcgtcgataccgatggggaaccagtacgcgaaggtgccgaaccccttctccacggcgagcgcacgcaccgcgttgtacgagccggcgaagccgatggaggcgatgacgaccgcgccgaaggccacaatcccgatcagccagtagtggacccgggtcagttccggaatgcccttcttctcttcaggctcggtggccgatccggggggatcagcggccgtaccctggtggtgacgcatgtaggtctccaaatctcagcgtcctgggccctggtggtgtgtcctcaccaccggggttccttcttgtcaggtctcgtccgtgggcttggcgtagcccttccggttcagccactcgtcgtacgcggccgccacctgttccttcaagctcattccggtgtcgagcttgcagagcgtgccccggcggtgcagctgaaggtcttccggcacttccacgttgaggggtcgcatccgtacgacttcctccttcttgggtcggcccctgcgcttgggcttggggtcatcggtcatgtggtcgccacctctccgtgtactgcgggtggagggatgatcccactgtgcggctatggatctatgaaagcaggtccctaggttcctagcaactatttttcctaggttccttgcaacctaggaaaaaaggccctacggtggaaccagaacgaacgagagggccggggttcccgccccgaccctctccgcccggaacggcgttgaccgcgccttccgagctgggacacccctattcgcagagagagggatctccgtgcagaagtctgccagccggaccaccggcatctccatcccggcccccgcgagccccccgcgcctcgtgctggtcggcaagaagggcccggcgttcagcaccccgtgcgccgactgcgacgggttcgacaccgtcgtgatccgccgcaacggcgaggcgtccaccgtccgctgcacctgccagctggcggtgagcgcatgagcgccaccgacgacgccgtgaagaaggccgaggccgcccgccagaaggcggaggccgacctgaagcgccacggccaggccatgagcgggatcaggggccgcaagtgagcacccgcccgcccctgccggtccgcccgcagccccacgagcgcgacggacgccagccgcagcagcagcccgcgcggccgcaccccgcccgatagggcccccggtgggccggtcgccaattggcgaccggcccgcctccccttgcacgccttgatggagaggcacacccatgtcgcactgcaccaaccccaccgtgctggaacggatctccgacgccgatctgcgcgccgacagccgcgcggagtggctggccggggagtaccgcgccggcgagtacccgaccgcccacgtccactacgacctgaccgacgccgcgttcgtcgtcgtcgccccgcaggggggtgcgtccgcgtgaccgtcgcccgcgaacgcctcatcgccctggccgccctcgtcttctccgtgctggtcatggccacctccgtggacatcggccgcaacgcgatcgaggcggccctgtccgggctgaccgcgtacggcaccgtcgtggtgctggccgcgctcgccctgtccgtggggctccggaagatctggaaggccagcaggaacgtgctggccgtcgccgtcgtgatcgccctcgtcctgttcgggatgggcaaggccgtggccgaggtgatgagctgatgcgcgccctgaccatccgccagccgtgggcggccgccatcacctacgcggacaagcgcgtggagaacagggtgtggccgacctcgtaccgcggccccgtcctcatccacgcgggcaagaccgtggaccgccgccacggccccatggtcgccgccgtggtgcgcgggctgcagctggacctgggggccgtgctcgcggtcgcccggatcatcgactgccacccggacgacggggagtgcaccccgtggtcgaccaccgggaacttccacttcgtcctggacgaggtgaccgccctcccgctcccggtcccgtgggcgggtgcacagcagctgtggaccccgccggccgtcctcgtggagaaggtgcgcgagcagctgtcgagcgagaccgccgcccacgtcctgcgtgaggaggcgggcccgtgctgaccgtctacgacgagttcgccggggtcggcggctccagcaaggggtccaccgccatcaaggaccgggacggcaaggccctgacggaactcatcttcgcggcgaaccacaagaaggacgccgtggaggaccacgcgcggaacttccccgccgccgaccacttcgagggcgacgtggcccgcgccgacatcacgaagttcccccgggctgacatcttctgggcgagcccgtcgtgcccgccgtggagcaacgcgcggggcaagcgccgggacttcgacaactccacccagggagtcctgttcggggagagcgagccggacccggagatcaagcgggcccgcgcgctcatggaggaggtcccgcgctacctgaacgcgatgatccttcggggcaagcccgtgctgtgcggagtcgtggagaacgtcgtggagtgccgcaagtgggaccagtggtcccgctggctccgcgaggtgcgttgcgggggcctgtacgaggtccgcgtgatcgccatcaactccatgcacgtcaaggcccgggggagccgcagggcgccgcagtcgaggaaccgcctgttcgtcgcctactggctcaagagcttgggccggacgccggactggaacaagtggctcaggcccaaggcgtactgccagacgtgcgacgccacggtgtcggccatccaggtcttcaagcgcctgaacgtcgacatgggcgcgtacgggcgcaacggccagtactggtaccggtgcccgaacgcgaagtgccgcaacgcgatcgtgcacccggaggtcatgcccgcatctgcggtcatcgactggtcgattgagggccgccggatcgcggaccgggacgagcccctggccgacgccaccatggagcgcatcgcgcggggcatcgcgaagttcgcgaagccgttcaccgtgcccgccggcgggacctggcggaccgagcccgtgtcggtcgaggacccgatgccgacccgcacgacccgcgagacggacgccctggccgtgccgcccctgctcatcccgaccgaaggccgggacgggaaggtggcgacgtcgaccgaggagccgatgcggacccagaccgcccgcaacgagaccggactggccatcccgccgttccagatcagtctccggggaggggggtcgaagaagaccgcgtacggcgtggacgagcccgtgggcacggtcagcgcgagcgggaaccaccacggcctcgtcaccggtcagcgtctgctcatcccgtactacagcaccggcacggcccgcacggtcgaggagcccgtgggcaccgtgaccacccgcgaccgctggtcgctcgcggaggtcgaggagaacgtcgacctgggcgacgtccggttcaggatgttggagccccacgagatcggcgccgccatggcgttcccggacacgtacatcgtcaccggcagcaagcgggacaaggtgcggaagtacgggaacgcggtcacgccgcccgtggccgaggtcatcgtgtccgcactggtcgaggcggtcaccggtgagccgctggaggtggcgtggtgacccgccgccagggcctgcagatgaagggcggcgtgcagctgcccatgttcgccgtcgaggtcgagccggagcccgccaccgtggcgggcccggcccggccggcggccgccgagtgggccgaggctcacgggctggagctgcagaccggcccgcaggggtcggcggtgctcagcccgtgcggcacctaccggtaccggctggaccggatctgggacgaggacaccgcgcccatggtgtgggtgatgctcaacccgtccaccgcggaccacaccgaggacgacgccacgattcgccgctgcacttcgttcgcgagggcggccgggcacggcggcatggtcgtggtgaacctgttcgcgctccgctcgaaggacccgggccagctccggaagcaccccgacccgatcggcccgttcaacgaggccgcgctgatcgaggccaccgacgacgccgtacgcgtcgcggccgcgtggggcgacgtcagccgctccgagcgcgcccgccaggcccacgccgtcaccgctctgttggtcggccacggccactccctggagtccctgggagtcaccggcaagggccacccccgacacccgctgtacgtgcgcgacgagacccagctgaccccgtacaacccgcagtcgccaattggcgaccgctccgccgagccggaggtggaccggtgagcaaggagaacgaggagttcaacccctggcgatgggaccgggacaacgcccgcaacgggcaggcccgcctcaccgtcgagcagaacggccacaaggtctccctggaccaccggggcgtgtcgatcgacggacagcggatcatccgggacgacccgtccaagggcgacgaacacggcttccagatcaccccgaccgggaccgtcatgtaccggggccaggaggtggccgccatcgagccctccccggacggcacggcgaacccgggcgaggtgaccgtgtggggcaaggacgggcccaccctccccgagcgcaggcagcgcgacctggccgcacgggagcgcgaggagggcgagcggcgcagccgggacgaccggtaccgcgccagcgagcagcaccagcaggaactcacccgagacggacaggagatgacgctgtgagcgaccagagccccgcgccgttcgatccggcgctctacctgatcgagcaggcccaccggcagcccgtgccgccgacgttccggcccgccccgcagctgccgccgaagcggtccgccggccgctggctgtgggaccacttcgggcgcctggccccgggcctggcgaccacgagcatgtccgcgctcgcgtggagctgggggcagaacctcccggacggctccaccgcgccgctgtggatcacgggcagtctggccgcgctcgcggggtgcgccgggtgcgtcgccgcgtcgaagcagcacggcgacaacgagaccgtgcgcgtctcgttcggcggggccgccgtgctcgcgttcgccggggtcaccgcgtggacgccggactggcagctggccaccctgctgtgggccgggtgcaccgccgcggtgtacgcgttctgtgcgccgctgtggcgggcagaccgccgcgagacccgcgcccaggaacacgagctggtcatggaggagaccaagggactcaacgaggcccgggtgaaggcgatcgagaccgccggcgccgtggcgacagctcagtgggagtaccaccaggagcaggcgaaggtggccgcgatcgtggcggccgccgacgcccgccagcgccgcgccatccagcccggccaggagctggacgtgcaggccctgctgaaggcggcccacgtagccgagctgaactgaccgaccgcaacgacgaaggggcccccgccacggcgggggccccttctgctgtgcgcgcctacgagccggcggggccaggaatcccgcccgcccgacgctggagacgtacagcggccgtccggatgcgggagaggtccacggcagcctcagcacggtggaacggggccgcgtcgagggccagcgcctcgtccagctgccgcagcgccttctccgccgtgtcggcagcggtacggatggtctggccgaccttctccgccgtgtcctcgtcgtcctccaccagctccgcgtccaccacctcgtcctcgtcctcgtcacggtcgccaattggcgactggtcggaggcgatgcccagcccttcctggtcgcgccgggccgcgatcaccgcggcggtgaccttcttcccgccggactccagccggaggacttccacgaagttccgggcgccctcgtcgccgttgaccttgacgaccggggccagctcccgggcgtgcgactccaccacggtgtcgagcaccgccgggccgagcggggcgagcgcgcgatggaccagagccaggtcaatgagccggtacccgtacgagcggtcccagccccaccgcgccttgacgtagtgcccgaacttcgcgtgcccctccagctcccacagcccggactcgttgatctcgtccaggagctggccaacctccacacggtgccgggcctgcagtcgccggaggctctgctggtactgccccacagacgcttcaatgcgcgcctccagggcctgcagccgctcgcgcggactcagctccacctcggtgccggacgacgcctgtacgggcagctgggcaccgccgccacgggtcgccagacccgccgtcaggacgtccccgaaactgtcgctggccttatctgccgccttgctcaccgtgccaccacgtccaggacctcccgtgccatccggtccatcggggaaccggtcttgaccttgattcgctgcttgaagacgtacgccgggccgtccagcgcgctggagtacttgaaccgcgaggcgagcaccgggtagtcggcggccgtcagcttgtcctgcagcctgtccgcgcccacgacgccctggccgaccatcgtcagcatgacgtgcagctccgggtacggggcccccgtgttcttcagttgctggatgtagcccagtaccgacgtcgcccgatccagttcgttgggggtcggctgcaggcacagaatcaccttgtcgaccgcgctcatcaccgtcaggtgcgggccgtcgtcgtgcttctcccaggcggccgtgtcgagcaggcacacgcccttctccgggcacagccgctgtgcttcctgccggatgtggtggaccgccggcgcggggtagaccggggcgccgaggtcgaccgcgttcgcgtgcgtgtagagggtgccgtgctcgttcttccccggcacgtcggtgtcgatggcgacgcaggggacgccgtacgacttccagtgcgcgagcaggtaggcgagcagggtcgacttgcccgcgccaccctttccgatgaaggcgacccggcggccctgggcgggcagcaccggaacggggcgaggtttcgtcatggcaccggacgctaccgccccgccgcatgatcgagaggaccgaccggcgcaccgcaggcagcttgtacgaccaaggcgcccgttcggctccgggggcagtcgccaattggcgaccgttggcgggtgcgggttactgagcggggctccgccccacaccccggccaccctgcggagggggtggggggcacggctcggtgggtgcgggttgtgggtggtggagatggtggtgggtcgcggtgcggccccctcgtcggacggcacccagagggcaccacaccgcccgccggccatccaggacgcctacggcgccgcgcgagcgcggtcgggcaagcccgatcctggacagccgacgaacggcgcggtagggcttcgcctgccgcccaacgagggaaccaccccgctcagcccggacgcacggcgcaggccgcgccggggtcgagcagccggttacggtgctccgtatggggatcagcacgggggaacagccgggatacgcgctactggtcgcggccgagccgcccgtacgacatccgctcgcggtcaccacggtgttgcctcaactggccgccgtcccgccggcgcggctggtcgggacctcgtacgcgagcgccgtacagctggccaaccccgacgaccccaacaccgtgttgacgaacctccgcaccgcggccgcagtcgagggcccgctactcgtctacgtcgccgggcacctggccgtcgacccgcgccagcaccttctccacctggccctggcccgcaccaccgcccgcacgatccggtacaccgcgctcccgtggcactggatcgccgccgagctgcagcgtcgcccgccgggcaccaccacggtggtggccgacctggcggccgacacggacgtctggcaggccctcgtccaccaggagcagtccctggccggaccgttcgcgctgtacggcgccgtgcagctgcaggaccgccgccaccgccccaccccctcgtacacgaacgcgctcgcgcacatcctccgcaccgcaccgacgaggccgagcgccgagcagctgcaccaccaggccgcccgcgcggccgccgtcgaggacgccgccaccctgtggttgggcgggcaagtggtcgagcaggcagccccgcaccccgacgtcgacgtgcccgcgccgaggaccgaggcgacgtcgacccccgcggccgccgtcgaggaggacccccacctggcgatccgggacgcgagccgcgccggccgccacggcgaagccgccgccatcgccgcctcgtacgaacaggccgcactccgggcgcacggcgcgcagtccgtcgaggtggcccactggatcgaggtccgcgcgttcctcgcgctgcaggaaggggccccggaccgcgcctgtcagctgtggctgcaggccgccgtggtccggctgaacgccgaccagcccgagcaccaccacgaggtggccgaggccgtcgaccgcgcccacggcgcctggcacctcgtcagcgacccgtcccagctccggcagttgggcatcgagctgttgagtctccgcacccgtgtccccggaaagagtggtgctcgcgcggacgttcagcgacgactcgcgcacctctcccgggccgtaaacccctgatatctcggggttttcggggccgcccgccacacgggaagtcgacaagtggcctcccgtgtcacgggaaaaccacaagacacgcgggaaagtgtggaccacacaggccccgttatggataagatcttggacatggcagtacgaggacgtcagcagccgggccgaacgggagtgttcccctcggacaagccgttgcgcgccaccgtgatgctcaagcccggcgactacgtacgcgggttgtacgaggagctggtgaacgaccttgggatctccggggccgaagtgctccgcgaagcccttaccgagctgcacaagagggaagcccgccgcaaggcgaggcaggccccgagggcagtccagaacgctggtgaggagctgccccagaccggatgacaacaacgtccggacgcgcaaaagccctgacccgaaagttcagatcagggcaccgctcgtccggcgggaccacctcagtcacaagctgccaggcgcgggtctgagagtccctatctccacaggtaggcccatttgcaggcgccggacgcaagtccggggccgggccttcgtatgtgccccttatctagctccaggagcaatcgcatcgtagcaagaagctgcggtggcggcccagtgcgccctcagtccggtgtgtccggaagggaggtcacccgcccaccgcgtacccagttcctccggctccaggccgtcgaggaagcccccgcccgaggaccgcccgtccagcccgcccaagtcgtagctggacgcgctccaccatggcgggtggagaaggcgacatgcccaggggagaccggtccccgtccgaagggccacggagacgtggagctggaggagcagacaatgaaaccggcccgtggcccctgccaggcgagcaggggtaaacccggagtagcccgcggttgagatcggtccgcgtcaccaagaccgaccccggcttgccaccgggagagtaaggccgagccgcccccatacgtgacacccgctgatcgggcacgcaggggccgtgtagacgctaaacggtgaaatggagcagcagccagaccggccttgccatgacgagtgatcccatggcgaacaaggtggaccccagccggcgcccgcgcagagcgggcagagacacgacctctcagcgctgactgcaagtcccggtcccaaggcgagcgtgcgaatacccgtggcctgagtgaagcgacataccgtgacgggcgtaccggaaacgagtaccccaggttgaagcgaaacccccctctagcagagatggcagaaccccaacgggaagctctgtcatttttgctaggggggggccgcttctctccacccgctcagggcacccggagggtgcgcgggtggagcaaagagaacagccaagcgcgaagcgcttgtcctttaactaccgggccgaaggcccgagaaggaacgcgcgaagctccttatccgcgcctgagagggccgatccggcccacccccaccgggggtgaggttgaggacgagagagagccggatcggccctctcaggggtgttcagcctggccgtaggccagtcctttacgcccgaacagtcgttccccctatgggcagttgaacgacttccctcacccaccaccgggccttcctctccgcctcccgcactgcccgggattggcatatgacgacaatgcaggttcccgtgacaacctaggttcccgacagttagggttgtcacatggagatgaaggaaccgacccaggaagaacgcgaccagctccgtcaggccctgcacaaggccctggagaagctgggggacacggtgtacgagcggctgaccgccggacgcccggacgacgcggaggaggtgctggacctcacccgcccggagatccccctggcgaagctgatcgtctgcaagtacgcggacgaggagctggacgtgctggccgagcggttcgcccgcgcggccggagccgccggagccaactacgccgagctgggcaccgcgtgggggatctcccgccaggccgcccgcaagcgctggcccggagcggtgagcgcgatcaacgagcgcgccaacaaggagcccgtgcacttcgaggcgttcggcggagaggccagggtgtccttccacccggaggacgggagctggtggtggatcgccaccgccgccaaccggaaggtgcgcgaggcgcccgagaaggccgagtacgacacgagcgaggaggccgcggccgccgctggcgccttcctcgcggccaacaccaccgaggagacgacccgatgacccagcccgacctgtccgccctggccctggccctgcggaacctgttcgacacctaccccacggacgccgacgacgccgagcgcgcgacgctcaccctggaagccggcgggcagcagcacgccgtacgcctccagcccggccaggtcgagtggctgacccacctcgtccgtgacgaggacggcagttgccgcaacgcccacgcagacgggaccggagtctgcgagcactgccggggactgggagtcgtcggcggccgcaagccccgcacatgggtcgcctggcaggtcgacggaggcggccccgggatgccgtgcaccgacgccaccaccgccaggctgtacgccgagcagcagtaccgcgacggactccacagcgaggaccaggacgcggccgtactggtgtggaccggcgacgaggacatgcgcacgctggaggaccagggccaggacaccggatggtgcgtcagcccggagaccatccagacaccgccggacgtctggacgtgcacctggtgcggcgaggacaacgacaacgcgttcgcccgctgccccggctgcagccacccccgccccgccgccaactgacctgatccgaggagcaacccgtggacgacgagaacaccgtggccgtgttggtggagaccatcgaccggttctttgaggaggtcgaccccgacgagttcgagtcggaggacttggcctgggccctcgtccgcgccatgaagcgtggcgcctcgtccgactgacaccccgcacgatcggcaacgggcaacaccgccaaccgactaccgccgcccccgggcggcatggaggctgaacagcatggagaccacaccggaagacctcagcaccctgtactgggacggacacgtccagagcgtcatcacctcgtacggcgccggccaccacgacgacccgggcggcaacgccgtggtggtcgacacccgccccctgcgcaacccgcccgaggaccccgaggttcgcgaccggatgttgcacagcaacggcctggacccggaggtgcgccggtacgtcatggcgacgccgggcgcgaaggagttggtggcgcagtccgccgagaaggtccgcatcttgctgcaggccgacaacctgaagcagtggaccggcgggccgcagcagtaccgcgtggatgtccacgtggtctgtggtggcggccgccaccgttcggtcgccgtggccgaggagatcgcggtgtacctgcgggccgccgggatcgggtgcgaggtcgagcaccggcacatcgagcggccgatcctgcagaagtgacgcggccgggaccgtcgtaaccggccccggacgcgcacaccaggacaccacatcgagcaggccccgcccacccgggcggggcctgtcccgtgctcaggacgcgaacgcctcccgccagccgttccgcaggccacggcccaccgcccgccaggcggacaggaagcagctgcacccgcgcccctcccggcgggtgcagccggccgcgtgcccgcgcacggcgagccggacgagggcgaaggggagcacgaccagctccgcgagcaggacgcacggagcgacgaagaggaccaggacgtgagagcgccagcggcgcgtgttcgtgttcatgctcgaaagtctggaggggttcccctgtggacagtttccggcgagcgcggctgacgcgccctcagaacggcccgccggggggccggtagggtctgttcgacgtcacagttatgccaattactgtgacagtgcaggtcagagcgttggaggcgatcagatgcggttgggcctggcgggatacatccgagtgtcgaccggcagtcagctggacgggttcgggctggaggaccaggagcgcatcgtgcgccgatggacccgcgagcacggccaccgcctcgtgaagctgttcgtggagaaggcggtgccgggcaccgtcgccggggacgagcggcccgagctggccgacgccctgttgtggatcgaggagaagcgcgtgcacggcatcgtcgcgccgaaccttgaccgcctggcccgcgagctggtggtgcaggaggcggccctggcccagacgtggaagcacggcggccgcgcgttcatggccgatcagggcgagatcctgcccgacgaccccgaggacccgatgcgaaccgccatgcgccagatgatgggtgtgttcgcgcagttggaccgaggcatgaccgtggccaagctccgccgcggccgccgcatcaagggggagaaaggccagtacgcgtacggcgccccgccgtacggatgggccgcgcacaagaaggagctgaccgaggaggagatggagcaggcaggccgagcccgcgcccgccagctccgggacgaggacgagctgtcgttgcgcgagatcgcggccgcgctggaggtcgaagggctccgcccgaagcgcggggagcactggcacccggagaccgtccgccggatgctcgcgaacacgaccgaccggccgccgaccctgcgccggcgcgagcgcaccgcgtagggacgacgaaagggcccggccaggtggccgggcccttctgcctgttcctcgtcaggaagctgggggcagcgtccgttccgccagctgcccgaccgccgcccgccgggccgagtcccacccgggttggggaggaaggctccggagcaggccgcgaagccgcttcgcctccaccacggtcacgccgcccagttcgagccggccgcgcggagccgggaccttcgcgccgtgcacggcgaccaccggacggaccgggacgccgagggcccgagccgcctgttccgcctcccagaccaccgtctgcagggcgcgagtctggtcgtagcggccgtagcgcagggtgccgccctgcacggtcagctgagacttgtccgacgtccagttcttcgtgtcgacgtacagggcgcccgcggccgtgaaggcgaggtgatcgaggttggcccgactcccggggatcgcccgatcgtggaggaccacggcgtgcccccggcggacgagcggcgccaggagcttggccgtccgtgcctccccggcggcgcccaccgcccagctgttgtggccccggcggtacagccgccgtacgccgagcccggccacgaccagcgcggcgaccaggccgagctgccagttcgccagcgagccgaccgccgacccgaccaccgcggcggccgccgccagtaacggcagcagcacccgggcccgtcgatgctgtgctgcccgctccactgtccgagctgcctcacccatccggcccgcgctcgcgcctgccccgctccggtgtcccgctgtcgtcatcctgccgcccctcccgtgtggttactgcctgtaccgggacggtagcgcccgggggtgacaccgcacaggcggaaagaccggccaccgtcacatggcacgcgtagccgcctctcgttgccgactgcggcccgtccggggtgccaaaagacggcagcggcgggaggggggaggggtggcccgggtgcggtgtgccgtcgactccgccggagttgggccgggcgccgtactcccgccgtcgcggatgacgggcgcgtgaggagaccgcaccgccggccgtggtcgagggggagcagcagctgccgcgaggtggccgagcccgtcgtgggcgctccgctcagcgcggcaccgtgggcccgacccgttcggcgaactgggagacttgggcaggtgagcaccacccgccgcccgttgggcaccggaccccgcaccgccgaggagcagtcgccaattggcgaccagcgcgaacgcggcaggacagcagcagagcgggcagccgtcgagccgcccgccctggccgtcgagaacgaggtggtggaggcgcggccgccgggccgccgcccgttgggcaccgggggcgcccgcttctagttttgctccctcatttgagggccgatttatggaacttccccaggtcagatggggtaacagtcgcccggactgttaccgcgatcctgggggaagcgcccgacgccggcgggccgttcgctccggccgggaagggacgtccgcacggtcgacccgtaccgaggtgggcccctcgtccggctggacatcgagcaccaggcgcaggcccccgccgcggtgcgtgagccgggtcggctcaccggcctgcagcgcggtgcacgcctgcagaagcggcagcaggatctccaccacccgctcgccccgctcccgatcgtccgtcatgaccctgatctgcaccatgaggtgaacccccttctcagtcgaccgaggaggccacgggcgcggccatctcacggagtcggtcgagcaccgcccggacgtcgcccagagcacggtggccgccgccgagcgcctgccagctgtagttgccccagtagtccgaccagtcgccgtaccagttcgagtacggcaccatcgcgtcctccagcgtcatgccgtcgagccaggccgccgccgacgccgccgggtcctcgtgaccggccgcccggtagtgccgggtcagctcccagcgcaacacccccttgtcgtacggggcgttccagatcaggcaccgccgcccgtcgagcgcggccgtgaggccgacgaggatctgcccgaacgagggcgacgtggccaccgcctcgtccgtgatgccgtggatctccgaggcgtccgccgggatcggccgcccggggttgaccagggtgtccaccaggacgtccccggagccggagatgaccgcgagttccaccacgcacgcgtccgcgtcgagccccgtcgtctccgtgtcgaggaccaccagggtctcgtccgcgagcgcggccgccgcccactcctgtagttcgagcacccgccggcgccgggcctcccgttcagcctcccgagcctccaccgcccgctgttgggcttccgcccgctcccgtgcgtcgcgttcctcgcacgacgagcaccaccgcggccgccagtacccgtacgggttcgcctcccgccagcggcgcaccgccgccttggtggccgtcttcaccgagcagccccgcccggggcaggtgatggagtacagggccgcctcagccttccgggcccgttcctccgcgagctgggcacggcggcagtcgccgcaccggttgtgcgtcttcgggtacggacgctcgcgtaccgtcccgcagccccagcacgtccgggcccgctcgcgctcccgggccagctgtgccttgtgccagcagtgcgagcaggggcggccgttcaaccggtgctcgcgcaccttgccgcactccgggcaggtccgggccgcctccatgcgcttcttgaccgccgaggacagcggccgcatcttcacggcggccgccgggtcgtacaacggcacctccaggtcgtgcttgcggaggtagaggtacgcgaggacgggctgaccgtccgccagcttcagccgggcctggcctagttgtgtctgcgtttggaggtaggccggcgcctgcccccaccggtagacgggcaccccgtccgtgaagccgtagggctccccgcgcggcacccgatccggggcctgatctgcgctttcacgactggccgggacaaccgtccccgccgtgcgtgccgtcgttgccgtgctcacccgtacctcccgaggacagtccgccggaattcccgacgctagcatttatagaccccattcgaagcgtttttcaaactccgccattcgaggaaatcgaaaagaccggagggcgcttagaactgtgcgcgcgaagccggattctcttaaaggagatccttttaattcaccggccgtggccgtcactcgttcgagtgggggccgtacgtggccagggcctcccggatgatccgggcgggcgggtagagcaggcgcgcgagttcgtcgcgacgggtcttctgttcctctgtcagccgcagcccggagccgaccaggccgagttcgtacagccgggccaggggcttctccgagactcgccacgaggcggtgcgcagctgcagagcgaggtccgccggaaaggcgtagttccgctgaaccagcgtgattcccgcactcgcgccgggccagcggccggacagcgcgaggcggtcgaggtccgattgcgtgagtgccgcccacgggcccgccaggtcctcgtccgccaggcgccggcggaccgcctcacccacgacgacctccagcgcaggccagtgctccggacgcatacgcgcgacctgtacgcgagcgtcacgcggccgaatgccggacgccaccagctcccgcacggtctccttttcctccaaccgccgccgcttatcgagcagcgcgagagcgcccgcttgggacgcggtgatccaggcagtaacgccgattttctccatgcgctgattctaaaggagatcctttccgcgagcgccccgcgcacggctgcattaaaaggatctccttttgtcgagcgcgccccgcttcactaaacgatcttgtaagggctgtcagccaggaaggcccaggtcgtccaggggcgccccggcggcccaccgctgcagctggcgaccgtcgagcaggtggaccccgccctggcgggaggcccacagcacatcggcgcggctgtacgagcccctgctgaccaccactcgaatcaggttgtcgatccccgggcggcccgcctcccgcaggggagcgggaccggtcggcgcgtcctcgtccgccgcctcgtccgccgggcggaacccgacgtcgagttggcggccgccgcggtcgcgggcgtacaggcggggccgcccctcgtccggcatcgcgatgacgtgccagccgtcgcggcgcagcatccgttcggcggccgccgccaggccgtggtcatcgagcacgccgagttcggtcgaggtgtagatgccgccgcgccggcgggccgccgcgcggcgccaccgcacgcccaccgccgtggcggccgcgagcagaacgacgcccagcaccaggccgccgacgccgagggcacggtgcagccagacgaggaggaccagcggggccgccgcggcgaaggcgaggccgacgaacgcgggcagcacgtcgcgcagttcggggccgtatcgcccctgtgcccgcagctctgcgaccgctcgttgtctctgcgagcgacgcgacccgggtacgggaggtcgtctccaccacagctccacctgggtcaactccccatcaccgcccgccgttcgtccctgcccgtagagatacccgcttgtgggagtctcccgccaaccgggacggagaccggccaggaactggccggacgggatgcggcgaaccgcttgcgccgcttgttggggaacccctacagtcaagagtgttggggaaccccaacaccgacgaagggaaccgctcatgacgacccctcagcaccgccccctcccgtccccggtggacgagcccatggccgtgagccggccgggcatggagccctgggagacctccggccggaccgcccactggccggacggagtgggcacgtacacgctcgtgtttcacggcaacaagcagtggagcatcgcggacgaggcggacagcgccatcctggccatggacgcgatccaggccgggaaccccaacctcggggaggagttcatctacgcgaacctgcgggacatccggcgcctgaagcagcgactgaccgccatcgaggaggagctgttgctgatggcccgcgagcccgacgacgccggggacaaggtgtcgtggcgcgacctgggcgagggactgggacagcaccacaccacggtgaaggagcggcacgaccgcatcgcggagggcggcacccacagcttccgccgctggctcaccgagaacaccccccgcgccgacctctacccgaccaactgaagggcgaccaccaccgtgagcaccgacgcgtacaaggacttccaggccctccaggtccggcgacccgacgacctcccgccggccacccccttgacctggcaggcggagaagcactcccagcacgccgagcgactgtcgaaccgccgcctgcccgctgacttcccgtacgaggtcgagcgcggcaccgcgggtgacgcgctcgcgcagctggcactgggggaggccatccggcgcaccgccctgaactaccggcccagcaccctgcacgaggccctggaactgggggcgacctggcaggaggtggcggccgcgctggactgcaccccggacgaggcgcgcgacgtgctccggtcgtacgcggacggacagcgccgcctctacgagggcgacgagcgcgaggggcggaagccgatcgggttcaccgccgagcagcaccgggccgcgctcgcactcaccgagctggccgacgacgagtcggcggccgccgaggaggaccggtgatccgagacgccgtgacgtgcgaccgcgacgggtgcgtcgcgctgttcctggaaccggtggacgacccgtacgcgctggacaccgacgagttcgaggacgtcatgaagcgcgccgggtggacctacggcgacgacgggcaccggtgccccggatgcgtccggggcacgggtccggtgttggaactgggggaatgcccgcgctgcaccgggacgacggtcgaccttccggcgggggcgacgtgccactactgcgggcacgtcgagccgcacccgaaggaggagtggtgatcctgcgagccatccgccggcggcgcgaacgcctggccgccgaacagcaggcccggcacttccaggctcaggtgcagcaggccacggacatggccatcaccgcggcggtgcgggcccgcctctccgaacccgtgacagacatccacatcacctggccgttacgggtcacggtgggcgacgtcctcacggccgcgcgggaacacttcgccctggaggtcaccgaggccgacgccgccgcgatgctccggcaccgcctggaatggcgggggcacgcgggatggggcgacctcgtgactgacgcctacgagtacgacgactgaccgaccctcagcaccccgaccggccgccgctggaactcgcgttccagcggcggccgttgtcgttccagtccgctcgaacccctcccgccttatagcgtgttcacgctacgatctgagacatgccgactcaagagggaacccggatcacgaccgcgctggaagcgacttgggccgcgttccagaagcaccaccccgaccttccagacgtcgtgatgatcaccggcacgggtacgcaggggcggaacaagaagcggccgtcctgggggcaccacacggcggaccggtggctggacgcggcggccggcggccgccgggcggagctgttcatctccggcgaggccatcgccgtgggcgggcagatggtggtggagaccgcgctgcacgaggccgcgcacgcgctcgcggccgcccggggcatccgggacacctcgtgtgcgggccgctggcacaaccgcaagttcgcggccctggccgaggagctggggctggagccgccgaagcgggcggagaaggtcatcggcttctcggaggccctgatcaccgccgccacggtcagccggtactcgtccgtcatcaggaagttggatgccgccgccctggcccggatcgaggcccccgacgaggacaaggaccaggagcaggacgaggacgggaagaaggagggcccgc

SEQ ID NO: 2807 - DNA, 975 bp, Unknown
  Kingdom: Bacteria, Phylum: Actinobacteria, Class: Actinobacteria, Order: Streptomycetales, Family: Streptomycetaceae, Genus: Streptomyces
tccaaccatgcccggccggacgcccgctcattacccatcggttacccagctccggccgggcatggttggatgcgaaagcagagcggatgacgagggtgtccagtcgggacaggcgggaatcgtgaggatcttcgggaaggtacggcatcggccgtccgcctcttggcggcaggccacggaccgcgcgttcacgctgatcggcgacggccggtacgaggacgcgggggcgctgctgacgcgggcggcggatctggagccctggctctcggagtcctggttcaatctggcgctgctgcacaagttccggcacgactgggagcaggcaagggcggcgggcctgcgggccgtcgcgctgctcgaccgggagtcgggcgccccggactggtggaacgtagggatcgcggccaccgccctccaggactggccgctggcgcggcgggcctggcaggcgtacggactgaaggtccccggcggcggtcagcacagcgcggccaccaccgagccgaccggtatggagctgggcagcgccgccgtgcggctctcgccggagggcgaggccgaggtggtctggggccgccggctcgacccggcccggatcgaggtgctctcgatcccgctgccgtcctccgggcggcgctggggcgaggtcgtgctgcacgacggggtgcccaacggagagcgggtcaccgcggccgggccctcctatccggtgttcgacgagatcgagctgtgggccccctcgccggtgccgacctgggtggtgctgctggaggcggcgaccgaggacgaccgggacgcgctggagaagctggcatcggacgccgggttcgccgccgaggactggtcctcctccgtacggctgttgtgccgggcgtgctcggagagccggatggagagcgacgagggcgacggggagcacctggacccgcacgatcacagtgagccgggccaccccgggccgctgggccaccgcac

SEQ ID NO: 2808 - DNA, 3828 bp, Unknown
  Kingdom: Bacteria, Phylum: Actinobacteria, Class: Actinobacteria, Order: Streptomycetales, Family: Streptomycetaceae, Genus: Streptomyces
ggccgaaccggtcggccagccaccccatcaccggggagaacgcgtacatgcccgcgatgtgcccgctgatgacgagcccgatcaactggagtccggcgccgtgccggcccaggtcgaccggggtcatgaccatgatcgacaccatggcggtgtgcgacacggtgaccgtcagcagggcgagccgcgccatcggcgactcccggacggccccgatcccggcgcgcagtgagcgcttcggggatgccgtcgggccctccggggccagggcgcgggcggtgaggagcggatccgggcgcagtgcgagggtcacgaccagtccggcgacgaggaacacggcggccgagcacagatacggcccggcggcctcgggcaccggcgtaccgcggaacagccggctcgccggagccgagatgttggggcccaccaccgagccgatcgtggtggcccagacgacggtggagatcgcccgcccccgccgctccggccccaccaggtcggccgccgcgaaccgggcctggagaccggccagggacccggcgccgaacgcggccatgccgagcagcagcagcggaaagctgggcagcatcgtggccaggaccaccaggccaccgcccagcgcaccgatcagataggcgagcgcgaggccggaccggcggccccgggcgttcatcagggcggccagcggcagcgacagcagcgccgtgccgacgacggaggcggtgggcgccagcccggacagcgcctccgacccgctcacctcggcggccagcatcggggccagggcgatgccgacggccacgccgaggccaccgagtatctggctgacgatgagcacggctgacgtccggcgctggagagcgggcaggccggcagccgtgacctgggggagggagaggggtcgcgtcaccggcgcagtgtgtcaccgctcggccgccgctgtgcacccggacgggtgaacggaccctgttccggagcagtgctcgccgcaggccccagccggcgtcaaacggccgactgtcgggcgacgacggcagtttgacgacagtccctgcggacacgacctagaacagcggctgcggcaggaacccctccagcgccagcagctgccgcttggtctccagaccgccgccgaacccgcccaggccgccgtcgctctccaccacccggtgacacggcaccaccaccggcagcgggttggcccccatggccgcgcccactgcctgcgccccctccggccggccgacccgagcggccagctccccgtacccgacgaccgtcccgtagggcaccccggacgccagctcgcggagcacctcacggtggaacccggcggtcagcgaccagtccagatcgaggtcgaaatcctgctgctcgcccgcgaaatacgccgcgagcccgcgtatcggctcggcgagccgcgcggagccgggcgcctccaccggctccgcgccgaaccgggtccgcaaccggtcgaggaccgcgtcccgcacggcggggcgggcgtggaaggacacactcaccagaccggccccggtcgcggcgagcagcagcgggccgatgtcgctgtccacgacggtccactcgacggccggctcggcaccggtcccgtagctgttcatgccgaccacggtacgacccgccactgacagcggcgggcccgccggcggacaactggcgggcccgtcggcgggaaaccgacaggcccgtcggcgggaaaccgaccggcccgccccctgccgcgtcagctcgtcgcgtcgcgcaccacgtcggggaagttggtgatgatgccgtcgaccccgtagtcacgggccttcaccgcgtccgccgccttgttgaccgtccacgtgttcacccgcagacgcttgccgtgcgggcccttgagccgctggacggccgccacgtagtcggcgccgatcgtcgcgtacgaggggttgatctgatcggtgaacgccgcgtacgagggcagatcggccaccgccggagtgcccaggaagccggtcgtgatgtcgggacgcagactgtgcaccttcttcacgctgtcggcgccgaagctctggatgaccagccggctccgtacgtgggagcggtccagccaccccgaccgccccaggacctggatgatgtcccgctcgatgcccgggtaggtcgccgggctcttgatctccaggagcagcttctgccggttgcgctccatgcggtgcaggaactgggtgagggtcggcacccgggccccggtgaactgcgttccgaaccagctgcccgcgtcgagtttcgccagctccgccgcggtgaagtccttgaccgcccacggcgcccggtcggggaagacctgctcggcgtccgtcgtgcgcttcaggtcggtgtcgtgcagcacgacgagcacgccgtcgcgggtgcggtggacgtcgttctcgacccactcgatgccgagcgcgtccgcggcgtcgacggcggcgagggtgttctccggcgcgtagcccgatgccccccggtgcgccacgacgaccggggcgtcctgccgctccggagcctcgggccggtcggcgggcagcagcagggcgccggcgccgagcagggcggcggccgtggtggaggcggttgcggtgcggacgaacacggtgactcctcacgtcgggagtgtgcggacacgcagagagtgacagcggcccgccaacgcccggcggggcggcgatggccgcgaaatgaacggaaccttcggtcccggggccaccgccggagcagggcacgcgggcgtgccgataaaatgtgctttctttgtctgcctgccgggactcgccccttggggactctcctcgaccccgggctttctcgaagggcgtacgcgcatgcaaggaacagtcgacggtttcacctacggcctggtgactccggtcgcggcgttcctcatggccgccctgggagccgccctcgggctccgctgcaccacccggtcccttcacgcctcacgctcctggcgggccggctggctggcgctggggtcgctgtccatcggctccggggtgtggaccatgcacttcgtcgcgatgacgggcttcacggtccaggaggctccgatctcctacgacaaacccctcaccttcgcaggtctggccgtggccgtggtgatggtcggcatcggcattttcattgtcgggtaccggggcgcgacccgcatggcgttgatcacgggaggcaccatcaccggtctcggcatcgcctcgatgcactatctcggcatggcgggcatgcgcatggacgcacggttcgcgtacgacacccccctcgtcgtcctctcggtgctgatcgccgggtgcgccgccacgggcgccctctgggcggccgtcaccctccgtggagccctctccggcctcggcgcgagcatcctgatggccgtcgcggtcacggggatgcactacaccggcatggccgcgctcgacgtgcacctgcacctgccgcccaccctgccgcccgacctggccgacgtcctgccgggcgaccggcccgccgaggtgatcggcccgatgctggccggccccgcctgcttcctgctcctcgccgccgtggtgctcctgttcgacccgggccgtgacgggcgacccggccccggacccgcgggccgggcggcgcccccggagcaccgtgggaggggctcggcaccgttgatccggggccgttgtcagtggcgagccgtacggtggttgcatgcggcccgtttccaagatcgaacgttcggtggcgcccttcgaggtcgtcagtccctaccagcccagcggagaccagccggcggccatcgccgagctggagcggcgtatccgcgcggatgagaag

SEQ ID NO: 2809 - DNA, 3300 bp, Unknown
  Kingdom: Bacteria, Phylum: Actinobacteria, Class: Actinobacteria, Order: Streptomycetales, Family: Streptomycetaceae, Genus: Streptomyces
gcgggcggcggcccgggtgatcgatccggcctccgcgaccgccacgagcgccgcgagccgtgtggggtcgtacatgaagcgttcctttaggcagacccagaagattgcaagtacacgctaaaggctccgccggtccaaggtggacccatggacgcacaactgatcgccttcaccggggtcgccgccggtatggtcgcgctgcccggcgccgacttcaccgtcgtcgtacgcaacgccctggcctcgcgcaccgcgggtctggccaccgcgctcggcgtcgccggagggctgctggtgcacaccgcgctcgcggtcgccggactcgccgcggtgctggtgaccatgccggtgctcttccgcaccgtccagctgctcggcggcgcctatgtgctgtacctcgggatcagcgcgctgtacgcgatccgccgccggccctcgcaggacggctccggctcaccctccggtacgcgggagggcgagccggcgcggcccgtgcccagggagttcgggcgcgcgctgcgccaggggttcctgaccaacgcgctcaacccgaaggccccggtcctcttcctcagcctgctgccgcagttcgtgccccacggccagccgccgctgccccggacgctgctgctcgcggccctcgtggtggtgctggcgctgatctggttcccggccgtcgccctgctcgtggaccgcctgggccggtggctgcgccgcccgcgtaccgcccgcgccatcgagggcggcagcggtgtggcgctcaccggtctgggactggcactggtcaccggcccgctgctgcgctgaggacgccgcgggcggccccggaggaggcccgggccgcccgcacgggaagagcgtccggccggtgggtcagcggacccgtccgtaccagacgctcttggaccagattttggccagtctcaccacgtcccccgatctgggggagtgccagatcttcccggccccggcgtagatgcccacgtggtagacgctgcgccccgaatggaagaagacgaggtcgccgcgtttgcgctgcgacttcccgatatggcgggtcttgttgtactgctgctgtgccgtgcggggaagcttcttcccggccttcttgaacgagtagaccgtcagccccgaacagtcgaagcggctggggccggccgctccgtacttgtagggagcccccttcttcgacgcggcgaccttcagcgccttcgtcgagtgggtggcggcctcggcgtcgctcaccagaccgggcgccagcatcgtggacgtcacggccagggtgagtaccgaggccgtaccgacccgggcgaacagagacgggacatgaacctgcgcagacatgcgcaacccttcgtcagccgcctgtgaaggatgacctgtcgggttcgggctggcgaagttgcccggccgcgtcgcggcttcaccccgagggcttcccggtctcccggtcggcccgttgcgctcgggtcctccactcctgccgatccactcctgtcgaccagtcatccgggcggcggcaggactcggcgtccgcccggaccgccccgccgcggtggcgggggcttgtcgtcccagggatcttgactcactcggtgccggatttccgagctgaaacggcggtttgtgagtctcctcaccactgatccattcgggtggacaggtcggattcgcgctcgtccgcgagctgggcgcacaccctcgtaccagcgacgaaagggaacatttcgagtacggaccgcgcgccgaacgcaagttgggccgtcgctcgcgcgggtgatctcctacgccgaacgagcgaggcgaatcggtcccgggaccgggcgtgtcgtgcgcggggccgaccggcccgctcccgtatggcgctccccgtgcgcggaggcggtcagttcacgggcggcggcatcgcgatccggcccgcccggcgctccccgtccaggacgcgcagggcccgcgccagggtcgtggcgtggatccgcgactcgccgcgctcgtgcatcagcgccagggcgtcgcgcagggccgtcgcccgggaggccagggcctgggcggcccgcagcgcgctgtaggtgtcgctgccgtgggccgggttgatccggcccacctggtcgagcacggccagatagcagtcgacgaactcgccctcggcgcgggtcagtgcgggcaggggcgggaaatcggatagctccatcggcgtttcacctcgcgtcgtacggcggccgggagagtcagcggttctccatgacgtggtcgaccagcccgtagtcgagggcggccttggcgtcgaggatggtgtcgcgctcgatgtcggcggtgatctgctccgcggtccggcccgtgtcccggaccagcatggccgcgaacatctcgcgggtgcgcaccagttcgcgcgcgtggatctccaggtcggacggctggccccgcatcggctcctccatcgcgggctgctggatgactacccgcgcgccgggcagcgcatgtcgacgaccctttgccccggccgccagcagggccgccgcgtaggaacccgcctgtcccaggcagaaggtctccacgtcgcaggtcaggaaccgcatcgtgtcgtagaccgccgccatcgcgtggaacgtgccgccgggagagttgatgtagagcgacaggggccggtccggatccgcgtgctccaggtacatgaactgggcgatgaggtcgctcgcggcgatgtcgtcgatcgggctcccgaggaagacgatccgctcggacagcagcttggagtacgggtccagagtccgggttccggtcgcggtgcgctcggtgaactccggaagtacgtagcgggcggcgggacggatcatggcggtgcctctctcctggagctgaccatccgtctgcccgtccgtaaaaaatgtacaggacgtacagaaggttatgatggggactatggcctacgagattccggtgacgcaagcgcgagcggagctagccgaactgatcaaccgcgttgtctacggcggtgaacgcgtagtggtgacgcggcacggcaagccgctcatcgcgctggtttccgccgctgacctgcaacgactcgaagaggatgagtccgctgccgaggagcaggtgatcagctcggtctcctcgatcggatccccgtcatccgctcagggcgaacggcgcaggttcggcatcgccgccgagcaccgcccgcacgacggtcgggacgcctgagaccccgagcgccccgagacagcgcggagccgggcgcccctcccgcaggaggggcgcccggctcggccgacgcggatccggagctcagccggtcag

SEQ ID NO: 2810 - DNA, 10730 bp, Unknown
  Kingdom: Bacteria, Phylum: Actinobacteria, Class: Actinobacteria, Order: Streptomycetales, Family: Streptomycetaceae, Genus: Streptomyces
cgccgagctcggcgcccccgccgcgatccgcctctacggcagggccctcgtcctgccccacctcaccgatcccgagcacgacgaagggaccaccgcatgaagcccgccagccaccacctcgcccgctgccgccgctgcagcgccccgatcgtctggtgcctcacctccgccaacggccgccgtcagccggtcaacgccgtgccggacaaggctgggaacgtcgccgtgatgcagggcgccgacggtctgctgtacgtccgcaccgtcaccgccgcccgcccggagatccggcccggcgagtggcaggccatgccgcatcacgccacctgcccgtccccgccgccgaggcgcagcagcgcgccgacgccgcgggcggtgcgggaagtgcggccggtcccgtggcagcggtgaacccggcggtcgtcgccgcccgggacgtgtccgcgctcctcgatgagcagtggcccgacgggacgttcggcggcgtgcgtctggtccccggcgtcccgtccgacccgatccgctgcccgcgctccgatcccgaggccgcggcccacgtcgcgctcctcgtcaaagaactcgacctacgccgggccccggtccgccggccccgagaggactccgcatgatctccgcccgcctccggtacacctcggtctccctgctcgccctggccttcctcgtcagtgggctgctctgggcacaggcaggcatctggcccggcgccctgatgtgcctggtcctcacctgcggctgtctcctcggctgcgcccgaatacggcgcaccgccgagcgccgccaggaggagcaggagctcgagctcgctctcctcatcccggacccgtggcccgaaccgtgggccgactggtgctgcgagcgcgggttcatcacccgcggcgacctccaccaccccacccgctgcaccacggtggtgggcccgtgaccgccgcaccgttcgcccggcccttccgactggtccagcggcacggcccagcccttgacggagcggagttccccaacggccgggtcgtcctgatggatgacccggactggggactctgcaccggcgcccgctccctggacctcctgctgcgccacggctaccccgacgcccgcatcgagtgggccgatccctccgctgccgacgcgcagcccgacgccgacaacgtccccgcaggccccgttccctgacccgccgcaccacccggagcgccaccatgaccgacacctgcctctcctgccacggccgcctgcccgaccactccccgcgtacgggctgcgaggcatgccagtacagcgtccacacctggctccgcgagctcccccgccacctggtgctcctgcaggacatgctgcgccccgacaccggacccgcccggcgcggcggcatcggccgcgcccacgccccgctcccgatccgcctcgaggtcctcgacctcaccggccccggccagcccgtgctcctggacgacccgcacggcgaccagaccggcggcatccccatgacgccgctgctgatgggttgggcgcggtacctcgccgccgactacccagcgatccgcaccgacgcccacggcaccgtccacatcgagcggtgcgacggtgcccgggtgcggaccggcgccgacgtccccgggctctgcaggtggctcgacgcctacctcccgtacgccgcgacccgcccgtggtgggacgccctgcatgaccaggtcgagcagctgctccaccgggtccgccggctcacccacacccggcccgtcacccgaccccgggacgccccgtgcccgagctgctcggcctggtcgcttgtcgagcgcgaggacgagctgcacatcacatgcacgctctgccccgtccgcctcaccccggcgcagtacgacgagcaccgcgcccaggtcatgcccgcactcgccaccctcgccctccgcatcgccgccacccagcaggccgccgcctgaccgccgtacgcttccgaacgtggctgcgccccctgctcaactcccatgagcagggggcgcagtgctgcgtgcggtcagtcttcgtccggggcggagaggtcgttgcgtcgcccctgggtgatgcccttctgccgctcggcccagtaggcgtcgaaccagtcgacggggtactccggtcggctgctgcccgggcggaaggcgggagctggccacttctcggccgggttggtggccagccggtggatcagagtgcggctgcggccgacgcgctcggccagcttcgggatggtcatggtcaccggctcctgctctggcccttcgggaggtgcgggcatggggccatcctctccgagaagtgtggacaatgtccacacttctcgctacggtcgtactcgccaacagaacggccccggccaatggcgttgcgaccgcccggccggggccggtcacccacctgcttcaccaggaggacgaccatgcgcgatcgtagccgcgccaccatcgcactggcattaccgcccgtctccgacgccgacgaggcgctgcagcgcgcccgtaccgcgatgaccgccgagacccgcaccctgatggaggacatcggccgcgccctgtgcgcgatcgaaccctccctcgtcatgcgggaggtcacccgcctcgcgtacgccggccgcgcggccgccgacgtccacggcctcggcaccccgcgcgccgtcgccgtcacccgtctcctgctgcgccacatgccgcgcgtcgactggcccgagccgcccgcgccgctcacccgcgccgagtacgggatgcgcctcatccggaaggctggccgctgatggccgccgaggagatcccggaggtcagcccgtacaccgccgcccgggtctaccaggccgggcaggccgccgccctccagggccgccgcccctccaccgccgagacccgcactcagctcggctccgcccgcacctcgggcaacgcctccgccaccacccgctgaaccgcccggccgggcgcacccgctgcgcccggccggccacgcccccggagcaccccatgcgcttcctgtacctgctcgccttcgtctgggcggtcgccctcccgaccttcctgatcgcgagggccctcggatgacccgcacccgcaccgtcgagcgcagccgcctcgtcccgcacaccatcgacggcaccacccacctcgtcctcgaccgctacaaggtcgacgtcccgcagcctccgcgcgactgggaccgcgttgtgctgaccggggtcaccgcggctgccgccgtgatcggcgtcgcctcgatcatctggtcgaccgcgagcatcggcagcctccttgacctggtcgtccccctcaccgccgccgcgtacgccgccgccctggtcttcgacctcgtgtggctgtcctgcatggccctggagtggctcgcccgctacgaccaggagcgcgccgccctcccgcgccgcgccgggtacatggccctcggcatcgccatgggcgcggtcggcgcccacggctggatctccggcgagttcgcgatcggctgcgtcgccgcaacggtgtccggcctcgccaaggtcatgtggaccgtcgtgctgcgccaccacgccaagcctctcgacagccacacccagcagtgggtcgacgccgagcgcgcgaaggcgggcggccgcctcgcgatggtctccgtccgccgcgagctcacccgcgccgagcaggccgtcgccgccggggccgtcctggtcaacgacgtcagcggcggcctcgccgacccggacatgatcccggccgtcgccgccgccggggtcccgttcgtcgtgatgcactggcgcggcttcagcgagtcgatgaacagccgcgccgtgtacgaggacgtggtcgccgaggtcctcgacgagctgcggcagcggatggacgcggtgatcgcgggcggcgtcgcccccgagcgcatcgtgatcgaccccggcctcggcttcgcgaaggacgccgcccacgacctgtcgctcgtcgcgcacctggccgagctgcgcaccctgggccgcccgctgctggtggccgcctcacgcaaacgtttcctcggacacgtcctggccgggccgggctcggccccgccgcccgcccgcgaacgcgatgcggcgaccgcggccgtctccgcgctgtccgcgtcggccggagcctgggcggtccgggtccacgaggtacgggcaaccgccgacgccgtccgcgtcgcccgcgcggtcgagggagccgcgtgaacgaggaacacgcacaggccgccgccgacatcgcggaggtcgaggcggccaacaccgccttctacgaggcgctggaacgcggcgactacgacgagctctccggccggtggctgccgggcgaggacctcaccgtctcctgcgtccaccccggctggccggtgctcacgggccggggtgacgtgctgcgcagctacgccctgatcatggcgaacaccgagtacatccagttcttcctcaccgacgtcaacgtctcgatgaccggcgacaccgcgctggtcacctgcaccgagaacatcctcagcgggggacccgccgaggagggcaacgcgctgggcccgctcgtgggccagctggtcgtcgccacgaacgtgttccggcgcaccgccgacggctggaaactctggtcccaccacgggtcgcccgtcctgagcgattccgatgaggacgacgacgaggaaacaccctcctgagtgggtacgggaccggtagggattggaaccgaggaccaccgggtatgggcggctaccagcccggtgaggcgctgtccatggcccccacgggcgagcactgtcggtgctcgcaggtagattcgaaagaaggcacctcgccgcccgcacgcggccgggtgcctctcgaccaacgacagcaggagtgattcgcgtggatcgtgtcgcgctgcgcggcctcaaggcccgtgggcaccacggtgtcttcccccgggaacgggaagagggccagaccttcatcgtcgacctggtgctcggcctcgacacccgtcccgcggcagccaccgacgacctggcccgcaccgtgcactacggcgtggtggccgaggaggtcgtcgacgtggtgaccggcgaaccggtggatctgatcgagacgctcgccgagcgcatcgcccagcagtgcctgaagcacgaaggcgtccaggaggtcgaggtcgtggtgcacaagccggacgctccgatcaccgtccccttcgacgacgtgaccatcaccatcacccggagccgagcatgactgcattttccaccgaagggcagagcgacccgaccgtacagccggttccgaccgccgtcgtccggcaggtggacgccgccgacgtcacgctctccaaccccaagatggccgtgatctctctcggctccaacctgggcaaccgcctggagaccctccagggggccgtcgacgccctggaggacaccccgggcctccgggtcaaggccgtctccccggtgtacgagacggagccctggggcgtcgaggcgaactcccagccctcgtacttcaacgcggtcatcctcgtgaagacgacgctgcctcccgcctccctgctggaacgcggccaggccgtcgaggaggccttcgaccgggtccgcgaggagcgctggggtccgcgcaccatcgacgtcgacatcgtggcgtacgccgacgtcctctccgacgacccggtgctcacgctcccccacccgcgcgcccacgagcgggccttcgtcctcgctccctggcacgacatcgaccccgaggcgcagctgcccggcgccggcccggtggcccagctcctcgccgaggtcggccgcgacagcgtccttccccgcgccgacctggaactgcgcctgccggagtaatcgttaggctcgacggacggtggtccggcgcacgaccggaccggacacaggcggcgcgaagggcggcacactcggtgaagcaactacggctcggggtactggcgggcctcttcgccgccgccggtgtcctctcctggggtggggcccgtctctgggacgccctcggcaccctgccgagcgtcccgctggccgcgtcgatcgtgctcgccgtgatcgcggcgatcctcctcgcgaccgccctctccacccgcacccgtctccgcgcccagcgcgagcgccgccccggcgccaagggcgtcgagcccctgttcgcggcccgcgcggtcgtcttcggccaggcgagcgccctggtcgccgccctggtcgccggcgtgtacggcggcaccggcgtcttcctcctgagctacctcgacatcccgccccgccgcgaccaggcgatctacgcgggcgcggcggtggtggccggcatcgcggtcatcgcggccgcgctcttcctggaacgcgtctgccgcctcccggagaacggcaacgaccacgacggcacgggcgcggcagccgcgtagggcggtcgccacgcccgtatcgcgtgttccgggcttgccccggaggtccgtgaggctagcgggccatgatgaggctcatcgcctcggcgcgggtcgcggggtccctgagctggccgcgtacggctgaggtgagggtcttcgccccgggcttgcggatgccccgcatggacatgcacatgtgctcgcactcgacgacgacgatgactccgcgcggctccaggatcgacatgagggactcggcgatctgggtcgtcagccgctcctggacctgcgggcggcgggcgtagacgtcgaccagccgggcgagcttggacaggccggtgatcttgccggtggaggcggggatgtagccgacgtgcgcgacgcccctgaacggcaccagatgatgttcacaggtcgagaacacctcgatgtccttgaccagcaccatctcgtcgtggcccaggtcgaacgtggtcgtcaggacgtcctcgggctcctggtagaggcccgcgaatatctccttgtacgcccgcgccacccgacccggcgtctcccgcaggccctcgcggtccgggtcctctccgacggcgatcagcagttcgcgtacggccgcctcggcccgcttctcgtcgaattcgccgatcgaaccctggccgtccagcgtcaccgggtcggtcatctgtgcctcgttcctctgtgctgtcccgtgcgcgggttcgcgctcagacctcgcaggcatacggaaaagccgcgcccccacaggctaaaacctggggggcgcggcatccattccgggaccgggtcggcccccgtgacgggggtctcaccggcgtcggtccggggctagctctcgggacgctcctcggggatcgcctcggtggacggggcgatgtccttcgtcaggtccgtcggggcgatctccggcggggtggccgagccgttggcgatcgatgcgccgttggtgagggccagctccttgggagagagcaccgggggccgcgtcgacggggtacgtcgggcggatccggtccatgccgggcgggcgggacgcctgacgagcggggcgaagatctccgcgatctcgtccttgcccagcgtctccttctccagcagttcgagcaccagggcgtcgaggatgtcgcggttctcgacgaggatctcccacgcgtcgttgtgggcggtctcgatgagcttcttgacctcctcgtcgaccagtgccgcgacctcttccgagtagtcgcgctggtggcccatctcgcggcccaggaagggctccgagttgtcgccgccgaacttgatcgcgccgagacgctccgtcatgccgtactgcgtgaccatcgcgcgggccgtcgccgtggccttctcgatgtcgttcgcagcgccggtggtcgggtcgtggaagaccagctcctcggccgcacgcccgcccagcatgtacgccagctggtcgagcatctcgttgcgggtcgtggagtacttgtcctcttccgggagcaccatcgtgtaaccgagggcacggccgcgggagaggatcgtgatcttgtggaccgggtccgactggggggaggccgccgcgaccagggcgtgtccgccctcgtggtacgcggtgatcttcttttccttctcggacatgatccgggtccgcttctgcggacccgccacgacgcggtcgatggcctcgtcgaggctctcgttgtcgatgagcttcttgttgccgcgcgccgtcaggagcgcggcctcgttgagcacgttcgacaggtcggcaccggtgaagccgggcgtgcgccgggcgacggcgccgaggtcgacgccctccgccacgggcttgcccttctggtgcaccttgaggatctccaggcgcccctgcatgtccgggcggtcgaccgcgatctgccggtcgaagcgtcccgggcgcagcagcgccgggtcgaggatgtccgggcggttcgtggcggcgatcaggatgacgccgcccttcacgtcgaacccgtccatctcgacgagcagctggttgagcgtctgctcgcgctcgtcgtgaccgccgcccatgccggcgccgcggtggcggccgacggcgtcgatctcgtcgacgaagacgatcgccggagcgttcgccttggcctgctcgaagaggtcacgcacacgggaggcgccgacgccgacgaacatctcgacgaagtcggaaccggagatcgagtagaacggcacgcccgcttcgccggcgacggcgcgcgcgagcagcgtcttgcccgtaccgggcggcccgtagagcaggacgcccttggggatcttggcgccgacggcctggaacttcgccggctcctggaggaactccttgatctcgtggagttcctcgaccgcttcgtcggaccccgccacatcggcgaaggtcgtcttgggggtgtccttggtgatcagcttggccttggacttgccgaactgcatgaccttggaaccgccgccctgcatctgattcatcagaaacaggaagacgaccacgatgaggacgaagggcagcagcgagaggaggatcgagacgaacggggactgcttcgacggcgagacggtgtaacccttctcgatgtcacccgcctcgaacttctgctgcagcgtgtcggcgagctcgacgccctggttgccgatgtagctcgcctggaacttgctgccggactcgccttcgagcttctggccgtccttcagttcgatcttgaggatttgttcgtcaccggtggtcagcttggcctgctccacctggtccttgctgatcgcctggatcaccttgccggtgtccaccgtcttgtagccgcccgacgagccgacgacctgcatcaacacgaccacggcgaggacggccagcacgatccacatgaccggcccacggaagtatcgcttcacgtccatccatacggagcgaagacgccccgtccctcctgcccgtaggtaaatgctgctgtttgaaaagactgtttgaaaagactgttcttcggacggtaccccagcatcgtcacccgcgactgccgggtacggcggagaaacctgctttcgcagcttcaacggcccgagggcggtgagggttccccagcgggtcggccggggtcagccgccgtagacgtgcggggcgagcgtgccgacgaagggcaggttgcggtacttctccgcgtagtccagcccgtagccgacgacgaactcgttggggatgtcgaaaccgatccacttcacatcgatcgcgacctttgcggcatccggcttgcgcagcagggtgcagacctccagcgaggccggctcccgggagcccaggttggacagcagccaggacagcgtcagaccggagtcgatgatgtcctcgacgatcaggacgtgcttgcccttgatgtcggtgtcgaggtccttgaggatccggacgacgccggaggactgggtgcctgccccgtacgaggagacggccatccagtccatcgtgacgggggtggacagcgcgcgcgccaggtccgccatgaccatcaccgcgcccttgaggacgccgacgatgagcaggtccctgcccgcgtactccgcgtcgatcttcgcggccagttcgacgagcttcgcgtcgatctcttccttggtgaggagcaccgactgaaggtcggtacccatgtccttctcgttcacccacgtctctttctctgcctgccggcccgggaaagcgccccgggccgggccggctgttcgcctgcacttcagccgcttgcgcgtcagctctgccgaatgaccagtctgccaccctgccgcatcgcctcgacgcggccgggcaggttgatggcccgctggccgcgccagccggtgatcaggcggtcgacttcttcgaggtgccgggcgaagagggagccggcgggcgccccggcctcgaccagtgcgcggcgcagcacccggcggcgtaccgcgggcggcaggacgtagagcttggcgcactccaggcggccggtctcgtcgcgtacggacagctcggcctcggcggcccaggtgtccagggcgtcggcgtcgtcgcgggagagctgggcggtgcgggcgagggcttcgacgacgcctttgccgagcgccttctccagggcgggcaggccttcgtgacggagccgggagcgggtgtaggcggggtcgatgttgtgcgggtcgtcccagacgggcagggactggaccaggcaggccttgcgggcggtctgccggtcgagctggaggaaggggcggcggtagcggccggccggtccggaggcggcggccatgccggagagcgagcggatgccggagccgcgggcgagaccgaggaggaccgtctcggcctggtcgtcgcgggtgtggccgagcaggacggcg

SEQ ID NO: 2811 - DNA, 5533 bp, Unknown
  Kingdom: Bacteria, Phylum: Actinobacteria, Class: Actinobacteria, Order: Streptomycetales, Family: Streptomycetaceae, Genus: Streptomyces
cgtcaccttcgcggtggccgccccggacaccggcacggccaccgcgaaggtgacgagcgcggcgagcagggcgcggcgcagacggcgtctgcgcgggcggtcgggcatggggtgaggtccttccgtaccgggggcatcgtgtgcttccggtacagaagttatggacggggagcggtagtcggcgtcccgctggagggggcacctgcggggtggctctcaggtatgacgtgggggatgcgggcggggctgtcgcgcggcacctgcggcgtgctccaccgacgtaatctggttccctcaccgggggaggggcccatgagcaaggtcgtctttgtgcacggcgtcggcaagcagtacctgagtgaagactccctgggccgggatgtcatccccgagctcctgggcggcgtacgtctggcgggcggggaggtacccgcgtacgacgaggtcgaagtcgccttctacggcgatctgttccgcccccgcggggcccgtgcggggtatgaaccgccctacgacgaggccgacatcgagacggacgaagagttcgccctcctcatggaatggtgggccgaggcggcacgcaccgacccctccgtccccggaccggaccagccgggcaccaggggtgcggccgggtgggctgcctcacgcgctctgcgactgaacacggtacgagcggcgctcgacgcgctgacgggcgcccactatctgcggggggtcctggaccgtgcgctgatcggcagcctgaagcagctcgtggcctacctgacggacgactccgtacggcgagcctgccgtgaccggctggccgcccgcatcacctccgacaccgaggtggtcgtcgcgcactcgctgggctccgtcgtcgcctacgagacgctctgcgaccccgagctcaacagtgactgggacgtccggatgctcgtgacgctggggtcaccgctgggcatgcgggcgctcgtcctggggcggctggacccggcgcccgaggggggacgggccgtgtggccgaagccgctggcgtcctggaccaacatcgccgacgccgcggacatcgtctccgtcgttcgcgacctgcgtccggcgttcggtgatgccgtgaccgacgtgccggtgaacaacggcagtcatatgcacgacgccacccggtatctgacggccgtggagaccggtcgagctgtcgcggccggcctgtcgccccggtgagcggccgaccgatgcgctacttcatcgccgcaggtacccgtcactaccggggcctcgccgaactccccctcgcccacgaggacgtcgagcgcgcgaccgagctcttcacctccatggggcaccggcgcgttctcgacgccgtgtcgtacgacccggacgccgagatcttcgagaacgccctcgccgactggtgccgtacaccggttctgacggccgacgacagtgtgatcgtctactacgcggggcacggcgaccgggccccgtccggccggtaccggctcgcttgcgccaacagcgaggagggcaagcctcgttcatggttgtccctgcccaatctcgccgagatcctcgccacgagtcccgtgcgcaacgtcctgttcgtcgtcgatgcctgctacgcggcggcggccaccgcggagctcgggcccatcaccaacgccatcgtggcggggcgggggcgcggagacgacttcggtgcgggcacctggctcctggcctcggcccgccaccgggatctcgccgtggacggcgccttcgtgaccgaagtggccaaggcctgcgcccagggcgacgggccgtcccagcgctatctggcgcccaccgtcatcgccgaccgggtcaaccaggtgttcatcgcgtcgggagcggcgcaacgggccgcctgctccgtggtggaccagtccggggcggccccgttcttcgacaatccgtcgttcgacccgcacgccgaagtcgggggcgacgaggaagcgccgggcgacacatccgacctctcctcgcacttcgaaccacgtggacgcggcgtcgaacacgtccacgacgaaggctcctacttcaccgggcgcacgagggcgctgcgggaagcccgggaccatctcgccggacagggcggcgggcgcctcctcgtcgtcacggcggacccgggctccggcaagtcggccgtcctcggccgccttgttctcgaaggctgtgccgacgcctcggtcaacgcccaccaccagaccatggagaccgtggtcgcgcggctcgccgccgccgcggacatcagggcgtcgaccctggtcgccctgctcacgaagctcgcggaccgggaactgcccttccggatcgtggtggactccctcgacgaggcgggcgcgggcggcgaccgggcggaagcccgccgcatcgcctgggaactgctgcgtccgctcgccgcggtgagctgtgtccggctgatcgtgggttcccggcgggacctcctgccccatctcggcgatcgggtaccggccatcgacctcgacgacgacgcgtacgcggacgacacgaacacggtcgagtacgtggagaagatcctcagcgacgagggagctccttacgcccggcgtccggacaccgtccgccccatcgcacgggaagtggcccgcagggccggccgctgcttcctcgtcgcccgtatgacggccagcgccctgttgcggggcccggtcgtcgacgtcggcgtgccgggctgggcggagcagctcccctccgatgtgggaggagccttcgagacgttcctccagcgggtgccgcagggcaggcacgcggtgaccatggcgctcctgaccgctctcgccttcggggagggcgacgggctgccccgcaggatctgggtccgggtggcggcccgcctgtcgggcatcgtgctggcggaggcggacgtcgacatgctgctggaggaggacggctcctacctggcgcgggtccgcgtggacggcacctggtacttccggctctaccaccaggagttgacggaccacatcaagggcagggtgctgcggagccgggacctcacggacctccaggagtgcttcgtcgacacactcaccgagctggttccggacggcgactggtcacgcgcacacgcgtacgtgcgcgcccgtctggccatccacgccgccggggcgggaactctggacgacctcatcgaggacgcctcgttcgtcgtcgccgtcgagccttcgacgctgctccaggcggtccggtacgcgctgcgccgggcgacgctgtcgatggcggtggagcgctacacctacctgctcgcggacacggaccgggactccccggaccgggccgccgtgcttgcctttgtggcgcacacctacggcgagcacgccctggccgggagtgccgaacggctctccacctcggtggagcgggtacgggtggagccccgtgagatcaccgcgcaccgggtggtcgggtggcacgcgggcgacgggtactccatccggtcccggaacccgaactggctgaccgcggaccttgtgctcccggacggcagccgcacggtgctcgcggccccgccgggggcctcgcatgtccacgtgtggctgatcgacacccccgcgcagtccacggtgcttccgcatccggcgcgggtcaccgggctggcgctgttcgccgggcacccgcacccggcggaggccgtcaccctcgatgccgagggcaccctgcggtggtggaacctcggggaccagaccctgtcccgcgtcgttcccggcacgccgtggaccgcgttgttcggcgccggcttccggtccgacggcacgcccgtcatcgcctgcggcaatgacgcccgggtggccgccctggccgtccccggcctcgacccgctggcggaggcggactgcccgacgggccagggccgcaacgtgtacgagaccaccatgggcaccgcctgcctggcctcggacggcgacggccgcgcccagctcctcgtctgcgacggtgcgggcgggcgggtgctcctgtacgacctggaggagcccggcgaccccgatgtgctgatcgatggtctgcggtacccggtcctggccacccgcgcccaggggctgcgagggacggtggcggcggtcagcgagccctggagcaagctccacctggtcgacaccgggacccggcaggcggtcggagcaccgttccacggcaccccgtggcacctcgccgggttcgcgcacggcagcgacgaacccgtgctggtggcgggggcggaagtgctgctcaccgcacggatggaccggcccttccggcaggccgacggatcccgcgtggccggtctggaggcggcggtcctgcacgacggccggctgctcgcgatcgaggcgggattcggcagtcagctgcgcctggtcgactgcgcgacgggcgtgcgcgtcggcgcaccgctgtccgggcacgagggggccgtatgcaccatgcggttgatcgccgcacccggagcggtcggccccgacctcctgaccgtcgggaacgacggcacggccaggatctggccgtggggatcgcacgagcggggcaccgggaaggccgcgggcgggaccaccgcgccggacgaggtccaggagctgatcccctggcggcaccggccggattcggtgatgggtgtgtccagctggggccgccacgtgcgccgggtggcgcccgtgcatccggaagcggaactccctgtgctctcgtcgcacgtcgtgacggacctgacgttcgagtcccgccccgacgtgcacgaccgcaccgaggaccccgaagggacgctcaacctgctgtcgtggcagtacaccgggcatgtcggcccggagaccacccccgaactgctgggctactcgccctcctcaccggtgtcctactgcgtctggcaccgcctgcacccctccggcgcctccgacacgaccgacatgcgctggctccacggcgatatgcacgaccggctgagcgggtggctgctcccgccggtgcaggggcggccccacacccgcttcgtcgggttcgaccgcctgcagggccgcgtcagggtcctcgacacaccggacgccgagggcagctggatccaactcccctggagcgtgcgccctccgtacgactacgtgtgcgcgaccgcgttcaccacggccccgggggacctggtcgtgatgagcgccgtccggcccgcccggaagtgggagaggagcgtggacggacgcgagccgcacgaatcgccgtcggcggcgccggacgcggtcccggcgcgcctgtggatcgtcgaaagcgcggccccgcaccccgtcgacggtgtcgagctcctccccgacgtgtaccgcttgaacccgcaccacggttccggcgggacccgttgggtgcttcagcgcggccggcgcggctcggtgggcgtgatcgacatcgagaccggccgtcggtaccccctgtggaccgccgacccgaccgggcggccagaggacgagcgcccgcgctatgcgcaggaccgctggaccgaactgtccgacggcgccccggtcctgctgtaccaggcacccgtcagcaacacccaccc

SEQ ID NO: 2812 - DNA, 6300 bp, Unknown
  Kingdom: Bacteria, Phylum: Actinobacteria, Class: Actinobacteria, Order: Streptomycetales, Family: Streptomycetaceae, Genus: Streptomyces
ggcataccggcacgtcgccgtaccggcgctgcacctcgtcggccgcccacgcggcgtcctcggcgggatgcgcgtcgtccgcgttccagccccggaggcgatagcgcagcacgtgcaccgcgagtccgtcgcccgccccggcacgggccagggaacgggcgaacggcagctgtgccgcgtacgacaggggggaaggacggcggtgcgagtcggcccggccgtccgggagcagcagcaccacgccgctgacctcgtccgttgctccggccgtctgaacggcccttcccagcctggggtcagacagggggagtgcgcgctgtcccatgacagaacagtgtcagaaggagaggtgtactccacccgacttcgcggtcactgttacgcatcgacaccaggcgctctacgcgcgtaggcgctagagtgccaagatgacgagccagaccccgaatgtccctgattccgaccagatccggcgcgcccccaaggtgctgctccacgaccacctcgacggcggcctgcggccgggcaccatcgtcgagctggcccgcgcgcagggttacgactccctccccgagaccgaggccgacaagctcggcatctggttccgcgaggccgccgactccggctcgctggagcgttacctggagacgttcgcccacacctgcgccgtcatgcagacccgtgacgcgctgttccgggtggccgccgagtgcgccgaggacctcgccgaggacggcgtcgtctacgccgagatccgctacgcccccgagcagcacctggagggcggcctgaccctcgaagaggtcgtcgaggccgtcaacgagggcttccgcgagggcgagcgcatcgcccgcgccaacggccaccgcatccgtgtcggcgcgctcctcaccgcgatgcggcacgccgcccgcgcgctggagatcgccgaactcgccaacggctaccgcgaccagggcgtcgtcggcttcgacatcgcgggcgcggaggcggggttcccgcccacccgccacctcgacgcgttcgagtacctcaagcgcgagaacaaccacttcacgatccacgcgggcgaggccttcggcctgccgtcgatctggcaggcgctccagtggtgcggcgccgaccgcctcggccacggagtgcggatcatcgacgacatcgaggtcgccgaggacggctcggtcaccctcggccgcctcgcctcctacgtacgggacaagcgcgtcccgctggagatgtgcccgacctccaacctccagaccggcgcggccacctcgtacgccgagcacccgatcggactgctgcgcaagctgcacttccggatcaccgtgaacacggacaaccggctgatgagcggcacgagcatgaccggggaattcgagcggctgaccgaggcattcggatacacgctcgacgacatgcagtggttcacagtcaatgcgatgaaatcagctttcattcctttcgacgaacgtctcgccatgatcaacgacgtcgtcaagcccggatacgcggagctgaagtccgagtggctcttccgtcagaccgctgtgaccagcggttcctccgcctctgcgggctagaggtccccgacaggtgaaagggccgggaagcgaaaccccggcccttttccgcgtgtcgggatgtttgcgataggggcagcgggatggctagcttgcagagccgctcacatccccttccccaaggatgaactctccatgaagaagtctgctgccaagactctcggtgtcgccgctctcggcgccgctttcgccgctgccgccgccggcagcgcctccgccgcccccgcgctgccgctggacgccgtggccggggcgctccccgtctcgacgatggcgctcgacaccgtcgccaagtcggcccagaacgcgccggtccaggagaccgtcggcaaggtcctcggcggcgacgccaccgacgcggccgccccggtgaccggcctgctcggcggactgcccacccagggcctcaccgccaacgggatcccgctcggcggctgagagcccgggccgggtgaccccggtccgcgcgccgggccaccggcgccacccgcacatgccagtggggcgcacaccctgacccagggtgtgcgccccaccgtgcgttcccgctccccgtgatgcggcgcgtcaccaggccgtcgcggaggaggcggccttctccgacggcagcagcgcccacagcgccaggtagagcaggacctgcgggccgggcagcaggcaggagacgacgaagatgacgcgcatcgtgccggtggagataccgaagcgccgggcgaggcccgcgcacactccgccgatcatgcggccttcgcgggggcggacaagtgcggccatggtgggctccttcgcgaaccgttgtgtgaggagcggccttccgcgctccccggtatatccatggtgccgccgcgaagagggacaaagcatcgctctacggtgcgaggccgaccccggtaatcgtcggggtcgctcccccaggggcctcgtccctgagacgggtctcctgccggtagtggcgaaggtcccgtacccccggcagtccccggcggcgcagccgcgcccggcagatggggacgaccagcagatgggccagcaccaccccggtggtgttcagcaacagcgagtcgatgtcgacgacctggccgggcaccccggtctggcccagctcgatggccagcgagatcagcgctccggcggcgaccgtacgcagcagcgagacccagggggagacgaagatccgccccccggccatcggcagcagcaccccgagcggggccagcagcaacaacgccccgccgatccggcgggtcgcctcggccggtcccagcgcgaggtccgccctgatcccggcgagcggctcgaaattcgccgccgtgatccagggaacgtccagcgggcgcagcgtcagccacccgacgaacagcagatgcgcgacaaggagagtgacccccgccgcgcggaagtggatgacggtctcgccgtccgaactgtgacgcacgtccaccaagacgccgcgaccgacaggatcggttccgcgccgtcgcggtccgctgtgcgggcggctgccccgggcggccccacggaccgcacggccccacggaccgcacggccccacggaccgcgcgggacccgcgtcagtccagcaggaccgcgtccggcgtggccaggtcgcccggccgggacttcgtctgcgaggtgcacagatagccgcgcggcgggtattccccgggcccgcccaggaccaccgagccgtccgtgaccagcgtctcgttctccgcgtacgtgcacaccagctgggccagcgcctccgccgacaggtcctccggctggctgctgaggcgcacggtgcccgccgggtcgccgtcgcgcgccggggtcacccgcagccccgccggaatcgcggtggtgaacccggcccgccgctcgttcgcgggcggcgtctgctggacctccttcagcagcgcccgggcggcgaccaccgggtcggcgccggtcgcgtccgccgccaccggacggtccacggtgaccagctgcgaggtgcacaccagatacaccgtgacgctcacgctgtccggcgaccgggtggcgacgtccgacgaggacagccggcacggcacccgggagggcgcggcccccgcgtccaccggcaccgaggtcgtacggattccgcacccggaggccagcgccgcggccgccagtacggccgccaacgaggctgccgtacgccgccggagcgggcctcgccggtacgtgacttcgccgcgcttcacgtcgccccgttctcgtccggggcgtccgcccccggttcgtcgtggtgcgctagcttctcggcgtcgcgcggcagccgcagttcgaagacggcgccgccgtccggcgagttcgccgccgtgatgtcgccgccgtggatgtgcgcgttctccatggcgatggagaggccgagcccgctgccctccgaccgcggccgggaggcgctggccttgtagaaccggtcgaagacgtgcggcagcacgtcctcggggatgcccggaccgtggtcccgtacctcgatgaccagctcctcaccctcggtccgcacccgtacgcccaccggcgagcccccgtgcttgagggcgttgccgatcagattggccaggatcacgtccagccggcgcggatcgagccggaccatcatgccgcgctccgcgtccaggtccaccgcgtccagccaggcccgcgcgtcgatgcacgcggtcacctggtcggcgacgtcgaccgtgtccagcaccagacgggccgtgcccgcgtcgaagcgggtcacctccatcaggttctcgaccaggtcgttcagccgccgggtctcgctgaccaccagatgcacggcgggagcgatcatcgggtcgagggtgtccgcctcgtcctccagcacctcggccaccgcggtgatcgcggtcagcggggtgcgcagctcgtgcgacatgtcggcgacgaagcggcggctcgcctcctcccgcgcgctcatgtccgcgaccttcttctccagcgatccggccgttctgttgaacgtacgggagagatcggcgagctcgtccgtgccggagacctccagccgggtgtcgagcttgccctcaccgagcttgcgggccgcgtcgccgagccgctgcacgggacgcagcaccgtcgtcgcggcggcctgcgcgagcagcgccgagccgaccagcgcgagggcggtggcgatccccagcgaccaggccagcgagttgaggtcctgccgttcctggtcgagggacttgagcatgtagccggtcgggccgccgccgatgatccgcgtaccggcgaccagatacggcgtgcccgctatgctcgtccgctgccagaacaggtggtactcgtgctcgttgctcgacgtcagcggctgcttgcgggccacctgcttctgcagcgagtcgggcacatgggcccgggtgaaggtgtccaggtcggagtagcccatgatcggcttgccgcgctcgcgttcggcctccagcagcacgctgtagcccggactgctggacgccatcgccccggcggcccgctggaggtcgtccttggtgggacgtgtcggcagccccgccgcggtgtcctgcatctgccgccggaagtcgccgagcgcggtgtcctgggtacgggtcagcacggcctcgcggttgagccagtacgcgatccccgaagcggacaccgcggccgtcagcgccaccagcgcgaacaccacgaccaggcgcagccgcagactggtccagcgcagaccggcccgcagggaccgcttggcggtttcggtcactgaggcgagtccagccggtagcccacgccccgcaccgtacggatcagggtcggcgaggacggcacgtcctccaccttcgcgcgcagcctttgcacacaggcgtccaccagacgggagtcgcccaggtagtcgtgctcccacaccaggcgcagcaactgctgccgggaaagggcctggcccggccggcggctcagctccagcaggagccgcagctcggtcggcgtgagctgcaggtcctcgccgtccttggtgacggtcatggcggagcggtcgatcaccacattgccgaaggtcgccgagtcggtcgactcgcgctccccccggcgcagcactgcccggatccgggcgtccagcacccggccctggacaggtttcaccacatagtcgtccgcgccggactccagtcccaccacgacgtcgatgtcgtcgctgcgcgcggtcagcagaatgatcggcagctggtcggtgcggcggatacgccgacacacctcgaaaccgtcgatcccgggcagcatcacatccagcacgaccaggtcgggccgttgctcgcgcagcagctcgaggccgtcctctcccgtcgccgcggtggccacacggtggccctggcgtgacaacgagagttcgagggccgtgcggatggcgtcgtcgtcctcgatcagcaacaggaaaggcacgaacgtcattctggcccatggtggcgcttcagttcgacctgtggcccggtccgattgtccgggcacggcctcaactacccctgtgacaggcctgtgacagtcgggggacagcgccatgaaactgccccggcaagctcttcgacaacagggaacgaacggactccaccgatagggggcgcgagatgaacgcactgcacagcaccagctcaagcgcagttgtcacgcgtctccacgacgtcgggcggagcacggagaagtccggtgccgtgaacctacgggggtgtgttcgaggcaccggacttctccgtgc

SEQ ID NO: 2813 - DNA, 10450 bp, Unknown
  Kingdom: Bacteria, Phylum: Actinobacteria, Class: Actinobacteria, Order: Streptomycetales, Family: Streptomycetaceae, Genus: Streptomyces
ggtggcggacggtgtggccaaggccggtgcgcggccggtcgcgtccgtcttgctcctcaagcgcctttcgcgcgtctagcgggatatgcgcggcatgtgtggcatgcctgatttatgggaacgtaccgtcaagtcgccgctacacgcggtggggtgagagtaaagaagtgccgggtgtgacgagaaaaatcctgtgaggatttgaactgatcacaagatggtcactagggtcaggcctcgaaccttcgcacggttgatcacccattgggggtgacggcgaaggaaccgccgagtccgtcatgtgcacggagccggggaatctctcccccacagcccggtaggcggctcagaggaagaaggagctcgccttcgtggcgtcccaccgtcgtcccaagcagccgagccgcacccgcgtgaccgtgctcaccgcgaccgccgccgcagccgtggccctgacctcccaggccgctcacgccgacccgaagccgagtaagagcgaagtcaaggcgaaggtcgacaagctctaccacgaggccgaggccgccaccgagaagtacaacggggccaaggagcagcaggacaacctgaagaaggaagtcgacgcgctccaggacaaggtcgcccgcggccaggccgagctcaacacgctgcgcacggaactcggttcgatcgctaccgcgcagtaccgctccggtggcatcgacccctccgtggccctcttcctcgcctcggacccggacagcttcctcgaccaggcctccgcgctcgaccagctgacggtcaagcagacggagtcgctgcagaagatccagtccaagcagcgcaccctcgcccagcagcgcaaggaagcccaggacaagctcggcgacctcgccgacgtccgcaaggcgctcggggagaacaagaagaagtaccagggcaaactggccgacgcccagcagctgctcaacacgctgacccaggccgagcgcgacaagatgaagagtgacgagcagcgtgccagccgcgacgccggcgaccgggtcgaactcggcaacgagtcccccgcgtccggccgtggagccgccgccctggccgccgccgccacgcagatcggcaagccctacgtctccggcggcacgggccccaactcctacgactgctccgggctgacccagtgggccttcgcgcaggccggcgtctccatcacccggaccacgttcacccagcacaacgacggcacgaagatcggccgcagccagctcaagccgggcgacctggtcttcttcaacaacctggcgcacgtcggcttctacgccggcaacaaccagatcctgcacgcaccgaagccgggcaccaacgtccgctacgagtcgatggactacatgggcaccttccagttcggcgtccgcatctgacgtcacggcccgcccgcggcacgcccgaacgagggaatcgccgcgcaccacactgacgccccgccccgccggagaccaaggtcaccggcggggcggcgacgttgtacccctccgccgccaccggcgcggtcttttgccggtgcgtggtcgcccgattactgtctggctgccgcgcagctcccggtctccgtccgcccgtcccgggcggcaggggctgcgcacgaccgcgtcagcggaagggagtgcggctacctgtggtgtcccatcgccgttccacacagtccggcttcaccagaggcgtccgggtcacggtcatctcggcggccgccgccaccgcggccgcgacgctgaccggagccccggcgagcgccgacccgaaggacacccgggagagcgccaaggccgccgtcgaccgcctctacggggaggccgagcaggccatcgagcgcttcaacgaggccggggaacgcgtggaccggctgcgcggcgaggcgggccgcgcccaggacgccacggcccggggacaggagcgcgtcaaccggatgcgcgacgcgctcggcgcgatggcgggtgctcagtaccgcaccggctccatcgacccggcgctcgccctgctgctctccgccgacccggccacctacctggagcgggccgccgccctcgaccgggccggcgcccgtcaggcgatgaccctggacaagctgcggcacgcccagcgcaagctcgcccagacccgcgcggagaccacccgcgccctgaccgagctggagcgcaaccgggccgccgtcacccgccacaagcgtgccgtcgagggcaagctccgcgaggcccgccgactgctggactcgctgccgcccgaggaacgcgccaccttcgaccgggtctcccgctccggccgcgaaggactgcccgacctctccggggtcgtccccggctcggcccgcgcgatgtccgccgtggccgccgcccaccaggcgctcgggagaccctacgtctggggcgccaacgggccctccggattcgactgttccggcctgatgcagtgggcctacgcccaggccggggtgagcctgccccgcacctcccaggcccagcgccacgcgggacgcatggtgcccctctcccaggcccggcccggtgacctggtcgcctaccgcgcggacgccagccacatcggcatgtacgtcggcaacggccaggtcatccacgccccctaccccggcgccccggtccgctacgatccggtcggcatgatgcccgtctcctcggtgacccggatctgaccgtacgatcggcagggtggccgtacgaggacgtgacgcgcgagggggacgcccccggggacggcggcgtgcggcgggcctgctgctcaccgtgctcctgaccgcgtccgcctgcacggcccccgccgaccccgacaccttcctcaccgccggcgccctcgacgccaccctggagcgccgcgcggcggccgtcctcgcccacgacccggcgggttacctcgacggactcgcgccggacgccgcgaagctgcgggccgtccagcgcaccgagctggaccggctcgccgacgtgcccctcaagtcctggacctacgacgtcaaggacatcaccgagcaggacgggcagtgggccaccgccgacgtggagctgcgctaccgcatcgccgggtacgacaccgccccggtcgccacccgccgcgtcctggagctgatgcgcgacggcgagcgctggtacatcaccgaggaccggcccgccaagggcgcctccgggcagctctggcagcagggggacgtcgaggtcgtcgagggcgagcacagcatcgtcctgggcgtcggacggtccgagaacgagctgcgccaggtcgccgacacggtggacctcgccgtaccggccgtctcggacgcctggccgaggccctggaaccgccgggtggtcgtcctcgtcccggactccgtcgaggacatggcggggctgctgggctcgccggaggccagttaccggggtatcgccgccgtcaccaccggcgaggtcggcggcaccggcaaacgcccggccatcgccgaccgggtgatcgtcaacccgcaggcgtacgccaccctgggcagcttcggacagcggatcgtgctgacccatgagacgacccatgtcgccacccggaccagcacctccacggccaccccggtctggctctccgagggcttcgccgactggaccgcctaccgcggcgaggaccgggccgccgacacgatcgcccccgagctggccgaggccgtccgcagcggccggacccccgccgaactccccgccgaccccgacgtcggcttcgacggcgacccggcggaactcgcggcggcctacgagggcggctggctggcctgcgagctgatcgcggagcggtggggcaaggagaagctgatcgccttctacgaggccgtcggcgcgcactccgggcggaacggggcggtggagcaggcgctggacgcggtgctcgacaccacccccgagcggttcaccgccgactggcgcgactacctcgccagccggctcggctgacccgcacccgccgaaagcgcccggtccgtgaccggcaccccaccccgcggccccggaaccgtcgaccgccacagccgccgcgccgcgatcagcgaggccgccaccagcagaccgttccgtacgagaaggagcgtcacgccccacgcgtcgctcgccaccacatggccgaagccgaccgggaactccagcagcgtcacccccgccgccaccagcaccagcacggccggaagcgtcatcgccgccccccggaacagcaggcacaccgccgcgagcccgaccagccacaccacgtactgcgggctgatcacccggctggtgaccgtgaacagcagcaccgccgtgaacgccgcctcggccggggtgtgcgcggcgaacgaccgggcccgcagccgccacagcagcagccagcccagcgccaggacgccgagccccagcgccagcgtcgacaccagctccacctgcgggccgaggaactccagcgagccgtagcgcagctccacccgcccctcccagccgaaccgccgtgccacgtggaagaccagcgctcccagggactcgacctcggtgccccggtcccgctggaacgccaggaacgcgaacgcccccggcatccacagcgcgaacgccgccgcgagccccgccgccgtcagcgccgccgacgtccaggcggcccgcgtcggacgtcccttgcgcaccccgaccagcagcagcgcgggccaccccttcagcagcgacccgcacgccgccagcgcccccagcgcgcgggggtgcgccggccccgccagcagcgcggccaccgccaccgccgtcaccatcaggtcgtagcgggcgtagaccgtcggacccagcagcggcacccccgcgatccacacccacgcacccgccgcccttatccccggccgtcggcccgcgtacagcagcagtcccagcaccagcgcgtcgcagagcagcaccagcacgaagaacgcggtcgcgtactccaggaacggcagcagggcgggggagaggatcgccagggccgccccgggcgggtactgccaggtgacgtcgtccagcggatacgtgccggtcagcagcgtctcgtaccagctccggtagatcaccgacacgtccacggtgacatccgggccgggcaccgtgaacaccttgaacacgcaggccagcagccatgcccgggtcagggcccacagggcgtacggccacggccccgctcgggtgggtgttcgtcccgtcatcgccgtcctcgtcgtcgctcgtttccggccgggttccaggcggctcatgatgccgccgggagagtgcctcagcggtgaagcgcggccgttcggtactgtcggcggcgatggacaagaccttgatcgtgaccaacgacttcccgccccgccccggtggcatccaggcgttcctccacaacatggcgctgcgcctggatcccgaccgggtcgtcgtctacgcctccacctggaagcgcggcgaggagggcacggcggccaccgccgccttcgacgccgagcagccgttccccgtggtccgcgaccggacgacgatgctgctgccgaccccgcgcgtcacccgccgggccaccggcctgctgcgcgaacacggctgcacctccgtctggttcggtgcggcggccccgctcggcctgatggctccggcgctgcgccgggcgggtgcccggcggctcgtcgccaccacccacggccacgaggccggctgggcgcaactgcccgcttcccgacaactgctgcgccggatcggggatgccacggacacgatcacctatctcggtgagtacacccgctcccggatcgccggggccctcacccccgaggccgccgggcgcatggtccaactgccgcccggcgtcgacgagaagaccttccacccggcgtccggcgggcaccgggtccgggcccgcctcgggctctccgaccgcccggtggtcgtctgcgtctcccggctggtgccgcgcaagggccaggacacgctgatcctggccatgcccgcgatcctcgcgcagatcccggacgcggtgctgctcatcgtcggcggcggaccgtacgccaaggacctggagcggctcgcggcggagaccggggtccaggactcggtgcgcttcaccggtccggtgccctgggccgagctgcccgcgcactacggggccggggacgtcttcgcgatgccctgccgcacccggcgcggcggcctcgacgtggagggcctcgggatcgtctacctggaggcgtccgcgaccgggctgcccgtggtggccggcgactcgggcggcgccccggacgcggtgctcgacggcgagaccgggtgggtggtgcgcggcggcagcgccgaggagtcggcggaccggatcgtgacgctgctcggggacccggagctgcggcggcggatgggggagcgcggccgggcctgggtcgaggagaagtggcgctgggacctgctggcggagaagctcaagaccctgctgtgaacacgccgtacggcggaggggcccgcaccgggaatcggtgcgggcccctccacgtgacagcgctcaggcgcggtagatcgactccacctcgtccgcgaagtccttcgccaccacgttccgcttcagcttcagcgacggcgtgatgtggcccgcctcctcggtgaactgggcgggcaggatacggaacttgcgcaccgactcggccttggagaccgccgcgttgccgtcgtccaccgcccgctgcacctcggccagcagctccgcgtcctcgcgcagcgacagggccgtcgagccggccggcttgccgtgctcctcggcccagcggctcaggaactcctcgtccagcgtgaccagcgcgccgacgaacggacggccgtcgccgaccaccatgcactccgcgaccagggcgtgcgcgcggatgcggtcctcgatcaccgccggggcgacgttcttgccgcccgccgtcacgatgatctccttcttgcggccggtgatcgcgaggtagccgtcctcgtcgagcgtgccgatgtccccggtgtggaaccagccgtcggccagcgcctcggccgaggccgactcgttcttccagtaaccggtgaacaggtgctcgccgtgcagcagcacctctccgtcgtccgcgatccgcacgaccgaaccgggcagcggctggccgaccgtgccgatcttctgccggtcccacgggttgaacgcggtggccgcacacgtctcggtcaggccgtagccctccagcaccgtgaagccgatgccccggtagaagtggccgagccgctcgcccagcggagcgccgccggagatcgcgaactcgccccggccgccgagcaccgcgcgcagcttcccgaagaccagcttgtcgaagagcttgtgcttgagcctcagccccagcgagggaccccccggggtgctcagcgcccggctgtaggcgatcgccgtgtcggcggcccggtcgaagatcttgcccttgccgtccgcctgcgccttggcgcgggccgcgttgtagaccttctcgaagacccggggcacgcccaggatcagcgtcggccggaacgcggccagctcgtccgtgaggttcttgatgtcggggacgcagccgagcttgatcggggccatcaccgaggccacctcgaccagccggccgaagacgtgcgcggcgggcaggaacagcagcaccgagcactcgccggtacggaagaggggcttcagccgctccaccacgttgccgcactccgcgaagaagctgcggtgggtcagcacacagcccttgggacggcccgtggtgcccgaggtgtagacgattgtcgccgggtcgtccgccttggcactgtgcgtccgcaggtccatggtctcgtccgagacctcggcccccgcctcgcccagtgcctccaccgcgcccgcgtcgatctgccagacatgcgcgagatccggcagcgcgtcccgtacggaggccacggacgcggcgtgcgcgtcgctctccacgagcaccgccaccgccccggagtcgccgaggatccactgcacctgctcggcggagctggtctcgtacaccggcacggtcaccgcgcccgcgctccagatcgcgaagtccagcagcacccactcgaaacgggtgcgcgacatcagggcgacccggtcaccgggctgcacgcccgaggcgatcagacctttggcggcggctctcacctcggccaggaactgcgtggcactgacgtccgtccagacgccggccaccttgcggctcatcaccgcgacgtcgggatgctgagcggcattgcggcggatgagatccgtcaggttgccgtccgtcgggacctcgtacagggccggaaggctgaactcgcgcaagactgctgctcctcatcgggctccggtgccacggctctgtgtgacgcaccggctgcggtccaagagtggcgggtgctcagtggggtgagcacgactggactgcccggacgttacccaccggtactcggttccggatagggggttccggccagatgtcttatgcatcacacatataaatggccctttcgcgcacagtagtccactgccgtcccgacgtggaagtaaccgcaggtccggacggtctatccagcgacggaagcggcaccctagggtgttcccatgcgagtcagcgaaccggacagccgggtcccggccgggggatcgacccggatccacgtggtcagcgacgtgcacggcaacaccgaggccctggcccgcgcggggaacggcgccgacgccctgatctgcctcggtgacctggtgctcttcctcgactacgccgaccactcgcgcggcatcttccccgacctgttcggcagggagaacgccgaccgcatcgtcgccctgcgcaccgcccgccgctacgacgaggcccgcgccttcggccgcgagctgtgggcgggccgcgaccgcaacaccgagatcctcggcgcggtgcgcaagcagtacgccgaactcttcgcggccttccccaccccgacgtacgccacctacggcaacgtcgacgtccccgacctctggccggagtacgcccgacccggcaccaccgtgctcgacggcgaacgcgtcgagatcggcggccgggtcttcggcttcgtcggcggcggcctcaagaccccgatgaacaccccgtacgagatcagcgacgaggagtacgcggccaaggtcgaggcgctcggcccggtcgacgtcctctgctcgcacatcccgcccgaggtccccgagctgacgtacgacaccgtcgcccgccgcttcgaacgaggcagccgcgccctgctggaggcgatccgcgccacccgcccccggtacgcgcttttcggccatgttcaccagccgttggtccgccggatgcggatcgggaccaccgagtgcgtcaacgtcggccacttcgcgtcgaccggaacaccctgggcgctgagctggtgaccgcgggcggccggggcgtggaccggagcgccccgggcacgcgatagcctgcacagcggcaggctcctgccgaacgcgaccggttacaccgcactggagggccacggcgatggctgaacacaccagctcgagcatcacgatcgaggcggcgccggccgacgtcatgggcgtgatcgccgacttcgcccgctacccggagtggaccggcgaggtcaaggaggccgaggtcctctccaccgacgaccagggccgcgccgagcaggtccgcctcgtcctggacgccggagcgatcaaggacgaccacgtcctctcctacacctggaccggtcagaacgaggtcagctggagcctcgtcaagtcccagatgctgcgctccctggacggcacgtacgcgctggccccgctcggcggcggcgagcgcaccgaggtcacctaccggctcgccgtcgacgtcaagatcccgctgctcggcatgatcaagcgcaaggccgagaaggtcatcatcgaccgcgccctcgccggcctgaagaagcgcgtcgagtccgcaccggggaactgagggccgtgcgtacggtcctggtcaccggcctcggcggcgcgggccgcagcaccgtcgccgcggccaccgcactggccgcggccgcgagcggcggccgcaccctgctggtctccgccgaggccatacccggcttcccggccgtcccggaaccgacccgggtcgccgacggcctcgaccacgcccgcatcgactccggcgagcacttccgcgccgaactcaccgagctccagaagcgcgcctccggcctcctggacctgctcggcgcgggccggctcgccggcgaggagctcaccgaactccccggctccccgcagctcgccctgctgcacaccctgcgccgggccgccgagggcgactggtccggctacgacacgctcgtcgtcgacctgccgccgctcgccgaggccctggccctgctcgccctgccggaacagctgcgccgctacctgcgccggctgctccccgccgaacgccaggccgcccgcgccctgcgcccggtcctcgccc

SEQ ID NO: 2814 - DNA, 5164 bp, Unknown
  Kingdom: Bacteria, Phylum: Actinobacteria, Class: Actinobacteria, Order: Streptomycetales, Family: Streptomycetaceae, Genus: Streptomyces
gtcaacgccagatatgttgataccccggcctgcttcggcaggttggtggttcctttgaaagtcctgtcgttccgctccttgtgggtggcggcaggcaatgacacagcgaggacgctgagaacaacgggtcttattccgaccggttgttccgctctcgtgatgtgtgcacccgattacgggtaaacattcacggagagtttgatcctggctcaggacgaacgctggcggcgtgcttaacacatgcaagtcgaacgatgaagcctttcggggtggattagtggcgaacgggtgagtaacacgtgggcaatctgcccttcactctgggacaagccctggaaacggggtctaataccggataacactctgtcccgcatgggacggggttaaaagctccggcggtgaaggatgagcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacgttgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatataccggaaagcatcagagatggtgccccccttgtggtcggtatacaggtggtgcatggctgtcgtcagctcgtgtcgtgagatgttgggttaagtcccgcaacgagcgcaacccttgttctgtgttgccagcatgcccttcggggtgatggggactcacaggagactgccggggtcaactcggaggaaggtggggacgacgtcaagtcatcatgccccttatgtcttgggctgcacacgtgctacaatggccggtacaatgagctgcgatgccgcgaggcggagcgaatctcaaaaagccggtctcagttcggattggggtctgcaactcgaccccatgaagtcggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttctaaggagcacttcttaccaggcttcggtttggtcagaggccagtacaccggcgaatgttcggtgctggttgctcatgggtggaacgttgactattcggcacgacaggttgatcacggctagtactgctcttcggggcgtggaacgtggtgagagatcggtcgggccgggcacgttgttgggtatctgaaggtatggccgtaaaggctgccttcggttgccggccccagtgaactcgtcttcagggacggggtgatgggtggctggtcgttgtttgagaactgcacagtggacgcgagcatctgtggccaagtttttaagggcgcacggtggatgccttggcaccaggaaccgatgaaggacgtgggaggccacgatagtccccggggagctgtcaaccaagctttgatccgggggtttccgaatggggaaacccggcagtcgtcatgggctgtcacccgctgctgaacacataggcagtgtggagggaacgaggggaagtgaaacatctcagtaccctcaggaagagaaaacaaccgtgattccgggagtagtggcgagcgaaactggatgaggccaaaccgtatgcgtgtgatacccggcaggggttgcgcattcggggttgtgggatctctttttcatagtctgccggctgtgagacgagtcagaaaccgttgatgtaggcgaaggacatgcgaaaggtccggcgtagagggtaagacccccgtagctgaaacatcaacggctcgtttaagagacacccaagtagcacggggcccgagaaatcccgtgtgaatctggcgggaccacccgctaagcctaaatattccctggtgaccgatagcggatagtaccgtgagggaatggtgaaaagtaccgcgggagcggagtgaaatagtacctgaaaccgtgtgcctacaagccgtgggagcgtcgctgtatgtgcttgcacatgcagtcgtgactgcgtgccttttgaagaatgagcctgcgagttagcggtgtgtagcgaggttaacccgtgtggggaagccgtagcgaaagcgagtccgaatagggcgattgagttgcacgctctagacccgaagcggagtgatctagccatgggcaggttgaagcggaggtaagacttcgtggaggaccgaacccaccagggttgaaaacctgggggatgacctgtggttaggggtgaaaggccaatcaaactccgtgatagctggttctccccgaaatgcatttaggtgcagcgtcgtgtgtttcttgccggaggtagagcactggataggcgatgggccctaccgggttactgaccttagccaaactccgaatgccggtaagtgagagcacggcagtgagactgtgggggataagctccatggtcgagagggaaacagcccagagcatcgactaaggcccctaagcgtacgctaagtgggaaaggatgtggagtcgcagagacaaccaggaggttggcttagaagcagccacccttgaaagagtgcgtaatagctcactggtcaagtgattccgcgccgacaatgtagcggggctcaagcgtaccgccgaagtcgtgtcattcacacatatagggccaacgcccgtgtggatgggtaggggagcgtcgtgtgccgggtgaagcagccgcggaagcgagttgtggacggttcacgagtgagaatgcaggcatgagtagcgatacacacgtgagaaacgtgtgcgccgattgactaagggttcctgggtcaagctgatctgcccagggtaagtcgggacctaaggcgaggccgacaggcgtagtcgatggacaaccggttgatattccggtacccgctttgaaacgcccagtactgaatcaggcgatgctaagtccgtgaagccggcccgatctcttcggagttgagggtagtggtggagccgatgaaccagacttgtagtaggtaagcgatggggtgacgcaggaaggtagtccagcccgggcggtggttgtcccggggtaagggtgtagcccgtgtggtaggtaaatccgtcacacgttaagggtgagacctgatgccgagccgattgtggtgaagtggatgatcctatgctgtcgagaaaagcctctagcgagtttcatggcggcccgtaccctaaaccgactcaggtggtcaggtagagaataccgaggcgttcgggtgaactatggttaaggaactcggcaaaatgcccccgtaacttcgggagaaggggggccatcactggtgatagcacttgctgcttgagctgggggtggccgcagagaccagcgagaagcgactgtttactaaaaacacaggtccgtgcgaagccgtaaggcgatgtatacggactgacgcctgcccggtgctggaacgttaaggggaccggttagctgctcttcggggtggcgaagctgagaacttaagcgccagtaaacggcggtggtaactataaccatcctaaggtagcgaaattccttgtcgggtaagttccgacctgcacgaatggcgtaacgacttctcgactgtctcaaccataggcccggtgaaattgcactacgagtaaagatgctcgtttcgcgcagcaggacggaaagaccccgggacctttactatagtttgatattggtgttcggttcggcttgtgtaggataggtgggagactttgaagcggccacgccagtggttgtggagtcgtcgttgaaataccactctggtcgtgctggatgtctaacctgggtccgtgatccggatcagggacagtgtctgatgggtagtttaactggggcggttgcctcctaaagagtaacggaggcgcccaaaggttccctcagcctggttggcaatcaggtgttgagtgtaagtgcacaagggagcttgactgtgagaccgacgggtcgagcagggacgaaagtcgggactagtgatccggcagtggcttgtggaagcgctgtcgctcaacggataaaaggtaccccggggataacaggctgatcttccccaagagtccatatcgacgggatggtttggcacctcgatgtcggctcgtcgcatcctggggctggagtcggtcccaagggttgggctgttcgcccattaaagcggtacgcgagctgggtttagaacgtcgtgagacagttcggtccctatccgctgtgcgcgtaggaatattgagaagggctgtccctagtacgagaggaccgggacggacgaacctctggtgtgccagttgtcctgccaagggcatggctggttggctacgttcggaaaggataaccgctgaaagcatctaagcgggaagcctgcttcgagatgagtattcccaccctcttgaagggttaaggctcccagtagacgactgggttgataggccagatgtggaagccctgtaaggggtggagctgactggtactaataggccgagggcttgtcctcagttgctcgcgtccactgtgtt

SEQ ID NO: 2815 - DNA, 8688 bp, Unknown
  Kingdom: Bacteria, Phylum: Actinobacteria, Class: Actinobacteria, Order: Streptomycetales, Family: Streptomycetaceae, Genus: Streptomyces
gccggggcggcggtggccgccgcggcggcggtgacgggggttacgtccagggccgcccggccccggactggcgccgccggatcaagctcggcgcgctgaccctggtggtcgtggtgctcgcggtctcgatctcgacgtacttctgggccgactcgaagctgaagcgcgaggtcgatctctccaaggtcatcgagcggccggagtccggcgacggcacgaactacctgatcgtcgggtcggacagccgtgaaggcatgtcggccgaggagaagaagcggctgcgcaccggttccgcggagggcaagcggaccgactcgatgatgatcctgcacgacggctccaacggcccgactctgatctcgctgccgcgcgactccaacgtcgagatcccgtccttcgtggggtccgagtccgggaagaagttccagggcacaggccggcaggtgaagctgaacgccgcctacgccgaagacggccccgaactactggtgcgcacggtcgagttcaacaccgggctgcacatcgaccactacgtcgagatcggcttcggcggcttcgcgaagatcgtggacgcgatcggcggggtcgagctggacatcccgaaggccttcaaggacaagaagtccggagccgacttccaggccggcaagcagacgctgaacggcgagcagtccctcgccttcgtccggacccgctacgcgctgccgggcagcgacctggaccgcacgaagaaccagcagaagttcctcgcggcgctggcgagccagacggcgaccccgggcacgatcatcaaccccttcaagctgtacccgacaatgggcgcgggcctggacacgctgatcgtggacaaggacatgtcgctctgggcgctgggcaacatgttcttcgcgatgaagggcgtcacgggcggcgagggcacgtcgatgaacatgccgatctcgggcagcatcggctccaacctggtctgggacaaggccaaggtgaagcagttggtggagcagctcaacaacgacgagaaggtcacggtcaagagcaactgaggccgtaggccgagcggttgaagggcgccgggctgttgcccggcgccctttcgtcgcccgtgccgcctacgttccgtaggtgacgttcccctcctcgtccatgacgggatggatccgggagggcccgtagtcgtccacgtcggacgggcgcgacttctccggcccgtccggcccgatccgcatcacccgctcgacccggatcacctcgaaccggcgtccccgcagcacgagttcgttgggccttcggcgcgcggtgaacttcttcgcggcccgcgcgtggagagccgcctccttctcgtccacctgcatccaggcgggcagctccggcatgtcgggcaggtccggcagttggggcacgggccgcgtgaggtggtggacgagcgcgcgacgagccccctgcggggtcgagaactgtccggtcaccatcgaccaggccgactccttacgctccaccacgcggaacgtcgtcgggaggagcaccaccccggggtgggtggtcaacgcccgccgggagtcagcccgtacgtcctcggggaagcgggcggcggtgtaggcgagccgcagcagcccggcccggtcgatcccctcgctcagcccgacggcggcggcgtggtcgaccacgaagccctcggtccgggaggggtcgggcgcgtccaggtcccagctgtcgtcgtccgggtcggtggcccggggcggctccaggcggccgccgccgatccgggcgaactcgtcggcgcgcacgacccggtagcggacgccgtccgccgacacctcgtcggtcggctcgacctccagccgcgccacggcgtccagcagtgacctccgcaccgccggatcgtcggtgtcgtccctcgccatgaaccacaggtgcgaattcagctcgtcccgggccatctgcggggaccccgactccagttcgcccagcagccgccagcgcggccggtcgccgcgccgctgctcggcgagcccgaacagaggcccccggaccacgatgttcgggtacttgcggaccgaggcgaacgcgtccgcctcggtgacctcggagaccgggtcgccgtgacgggtgacgttgatcgtgaggtggtccggcgatctctccgggtgagcgtccatgcactcggtgtgccgaaggggggttccggtgtcagggtttccgccgcaaagggcttctgccgcgcggagttggcgtcgaggccctgcgcgagctggaggcccacggcttcccgcaccggacccgcgcgagacaggagagcggccggatggtcacccgcacggtgttctgcgaccagccgggtgcgttgccgcggggcgggacaggggtgcccccgatgccggtggtggcgcctgccccctgtgacgcgaggacgggccgggctctgcgtcgagagtgcagggcccggccgttgggacgccgttccgtttcacacccccaggatgcgggagagtccgtagtcgaagcgctcgtcgaaggaggtgtcctcgaagtacgcggcggctcgggacagtgaggggtatgcgcccgtgtccagccgtcgcgcgaacgccggacccatcgcgtcaggaagcgcctgttcctcctgagccagccccaaggcgaagtagacaaggctccagccggtccagaccgcctcgcgttccgccagcccgccggccaggagcgcctcggtcatcaggtcggcgaagcggagtgtggcgggttcggcggcgtacgtaccggccacgatcctggccccgtcccggtgggccagcagggcacggcggtagcggtggagcagttcgcggacccgtggttcccagggctcgggcagcccgtccaccggcgccccggccacgatcgcgtccgccatcaactccgacagccgcgccttgctcttcgcatgccagagcacggtgttcatccggacgccgagccggtccgcgatgccgcggatcgagagcccgtccgcgcctttctcctccagcagttccagggccgcccgcaccaccgttccggggtcgagccgagtccgggcgagatcctccgcttgcttcttggtcaccgacctagtctactgggcacactcggccttggtcactgaccaagacattcttgaggagctgacatggagcacgagcacgtagtcatcgcaggaggcggccccaccgggctgtggctggccgccgaactgcggctgggcgggacacccgtcaccgtcctggaaacccgccgcgagcgggatccccactccaaggccctcaccatccatccccgcacactggaggccctggccacccggggcgcactggagcccttcctcacggagggacggcgcatccccagcggccacttcggcggactcgacgaccggatggacttcggggtcctcgacaccccctacccctacacactcgctctgccacaggcccgcaccgaggagctgctggaggagcacgggaacacggtcggagccagaatccggcgcgggcaccaggtgaccgggctcacccaggacgaagacggcgtgagcgtcgaggcgaccggacccaacggcccgtacacactgcgcgccgactacctcgtcggctgcgacggcacccgaagcaccgtgcgcgaagcggcgggcatcgacttccccggcagcgacgccaccacctggggcttcctgggcgacgtcgtcctggacaacccgccaccgggagcggtgacggccgtgtcaggcccgaccggcggcgtcatggttgtcccgatgccgggcggcatccaccggatcgtgggcggtgacccggacagtaccggtaccggccaccccggcgatctcaccctcggcgaactccgcgccaaggtgaaccggatcgccggcaccgacttcggcatgcgtgacccgagctggctctcccggttcggcaacgccgcccgccaggccgccgagtaccgcaagggccgcgtcctcttggcgggcgacgcggcgcacatgcactacccggccggaggcgtgggcctcaacgtcggtatccaggacgccatgaacctcggctggaaactggccgccacagtggcaggcaccgcccccgccggactcctggacagctaccacaccgaacgccacccggtcggcgccgacctgctgctcagcacccgcgcccagacggcactgatgaacgcctactcggcggagggacaggacctgcgcgcactcctgagccaactcatcgccaccgtacccgcgttctcccggagcctggccgaacgactctccgcactggccgtcacctacccggcccccgcacaccatcaccccctgaccggtcaccgcgcacccaacctcgaactcgccgacagcacagacctcttcacactgctccggaccggccgccacgtcctgctgcacttcaccggcaccccggcaccgccctccaccccccacgtcatcacgcacacagctcaccggcccgacccgcgccccgcctggtccaccgtgcgtgccgcgctcatccgccccgacggccacgtcgcctgggcgagcgaacagcccgacgccgaagccctgcgggccgaggcgcacgcggcggcctccgcgactcaccgctgaccagaacgccgtcgacgtccacggcccccggttgtcacgccgcgagagcgcggccggaccccgtcgctatgtctggcgacggcatccggcgaggaggatcgcgaccatgcgtccggcgtcggcccggtcgtagtcggggccggtgatgcagaggttcccgatggcgcgcatgagcgtgtaggcggtgatgtccgggtcgatctcgtcggcggcgacgcaggcgtcgagcagggtcgcgcaggccgggaccagggtgtcgagcatcagggcgtggaggttctccagccccggatcgccggaccccagggcggcaccgaggccgtgcttcgtcaccaggaactccacgaacgcgtccgcccagcgggtcagggcggtgaacggggaggccgactcctccaggagacggggcgcgagtgcggtgcaggtgtcgatctggtgccggtagacggcggtgaccaggtccgcccgggtcgggaagttccggtagatcgtgccgacgccgacgccggcacgttcggcgatgtcgcggatgggggcctggacgccctgctccacgaagaccgccgaggcggccgccagcacaccgccgcgggtgcgctgtgcctgcgcttggcgtactccgaccgactccggcacgaggctctccctttactcgcggaacaatgttccgctaagttggcggaacggtgctccgccaaagtatggcagagcgttcccatggagaaagcgcaggtctcccatgccttccagccatctcgaccagcggatcgtctcagtcaagcccatcaccgttcccgcgcccggccgcggcatcggcctccaggtgaaggtcaccgccccactgtcgggccggcaccttcccgtcatcgtgttctcccacggcaacgcatggtccctggacggatacgaacccctcgtcgaccggtgggcagccgccgggttcgtcgtcgtgcagcccacccacctggactcccgccgcaacggcatcggctgggacgacccgcgcttcgccaccgtctggcgcgtccggatcgccgatctccacgcggtcctcgacggcctgggcgacatccttctccaggccggcggcctggagacccgcgtcgaccgcgagcgcatcgcgatcgtcggccattcctggggcgcccagaccgccggcgcgatcctcggcgcgcgcgtgctcgacgccgacggcctacccggagaggacttctcccaccccgccgtctcggccggcgcgctgatcgccgcgaccggaaccggcgacagcctcaccccgttcgccgccgaacaccttccgttcatgaggccggactactcgaccatgaccaccccggccctggtcgtcgcgggcggcaaggaccggtcccagctctccacccggggaccggagtggttcaccgacgcctaccgcctcagcccgtccccgaagagcctgctctccatcgccgagggcgagcacaccctgggcggcctcgccggcgaggcggtcgccgagaccaccgacgaggaccccgcccgcgtcgctctcgtcgccgacgcggtctccgcctacctccacgacgccctcaagctcgacgacgccgcgtgggccgccctcaacaccgccgccgcggccggcgacggcacgtggagcatcaccggcaagtgaacccgcacccgccgggcagcggtcaggtgccgcggtcgtaccgctcggcgagcctggtggccacttcccgcatcacggtcgcgttgttgcgcagcgcggtgtcggggtcgacgcggtccttcggcgataccgccgatgtcggtgctgccgaagtcgttggggtggttgcggatcagtgcgcgcagaccccaggcacagagctcgtcggcttcgttcgcacgcttcaggacgccttggtgtcgaacccgtcgctcttgaggctcgtaccggcggtctcgctcgccgccttcgcgtgcttgccggtcggttcgaggccgttgaacaacttcgtcgcttcgagcgcgccacgatatctgtgtgatcaaactatgcctccgggagaccggtcaggagacggctcccctcggttcgagttcggcgaagtcctcgtggagggcgtcgagatggcggcctgtcggcgtaccgtccgaggtcagctccgccagccgccagccgggcaactgcgcctcgacctcggtcgggagcgacccgtccgccgggtccgccagggcgtacagcaccccgaacgcggtctccctggcaacctcgcgggccagcgcgccgaggtcctccggggtgagcccggtcgtgagggcacggtcgacggcgtcggccgccgctccgtcggtgcggtaggcgtcgacccactgcggggcggccgtgctccaggcgtcgacgtcctgccacaccatccgcaggaggcggtagcgggcgagctgcggcaacccttcctcggcctcggactcggcccagtcgcgagcgtcggcgtccgcccccagggcgttgaagagggcggtcaacctgtcgagttcggtcatggggagggaggctaccggccgtggcaggggtgggggacggacgaatgggcgcgcggggaccgatgagtttccccgggacacccggtcagaacatccgtaagagtgagaggcgacaccgggcaccggccggggtcccgccacgacacagccaggagacctgatgcgcaccctgatcagcaccgccttcgtctcgctcgacggcgtcatggaggccccgggcggcgagcccggctaccggaactcggggtggacgttcaaggacatggagttcctgccggaggcgtacgccatcaagggccaggagcaggaggaggccacggcgcttctgctgggccgggcgagctacgaggcgttcagcccggtgtggccgggcatggcggagttcgccgagtacaaggtgatgccgaagtacgtcgtctcgaccaagctgaccgaggacgagctcgtgtccgactggggcgagaccacgatcctgcggtcgctcgacgaggtcgccgccctgaaggagaccgagggcggcccgatcatcgtccacggcagcaccgccctgaaccggagcctcgcggacgccgacctgatcgaccggtaccacctgctcgtcttcccgctcctgctcggcgcgggcaagcgcctgttcagcgacacggacaaggacgcccagaagctgaagctggtcgagcacgaggcgtacgcgaacggcatccagaagaacgtcttcgaggtcgtccgctgacgctcccgctctcccgggcctcccggcggagccagggcggtgcccgctcgtagtcgtcatcccctgagctcgccgaactcactgggccaagcgtgaccgttctctataggttcggacacacccgtcgtgaggacgggcctggacccagcatcagggagctcgtatggcatccatccaccgcaccaccatgacgcccaccaagctggagcttctcaccggctggctgccgaagcagagctggtacgtgggctccggggaaacgccggacctggtcaaggccggcgggttccgtctggacgatccggagggggaggtcgggatcgagttcatgatcgtggcggacacggccgggcaggaaccggtggcgtacctggtgccgctgggctaccgcggcgcggcgctggaaggcgtccccggcgcggcgctgatcggcacctccgagcatggggtgctcggcacccggtggatctacgacggtgcccacgatccagtggtgctggcgcagttgcgcgcccttctgcgcggcgaggcgaagccgcagcagcagagcgtgagcgacacccccgacccgaccgtcgtcgtgcacgggaccggccccgacgagggcgccgacgtccggatcaaccgcgtcctgcggccggcggaagccgagcaggggtcgtcgggacgtctcgtcgccgggtggacctggccggacggaacggctgtacggggagagatggccgccgtcactccgcggtagggcaaagcccacgcgacgggcccccggcgcggtgccgggggctggagccgtgatccggcacgaccggagcggctgcgacgtgggggggggtggacg

SEQ ID NO: 2816 - DNA, 2890 bp, Unknown
  Kingdom: Bacteria, Phylum: Actinobacteria, Class: Actinobacteria, Order: Streptomycetales, Family: Streptomycetaceae, Genus: Streptomyces
ggccgcggcggcggtggtggcgagcacggagcgtcgggacagggaccgggacacgtgatcctccagggagggggcgggtcggacggggctgggcgtgaactgccttctggaccagacccgttacctttgcgagacaaccgggccgagtccagaccttcgcaggaatccgtggcggagaggtgaccggtcagcttccggtggccgacttccaggcgtcgatgtacgtgtccaggttggcgccgatgtccgcccagtcgggctcgaagatctcgacgccctccatcagcccggccagctcgacggcgttggcgtcggtggcctcgatgtccttgcgggcggcgaagcccccgccgaccgcgctgacgtcgcgctgggcctgctcggagagcatgaagtcgagcagcttcttgccgttctcgctgtgcggagccttcgcgacgaggccggcggcgtacgggagcgcgaagctggtgggcttcccgtcgcccttggcggggaaccagatgccgaggttgggcatgtccttggactgggcgaagttcatctggacgtccccgttggcggcgaggagctctcccttgtcgaccttgggggcgagcttgccggtggaggcggacgggccgacgttgttggtctggagcttcttcaggtacgccatggccggctcctggccgccgaagtcgtgcatcgccttgatgaggacggcggtgccgtcgcccgcgacgccgggggtggagtactggaccttctccttgtacgaggggtcgagcaggtcctcccaggtcctgggcggattcttcagctccttcttgttgtggacgaacccgaagtagttgttgacgacggaggtccacttcccgtcggccgcccggtcggcgccgtcgacctggtcggcgcccttcggctcgtacgcggtgagaaggcccttggcgtcggcctgttggatgaagggcggcagggtgacgagcacgtcggcctgggtgttggacttctcgcgcgcggcgcgctgcaccatctcgccggagccgccctccacgtacttcacctcgatgccggtcttcttctcgaagtcctcgaagaccttgtcgtaccagccgtcgccgttctcgcccttgaggccgtcggcgctgtagacggtgacggacttctcgtcggaagcggcggaggagccgccgcaggcggtgaggctgacggcggcgaggccggccagggggagggctagggcacgggcacggttgcgcatggggtttctccagagggagtacggggtggggatcagcggtaggaggcgcgggtccggatgcgggagacggcggccaggacgaggagcgtcgtcgtcatcaggaccacggcgagggcggcgccggtgaagagcgaaccccggtcggtggcggcgaagatctgcaccggcagcggggtccagtccggcgggtagagcatcatcgtggcgctcaactcgcccatggacagggcgaagcagagcccggcggccgaggtgagcgagggcagcagaaggggcagccggatccgccacaggacccgggcggggctcgccccgaggccggcggcggcctgttcgtacatcgggtccagtcggcgtacggcggcggataccgactggtacgcgaacgcggtgacgaggacggtgtgggcgaggatcacgatccagcgcgtcccgttgagcaggatgggcggccggctgtaggccaccagtaccgcgaggccgacgaccaccgagggcacggcgaccggcaggatgaacagggcgtccaggagccgctttccgcgccggcggagagaagcggcggccagcgccgcccagccgccgaggacgagggccagcacgctcgcggccacggccgtgaccaggctggtggtcagcgcctggagggagtcgccgctcgtcgcggcggagtagcgctcgacggtgggtccggagggaaaggcgccggaccagttcgtggcgagggacgcggcgaggatgacgagcaggggcaccgcgaacagcgggacgaagaggaggaggaagacggcccaggtggcccacttcccggcccggctatgcaccagcacgacggctcaccacccggtagaggctgtagaggcccacggagatcgcgatgttgacgacggcgacgacgcaggcggccgggtagtccgactccaggatcgccttgctgtagacgagcatcggcagcgtcgtgacgcccttcgccccggtgaacaggacgatcccgaactcgttgaggcacatcaccaggacgaggctgccgcccgccgcgagggccgggagcgcctcgggcaggatgacctgccggatgatccggacgggcccggcacccagcgaggaggcgacctccagttgtccggtgtccagttgggagaacgcggcgagcagcgggcgcatcacgaacggcgtgaagtaggtgatctcggcgagcaggacaccccagggggtggtcaggaagtggaagggaccctccgccgccccggtgacgtcggtccagagtccgttggccatcccgacggaaccgtagacgaacagcagggccagggtgatgaggaaggacgggaaggagaggaacacgtcgacgaagcgtgcgaccgccttcccgccggggaacgggacgaacgcgatgaccagcgcgaggacgaacccgaggacgaggcatcccgcggtcgagccgacggcgagccacacggtggtggtgagcgcctcgcggaagacctcggaggcgaagacgtcggcgtacgggtcgagtgagacgccgccctcgtcgggggtgaaggactgctggacgacgagggccagcgggtagaggaacgcgagcgcgaggacggcgacgggcggcagcgcccagacccaggtggggacggagcgggagggtgc

SEQ ID NO: 2817 - DNA, 8821 bp, Unknown
  Kingdom: Bacteria, Phylum: Actinobacteria, Class: Actinobacteria, Order: Streptomycetales, Family: Streptomycetaceae, Genus: Streptomyces
cctcaggcgtgcttgagggcccggattcccaggcgtgctcaagcccgcccggctcccctcaggcgtgcttgagggcggcgaccgccgaggcggccaggtcgtccaggtagcccttcggcagttcgccgcggaccacgacgagccgccagtacagcgggccgacgatcagatcgagcgcccggtccggatcgctgccctcgggcagctcaccccgggccaccgcctccctcaccaccacggcggcgacgccctgctgctggtccaggagcgcggtcttgatcgcctcggagatctccgggttccgggccgcttcgaccagcaggtccgggatgacctgcgaggcgaccgggtggcgcagggcgtacgcggccagttccaggacggcgcgcacgtccccgtacagcgcaccggtggccggggcgggcatcccctgggcggcgacggccgcgaccaggtcgaggaccagcgccagcttggacttccagcgccggtagacggcggtcttgccgacgcccgcacgccgggcgatgccctcgatggacatccgggcgaaccccaccgcggcgagttcctcgaagacggcggcgcggatggcgtccgtcacgtcctcgcgcaggacggcggcgcctgcgggggcgcggcggcgggttccccgttcggtggtcatggcccgcatgatagtcggccgcgacgaaacggttgcgttgcgacgtagaagcgtcctactctcagcgttacgacgatacggtcccgtcccaacgagggcgtccctacgggaccgtatcgttccgcccttccgtcgttccgtcgttccgctccgatcccccctcccgcttccgtcgaaagcgatcgttcgtggtgagccagacagcagctccgccttccccggtgagcgcccccgcccaggacgtccccacctacgcacccggtgagctggccgccctggccgcccggcacggcctgacggtcagcggtgcccggccagccctgcccgcctatatccggcagctgtgggggcgacggcacttcatcgccgcgttcgcgacggccaagctgaccgcccagtacagccaggcgaaactcggccagatctggcagatcatgacgccgctgctgaacgcgacggtctactacttcatcttcggtgtcctgatgaacaccaagcacggagtggaggacttcgtcccgttcctggtcaccggggtattcatctggaccttcaccgccagctcgatcaccgcgggaacgcgggcgatcagcggcaacatcggcctggtgcgggccctgcacttcccgcgcgcctcgctgccggtggccctcgccctccagcagttgcagcagctgctgttctcactcggcgcgctgaccgtgatcctgctggcgttcggccagtacccgcgcccgtcctggctgctggccgtcccggcgctcgcgctccaggcggtgttcaacaccggggtgtcgatggccgtggcccggctgacggcgaagaccccggacatcgcgcagctgacgccgttcgtgctgcggacctggatgtactcctccggcgtgatgtggagcctggaccacctgctcaagggtgaccgggtgccgcacgcggtgatggtggcgctggagtacaacccggcggcgctcttcatcaacctcatgcgctacgcgctcatcgacagttacagctgggcgcagctgccgccgttcgcatgggcggtcgcggcgggctgggcactgctgtgcggcgtggccggattcgtgtacttctggaaggccgaggagacgtacggacgtggctgatcccaaggatttccccggcctcaaggatgcgcccgccgacccgcgcgtcccgaccgtcgtcgtcgacgacgtccacatcacgtacgcggtcaacggtgcccgtacgggcaagggcagcgcgacctcggcgctcagccggatcaccacccgccgtcgcacccccggcgcacgccaggtgcacgccgtgaagggggtcagcttcgccgcgtacaagggcgaggccatcggtctgatcggctccaacggttcgggcaagtcgaccctgctcaaggcggtcgcgggcctgctcccgccgacccggggcagggtccacacccagggccagccgtcgctgctcggcgtgaacgcggcgctgatgggggacctgacgggcgagcgcaacgtggtgctgggcggactcgcgatgggcatgacccgcgagcagatccgcgaacgctacgacgagatcgtcgacttctccggcatcaacgagaagggcgacttcatcacgctgccgatgcgcacgtactcctcgggcatgggagcccggctccgtttctccatcgcggcggccaagagccacgacgtgctcctgatcgacgaggcgctgtccacgggcgacgcgaagttccagcgccgcagcaaggaccgcatcaaggaactgcgcgccgaggcgggcacggtcttcctggtcagccacagcaacagatcgatcaccgaaacctgcgaccgggccctgtggctggaggcgggcacactgaggatggacggcccggcgaaggaagtagtggcagcgtacgaggcattcaccaaacgcaagtagcccttcaccccgtccggccgaccccggcccgtccggcgcttgaggacaacacttcagcccgtccggcgctcgaggacaacacccgcgcctcggcggcccgtaccaacgcccggggggccggcaccaccacgtggcgccggcccccacagacgtacaagaccccctaagcgtgcgtacggagcagcgtccgcatcgtccgcatcgccaccgacagattcgccagatcgaacgcgtccgacccctggatctcctccagcgtcgaccgcgaccgggccaggatcgccgcgttcttctcctcccacgcccggaaccgctcctccggggtcgcggacccgttccccacgctcagcacgtccgaggtgagcgccgcgtgcgccgcgtacaggtcctcgcggatggaggcgcgggccatggactgccagcggtcggcccgcggcagctcgatgatccggtccatcagctgggtgatccgcagccggtccgcgaggtcgtagtagacctcggcgacctccagcggatcccggtccgtacggtcggcgatggccacgatgtccagcgccgggaaggcggaggagaacccggccacgcggaccgccagctcgtccggcacgcccgcggccgtcagctcgtccaggatcgagtggtaccagtccaggtccgcacccttgagcagcttgggcagctcgtcccagacccgcgcgacgccgtcccggaacccttcgatggtctccgcgatggcgacgggctgcggcctgttgcccagcagccagcgcgcaccgcgctcgaccagccgccgcgagtgcagccggatccgggtctggacgtccgcggcgaccttgttgtcgagcgcctcgaccgcgtcccacacccgggacaggccgaagatctcacgggccgcgaactgggcccggacgatctcctcgatggacgctccggtctcctcgcgcagccggtgcaggaaggtcgaaccggcggtgttcaccgtgtcgttgaccaggaccgtcgtgatgatctcgcgccgcagcgcgtgcccgtcgaccgcctcggggaaccgctcgcgcagctcgctcgggaagtaggcgtgcaccagcttctgcaggtgcgggtcgtccggcaggacggtggagatcagctcgtccgccgccgtgatcttggtgtaggcgatcagcacggccaactccggctggctgagtcccttgccgttgctcagcagctcccggatgtgccggtcggcgggcaggaactccagcgcccggtcgagagcgccgtcgcgctccaggcgtcgcatgaaccgctgctgggcgtggagcagggacggggcctgggcggaggcgttggagagcgcgacgttctgcgcgtagttgttgcgcaggaccagtgcgccgacctcgtcggtcatgtcggcgagcagcttgttgcgctgcttgacggtcatgtcgccgtcgcggacgagaccgttgagcaggatcttgatgttcacctcgtggtcggaggtgtccacaccggcgctgttgtcgatcgcgtcggtgttgatccggccgccgctgcgggcgaactcgatccggccgagctgggtggccccgaggttgccgccctcgccgacgaccttggcccgcaggtcctcgccgttcacgcggatcgcgtcgttggccttgtcgccgacgtcggcgttcgactcggagacggccttgatgtacgtgccgatgccgccgttccacaccaggtcgacgggtgccttgaggatggtctgcatcaggtcggcgggcgtcatcttgctcaccgaggggtcgatgccgagcgcctcgcggacgtgcgagttgagcgggatcgacttggcgctgcgcgggtggatcccgccgcccgccgaaagcaggcccgtgtcgtagtcggcccaggagctgcggggcaggtcgaagagccggcgccgctcggcgtacgaggtggcggcgtccgggttcgggtcgatgaagatgtgccggtggtcgaaggcggcgacgaggcggatgtgctcggagagcagcatcccgttgccgaacacgtcgccggacatgtcgccgacgccgacgacggtgaagtcctcggtctgggtgtcgtggcccagctcccggaagtgccgcttgacggactcccaggcgccgcgggcggtgatgcccatgcccttgtggtcgtagccggccgacccgccggaggcgaacgcgtcgccgagccagaagccataggcgacggcgacctcgttggcgatgtcggagaagctcgcggtgcccttgtcggcggcgacgacgaggtaggtgtcgtcctcgtcgtgccggacgacgtcggcgggcggcacgacctcgccggccaccatgttgtcggtgatgtcgagcagcgcggagatgaacgtgcggtacgcggcgatgccctcggcgagccaggcgtcgcggtccacggacgggtccgggagctgcttggcgacgaagccgcccttggcgccgacgggaacgatgacggtgttcttcaccatctgcgccttgaccaggccgaggatctccgtacggaagtcctcacgccggtccgaccagcgcagcccgcctcgggcgaccttgccgaaacgcaggtggacgccctccacacgcggcgagtagacccagatctcgtacgccggccggggcgcgggcaggtccgggatggcctgcgggtcgaacttcatcgagacgtaggagtgcggcgtgccgtcctccgtgtgctggcccctcttctcgcttccctcgcttgcgctctggaagaagttggtgcgcagggtggccttgatgacggtgaggaaggaccgcaggatccggtcctcgtcgagcgaggcgacctggtccagggccccgtccagctcctccaggagcccgtcggtcagctccgtgccggcgctctggcggccgggcgacatgcgggcctcgaagagcgagacgagcagccgggtggtgtggacgttgttgcggagtgtggactccatgtagtcctggctgaaggtcgaaccggcctgccgcaggtacttcgcgtaggcgcgcagcaccatggcctgacgccagttcagcccggcgccgaggaccagcgcgttgaagccgtcgttctccgcctcgcccctccagacggcggcgaacgcctcctggaagcgggcgcgggcgtcgtcggcgagatagccgccgttgccgttggccagcggcatccgcagcccgaagtcgtagatccaggcgtgggtgcggtccgcgcagcgcagctcgtacggccgctcgtcgacgacctcgacgccgagctgctgaagcgccgggaggacggcggagagggagacctgctcgccggtccggtagatcttgaagcggcgctcgccggggcccgcgccgaccggctcgtacaggctgagagcgaagtccttctcgccctgcttgagggtctccaggtggaccaggtcggcgacggcggcgcgcggcgagtggtcggccttgtagccctcggggaacgagtggccgtactggcgctggagttcggcgccgcgctcctcgcccagctcggcggtgagcgcctcctggaagccgtcggcccaggagcgggcggcctcgacgaggcgggcctcgatgcggtcggcgtcggcgtccgtcaggtgcggcagctcggtgccggccgggacccggacgacgaagtgcagccgggagaggatcgactcggtgttccaggcggtgaagtcgacgctgttgccgccgagctcctccttgaggatgtcgatcagtcgcaggcgtacgccggtggtgtagcggtcgcgcggcaggtagacgatcgcggagtagtagcgcccgtactcgtcctggcgcaggtagagccgcagccggcggcgctcctggaggtagaggacggaggtcacgatggagcggagctggtcgacgggtgtctggaacagctcgtcgcgggggtaggtctccaggatctggagcaggtcgcggccgtcgtggctgttgtacgagaagcccgcgccctcgacgacctcggcgaccttgcgacggatgacgggcacccggcgcacggactcggtgtaggcggcggaggagaagagtccgaggaagcggcgctcgccgacgacgttgcccttggcgtcgaacttcttcacaccgacgtagtcgaggtagctggggcggtgcacggtggcccggctgttggccttcgtcaggacgaggagcttgtgctcacgggccttggcgcgggcgtcggcgggcagccggtcgaaggacgggctgacggggtgcgcctcgtcctcgctgtggtgcgggtcggagcgcaggatgccgagtccggtgccgggcacggcggacagcgcgtcgctgtccttcagctcgtactcgcggtagccgaggaaggtgaagtggtcggcggccagccagcgcagcagctcgcgggcctcctcgacctcctcgtcggcgaggtcgtccagcggttcgccgggcaggtcgtcggcgatccgcagggcggcgtcgcgcatcttcccccagtcctcgacggtctcccgtacgtcggacaggacgcgcagcaggtcggtggtgatctgctggaggtcggcgcggtcggtctcgcggtcgatctcgacgtggatccaggactcgacgagagcgtcgtggggcagctcggccttgccgcccttgcggcccttggcgctcttcgggaggccggggccgccggagaggacctcgatgagcttgccggtgacatcgcggcggaccgtgacctgcgggtggatcacgacgtggatgccgcgcccctgccgggacagctcgttcgtgacggagtccaccaggaacggcatgtcgtcggtgacgacctcgacgacggagtggctgcaggtccagccgttctcctcgacggtcggggtgtgcacccggacgttcgcggtgccctggggacggttctcggccagccggtagtgcgaggcggcggcgccgaagacgtcgaccgggtcacggccgctgaggtcctccggagccgtatgcaggtagtagcgctggaggtaggcgagcaccgtgtcctgacccggacgggcgctctcatcggccccggcagcggaagtccgcgcccggggggcacctcccgggccaccgacaccaccgcccggaccgtcttcagctaccttggcggcccctgcgagcagctcggccttggcttcgtccagcttggtctgcatgtcctctggctcctgtcgcgcgccgttgcgtgacgtaggtgagaaaagcggcgtaccgccacgacgcggggtttccggtctgggtcgacgctatgccgcttcgagagatacccgggaccatattggccattttcggcagccggtccggagtcgggagatcgcggatcgcccgggtgctgtggcactccgggcggcagccgggggcttcgctgcccccgaggcgtatcgcgctgatcacggcaccaggctatccccctcgcaccccatcgcgtcatgagctgcttgtgtacaaaagaacaccccgaactttgacactctggacagtgcgccgcgccgccttggcgaactcccgaaaccggggcagtctgtccgtaccgcacggatccaggccctcggcacgccatcggggccaccggccccgaggagcccgtcatgccgcagaagatcctcatcgtcaccggcgacgccgcagagtcgctcgaagtcctctacccgtaccaacggctgctggaggaggggtacgaggtcgacatcgcggcccccgagcgcaagacgctgcgcttcgtggtccatgacttcgagcccggcttcgacacgtacacggagaagcccggctacacctggcccgccgacctgtccttctccgaggtcgaccccggagcgtacatcgccctggtgatccccggcggtcgcgcccccgagtacctccgcaacaacgccgaactgcggaagatcgtcggcgcctttttcgccgcggaccgcccggtggcccagatctgccacggccctctgatcaccgccgccaccggcagcctcagcggccgcaacgtcacggcctacccggcactggaaccggacatgcagagcgcgggggcgaccttccaggacacggaggcggtcgtggacggcaccgtggtctcctcccgagcctggccggaccacccggcctggatgcgggagttcctgaaggtgctcaagtcaacccacccctcagacccctccggcatctgaggccccctccccatccccac

SEQ ID NO: 2818 - DNA, 1280 bp, Unknown
  Kingdom: Bacteria, Phylum: Actinobacteria, Class: Actinobacteria, Order: Streptomycetales, Family: Streptomycetaceae, Genus: Streptomyces
gtgcacgttccgccgcctggcgcggcggaacgtgcaccagctggctggagacccgctccttggtgaggctgctgttcacctcgccggtcagcagcgccttcacgtccgcgttgacctcgggccgcagccccttcgccgcggtctgccgctcgaagtgcttgctgctgaagaagaccagcgccccgccgtcctcggtgcgcagcccgagcggtgcgaacgccgcactcgtcagcggctggtcgacgtactggtacgagaaccccgcccgccgggtggtgcggcgcgtctcgcgccagcccgaggtcgccgtcgagggtgtgaacacatccggggcgccgctctgcagatagccggtgtacgaggcgctcagctccgcgggcgccacggccaggctgtcgtccccgggcttcaccggggtggcgaacccgtcctcgtccagggtgaactccggtacctgggacggcgggacgaccgcgagatacgacgccttccacagggcgtcgggtcccgaccgttcgaacaccaccagccagcgggtgtccagcttcccgccgtcctggtcacggttggagtcggtgtccgcgaggaaccagcgcggccaacccgccttcttggggatgacgtacgtcgcgtcgtccagcaccagcggcttgtgcgccttgttgccttcggggttgtacgtctgccgcgccttcagcccggcctggttgatcgcgccgagcggacccgtcacccggtccgcgtccagcgccggatcgaacgccttgtccgccgcgttgtaggcgtcggtgaagtccttgagcgcctgcgcggcctccggcttcttcgccccgggcagcacttccagctccccgtgcaccgtcacacagccgctcgccgtcacgcacagcaccgtcgccgtcgcgagccccgccgtcagccggcccagcccagggtgtctcgtcatccgttgcttctgcgccttctgaatccgtcgcccgcactgaccgtcgaaaccctaccggggcgacggacggcgtgcgggcggggaccggatacagcgtccacaccgtgacctggcggtggaagccgcctcagacccctcgcaccggcacgatcagcggcctgcccgtacgggggtgggggaagacctccaccggctgccggtagacctcaccgagcagctcgccgctgaacacctcgaccggtgggcccagttccgcgatccgaccctcgtgcaggacggccgcccggtccgcgtacgccgcggcgaggccgaggtcgtgcagcacgaccaccac

SEQ ID NO: 2819 - DNA, 6237 bp, Unknown
  Kingdom: Bacteria, Phylum: Actinobacteria, Class: Actinobacteria, Order: Streptomycetales, Family: Streptomycetaceae, Genus: Streptomyces
ggtaccgccgctggaggccgtcggcaactcccggcggtacgcgctcgtcgcgacgctcgttgctctcgtcgtcggcggcctccagcggcggtaccaggaaggtggaggagccgccggacccggccgactggagggcccggtagtagccgaagccgtacccgccggatccggcggctccgtcgaaggaacgctccaccaacacccccagcggcagcaggatcagcagcagcgcggtgagcaggacgccgccgagcagggcccactgcccggcaccgcgcggccggcgggaggtctgggccgggtcgacgagcttcagcgcccgctcccggcggcgtacggtcgcggcgtgcacggcgaggatcgcgccgaccgcggcgaactggaccagggtcagcacggcggccgtcggcaggtccagcagttgcgcggtctgccggtagatctccacctccagggtggagtacgcgggtccgccgaggatctgcacgacgccgaaggaggtgaaggtgaagaggaacaccatcagcgcggcggcggcgacggccggcgcgagcgcgggcagcgtcaccctgcggaaggcggcgaaccgtccggcgccgagcacccgggcggcctcctcctgccgggggtccagctgggaccagagcccgcccaccgtccgtacgaccaccgcgtagttgaagaagacgtgggccaggagaatcgcccacacggtggtgtcgaggcggacgccccacagttcgtcgaggagcccgccccgtcccagcaacgccaggaacgcggtgccgacgacgacggtgggcagcacgaacggcaccgtgacgaccgcccgcagcagttgcttgccggggaagtcgaaccgggcgaagacatacgccccgggcagggcgatcagcagagtgagcgccgtcgaggcgagggcctgccaggtggtgaaccggaggacatcgaggatgtcgggccgggccagcacctcgccgatccgcccgaactgccagtcgcctcccgccttgagcccgcggccgacgatcgcggtcacgggataggcgaagaacagcgtgaagaacgcgacgggcacggccatcaggccgagccgcagcgcggccccgcgccgcccgggcccgcgtcgggtccgggcggtttcggcggtcttcgccccgggatctacttcaggaccagcgactgccacgactggatccactgctcacggttggcggtgatcttctcgggcgcgacggtgggaggcgtgtcgatcttctcgccgaacttcgtgaacagctcggggagggccgcgtccttcacgaccgggttcacgaacatgttcagcggcatgtcctcctggaacgtcttgctgatcaggaagtccagcagcgccttgccacccgtctcgttcttcgccccggtcagcagccccgcgtactcggtctgccggaagcaggtgccggtggcgaccccggtgggggcctccttcggctgcgggtcggcgtagagcacctcgacgggcgggctggaggcgtaactgacgacgagcggacggtcggcgttggccttcctgccgcccgcggagccggagaactcctcgttgtacgcctgctcccagccgtcgacgaccttgacgccgttggccttcagcttcttccagtacgcctcgtagccgtcctctccctccgcggcgatggtgccgagcaggaagccgagaccgggcgaggaactcgcggcgttctcggtgacgaggaggttcttgtacgcgggcttcagcaggtcctcgaaggtcttcggcggcgcgagcttcctgtcggcgaagtacttcttgtcgtagttgacgcagatgtcaccggtgtcgacgggcgtgacccgcctctccgcgtccgtctgcgtgtccgccgcgaccgtgtccaggccttcggcctcgtacgcggtgaacaggccgttgtcgagggcgcgggagagcagggtgttgtcgacgccgaagaagacgtcgccgcggggggagcccttggtcaggatctcctggttgagcgcggccccggcgtcgccgctcttgaggatcttgaccgtgtagccggtctccttcgtgaacgccttcagcaccttgtccgagacgttgaaggagtcgtggctgaccagggtcacggtcttggagccggtgcccttggaggccccggatcccgcggagccgtcgtctccgcagcccgcgagcacggtgacgccgagagcggcggcgagggcggtcgccgcgtacttcgtggtggtgttcatgtgattcctcctgggggtgaccaggaagagacgcggccctgcccgccgtccggcgaaccggaagcgggcagggcgcaacagcttgagtaaggtccgaacttcctacccggaatgacccgggcgaggttcagagggtctgcggccaacctgtccttggtgccgcactctcagcgctgtggcgctcccctgtcggaatatgaagttgatttcgggcccaggctacaccggcggttttcggccgcccgtccggtacggcccttagcgctcggaggccgccagctgcccgcaggccccgtcgatctcctgaccgcgggtgtcccggacggtgacgggcacgccgtgggccgcgatggcctcgacgaacgccttctcgtcctcgggccgcgaggcggtccacttggagcccggcgtggggttcagcgggatgaggttgacgtgcacccgcttgcccttgagcagtcggccgagccggtcgccccgccaggcctggtcgttgatgtcccggataagggcgtactcgatggagatccggcggccggacttatcggcgtactcccaggcggcgtccagcacctcgcggacgttccaccgggtgttgacggggaccagggtgtcgcgcagttcgtcgtccggggcgtgcagcgagacggcgaggcggcacttgaagccctcgtcggcgaagcgcagcatggccgggacgaggcccacggtggagacggtgatcccgcgctgcgagagaccgagaccgtccggctccgggtcggtgaggcggcggatcgcgccgaccacacggttgtagttggcgagcggctcgcccatgcccatgaagacgatgttggacagccgcgcgggcccgccgggaacctcgccgtcgcgcagggcgcgcatgccgtcgacgatctggtgcacgatctcggcggtcgacaggttgcggtcgaggccggcctgcccggtggcgcagaaggggcagttcattccacagccggcctgcgaggagatgcacatcgtgacgcggtccgggtagcgcatcaggacggactcgacgagcgtcccgtcgtgcagcttccacagggtcttgcgcgtggtgtcgtcgtcgcagctgatgtgccgcatcacggacatcaggtcggggaacagcgcctcggcgagcttctcccgcgaggacgccgggatgttcgtccactcggccgggtcgtgcgcgtaccgcgcgaagtagtgctgcgagagctgctgggcgcggaacggcttctcaccggtcgcggcgaccgcttccttgcgctcggcgggcgtgaggtcggcgatgtgccgcggcggcttcttggatccgcggggcgcgacgaaagtgagttctccgggcttaggcatggttcatccagtgtcgcagacacgccgaggtgccccgggtcgtcacccagctcaccaaccattaatcggcggtggcgctggtcgttaatggtggttgtcggtcgtcgtcggcggcccttcgacggcccacagacggcccagcgccgtagctccgtccccaggtcagagtgtcagccgacgctggtggcggggaccgtaccgacagccaagaggtgcgagctggcggcgaggagctccgggtacggctctgccatgcgggccgcgtccagagctgaggcgatcagctcatccgtgggaccttcgcccggctgctgttccgccgccttcaccagcgaccaggcagggccctcgataccgaagacctgcacatcctccagcccagcgtcggccagctccgccaccagctcttcggcccggtgaaagtacgacagggtgaacccccgcgctccgtcatagaccgccgtctccagaatcttggagacggagttgtggatccgttcggtgtgcaggtgggcgtacgtaacgtgctcgaagagcgacgcatagcgattgatcgcggctgcggcgaccagtccgccgggcttggccacacgggaggcttccgcgagcgcccgttgccggtcggcggggtcgggcagatggtagagcggcccgaggagctgcacgacgtcgaaggtgtcgtccggctcaggcaggtcgcgcgcgtcaccgacgaccgccggacacaccgccgacgcggccccaacgtggcggggcaccgggtctaccagagcgacgtcatagccgtctttcaccagccattcagcgtgaatcccggtccccccgcccacgtcgagcacacgcgccggcgcggggggcagaaagcgtcggaggagttcctgagttctgaccagttccatccgaccgtctgccgagctgcgcagacggctgtcctcgttgaccgtctcgccatagaaccgcatcacggagggtgccaattcgagattcgacatggtcgcagtatcgtgtgtaccggtggaccagtccagcgcaggaaataggggaagccatggcagtcctgaagtacgaagagatcgcagagttcctgcgcgcccgcatcgccgctggtgagatcgcccccggggccacaattccatcgggtcgggagttggccgagcagtgggatgtgtcacgagcgaccgccatcaaggccgtcgatgtactgcgaaacgatggcgtggtcgtggccaagcagggaaccgggttcgtcgtcaccgagacgcccgttgcgcgccccgccggggctcgccgtgcggggtcggcgcgcatcctgggcgggatgccgttcctgcgcgtcggtgagcccgactgggcggaaccccccgcccgcgtcgccgccgctctcggcctcgcccccgggacgacggcgcttcggcgcgttcgggttctccagctcccggacgggacgccgaatagctgcgttgaggcgtggttcccgccggaggtcgcggaggtgtcgccgcgcctcgcagacaccaccccgatcgcagaagggacgacgcgctacgtccgtcgccagacagggcggggtccagccgaaggcgtggacatcaccaccgttcggggcgcttcggagacggaagcagaacgcctaggggtacctgaaggggcaccggtcgctgtgctgctgcacacggcgtacgacgagcaggggaaaccactggtctgcgaggaaggcgttacaccgtcctcactgttcgaacaggtcgacacctacgcaatgtagacagaaagccgcaaacgaaacggctggaccggtccaccggttcagctttttttattgcctcgaaatgccgccccacctgcactttccgtcacaccgacacgacgaaacgtgagttcatcgcttgactggaccggtccaccggtccagtctcttggttgtggccagcagccgatccggaacttccggaaagggcggtgaaccacgcagaaggggccttctttgggctgcttcgacctgcacgaccgggcgtctcgtcttcgggcgagacgccaaggggcccgggacagatcgggccgaggcgaccggcgccttgtcagtccggatggcttagaccgcaaggtcacgtctccacacgcctaccacgcggccatgcagcgctacctgatacgggcgctgcccccgcgaaggagacatcgcaccaccccaactccgcagctcacactgcggccggttgcctcccccgcccgtccagcccgcccttgtggtggtgctgtacgggcgaggttgaggggagccggatcgtccgccctccataccttctgggagtcatcgtgagtgaagttgagatcgtctcgttcggctacctgcacggcgagccgccggccgcgcacctgaccatcgacctgcgccaccacttccgcgacccgcatgtccgaccggagctgcgctacatgaccgccgatgacgctccggtccgcgaggccgtgctcgccacgcccggcatcaccgccctggtcgacgcgaccgccacggcggtcgacgcgttcgcgtccggccccacggcgggcgtcgtgacggtggccgacggatgcgccggtggtcgccaccgcgccccgacgttcgcccgc

SEQ ID NO: 2820 - DNA, 3475 bp, Unknown
  Kingdom: Bacteria, Phylum: Actinobacteria, Class: Actinobacteria, Order: Streptomycetales, Family: Streptomycetaceae, Genus: Streptomyces
gaccgtggccgccctggcggctcggccccccggaacggcgcggcgccggcgaaccggagcggttgctgcggtgcgcaccggcatcggagccgaaagtaggactgcccgtgcggctgcgggcacgtgcggagcggttgttggtgcgtgaggggttcattcagaaccttccttgacacggtacgcatcaaggaattctcgcagcagaagaacagcgcggggaatcgcaagaaacggaccgaacgaaatgcgaaatcagacacgacctgcggcgcatcgggcgcacatgcaggcgatggaacgggcgacgtcacgcgggcagggaaggcgcaggacgtctacgggtacagctccgaagaggcccgtatttctggagagggatctgcgggcatcaccaccccacgggcgaaagccccggggaatgcccgtagctggggcccgcaccccgagggatgcgggccccagctacgaagtacgcgtcggcgtcagaccggaacgatgttctcggccgtcgggcccttctggcccgccgcgatgtcgaaggtcaccttctggccttcgagcagctcacgaaagccctgggccgcaatgttcgagaagtgggcgaacacatcggcgccgccgccgtcctgctcgatgaagccgaaacccttggccgcgttgaaccacttcacagtgccggacgccatgtcatatctcctctggggcagtacgccgggacccgtaatccacggataccaggtcgccgcgatgatgccccgaccggagaatgaccggaaatacaaaacgcttcctgcggctgaagcagccggcgaaagcgtcgaagtttttgggaaccacgactgcaactgagatcgacagtagcatgcggtagcggccccccgtacggttaaatactccactctgttcgctgcggtaaacacactgtccgcgcgaaacatttaattctcgtcccgcggtcatagatatggagcccgccggagcgtccggcggcacgggcgcgccgagacaccggccccgccccctcacgcgcggcccgtacgctcgtccgggggacgacacatcagccccgccgcctgcccgctgccgaggagttagtggcacgcgtcacaggaacgggcgcaaggtcgcggagagataccgggtgtgagggaaccaccagaatcgaagaccccggagaatcctcagggctccgacggcaccctgggcgccgaggccccggagtccgcggagaacgagatgcgccggcgcctgcaggcgggagaccgcgaagccttcgccgagttgtacgagagctgcgcccatgccgtctaccgtcacgcgctgaggctgaccggtgactggtcgactgccgaggacgtcatggcggacaccttcctggccgcctggcagggcagagagcggttggaggagggccggggtcccgcgctgccctggctcctcggcatcgccacgcacaagtgtgagaacacccggcgggggctgcggcggcgcctggtcttcctggcccgtcagccaccgcccgccgccgtggcggacttctcggcggaggcagcgtcccggctggacgaccggagccgtctgcgcgccgtctcggcggccttgggtcaactgcggcgccaggagagggaggtgctctccctgtgcgtgtggtccggactggactacgagcagaccgccgacgcgctcggtatcccggtgggcacggtgcgctcccggctctcccgcgcccgcagaagactcgcccggatcgcggaacagacggaacgtgcggaacgcccgcgaagaaacctggaacccgcgggagtccgcggagaggtaaggaatacaaccgcgatcgcgacccagcccgtgcgggaggaaaccccatgaaccgcgaagacgccgcctctcctgagaacaggagcgacggcgaagcccggcatctggcccggctgcttccccctccggtgaccgaggacctgtcgcccgagcgattccgtcaccagaaggaagtcctgatgaaccacatcgacgccgactcccgtcgtgtcagtccggctcagcccgtcccccgccgcaccagccgactcctgcgccccgctctcctcgtccccgtgtcggcgatggcactggccggaatcctcgccggcggcctcgccctcggtacggacgacgaggaccggacgacgagggcgacggccacccagggcacagacggccttcttcaccgcctctcgaccgtcgccctcacgcgtgaggcacccgtcgtgcgggacgaccagtttctctacacccgttcccgagtccgggaggccgagatcggcagcggaaaggccgtactgagcccgctgaccgagacggagggctgggcgccgcaggacccgcgccccctcaaaaagaccgggctcacccgggtcaacggcaaggatcaggtcagtaacgccgaactcggggacgacaacggcaccccggccggactgtcccgccccacctaccgctggctcgcctcgctgcccaccgacccggacgaacttctggcctatctccgcgctcacgtccggaaggacgccgagcaggaaaccgaccagatcgtcttcgagcagatcggcgtcctgctcggcggggtactgccgccgaagacggccgcggccctctaccgtgcggcggcggacatcccgggcgtcgaggaggcaccggatgccaaggacgccataggccgcacgggcctcggcatcgcccgcgaggacaccgcacacggcaaccgcaccgaatgggttttcgacaaggacgactactccttcctcggctcccgcgtgtaccggacgaaggacgccccgtacgcaaaggccgggtcactcctccacagcaccgccgagatcgaccacgccatcgtcgacaaggccggacaggtgccgggcaaggtacccgggtccaccgggaaccagcaggccggctgatcgctccgcccgccttcgttgaccgatcacctcgcagttccgggcgacaggacgcggaccagggccggcgggcgggacgccacctcagcctgcgctcgtcgggttctccgatgcggctttgcggtattcggcgttgatgcgctgggcctcttcgagctggtcctcgaggatgacgatgcggcaggcggcctcgatgggggtgccctggtcgacaagctcccgggcacgtgcggcgatgcgcagctggtagcgggagtagcggcggtgcccgccctcggaacgcagcggggtgatgaggcgggcttcaccgatagctcggagaaagccctgcgtggtaccgagcatctcggcggcccggcccatcgtgtaggcgggatagtcgtcgtcatcgagacgtccgaacgagtcgcctgctgtcatttgcacctctctgtggaacgcgtggaggggcccgagtgccgtacggcactcgggccccgaaggaactgctaacaccatccgccggccctggttactgcgccggccttctgtttccgctg

SEQ ID NO: 2821 - DNA, 1488 bp, Unknown
  Kingdom: Bacteria, Phylum: Actinobacteria, Class: Actinobacteria, Order: Streptomycetales, Family: Streptomycetaceae, Genus: Streptomyces
ggcggcggccgggtggtgcccggtgcccgagccttggcgtacgcagtcggggcactggaagccgaccgaggcgctgaccatgcactcggggcagatgggccgctcgcagcgcgtacagctgatgccggtcccgcggtcggggtggcggtagcaggtcggcgtcggcacaccgcttcccgcggcggcacggtcccccggcggctgctggtccatcggtcctggcctgcctctcggtcctcgtcgctcggcggcgccgacagggccgcccccgctggtccgctatgtatcagtacggacgggcggggcggttggttcccgcgaggggtatccggcggaagtggacgtcagcgggtctcgacgaccacggactcgatcaccacgtcctccagcggacggtcggtacgcggattggtcggggtggccgcgatggcgtcgacgaccttgcggcccgcctcaccggacacctcgccgaagatggtgtgcttgccggtcagccaggcggtgggggacacggtcaggaagaactgcgagccgttcgtccccggtcccgcgttcgccatggccagcagatagggctgggtgaagcccagctccgggtggaactcgtcggcgaacttgtagccggggccgccggtgccgttacccagcggatcgccgccctggatcatgaagccgctgatgacgcggtggaagacggtgccgtcgtacagccggtccgtggacttctccccggtctccgggttgacccactcacgctgcccggtggccagctcgacgaagttccggaccgtcttgggggcgtggttcggcagaagccgaatctcgatgtcgccccgattggtcttcaaggtggcgtaaagctgctcggccacggtctgccttccttcgtccttcacctgacgtcacatccatcgctgacgtccgccgatcctcccacggaccgggaaatgtgcggccggatgccggacgaaacggcgcgttcgccaccgaaccgtggcattgtcgtcggcacacttcacatgaaccgttttgacctcaaatggcgaccatgacccggatgcccgtcccgcatgccgggcatggacccaacaggcatgatttcgaactgggcggacaggcggagtacctacccgccaccaaggaggaggatctcgtgacccgcatcgacagcgtgcgcgccgcaaccgactcggcgaaggacagcgcgcagcacgccgcggaagtggtggcgccctacgccgacacggccaaggagcaggcggcccactacgcacacgaggcgcgcgtacggctcgcgcccaaggtgacgaaggcggcccagcaggcccgtgtccagtacgcgtcccatctcgcaccgcgcctcgaacaggcccgtacgcacgtgccgcccaaggtcgacgaggccgcgcaccgcgccgcggtctccacccgcagggccgcacggagcgccgccgactacaccgccccccgcgtcgagcacgtccgcgc

SEQ ID NO: 2822 - DNA, 5353 bp, Unknown
  Kingdom: Bacteria, Phylum: Actinobacteria, Class: Actinobacteria, Order: Streptomycetales, Family: Streptomycetaceae, Genus: Streptomyces
ctgatgcacccctactacgcggccgagcgcggcctcgtcgacgacgtcatcgaccccgccgagacccgcgaggtgctcatcgcctcgctcgccatgctccgcaacaagcacgccgacctgccgtcccgcaagcacggcaaccaacccacgtgagcaccgcgaccgggccgctcggccccctcctgcgcgtggtccacggctccccgaccgacgaggaactggccgccctcgcggccgtcctcaccgccgtccggagccagccgccccctccgcccccgggcagcgtccgcgaacgggcggcctggggcgactcggtgcacccactctccccggccgcctcctggcggaacggccggggatgacacgcacgggccgcctcgcgcggcccgtgcgtgccggtcactgctggaggtcgccgccgagcagcatcccgctggcccagggcagccccagaccggccgggccgaaggaggccgacgaggcgtaggcgggagccgacgcaccgcccggcaggacccacaccgcgccctggtcgttctcccacgcggcaccgaccacgaggtccggccgcccgtcccggttcaggtccccggcgctcaccgtcgccccgaactggtcgcccgcctcgatggcacccggcaccccggcggtgtcctggttgaacgcgtacgagcccgcgccgagttggcccgtacggcggcccggcacgacgatgacgcccccggcgttgcccttgccgccgatcgcctcgccgggcgtaccgacgatgatctcggcggctccgtcccggttcaggtcggcgaccgcgacggacgccccgaacgcgtcgtactgctccccgccgcccggcaccccggcggtgtcctggtggatgatcatcggatccttgtcgtacgccacgcccttcgccgacccgaaccacacgtgcacggccccgccggtgtggccccacaggccctccaccgtgccgggctcgtcggggtcgccgaggaccaggtcgccgtagccgtccccgttgacgtccccgacgacggaggtgagcccgtcaccgccctgcatccggtgggcccagggatgcgcctcgttggtgtagttgacgaacgcgtagccgccgctgagcccgcccatgcggccgttgacgagcacccggtcggccgccctgtccccgttcacatcgccgtacgcggcggagcgcatccaccccgtcccgtcgtgcaggtaggacgacgcggcgccgcccgtccgggtgaacggtccggtgagctgggtggtggtgccgttgttgacgacgaggacctgggtcccgtccggcccggaccaggcggcgacgtcccggcccgcctgcccgcccggctcgacggcggtgggcagcgcggccccggacaccagtccgttcttgctgccccagaggacggtcgccgcgccggccgacttcgcggagccgaccgtctcgtacggcgatccgatcacgacgtccgcgtagccgtccttgtccaggtccgcgatggcgctcgacgccccgaaggcgtccccggcctcggcggcccccgggacacccggtgaggcctgcgtgatcacggcccgcttggcggcggagacgccctgggcggacccgtagagcacgacgacggccccggcccagtcgagcccgttgacggtggcacggggtgcggggacgacgacgtcgccgtacccgtccccgttgatgtcctgcggcacgggaagcggcgcggcctgtgctgtccccccggacagcgtggtcgcggccacggtcgtcgcggcgatggcggccagtgcggccatgcgtctggtccgtgcggtcgttccggtcatgtgtagtgcccccaccctgagttgcctgacgtgtgtgggggtattcagccacgggaccccgcgccgccgttacgcggggtcccggttcggcggaccggtcagcccgtccagccgaggaacgcggaccaggcgtccggcgcgacggcgaaggcgggcccgtcgggcaccttggagtcacggacgtggacggcgtgggggcaggtggcgacctcgatgcactcgccgccgccggcgttgctgtaggaggacttgtgccagtcgaaggcgacctcgatgcactcaccgccgctgtcgctgctgtagctcgacgtgaaccaccggagggtgctgctcattccttcactcctgccaaccgcttgatgaggtccagcgattcacgaggacccagggcctgtgaccggatcttcgcatagcgctgagcgtacgtgctcacctttgccgggtcactgatcagcagactctcgtcctgcggttccagatagacgagatgttcatgcgccgaagtctccaccagggtcattgcgccgcgagcacctgcatactccccgtacataccggcgtccaggggcagcaccagaagcgtgacattgcggcggcgcgcgcactccacgagatggagcaactgctcccgcatgatgtcctcgctgccgatgacgcgccgcaggacggcctcctcgatgacgatctcgatcatcgggagcggctcccggtcgaagaggaccttgcgctccatccgcagctgcaccagctcctccacacgctggtcggagagcggtgggtatccgccaccgatcagcgcacgcgcgtacgcctccgtctggaacagcccgtggatgacgttcgtcgcgaagagctggaggctgatcgcggcctgctccagcagcgcgtagtcctggaactgcagcgggtacttctccatccgcatgaaccgccgcgcggtctcgaacacgcccgtcccgttgccgagcacacgttccagctccaccagcatcgcgtcgctcgccggctgtgcgcacgtctccatggcgctcacggccgctgccgagtagccgagctccagaccgagctgttcctgtgtccacccccgctggatgcgcatcgtccgggccacttccgccaccatgagggccatcgggctcgcggtttccttgttctcagcactcgccattacgcgatctcatttcgactcgaccggactcaaccggtcactactcgaagtcgttgaaatccaccccacttcagagaagttcgagcaggtcaacggctgtacgacgcacctcggcaggtacggagaacgctaggtgatcgggttcacaatcgtctcgtgaacgcacttaatggcgggatgagggccgagtggattccggactccggatttcacctccgcaaggcgggcgtgcagttcgacgccgtccgcgtggacggcgacgacgggcggcggctggccgacctgatggaggagttggtcggcggtgaaccgggacccgtcgtgaccgagtcgaacggtcggcgcggggtgtacttcctcgtgcccgcgggctccacggccgggcggccgtggccgcgtgcggcgacgacgttcaacgcggcgacgggccggatcagttacgtccccgtaccggcgctcgggggtgacacctggccgctgatgtggcgctatccgcccacgcgcccggggaggttcgtgcacacgttaatcctgttcaacgcggcgtacgcgtcactgaattgagtgaccgagatacgtcacgggccccgcgtccggaaccgcgatctcgtggaagccgacgcggtcgtagaaggcgcgggcccgggtgttggcggtcagcatgcccaagtggacggccttgacgttctgttcggcgagcgcggcgaggaaggtctccatgagtcgtcgtccgtgtcccgaccgctggtgggtcgggaggagatcgatgtgcaggtgggccggatagtcggccagctccggcaggatcatgcgctcggggtcgtgcatcaggacggtcatctcctcggcgggagtggccggttcgcgcacgggggccgggtagtgctcggcgaggccggggagccattcggcgcggtagcggtcgacgaaggacacggtgtcggccgtgccgaggatgtagccgaccgcgcgcccgccgtcctcgaccacgaacgccagctccggctccaggacggcgtagggcgcggcgaagatgttcggcagcaggccggggtccgggtagaggtgacgggcgtccccgccctcgtgcccggtgcgtacgcagatgtcgaagagggccccgcggtcctcggggcggtacgggcgcagcacgggcgacggaggagtcatgcgcggatctttcagctgcgggagcgctcccgcaagggttttcccgcagttggagccgtcggcggtcttgggcaaggcccgtgcgggcagcgcccttgacagtgattacatgcacatgcaagtttagttcccgcaaggcaagtcgccgacggggcatcgtggaaagcattcgcttgcatgtgcaggcaaattatgctcgccccgttcatccccgcccattcgccgcacggaaggacctcccatgcactggctctacctcgccatcgccgtcgccttcgaaatcctggtcgccatcgccgccggaaaggccgagggcttcaggaaccgcaagtggaccggcatcaccctggccagcggtgccgccgcgaccttcttcctcagcaaggcgctgctgaccttcgacgtcggcgtcggctacgccctgtggacgtccgtcgcgggcgtcggtatcaccgtcctcggcgcgctgttcttcggccagcgtctgaacgtgaacaaggcgatcggcattctcctcgtcatcggtggcgtcgtcggtctccagctgagcggttccgcctgactccggggccgactcccggccccgtacgccccgcacgcctcgcacctccgcgccaccacctgacgacttccctgagagaggactcacctcccatgtccaacgaagccaagagctccaccaacgcctggctctcgctcctgctcgccggagtcttcgagatcgggtacgcgcttgccgtcggcggcagcgaaggcttcaccgttctgacctggtccctggtcgcggtggtgttcttcctgctgacgctctacgcactgagcctcgccctccgcacgatcgacgtgagcatcggctatgccgtctgggcggggatcggcgcggtcggcgccgcggttctcggtccgctcttcttcgacgagaccctcaccccggccaagggcatctggctggccgtcatcatcgtcggagtcatctggctcaagctcgccgaccgcacgaagcccgaggaggccgccgcaccccggccggagccgaccgtggaccggcccggcgcgcttcgggtctgacgctcctgccgccggtacgccgcaggcgcccgccgcccctccatggaggggccgcaggcgcaggctctccggctcctgcgcaggcaaagaacggcgggaggcccggggttgccc

SEQ ID NO: 2823 - DNA, 6736 bp, Unknown
  Kingdom: Bacteria, Phylum: Actinobacteria, Class: Actinobacteria, Order: Streptomycetales, Family: Streptomycetaceae, Genus: Streptomyces
cccggctcgatccggaagccgcgcaccttgacctggtcgtcgctccgcgcgatgaaatccagttgtccgtcggcgcgtcgtcgcaccaggtcgcccgagcggtacatgcgctccccgggcgcgaacgggcacgccacgaagcggcccgcggtgagcgcgggccggccgtggtaaccgcgggccagcagagcgccgccgatgtacagctcgcccaccgtgccggtcccgaccggggcgagcgcctcgtccaggacgtacagccgggtgttccagacgggacggccgatggtcaccaccccggccgggacgtcgtcgcccggctcgatgcggtactccatgcagccgatggtcgtctcggtcggcccgtactcgttgatcacggtggcgtcggggcggcgggcccgccactcggccagggcctcgccgagcagcgcctcgccgccgagcaccagctgcccggtcggggagtaggcgtcgggcagggccgccagcaccgcgagatgggtgggggtggccttgacgaaggtggcctcgggcagggttccggagtccggggcggacccctcgtgcaggtccaccagatggacgcagccgcccgcggtgagcggggcgtacaggccggtggccgtgaggtcgaaggcgaccggcgagtgcaccagggcacgcccggtgacggctccgtacgcctgccgggcccaggccagatagacgttgagggaacggtgttcgacgacgacacccttggggcggccggtcgatccggaggtgtgaatgacgaagaccgggtgcgcgggacggagcggagctgtccgctcggcgtcggtgaggtcggccgcggacagggcggccgtctccgcgacggtctccggggcgtcgagcaggacgcggtgggcgtccgtcgcgggaagcgggtcgccggagcggccgatcaccacggacggggccacgtcgtcgagcatcagcgcgatgcgctcggccgggtgggaagggtccagcggcaggtacgccgcgccggccttgaccacggccagcagcgcgacgaccaggtcgacggacttggtgagggcgaccgcgacgaagcactcggggcccaccgaccgcgcgacgagcagccgcgccagccggttggcgcgggcgttgagctccgcgtacgtcagctccgtcccgccgtgggcggcggcgggagcgttcggggtgcgggcggcctgtgcctcgaagagcgcggtgagcgtggcctcgggcaccggccggtcggtgtcgtcggactccgccatcacccggtgcgggtgcccgggcgtcgcacccggcccttcggcgagcgcggtcacgtgcgcgcccccggcctgcggggctcacccaggtccacggggagggcggtcaggccgcgcgccaccgggttggacttccagcggacgctcccgggaccctcggcgtggcgcatctccgggaagcggtcgaagatccggccgaagacggcacggccctcggtccgggcgaccatcccgccgacgcagtagtgcgcgccgtggccgaacgccaggtgacccgcggtgttccgggtgatgtcgaagcggtccgggtcggggtaccgggccgggtcccggttggcggaggcccgggacaggatgacgatctcgttccggtccaccgtgacgtccccgaaggtgacgggctccgccgtgtactgcggagtgacgatgtcggtcggcgggtagtaacgcagcacctcctcgaccgcgttggtgacgagggaggggtcggcgttgagctgcttgagctggtccggttcggacagcagggcgtgcacaccgttgccgagcaggtcgacggtggtctcgtggccggccaccacgaacagcatggcctgcgcgatcacctcgtcctcgttgaggaactccccggagtccagggccccgacgaacgcggtgaacgcgtcgtccccgggccgggcgcgcttctccccgatcagcgcccgcagtcgttcgacggcgatgaccgcacccgccgcgtaggccccggtggcaccctggtcgcgggaggcgtcggtgccgtagccgaagagttcgtggtcctcctcgggcaccccgagcagttcgcacaccaccgcgagcggcagcttccaggcgaagtcccggaccaggtcgacgggtccgccgccggcccgctcggcgagatcgtccagcagggcgtcggtgagggcctcgacccgggggcggatgccctcgatccgcttcttggtgaagaaccgggccatcacggaccgcagccggggatggtccggcgcgtccagcagcgtcaggttgcggccgagcagccgggccacgtccccgccgatcgcgggcggctccgggatgcccatctcggccatgaacgggttcaggtcgtggcgaagccgggagtcggcctgcccgtgatggacgtcctcgtaccgggtgacgagccaggcccggccgggcgggcccggccaggtgatgccgcggaccggatcgttgtcccgcagccaggagtagacggggaagggattctggaagaaatccgggtcccagacgcccggaccggtaccgccgatgggctgtccggggagcgggggcgggccgcctgcctgaggtgtttcggacatgactcgattgcctcctcgatcggaaaagtggtcaggattcggtcgtcgaaatcaggaagcggggccggagttcttcgcggcgccgagtttctgtgcgagtacgcggccgatctgtccgatcggttcggggttcgtcatgtcgtcgtggtcacaatcgatggccaccgtatgaatacgaccacccgtgaaggacgaccacgactgcggattcggcgacccgtcattcttgttacgggttgcgacgaacattaggaggtcgccggtgaaaagacgagggcgatgggtgacccgctgcatgttcctgcatgccgcgaccagggcggtgacgcgccgctcgtccagccccgccagggcgctgcgggtggcgccgaccgcctccgcgaccagggccgcggtgagcggccggccgaaggcctccgggtccacaccggcgaagcgcagcagcgccgcgagcacctccgactcctcggcggcgcctcgctcgccggtgaccgcctcggggtaggcgtccagtgcggccagcagttccacctgctcgcccgcctcctggagccggacggccatctcctgcgcgacgaccccgccgatcgaccagccgagcagccggtacggtccgctcggctgcaccgagcgcacctgctccagatagtcggccgccatttccccgatggattcggggagttcggccggaccggccagaccgcgcgcctgaattccgtacacggggatctcgggatcaatatgccggagcagcccggaatacgtccagctgattcccgctgccggatgcacacagaacagcgcggggcctccgtttccggggcgcaggggcagcagaacctcgaacggatcctcctcgacacctgttccgatacgttcggtgaattccgcgacattcggcgcccggaagagggtggcgattcccacctcgacaccgaggaccgcccgcacccggccggtgagccgggtcgcggtgagcgaatcgccgccgagcgcgaagaagtcgtcgtcgataccgacctcctcgcggcccagcacctcggcgaagagccggcagacctctgtctcgcgggggttgcgcgggctccgggagagcaccgggccggccaccggctcgggcagcgccgcccggtccaccttgccgttcgcggtgagcggcagttccggcagtgtcatgaacaccgacggcaccatgtagtgcggcagccgggccgcggcgtacgcgtgcacgtccacgggctccgtcgtgtccgccgggaccagatacgccaccaggcggcgtacgcccggctggtcctcccgtaccgcgacggccgcgccggccaccgcggggcagccggtgagcacggactcgatctcgcccggttcgatccggaagccgcgcagcttcacctgctggtcggcccggccgaagaactccagatcaccgtcggggcgacggcacaccaggtcgccggtgcggtacatccgggtcccgtccgcggcgaacgggtcggcgacgaaccgctgcccggtgagacccggacggttcagatagccgagggccacccccgcgcccgccacgtacagctcgccgacgacgccgtccgggacgggccgcagcgcggtgtccagcacccggaccgccgcaccccggacctgacgtccgatcggaggcacaccttccgccgcctccagcggggcgctgacggtcgcggcgaccgtggtctccgtgggcccgtaggcgttgaacacccgccgccccggcgcgagccgggcgtgctggtcctggtcggcgactcgccgcccaggaccagcacgcccaggtcgggcagggcgcgttcgggcagggtcgcggccaccggtgcggcgagcatcacgtgggtgacggcctcccgctccagcgtgtccgccagctcctccccggccaggcccgcggcgggcggcagcacgagcgtgccgcccgacaggagggccatcgccacatcggcgaccgagggatcgaagttcgccgacacggcctgcagcacccggctgcccggtgcgagggagaaccgcgcgatgtggtcggccgccaggttggccagggacgcgtgggagaccatcacgcccttcggctccccggtggagcccgaggtgtggatcgtgtacgccgggtgcgcgggcagcagaggggacctccgctccgcctgttccaggttcccgtcccacacctcccggacggcggcggccagttcggcctgacccagcaccggacccggtaccgcgtccgccggtccggtggccagcaccagcaccgggcggacgtccccgaccaggtggcccaggcgttcggcgggcaggcccgggtccagcggcacgtagcccgctccggacttggccaccgcgagcagcccgacgagccactccaccgacgacggtccggtgaccgcgaccagggcgccgggtcccgcaccccgggagaccagcaaccgcgcgacccggttggcgcgggcgttcagctccgcgtacgtgagcttgccgcccggccccgccacggcgagcgcaccgggggtccgggcgacctgggcctcgaacagggcgggcaacgtggcggccggtgccgccgaccgccggtcgtcgcccgcggccagcagttcccggcgctccggcgtggacagcgggtccagccgggccagcggggtgccgggccgctcggccatggtgcgcagcacctccgtcagccggccgatcagccgcccgccgtcgtccaccacgtcgggccggtggtccagccggatgtgcagccggtcgccgaccagggcggccgacaggctcagcgggtagtgcgtggcgtcgcgcagttcggtcgaggagacccggaccgggggcgccgagccgtccggggcggcgaggccgcccggagcgaccggatagttctcgaagaccgtggccgtgtcgaagagttccccgaccccggccatccgctggatgtcggccagacccaggtactggtgcggcagcagcgcgagctgctccgactggacccgggccagcagcccgcggaggggttcctccggccgcagcgtcactcgcacggggagggtgttgatgaagagcccgaccatggtctcgatgccggggatctccggcggcctgccggagacggtcgctccgaaggtcacgtcgtcgcgaccggtcagccggccgagcaggatcgcccaggccgtctggaccagcgtgttgagcgtgaccccgagctgccgccccgccgcgaccagttcggccgtgaacgcggccggcagatcggtctccaggcgttccgtgcgggccggtgcgctgccggccggggccagcagcgtcggctcgtccagaccgtccagggcggtacgccaggcctcttcggaggccgcccggtcctgcccggccagccagcccagaaagtcccggtagggcgtgacccggggcagctcgtgcccgcggcccgaatagcaggcggccagctcggccagcagcactggcatggaccagccgtccagcagcagatggtggttggtcaccacgaaccggtagcggtcgtcggtgagccgcacgagcgcgaaccggatcagcggcgggtgggccgggtcgaatccggccccctgctccccggccagcacccgttccagcgcggcgggccgctcggactccgccagggaccgcagatcgtaggagaaccacgggagttcgacgtccgcggggatgaactgcaccggctgcgcaccgccctcgtgccagaacccggcccgcaggttgccgtggcggcgcagcacctcgccggccgccgcggcgagagcaccctcgtccagttcgccggtcatctccagcgagagctgcacggtgtaggcgtcggtgccctccccgtacagcgcgtgaaagagcaggccctcctggagcggggacggcggcaggatctccgccagtccgggacgggcgcgctccagccgttcgatctcctgctggtccagggagaccagcgggaggtccgacggggtgcgaccgccggccccgggctgccgggtgtgcgcgacgagggcgtccagggcggcgaaccagtcctcggccagctcgcggacctcctcgtcggccaggacggccgagggccaggaccaggtggcc

SEQ ID NO: 2824 - DNA, 1271 bp, Unknown
  Kingdom: Bacteria, Phylum: Actinobacteria, Class: Actinobacteria, Order: Streptomycetales, Family: Streptomycetaceae, Genus: Streptomyces
cgacgtactccatcacgatgtagccgtcgagcgagccggtccgctggtccaggtgctcgacgaagttgtagatccgcacgatgttggagtgctcgatctcggcgaggaagcggcgctcggagatcgcggcggccatcgcgtcctggtcgccggtgtccagcaggcccttgaggaccacccagcggtccgacacggcccggtccaccgcgagatagacccagccgagcccgccgtgcgccagacagcccacgacctcgtactggccgtgcacgatgtcgccgccggtcagcttcggcacgaaggagtaggggtggccgcacttggtgcagaacccctcggtgcggccccgccgctcaccgcgcgaacggcccaccggcgcgccgcagtccgaacgggagcagaaccgcttgcgctcgggcacctccgggttctccatcaccgccgtgcgcggatcgggccggggcacgtccggcacgtccacgaggccgacgccgagccgtccccgggccgaggccgccgacgtcgagcccgaggaacgcaccgataccgaacgggaggtggacaccccggacagggagcgcgacagccggccggagaccgagcggcgcgaggtcgacgaacgggacgaggagcgcgcggaggcgcgggagccggaccgtgccgaggaactgtcccggctgctcgcccggccgcccccggcgatcccggtcggcggcgaactgaccatgcccgtcggcgagacgaccggcgccagaccgcaggtgtcgcagtacagctcaccgccgcccatgtcctcgtagttcccctcgcacgcggggcgctggcactgcgtactcatcgtgtctccccctcttcgcccgtgcccgtgccccgccggtcctgcggtccgtcgggccggtgcggcgtcagcatgtccgcgaccgcgtgctggtagcgcagaacggcctgctcggcgacccgcagatcgcacggcgcgctccacagcatgcggcgcgccgcgtcgtaccgctcgatcagcaccggatcctccgccaggccgtgccgggccaccttcgccttgtaggcgtcgagccggccgcgcagctccgcgcggaccgcgagcggagccgtcaccgaggtcagcgactcccgggcgcgcagcagttcgtcctcggcctcctgctccagcgactccagcagcggcgagagccggtgccactgggcgtacctgcggtggtccgacgccgccgccagccgctcctggagggcggtcggcggcgtcggaccaccgc

SEQ ID NO: 2825 - DNA, 7955 bp, Unknown
  Kingdom: Bacteria, Phylum: Actinobacteria, Class: Actinobacteria, Order: Streptomycetales, Family: Streptomycetaceae, Genus: Streptomyces
  misc_feature (7457)..(7470): n is a, c, g, or t
gtctaccaactcctcggggacgaggccctcggcgatcgcgtcggtcagcgggcggccgaacgccttgacggttggcagttccacgtccacgcccgcaccgagtgcggcacccgccgcctccccgaaggtccccgccaccccgtgcagcgtcttgaggaacgcgatgccgaaatagtcggccaccacggtcccgtcgaacccccaggtgtcgcggagcagaccggtcaggagcaggccgtcggccgcggaggggatcccgtcggtgtcggtgtaggcgtgcatgacggaccgcacgccgctgtcacgtacggccatctcgaacggggtgaggatgatgtcggcccgctcccgtgcccccatgccgacgggggcgaggttgcggcccgcccgtgaggcggagtacccggcgaagtgcttgagcgtggcgacgatcccggccgactccagtccccgcacgtaggcgctggctaccgtacccaccaggtacgggtcctcgccgatcgtttcctcgactcgaccccagcgtgcgtcgcgtacgacgtcgaggaccggggcgagaccttgatgcacaccgacggagcgcatgtcgtggccgatcgtggcggccatctcagcgatcaactccggatggaaggtggcgccccaggagagcggcaccgggtaggcggtcgcaccccaggtggcgaagcccgccaggcattcctcgtgagcgatcgcgggtatcccgaatcggttcgccccggcgatccgctcctgggttcgcgacagcgagagagcacccacggccgggtcgaccggcgccgtgccgaacgggcgggtcagctggccgaggccgtgcggaaggaggtcgtccaggacgacggcctcctccatgtcgtgctggaagggcgctacttcggcgccctcatccgacgctcccacccagacgccgaagagctgggagatcttctcccgaagggtcatgaccgcgagcagggcgtcggccctggcctctggagcaagggcgggatcgcgccagggtccgtcgccgtggtccgtggcgccggataccggcgccaggcagtcggcgacccccgcgggtgtctgcgcatcggcgttttcgctgttggcggtcactttcctcctacccccatgagcccctgcaccagggcacggcgtgcgaacaggtaggcgatcaggatgggaagcatggacaggacgaccgcggcgagcaggccgggggtgtcgactccgtgttctgtctggaagtcgtagagacccagggtgatcaccttggtctccgccgactgggtcaggacgagagggaagaggaaaccgttccacgcctggagcgcggagaagacgacgatcgtcgagaccccgctcctggacagcggcagtaccagctggaagaagacccgtcggggggaggctccgtccatcgtcatcgcctcgtacagatcgggggtgatgtcacgcatcacccccgtgaggatcagggcgcacaccggcatggcgaaggctgccgtcggcaggatgactccgatgaggtggtcgtagagaccggcctcgctgatgacgaagaacatcgggacgatgaccgcctgcgaggggatcgccaggcccagaaggaacaaccggaagaccgtggtggtggcccggccccggctcctgacgatggtgtacgccagcggcgggacgagaagtacgacgatgcccaccacgcacacggtgacgatgaccgtgttgaggaagtactgcgcgaatccgctgtcgaggtcgttgacgtagttgtcgagtgtgaagctctcggggacggccagcgggccgttcgccgcgtagtcggggcgcgactggaaggtcgcgacgagcatcacgtacagcggtagccccaccacgaggagccagaccagcgagccgaaaccggcgaagtagttgggacggctctttctcacagtccctccatggtgctgcgcatcttgtcgtagcccgagagccgtaccacgatcagcgagatgaccgtggagacgaggaccaggagaagggcgatggcggacgccgatccgtagtcgaaacccttgaacgccttctggtacatgtagtacgcactgatggtggtgtcgcttccgggtccgccctgggtcaggatgagcacggtgtcgaaggtcgtcagtccgccgaccaccatcaggatcatcgaggtgatgatcgagttgcgcagttgcggcagtgtgatgtggaagaactgccgcaccgtgcccgcgccgtcgatctgcgccgcctggtagaggaccggcggcaccgcgcgcgccgcgccctggtagatcagcgtgtgcagtggggtgaactgccaggtgctgacgaagaccaggacaccgatcgcaccggcctgcgtcccgaacaggttgccgtcgccgaacagccaggtggcctgcgcggggacgccgaagttggggtcgaggacggcccgccacagcaccgagacggccgcgacggacagcagcatcgggacgaagtagatggcggacaggacggcccggttgcgctggtgtccagccgcccagactccgagcaggatgctcaacggggtctggacgacgaccccgagcacggtgagcaggacgctcagccagaggctcttgatcatgacgggatcgccgaagagctgcttccagttgtcgaggccggtgaattccgggttgctcagtccgtcccagctggcgaaggagagtacggcgaccatgatgagcgggacgatggcgaagaggccgaagaagacggcggcgggtgctgcccagaggaatccggggcggcccgctccgatgccggacgagtcgggcttcccaacagtcgcgccggctgcggggagagtggcagttcgggtcatgtcatgcgttccggggggtccgggcttccgtgaggtcacgaggtcggcagtgcctgcatggcctcgatgaaggcgtcctcatccatcgagccgttgaagaactgctggagggactggtacatcggagtggcagccgactggggatacgcctggtcccaggagagctggaacgcgggggccgccttgaccatgtcgtactggaacctcgcgaactcggggctggcggcggtgtccaggaaaccctccgtgttcgtcgtggtcggcaggttgccgatgtcgagctgcgccttgacgaactggtccgagtacatgagcttcaggaactcggcgacggcctgcgggtgcttcgtcttcttcagcacggagtagaagttgttggtgttgcccacgacgttcgcctggtcgcccttgccgccttcgacagaggggaaggcgctgtatccgaggtcactcttcgcgaactcggggtgtgcgtcctgctgcgtcgagtactcccaggaacccatcagctcgaaggctgccttgccggtcgccaggagcgtgggggacccctggtcggtgaacttcaccgagtcgtagttggtaccgaaggccccggcgtccaccagttccttgatcttgcccagagccttccggctgtccgggctcgcccaggcttcctggtcgccgtccagggctttctggaagagctccggaccggcgatgcggtcgtacaggtactcgaaccacatcagtgtcggccatcggtcgccgccacccagtgcgatcggggtgactccgtcggccttcagcgcctcgaccgccgccaacaggtcgtcccaggtcctgggaggctcgacacccgccttcttgagcaccttgccgttgttgaacaggagcacgggctgcgtaccgcgcatggggattccgtaggacgtgccgtcgaccaccgcgctgttgaacacggacggcaggaatttggtcctgagtccggggtccttggcgatgaaggggtccagcgggagcagcagaccggcctcgacgaacggtttgatgctgccgccgccccagttgaagaagacgtccggcgcctgcttgctgttgatgatcgtctgcagcttggcctggtagtcggcacccgggatcgtgtccaggaccaccttcaccttcgacgtctcgttgaaggtggcgacgagctccttctccaccttgttggccgcgtccccgtagaccaggacgtggatggtgtcgccgccggcggcatcggagtcttctccgcacccggacagggacagcatcagggccagcgcggcaccaccgacgacgacggtccgcgagaaccgtgcgtgttgcttcatcgactcacctttcgaaacttttcgacacagttaccgaaacttcctgggtcgggacgctagaactccccaacaaggagggtcaaccctcggtcaccgcgttatcaaagcgttactctcaggtggcggctcccccgtgctttatgctcctcgccatgcgcgatgacgagaaaatgggccgcatcactctggcggaggtggcccagcgggccggcgtctccatttcgacagtttcgaaggtcctcaacggccgacaggacgtggcaccccccacgagggtcaaggtggagcgcctgctggaggcacatgcgtaccggaggacctcacggtcgacccgcgaggcgccactcatcgagatcgtgttccacgagctggagagcatctgggcgatggagctgatccggggagtggagaacgtcgccaaggcccacagcgccggagtcgtcctcaccgagagcggaacgcgccactcgccgagccccgactggatggaggcgatgctccagcgtcggccgctcggtgtcgtcctggtcttctccgccctgcccgacgaagtgaaacagcagctcagggcgcgttcgatccccttcgtcatcatcgacccggcgggcgaccccgatccggacgtgccctccgtcggctccgccaactggaacggcggactggccgccacccgccatctcatcgagtacgggcaccggcgcatcggggtcatcaccggacccgaggacatgctctgctcccgcgcccggctcgacggctaccggtcggcgatgaccatggcaggcctggaagtggaccccggactcatcctcttcggcgacttccacgtggagggcgggtacgaccgcgccgtcgagatgctctcccggccccagaggcccaccgccatcttcgcgggcagcgacctccaggcactgggcgtactggaagccgcccgggtccacggcctgcgcgtcccccacgacctctcggtggtcggctacgacgacgtctccatcgcccgctgggccagcccggcactgaccacggtccatcagccgctgcgccagatggccgaggaagccgcgcagatgctgatgcggctgcgcgcccaggagccggtctccacacgcctggaactggccacgagcctggtcgtacgcaagagcacggcaccgccgcccgagaactgagcaccaggtggaccgcggtcccggttcgacagagggtcgcgacttcctggtcgcgccccacggccaggacgtgctcgcgcaggctcagcgccgagccgggcggctcagtgcgacacggactccgagaggccgtccgcacccctacgcgtccgccacggagtcgacatcccacaccagtgtcccggcgcaacagcggcccgccggaactggactttcgtgccgggcacttggacgctccgcacgatattcggccgccaggtacctgcggttcatacgggactgctgtgattcccagcgctgaacattccccaaccaggaggcgcttgtgaatctggtcgtcaacggagacgccgaggccgggccgggcggaaccgccgagccggtggagtcggtcaccggctggaaggtcacccagggcgcccccgccctggtcggctacgacgtgggcggcggctatccgaccccgtccgaccccgggcccgccaggcgcggcagccggttcttctccgggggcaccagccggcggacggcgctgatgcaggacgttcagctgcctcgtaaggggcccaccgggcaggccgctgtcgacgcggggcgggtcagatactccgtcgtcgcctggctcggcggatacgccgcccaggaggacggggcacggctctccgtggagttccgggaccgcagagggacgccggtcgcgctgaccgtgctcggccccgtggcagcggccgagcggggcggacgtactggactggtcgagcgcgacggggaggcagcggtgccgcccggtgcccggtcggcgcggctgctgctggtcttcacccggaccgggaccggcacctccaacgatggttacgcggacgctgtctccctcactctgagcgccactggagaccggtcatgaaactcaaccgtcgggatctcctcaaggccgcgagcgcggtcggcgcgctcaacgtcgtctggccgctgagcgccgggctgtcgcccgcgcaggcccgggaggccgccgaggctctcggcgcgcagtacgacccggcgcccttcaccctcggagtcgcctccggtgatcccctgaccacgagcgtcgtgctgtggaccaggatcgcgcccgaccctctcgccgccgagcagccactgcccgaggtcgtcgaggtggagtggatcctcgccacggaccgggcactgcggcgggtcgtggcgcgcggcaaggcaccggcctccgcgacactcggtcacagcgtccatgtgcccgtcggcgggctgcgggcgggcacgcactactactacgcgttccgggccctggggaggaccagccggacagggcggaccaggacggctccctcgggaaggatcggcagggtcaggttcgccgcagccaactgtcaggccttccacgacggctactacggcgcgcaccgcgccatcgcccgggaggacgtcgacttcgtcgtccacctcggcgactacatctacgagcacggcccggtcggcggcgaccacgtccgcgaccacgactcccccgagatcctcaccctcaccgactaccgccgcagacacgcgctctacaagggcgatgcctccctccgcgaggcccacgcggcccacccgtggtttctgacctgggacgaccacgaggtggtcaacgactactcgggcaccggcggcggcgcgcccatgatgcagcgccgggccgccgcctaccaggcctggtacgagcacatgccgcaccgggacgggggcgagtcctcgctgcccgatccggtgatccaccgcaaccgccgttggggcgacctcctcgaactcagcgtcctggacctgcgctcgtaccggtcggcgcagaacctggccggagggacgatcctcggtgccgaccagaaggcgtggctcaagcggaacgtcgaccgggcgccggacgcctggcacgtctgggccaactcgatcatgctcagccagttgcgcggccggcccggtggcgggtacatgttcaccgaccagtgggacggcttcctcgccgagcgcaaggaggtgctggaccatgtgcacaagagcggcctcgaggacctggtggtgatcaccggnnnnnnnnnnnnnncaaccgctacggctacgacgtgtacgaggtcacaccggagcggttcaccacccatatgcgggtcatcgaggaccgcagggacccccactcgcccgtctcgaccctcaccaccttccacgtggaccgggggacggtcggctcgtacgaggacccggcgacgaagaagtcgcccgcgcagtaccgaagggactgaccgccgggctcctcgcgcgggtatggacgcggcgcgtgtcacaccgttggggggcgacgtgacgggcaaggggatcagccctccgcccgaagacaccggattcaggtcttcacaggcgcgggcggtggggtcatcgcccaccggatggtcctggtcagggccttcccggcggggcgtacgcacacttcctcgatcctcggcgcccggggcagccgcagtggctcgcgggcccacggcgggagcgaggccacggcgttggcggcgagcacggcgtacggggcgcggaggaagc

SEQ ID NO: 2826 - DNA, 3474 bp, Unknown
  Kingdom: Bacteria, Phylum: Actinobacteria, Class: Actinobacteria, Order: Streptomycetales, Family: Streptomycetaceae, Genus: Streptomyces
gcgggggcgctgccccgggcctgttcgacggcgcggtcgacgaaggcgttgagctgggtgtcggcgtcgtcggcggtggtggggttctccacggcggccgtgaggttctcgacggcacgggtgggcatgacctgcgggtcggcgcccgcgtcgaagccgtcgccgaggcgtatcgcgtagacgccggtgatgccggtgtcgctgcgcagggtctggaggaggccttcctcggggaaggccggggtgtcggggaggacggccacgaacaccggcctgtcggcgtccgtgatcttgttctccagggccttctcgtcagcgacggagagctgatcgcgagcgcccgggtccacgtagaccgggtcgtcgcgcagggcctgggcggcgtcctggatggtcgcggcgggcgcggcaggcgcggccgacgcgggggaggtcagggcgagagccgccgctgcgatgatgagcagcaggcccgccagcagcgcgggaaagagccttttcctcatacttcacgctactccagacgggcgacgaacgccgtcgcccgtctgggagcgtcttaccgcgctgcccggtacgccgtgcgcagccggtccatcgccccggtcaggtcgccggtgagcagcaggtggtccgcctccgcgaacggcttcgagacctcctgggtgaaggtcccgtcgatcttccgctggaccagcagccgggcccggtccacgatcgcccggcccgccggggtcttccccaggtgcgccttctcggcgacccgggcggcgacggtgagggccgcgagggccggctcgccgccggccgggggcttcctcagggtggtcaggccccagccgtagggaaactgcgggtcgtaggccgcgtccccgacgttgatcggaagctgggcctccgccttcggccaggtcaccgggagctgccccgtgaaggcacgcctgccgtagaggacgtcggccacgccgtcgccctcggagcccggcagccaggaggccaccagggcgtccatgtccccgagccggtcgccgatgagctgcgggcggccggagacgacgaggaccgcgcacttcatggcggcgcagaccttgtcgaccgccgcccggtcggcggccgtcagctccaggtcgtggccgttgccgacgtccccgatgccttcggcgtacggggtctcaccgacgacgaccaccccgacgtcgtacccgtccgtggcggcggaggcgtcccgggagaacgtcacggactcgggggtcagcgccgcctttcgcatgccctcaaggatcgtcgtgccggtggtggtcttcccggaggagccctgccagctgatggtccagccaccggcctggttgccgatgtcgtcggcgttggacccggcgacgtacaccttctggccgggcctgagcgggagaacggctccctcgttcttcagcagcacctgggacttggccaccgcctcgcgggccaccgcgcggtgcccggcggagccgaccttctccaggtgggtggtgtccgcgtacggcttctcgaagaggccgaggcggaacttctgggtgaggatgcgggcgaccgcgtcgtcgatccgggcctggccgatccggcccgccgcgacctcctccttcagcgtcttcgtgaactcctggtacccggtcggaaccatgatcatgtcgagtccggcgttgaccgacgtgcggacgtcgctcgcgtagtcgccggggatctggtcgatggcctgccagtcgctgatgacgaacccctcgaagcccatccggtccttgaggacgccgttgatcatctcggcgttggcgtgcatcttcaccggacccttgtcgtcacccaggacgtccagcgaggagtacgagggcatgaccgtgccgacgccgcgctcgaccgactcctcgaacggggagaggtggaccgcttccagttcctcgcgggtgacctcggtgacgccttggtcgaccgtgtacgagccggtggtggaggagccgtacgcggtgccgccgtcgccgacgaagtgcttggcgctgccgagcaccttgtcgttgcggtgcaggtccttgccggacgggctgccctgcatgccctggatgaccgtttccatggcctcgaccagggccgggtcctcgccgaacgcctcgtaggagcggccccagcgttcgtcgcgggtgacgcagacacagggggcgaagtcccacgggacgccggtggcgcggacttccttcgcggtgatcgcgccggtccgctccgcgctcctcgggtcgcggcccgcgccgatgccgatgttgtgcggcatgatcgtcgcgccgacgacgttgttgtgcccgtgcaccgcgtccacgccgtagatcagcgggatctggaagcgggtggctcgggtgcgcagttggtaggcgtcggtcatcttcgcccaggcggcggccgtgttgggggtggggacggagcctccgccggagagcagcgagccgaggtcgtaggcggcgatgtcgccgggggtgcggagcgcgttgcgctcggcctgggtcatctggccggccttctcggcgggtgacatgcgccccagcagatccgccacccgctgcttcacgggcagcttcgcgttctggtacgggaggccgtgcgcgtcgatgacgacctgcgggttctccttgggtgccttcgcgccggtgaccgtcacctccagggggatcgttttcgccccggcgggcttcgaggccttcgccgtgcggacggtgatccggtgggtggtgccggaggcggtgcccgcggggaaggtgtggctgccggtgaccggggtgtagtccttgcccgcctcggccgtgccgcccttcgtggcgtacgtgacggtgacgggctcctcggtgggcagggagccggtggtggcgacggagaggccgatgtcggcgctgtcgccgttcttcaccggccggaccgccgtgtcggtgacgacgctcgcggtgagggccgggtccgccttgccgtacagctcgacggcgtccagggcgaacgcgccggggccgccgccgggcagggtgagggcgtatccccacatctcgttcaggccgaggatctggtcgatgccgccgacgggctggtagtcggcccggtagacgaagtcggcgaacgggatctcgaccaggtgccagccttcccagtcgtcggtgaaggaagtggtccacagctcggacgcgccgccgttcgcgccgccgtccttgatctcgaagctgatcttcttgccggagccgggcggcaggggcgcggtgttctggccgtaccaccagaagcggatcccctgatgggcggtccagttccgcggcggggtgtccgcggcgaactcgtggctgaacccgccgtacgcgctgatgtcgtaggagccttcgaggacgtgtccgccctcgggtgcgtccgggcgctcggccagcttcagtcgcgggtggtcgtccgcgtcgccaccccaggtgaagagggcgtcggcgg

SEQ ID NO: 2827 - DNA, 1304 bp, Unknown
  Kingdom: Bacteria, Phylum: Actinobacteria, Class: Actinobacteria, Order: Streptomycetales, Family: Streptomycetaceae, Genus: Streptomyces
cgcggcggccggcggcgcctccgtggtgagcagttcgtcggggatgaggaccaccgcgcgtacgcctccatagggggaaacggagtccaccgagacccggaagccgtagcgggcggcgagcatcccggagacggcgaacccgaactgcggcgggatgcccaggctggagacgctgatcgcggcctggggggagaggagagccgccgcgcggtccttctcctcctggcccatgccgagaccggcgtcgtcgacgatgagacagacgcccgtcggcacggcctggatgttgatctcgaccggggtgccgggggcggagtagttcgtggcgttggctagcagctcggcgaggaccacggcgacgggttcgaccgcccggctgacgacggagaagttcacctggccgttgacccggacccggtcgaagtgccggatacggccctgggcgctgcgggccacgtcgaagacggaggccacggtctcgcgccggccgagccagccgccgcagagcacggcgatgccctgggcgcgccggccgaactggctgttggcgtggtccatggccatcaggtcggcgaggatcccgggatcgtcgccgtacttgcgctgggccttctcgatcacgacctgctgttcgtccgcgaggccctggagggtgcggacggcggccttgaggacggccttggtctcctcctcggcgtccttgcggacctccgccagttcggtggactgacgttggagcagaccgttgtggacgacgtggagttcgtcccgttggtgcaggagcgcgtcgcgctcctggcgcagctccgcatggtgtctgcggagcttgacgttggtcgcgcgagcccgcagaacggcacccacggcgaccagtgctacgacaaccagcgcccagatgacggggccctgtggaaatgtcatgagactcacttcaagtgccatggcggaaacggcttgacaccccgtcaggcggcacgcagtcagggctcgttcgccacgaccgtgcgccgcttcgggaggtgcccctccgaaggtggggccgaggatttcatccctcccggaatgcccccacacgccatcagcccactggaagtaagatgatcttatcatcggccgcacgccgaaatgtcaaggccgccacgccagttgccagtcgactcacaacgttcacattgcggagacctggaggacggcaaccggccgtcgcccgccaggggttggtcagctcggcgaccccgtggaggcgcgggtctccagggaccaggagtgccggcggacggtgtcgcgggccgcgcggcccgcga

SEQ ID NO: 2828 - DNA, 10715 bp, Unknown
  Kingdom: Bacteria, Phylum: Actinobacteria, Class: Actinobacteria, Order: Streptomycetales, Family: Streptomycetaceae, Genus: Streptomyces
  misc_feature (555)..(612): n is a, c, g, or t
cgtgttctcggtgcagatgctcggcccgcagccgggcacgggccacggcggcttcgtcgcgggcttcctgctggatgccctggatcgcctccagcgcggacccggtcagcgcggtccgctcccacaacccgtggaccagccacagggctttcgcggccaggggcagccaggcgaccgcgagccacgcgccggcgcttccgtcgacggtgacggcgtgagcgaccaggactccggtggcgaccaggccgaagccccagcccaccgccgtgaccgggggggagtggtcgccctgcgcggcgaggcggcgttcgtaggcgagagtggcaagccaccctccgtcgatgccgagaccgaccaccagggcgatcgcccacggcatcgaggtgccgagccacatcacgaccacagccagcgtgaggaccatggacaccgccgtcatcgcgaccgcgggaagaaccgtcttcgcgccctcggtactcatgccgcacctccgatgaacgggcggttggtgaggccggtgatcgtggcgatgtcgtcgccggtgagcttggtgtnnnnnnnnnnnnnnnnnnnnnnnnnnnnnnnnnnnnnnnnnnnnnnnnnnnnnnnnnncgcagcccagggcgcggccgaggcagtggccgaagccggtgaggacgtcgatgacctgctcgcggtcgtgctcggcggcgcaggacagggcacggtccggggtccacagtccgtaggtcatgaggtactggacctgcgcgacggttccggccgcgccctgggctgcgaactgccagggccgtgcggcgtgggctcccagggcggtgttgccggtgacgccccaccggtccgcgtcggggaaccaggcgatgacctcgctggtgatgacgtgcatgccgtacgccatggcgaccacagcgtgtccggcctcgtggaaggcgagcccgaggcgggactgctcgtaggtgagccccgtctcgaagctcgcccgctcgttgccccggtggtccagcagaacgcccggggcgggcgcggtgggaatgctcatgactgctccccccgccacgggaaggggcgcgtgtgctgggcggtgcggaagatccgtgcggccaccccggcgggggcgtcgggcttggcgaccgggcgggcgccgctgatcgaggcgagcatgcgggcggcatggtgctcgcacccgtcggcacccgcgttctccgcgtcgacgacggtcacaacgaccgggccaccgcacggcgtcgcgtcctccgggtgcgcggccgggcatcgcaccggagtgccggcgggcggcgcgtcgaccatctcgaccagctgtgccacggtcgcctcaagacggccgatcatccgggccatggcggacacatccaacaggctcatggactgcgcatccgccagggcctggcgggcagcgaggatccggctgcggtcgtacacggtgagatcgaagcgactcatcaggccgcaccccccgacaggctcacgatggccgaccggttggccagctcccggcgggccgccagcacccgccggcgggcccggcggatccgccgctcgtccagctcggtcggcgtgcggtcgatggtcatgatctgcgcgtccagcaggacgacgtccgccaggatggcgggcatctccgtctcgatcgcgtccagctcggcgtccgacggctcaccgtcaaacgagttggccgtaacaacggcctgaagtgctgcgatgctcttcatgagtcgttctctcccttgaaggatgtgcggctcgaacagcggccccggtgttccagcaccggggccgcactgcgtcgtgaagtggttggggtatcaggcggtggcggcggcgcggacgaggtcgtcggcggcctcgatcgcggcctgacggtagaagtcgaggagttcgcggttctcggtgttccgcagggcgtacgtcgcaccggccgcgtcttgagcgaacccggcaagttcgggggcgaggatcgccagcgtggtcagcggtgcggtcagggcggagcgggtgttgtgactggccgtacgggcggcctggtagtcggcgtccgaagctccggacagccgcaggtcctcgcggacccacatcgcccggcggtgatcggccagcgccgccgtcagcgcggtgacggccgcgatccggtcccgccgctcctcgtgccggcggacgtcggcacggtccgtgcgggcggtgcgctgctggagcatgtaggcggtcaccgaacccagcagggttcccagtaccgcgatggcgcttccccacatggcaggttcctctcgtcggctgaacccgctgcgagtgcggcgggcgtgcgtgccccgtgccggatttgatccgacgtcgtcgcggctcccgcatggcgggcccggggcttcggttctcgtgttcgctcggcgctgctcagcccggggagatccgaagtcccggacgtctgaggccgcagcttcaaggtgtgccgtagcggttctttcgagtcggtggcgtgtcccccatctggggtgttgggccccggtgtgacgggggccccttctcggccgactggtctccactcgcctcggccggaacggtcacggccgccatactgcggtggatcacgctgttgagttgttctggttttggagcgccacaacaggggccctcctcccgctcctgccttacggccgatgcggtacctgtattacaggtcccgcatgagggttctgtcaagcgaagcggtgatggcttctccttttcgcgccttaacttcttggcgcatcatcagcatcggcccaggtcaagggcgttgtttaccccgtccgtggacagctgaagggcatctggctaccttcgagaggtcccaagacgtcccacgggggttgagatgtccaacgaacgattgcggtccgccctgctcgctcagggggtgaccatccaggaactggctgactcgatcgaggtcaacccgaagacggtcgaacgctggatcacgcagggcaaagtcccctacaggcgacaccagtacgccacggccgcgaagctcaatgtcgatgtgacgacgctgtgggacgactcgcgcgctgtcgctacgtcaaccgatctgagcaaggctgagatcgtcaccatctacccgcaccgccacatggtgccgaacgccttgtggcgtgagatctacgaacgagccgagtcccgggttgatgtcctggtctactccgggctctggctttcggaagaccctctgtttcatgcgctcttgaagaggaaggcggaagaggccacgcaggtgcggatcctgctgggagacccggactgcgatgctgtgcggcagcgcggtatagacgaagggcaccgcattatggacggcaagattcgcaatgctctggtgaactaccgcccgctcttcgccagccacccggatatcggcttccgcctgcatgacgggacgctctacaactcgctcttccgatccgatgacgagatgttggtgaacacccacgtctacggaatcggggcctacatggcgcccgtcctgcacctgcggcggctgcccggcggcggactattcgatacctacgcgaatagcatcgaacagacctggggcagtgcccgcccggtctcggaccacgacatcacgggagcttgaacatgggacgcatcgactaccttcacgatcccgacgccccgccggccaactcggtcgtgccgtccgtcgtggccttcgtccagaacgactcaggccaggtactgctgatccagcggtcggacaacggccggtgggcactgcccggcggggggcacgacgtgggtgagtccatcagcgacaccgtggtgcgcgaggtgtgggaagagaccggcatcaaagccgaagtcgtcgacatgtcggggatctacaccgaccccgggcacgtgatgctgtacgacgacggcgaggcgcgccagcagttcagcatctgctttcgcgcccgcccggtcggtggcgacgtccgtacgagcgacgagacgacgcaggtccgatgggtcagcccatcggacctgcgggagttcgacatccaccccaccatgcggctcaggatcgagcacgccctggaccggaagcggattgcgccctacgtcggctgacgcttgacggtggcgagtcgctcaaggacgcgcaccgtgcagccgaggatttccggttcggctcggcggatgaacgtcccgatcaagctctccggaccgtagcgaccagcgatctcattgatccggtccaccggattcgtcggggtgccgtccggcgtggtgttcatgtcgcagaagcagagagcatcgctcaggtggggatcctcccgggggaactcctcttccagttcgtcccgaagccctcgggcttccgcctccatccacgcgcaggagtgatgagcgacaaggcgcaccaccctctcgtcagcacgagcgacatcccgcagataccgcgccccgtccagcgggtgaaagcctgtcttggcgagatccggcgcatagccaatgtcgtgaagcacggccgcagcttcaaggagatcggagtccgaaccgaggatcgggccaagcacacgggctctctccgccacgccctgcgagtgcgcccagcgacgcggcaggggctcggagagaagcgactcggcaagcgggtaggcccactcggtcaatgccttggcgttcacgggttggcactctcctctggcttcggcagggacagtacggtgcgaggcttgccctgctggccttccgacagaagccctgcggcctccaacttgtcgagagccttggccacggtgggccgcgagacaccgaaccgcgcacacagcttggtcgcgcttgggaaggcagccccgacggatagatggtcattcgtgatcacgtcggtgagccgttcggccaacggccggcggtcgacggcttccccgcgccgcgcaacttgcaagcggctgccagcaacgcgttccgcgacgccctgttcctggaggacgtcgaagactcggagagctacgcctcgggagacgccgaactcgcccatcaagtccgcagccgttggcagctctgtcatcttcgggtcggcttcgatccgggccctgacgacttcagcgatcttcaggaaggtcccgcgagggctggtctgctgcgacacgagtctcccctctctccgtcgtagtcggtccaagcttgccatgttcctccatctcgtcggtcctgccgagcctggtgcccgaacgggctgttggggcgtgaatcgcggcatggagggccaggttggccaacctgtggccaggaagccggaaaacgactgatggtctgctgggtttccgcagggcagggatggctttgtcgctgtaaccttgccggccttcaaggccttcacggcaccgacgcactaggccctgatccttattcagttcgctggcgaaggccgtagcaccgtgtcgtattggacggatcgcacagcgtccggttgccgagctgacgggttcggagccctttctcattattgtgaatcggtatcagccgccaagaagctagtgattgcattgctgaacatccgcagatccgcgcttggtcgttcatgatgcccctcgtcgaacacgcgggttagccacgcgcccttattcgatgaagatacctctctcacccagcactcaagttcgcccacggggacaaggaacaatcctagctgggcgaagtaggccaacaaacgggcagcggcattgtgcggctccccgctcagtgcagcaaggccggaagtttttagaaatttccagccgttggttgccgccaaggatttcgtaatctgatcgatagcagcctgacttagcgtctctttccctcgggggtttccgatagcggtgacgatctcctttttgatgtcacttgctggcttggttacgacagaagaagaagcgtgggcttgaagcgttttcatgtcctcccgaacttcctcccaattgccgcccagtagccccattgcctgtctaatttttgttccgtcattaaggaaatcgaagtcggccacgattgcggtggggataccgcaggttcgcaacttgtgcgccgcgtcggcgagccgtgccttgccgtttacgtgcaggaacgtaaggttgaaatttcggctagtcgcacgaagtgagtcgatggttgccgcatagaaatggcaatcgccttcagcttcacacaaaacaacaccgtcatggaacaggccagagacgatgtttgaatacctcagaagtggcgtgtccagaatttcggccacattctcggatttcagagttctggctgtgatcgtgtcgcccgcgcgcgagattcttacgagcgaaagtgcttttggcgatgccttctgattcgccgcatttccttccagtacgccactcaggaagtcggcgctatgtgtagcgacgaaaacttgacaaggtgagggggtgtgtaggactagatattttccgagcaggcgggcttgaggggggtgaagaaatgcctcaggttcgtcgatgacgattatcggagccggtcgcacaagggtgtgcagaaggaggttggtgaaggcgcgcattccatcaccttgttctgccaggcgtggaagtgcgtcatatgcctcccgcagctcagcagaagctgggggcgccgtgtcgggcattccaggtgaaccgatttgcagctgaatgctgggaacgtagcgatttatggaaactggcattccgaatgcatttttgaagagatctgaaaatcgactgtgggcgtctatatcctcccataggcgctgcgtggggtggtttggcggtcgtgcttgatcccagaagtgtgaggtggtttggtcttgcaatcttagatcggtccactggtcgcttaccagcaaataggaaattgagtggaaatatccactggtccacgcggaacggagttcgtctacatccaggccattgtcgtcctggttcaagcgcggagttaggagcgtccggccggaaggtcgatgcaaccgtgtctcgtggcccctttcttttagccaggccagaagctcttcgctcgttccatctcgattaacttcaaggctatcgacccaatgcgttttttggccggcgctgcctgggtggtggtgaattgcatttaccaattctcgaagcagggcggattttccgctattgtttggaccggtgaagatagtcatgccatccgaaggtggctccactaccgttccgtcattcagccttagcttggtcagcccaaaggaaaccggcattcagtacccctccgtgttgagccggagccgagctggccccgcttccacgtatatagcctgctaggggtgttgcgcgctcgctttttgggatcctcgctgcccggctgtcagttggaggaggtggaggaggcgcgcctctgcggggtatgcggtggcgcagagcggagagcggcagtttcgggcgcacgggcatggtctcatctgcggtctcagtggctcctcgatccagtgccgtcggccgcagtccacgggggcccgtgctcctcttgatcgggcagtgagcggactccgcggatagcggtgaaccggtgcggaacgagagccgacaacttgtaacgcgtagatcgcctgagcctcaagagctgctcgcatccgtctcgtgatgctacgcacagctcgtatgggcgtgacccacctgggagccgtgggccatgtgtgggccagtgaagcacccctggggcgcatgcccagcatgggagcaggtcagagagccgggcgttcgtggaggtgggcggtcttgaaaaccgtcgtggtccttgccgaggagagaggcaggggcatcaccggctgccttcgaccccaaagggaccgccagggtcggcatgtggtcctgtcagtggcggttgataggtgtagccgtatggctcttccttcgcacgcatctgggcaggacgttcccttcggtcagctcggcgaggctgatctcgtgctggatgccgtctacgccggcggctcctcagggcactccggtgacgatgccctggcccggctgcttcccgggaccggtaaccaaggcgggttccggtatgccggttcgccggccaaggggacggtccggctggtcgtcctgtacaccagcggcggcgaggtggactggcccgaccacctggacaccgagacagggacgttcacctattacggcgacaacaagacgccgggcaaagccctgcacaagaccccgcgcaacggcaacgtccttctgcgggatgccttcgaccactcccacggcacggccggtgaccgcggcaccaaggtgcctcccttcctgctcttcgagaaggcccggcccaaagggcgagccgtgcgcttccgcggcctgcttgcccccggcgggcccacgctgacgtccgacgacgagctggcagccatctggcggtcaaccgagggaaagaggttccagaactaccgctcgcgcttcaccgtgctggacgccgagcagatctcccgcaactggatcacccacgtcctcgatggtggtggcgtgctcgaaggagagtgccccgaggtctggaagacctgggtgcaaagccgcgtctaccgtccgttgctcgcccctgccacaaccacgatccgctccaccgcggaccagctgcccgcagacaagacgggaaaggcgatgctggaggagatccggcagcacttcctcgggcgggagacagacttcgaggcctgcgccgtggccatatggcgcctgatcgccccgtccaccggcgcagtagatgtgacccgcccgagccgcgacggaggacgcgatgccgtcggggcgtacgtgctcggacctccggccagcccgatcagcatcgactttgcgcttgaggccaagtgctacagcccggacagcggcgtcggagtccgtgaagtctcgcgtcttatctcccgtatccggcaccgcaacttcggcgtgctggtcagcacgtcctacttcaaccggcaggtgcagagcgaggtacaggaggacgggcacccgatcgcgctcgtctgcggccgcgacatcatcgaagcactccggcagcacggccgcaccagcgttcccgcggtccgtgactggctccagcagagcttcccgaaccggtagccgcaccttgcgaccggctctgcgacgaaggtctggcccggcttcctgccgggccagaccttcaagaatggtcaggaagatggcgccgtgcgaggagttcagtcctcggtgtccttacggcgcttgcgctcccgctcgtaggccttgactgcttccggagctccttcggccggccagggcttccaggcgcgcagttcgtaggtcaccgcggtcacgccgttctccttgacccggtgtgcggcgatgtcccatcccaggacgaaccgcagctcccgcagccgcttcttcggatcccccttgtgcgtatcgcgagccacgatctggatgagttcggccggggtcgcctcgcccttgtcagcgaaggccttgagcagctccccgatccgctcccaggggttcgtgcggtggatggcctggccgagcgcgtcaccgtaggggttgagcgacttgaagaaggcgcgcttgccgttgttgtgcggctggcagagcggttcgaggttgtccagctcggtctcgcctccccaggaccgcggcacgatgtggtcgatctggagccgcgcgtccttcggcccggcgccgcacatcgcgcagaaccgtcccttgacggtgaacacctctgcctggagcttcgggctgatcttcccggtgtcactggcgggcgtctcgctccacccctcaagccggtacacccacttcccgtcgccctcccgccggtaggagtccaccttgaagtggtcacgcacctcccgcagacggcgctgggtgtgcacgttccccttcccgaagacctcccgggaccgctcgatccactcgtccatggtcggcggatcctcacgccgcttcagcaggaaacggcacgcctccgccgtctcacggctcgaaaacagggcgtcgatctccgcactgtcccaggccggcagggcccgctccggtgtctcgtccatcatcaccactcatacctcccctgacgaacgtcagccctgacggctgacgatccagaccgtagagggcggcatcacatttttcaagtgagtagcctcatgccgcctcgactacaggagccacgcttgtggctctgacctgctcgtttaaagattcctccgacggcgaaattttcgtccctgtgactgagttccgacggcgagatccgctcggcttcgactgtgtgggcacatcgcgaggaggcttcgccctggcagcctcgttgttctggtctttgtccagttcacggccggacgccgcggtacgcaggggtgcacgcaccgcctccgagctgctgggcgtaccccctgcggcccaccgcgaacgactatgcgcacagttggaaagcgtgtggcggatcgggcgcgcggccccggccactgcgagccagaggagacgggcaggacgacgtgtcggggtgagcgaccctgacggccccctgcgtgagtcgccccagaggagcagccgctcccggggccgacgcgcaccacctacgcaccacctagggcggacagccagggtcaatcatgggtccgcccacgagctgacgacgttgccgttacaggtccgtaagcgcaggtcacaagagtcggacagagctgaggagcgcagattcccaagctcagagcgcgagttcgattctcgtcacccgctctt

SEQ ID NO: 2829 - DNA, 50633 bp, Unknown
  Kingdom: Bacteria, Phylum: Actinobacteria, Class: Actinobacteria, Order: Streptomycetales, Family: Streptomycetaceae, Genus: Streptomyces
  misc_feature (545)..(546): n is a, c, g, or t
gcggcgggcctcagcggccgccggcgagcagcagcggcgccccacccggagccggggcggtccggcgctcggcgccggcccggcccagcagcggggatgcgggcacggtcggcagcagcccgcgccgggccagctcgggggtgacaccctcgccgaaccagtacgcctcctccagatgcggatacccggagagcacgaagtgctccacgcccagcgcgtggtactcctcgatccggtcagcgacctccgcgtggctgcccacgagcgcggtcccggcaccgccgcgtaccagaccgacgcccgcccagaggttcggcgcgatctccagcttgtcccgcgaaccgccgtgcagggccagcatccgctgctgcccgaccgactcgctccgccccagcgcctgctgtgccgccgcgatcgtgtcgggatcgaggtcgcccagcagccggtctgcggtggcccacgcctcggctgaggagtcccgcgaaatggtgtgcagccggatgccgaaccggaccgtgcgcccctgctcctccgccaggccgcgnntcttctcctccaccgcggccggcggctcgccccaggtcagatagacgtcggcgtgggccgcggccaccggcccggcggcagtggaggacccaccgaagaagatctccggcagcgggtccggcggcagcgcggtcagcccgccctccacctggtagtgctcaccgtcgaagtcgtacggctgcccgctccaggcaccccgtaccaccgacaggaactccgcggtccgcgcatagcgccggtcgtggtccaggtggtccccgaaccgccgctgctccgtcgaatcgcccccggtcaccacgttgagcagcagccgcccccgggtgatccgctgatacgtggccgccatctgcgcggccagcaccggggagatgacccccggccggaacgccacgaggaacttcagccgctcggtgtgctgcgcgagcgccaccgtggtcagccaggcgtcctcgcaccacgtacccgtgggagtcagcacggcttcgaagcccaactgctcggccgccttggcgatctgggtcagatactcgatgtccggggcccgcaccccgctcaccggggtgatccggtcgcgcttgatgccgccgtcggtgtaggcgtgccggtcgacgagcgtccggccgtcgcccccggtgggcaggaaccagtgcagatggacgttcacgatgaggcctttccgtaggagcgcggtgcggtggaggaagcggggaggtcacggttgaaccgggtgtcgacgtagtcctcgaagtcgaaccgccgcggaatcagcttcagttcggcgaaggtgtcggcgatctcctgctcggaggcgatggccgcggcgtcgatcgcgaccgggacgcgggtgccgtagctgagtttcacggcgtccagcgccacctcgtagggcagcccggtctccttcgcccagaccttcgcccactcctccgggtgctcgaagacccacttctgggcccgctccagccggacgaggaggtcgccgatggccttcgacttcttcccgtccttgagcgagacgggtgaagcgacctggaaaccgaggccgttgacgacgccctcgccggtcgtgaggacccgggcgtccgccgtgcgcaggacctgcgaggtgtacgggtcccagatcgcccaggcgtcgaccttgccccggctgaacgcggcgagcgcgtcggcgggctgaaggtggttcagcttcacgtcctcgatcccgagtccggccttcttgagcgaggcgaccagctggaagtgggccgaactgccttgtgccacggcgatggacctgcccttgagctggacggtcctcttcagcggcgagtcctcgggcacgacgatgacctcaccggccgacgagccgtgcgtggcgccgacgacagcgatgttcgagtcggcccccgcggcgaagacgggcggcgtgttgcccacgcctccgatgtccaccgccccggcgctcacggcctccagcaggggaggccctgaggtgaaggtggaccacttgatgcggtagccgaggtcgtcgagctccccggaggcccgcaggatcgcctcgtaaccacccttctggtcaccgacgtcgagcgtcaggctgccctttccgtccgtgctgccgcccgaattcgcggacgaagcgccgccgcacgcggagaggaggagagcgagaggaaggagcagggcgggcagggtgcggcgtttcatgatgcgtctccgtgacgggggtgtgcgggcgatacgtcgggtgcctcagccggccccggaccggacggggcgacggcgacggacggcttctcatcggcagcggcgccgtgctcaccgtgggcgtgggcctcgccttcgacgcggccctcgccctcgacgcccagttcggtcagcagccgggagcgcaggtcggcgaacccgggggagccgaccccgcgcggccggtccagcgcgacgggcgtgtcgtacgcgatgcgcccctcccgcatcaccagcgcccggtcggccagcagcagggcctcgtcgacgtcatgggtgaccaggagcacggtgcagtcgcgcccctgccagagctccgcaaccagctgctgggccttgatccgggtcagagcgtccagagcgccgaaaggctcgtcgagcagcagcagatcgggctcgcgcaccagggccctggccagcgaagcacgctgcgcctccccgccggacagcgtcctgggccacgccccggcccgctccgccagcccgacctccgtcaacgccctctcggcgacagcgcgttcgggcctgccgggcagcccgagcagtacgttgcgccagacccgcttccacggcatcaggcgcggggcctggaacgcgaccgcgcgccggcggggcaccaggacggtgcccgagatctcccggtcgagcccggcgagcacccgcagcagggtcgacttgccgcagccgctgcgtccgagcagcgcggtgaactcacctgccctcagggtgagatcgaggtcgtcgatgaccgggcgcccgtcgaaggcgcgggtgagtccttcgacccgtacggcggcctccgggtcaccggccgacgctgcggccctcgggtcggggacaagggtgtctttcactggccggtgaaggtcggtcgccattgcagcagcagcctttcgaggatccggacgatgacgtcggcggtgaggccgaggaaggcgtacacgacgagacagacgacgatcacgtcggtccggaagaactcacgggcctggttcatcaggaacccgatgccggcgtcggcgttgaccgactcaccgaagacgagcgcgagccacgccgtcgccagcgagtaccgcagcccggtcatggccccgggcagcgctcccggcagcaccacatgccgcaccaggccccagcgctggagtcccaacgactcaccggcttcgacgagttgggaatcaaccccgcggattcccgcgtagacgttgaggtacagatgaaaggccaccccgagcgcgatgagggccaccttcggcgcctcgccgatcccgagccagatgatgaacagcgggatcagccccacccagggcaccgtgcgcagcatctgcacggtcgcgtcgaccaggtcctccccgagccgtgacagccccgacacgagtgcgagcgccgtcccgacgaccccgccgagcaggagccccacgaccacccgctggagcgagacccccatcgcggcgggcagcgtcccgtcggccaccagatcggcgccggcgcgagcgatggtcccgggcgaggcgagcacatcgggatgcagcacccccgtggcgctgaacacctgccacaacgcgagcaacagcaacggccccaccgcccgccgcacccaccgcggagcggaccgcagtcgagaccgccggacggacgccggaaccaccgcctccagatccggcggcgtacggctcggcggggaggatttctccggggcaacggacaggcctggtgggggtggtgcttggctgacggtcatgagggctccacggaaggccgcacggaggcgggcgaaagggcgaaagccgaagggaggaggcgcggagtagcggagaagcggtcgggaaacacggcgcgtggccgcgccggaggcactccgaacccacccgccacaaccgaccggagggtcggcggtacgacggaagggggagaaatcgcggtgtgctcagcggccgccggccggcacggagccggacgcgactacgcgaccagggcggccaacacggctacggaagggcgaacgacggaataccgcaggcgcagccgtgcggtgggacacgctccggaagttcgctgggagaacgtcagcagccgcgacgacacgcagcggaagccactcgcagcaggtcgatgtgaccgcgcgaagtgagcagagctgatcggaacatgtggctgaacgtagccatccggtcgggacacggtcaatggtgtctcggaccgtggacgcgtcatctcacgccagtggggtgaagatggaggcatgtccgattccttcaccaccacggtcctgaccatcaccacgggtacgtccgagagcgtcacggacctgacgcgcgcctgcgaggagttcctcacccgcaccgcgcccggccgcgacggcctgctcaacgtcttcgtcccccacgccaccgccggtgtcgccgtactggagaccggcgcgggcagcgacgacgacctgctggccaccctccaccacctgctccccgccgacgaccgctggcagcaccgccacggcagccccggccacggccgcgaccacgtgctccccgccctggtgccgccccacgccacactgccggtgatcgacggcaggctggagctgggcacctggcagtcggtctgcctggtggatacaaatcgcgacaatgcaaaccgtcaggtccggttgtcatttttcggggccggccgcaccaaatgaaagaggcccagctctgggcagggctggatgagcagtgctgcgcggcgatttgcgcctggggaggatgtcatccgcgaggaactcggcatcaccgcatcgaacgcgtgctgaccgacaatgcctgggcctgacctgtgtcgggccattgctggcagtgggctgacggtcgccgccggggtgcccggggattccgtccctggggagccccggaacgcggagtgcactgcagaatgcagactccccgtcgagcccggactgccgggccgaaggggaggtcgaccatccgcgaagcggccgaggccggccgggtacggctgggtgtcgacaagctggacctgctgtacgcacagtcggcggagccggatctcgggtgtcacgtgattgttccgctcgccagcggctaccggttggtgctccgggcctggggattccggcccaccctgtacctcgacgtgcccgacgaggtctcggcccaggccgtcgcgcggttcctcgcgccaggcaggcaggtcgcttctcgacgccccactccggagaatcgatgcagcgtgttcagagttcgcccccgcacacccagtgacatccggggcggccggggattatggtgcgaacgtagtgtgacaacgttgtcagttgagcagaactcgaagggaaataccccatgcggtttgctttcagaccgttccgtccccgtgcttccggtataacagccggtctgatggccgccgtactcgcgagtggtggagtgttcggcatcgccgagcccgccgccgccgcgggcgcggaaccgatcgatctggtcaatccgttcgtcggaacccagaacttcggcaataccttccccggggcgagcgcgccgttcggcatggtccaggtcagtccggacaccggcggccagggcggctacgactacaagcaggactcgatctacggattcagccagacgcacctgtccggcgtcggctgcggcgtcatgggcgagctgcccatcatgccgaccacgggtgcggtcgactccgtggacccgaacacctaccgctccccgtacagccacgacgacgagcaggccagtcccggctactaccgggtggggctgaagaagtacgacgtcgacgcggaactcaccgccaccgagcgcaccgggtggcagcgctacaccttcccctccaccggttcggccaacgtcctgttcaacacgggcaaggccaaccagtccgtgctggactccgaggtgcacgtcgtcggggaccgcaccatcgagggccgcgtgcacgccgggggcttctgtgccggacacgacgagcacacggtgtatttcagcgccaccttcgaccggcccttcaaggcttacggcacgtgggacggcgcagaccccgagcccggtacccgcgacgcggagggaggcggccagaacggcgcctgggtgaccttcgacgcgaccaccgaccgggacgccgtcctgaaggtggggctgtcctacaccggtgtggagggcgcccgtaagaacctggcctcggagaccaaggggtccttcgacttcgacgccacgcgtgcggcgttgcgaaacacctggaagaagcagctggattccatccgggtcggcggaggcgcggcggaccggcagaaggccttctacacggcgctctaccacagccagttgcacccgaacctcgccggtgacgtcgacggcatgtaccaggggttcgacaacaagacgcacacggcaaaggactacacgccgtatcagaacttctcgctctgggacacctaccggccgcagaaccagcttctgcagatgctggagccgaaggtcgcccgggacgtcgcgctgtcggtcgtcgcggccggccgggacggcggctggctgccccgctgggcgctcgccaacagcgagaccaacatcatgaccggtgacccggtcactcccttccttgtggaggcctggtcaaagggtctgctcgccggacacgaggcagagacctacgcgttgctgaagaagaacgcgaccagcaccccgcccgccgactcgccgtacaacggacgctcgggatccgaccactacgccgagcgcggctacatcccgtcaggtctcgagctcggcaaggactgcgcggacaagggcggcgacaacgactgcaagcacccggcgtcggcgacgatggagtactccgccgccgatgcgtcgctcgcgctgatggccgaccggctcggacacaagtcggacgccaggatgttcgccgcgcggggccagtggtaccggaacctgtgggactcctcgatccagcagttccggccgcggacggccgacggcacctggctcacgccctacgacccggtcgaggcggcgcaccagttccatgagggcggcgcgtaccagtaccagtggctggtaccgcaggacccggccggactcgtcagcctgatgggcggccggagcgccacggagaagcggctcgactccttcttcgtccacgacaagctgctcaccgacccggcgggcacggccaggaatgactggatctcgcagccgtacgactactacggcaagccgacgtacaacccgaacaacgagccggacctgcacgccccgtacatgtacaactgggtcggcgccccggcgaagaccgcgaccgtggtgcgtgcggcgatgacgctgttcaccaacgggccggacgggatgacgggcaacgacgacctgggcaccatgtcggcctggtacgtcttctcctccctcggcctctacccgacgatgagcggcggtgacttcctggccgtgtccagcccgcagttcgaatcggcgaccgtccggatcggcagctatcaccaggcgtccgggaccaagggccagggcggcacgctgacgatcgaagcacccggagcgagcgacacgaagcggtacgtgcagagcgtggccctgaacggccggaacgtaccccagacctggctgagctggaacaagctcgcgcacggcggaacccttgcccaccggctcgggacctctccctcctcctggggcacgggcaagggcgcccagccgccttccgtcaaccaggcatcccccgacagccgcaagcacgtcgacgcgtcgctgcgtcccgcctcggcggtcgtccccacgggtgacgccgcacagaccgcgaagttcacgctggacgtcctcgggcaggctcccggcaagctgaacgtgtcggtcacggcgaaggtgcccagcggctggaaggccacgacggcacagcgttcaccactggtgatcgcttccggtcacctgccggtccagaagaacgtgtcgctcgacatcaccgtgcccccgggcgtcgcggccgggtcctacccggtggaggtgaaggtcgcgggccgagggacgaactcggtcacccgcaaggccaccgtcacggtgggagccgccacgacctgcgcgagtgagacgaacgggcagtgtgcggtggacctgcgcgcagacctcggccacgacggcacggccacggtggcgaactccgacgagggcaacttcgacgggcacggctggagctatgacggcgacctgctgcccaaggcggggccggtcacctgggacggggtgacgtacgacgcgccggaccccaccggcacggcgaacaacttcctcgaagcaagcgggcaggccctcctgctgcccgccggacagcacagtgcgctgcggctggtcggctcggcgcacaacggtcctgtgaccaccacactgaccgtgcactacacggacggcagcagcagggaggcaccggtgacgttcggcgactgggcgggctccgcgccgaacggcagcacggtggtcctcgacatgccgcaccgcatcaagcggggcagcggtgtcgacgggccgtccattcggctcttcggtacggccgctgagctcgatgggggcaagacggtccgttcggtctcgctgccggacgactcccgcgtcgagatctacgctatgacgctcgtttagagagggacggcggaccgccgaaacccagccggcggtgcgccgttccggatcggcacgcccctctcatcggggccccggcgcgaaagcgccggggccccgatgagtactcgctcaccccggcatccggcccacgtcccatgggggccgacgcctgcggggggaccggcgatggacgctggcctgggtcaagacggtgatcggccgacgcctgaccatccgacccgcctgaccagcagcccggcaccccgagttcgacctcagtagtccgaggttgccttaacggaggtcggtggacacgaacgtcgaccatgcggagcgccgggtgcggctgagctttctgggctgaccaagatcactcccaggggtcgtgccgccgattctccgtgccaggggtccaggagtgcttcacgttcgacggcgtcgtccgacggggcggcgtcgaggcggtcggtgatgtcgaggaggccgccgcatctcgtccagggtgaaaccgagaggcttcacacggcggatgaccacgagccgggcgacgtcggcctcggtgcagagacggaagccgccctgggacctggcggagggggtgacgagcccgacttcctcgtagtggcggatggtgcgcggagaccgttcggtccgtggggcgactgcgccggtcccgccatgaacagaaggaccagggccacaggcgtggacgacgagcacagcagaccgcatcccgtacgatccaccgaaccccactctaacgttagggtagagttgctggtgcgggagcggctgatccgcaccgctgctgccgtttccggggtcgaagacgcccccccggcgaagattcccgattcttgcaggagagagcgtgcgcgagcccatgacgccgatcgccgccgcctgcccgccgtgacccttcgcatcccgatgtgacctgccggccgcacacccgcgccgggctccatcatcgttcggcttccgacccgccccgcgggccgtccgcagggttccgctccggcccctgtgtgtccttcccgcacgccccggcctgcccgcgggctgtgcccgagcacgacaggtgcctgcttccttgtcctcttccgtactgacttccgccggacggctgcgcggcctgcgccccgactggctgaacaacccgaaggtctggcgcaccgagatcctggccggtctcgtcgtcgcgctggcgctgatccccgaggcgatctcgttctcgatcatcgccggtgtcgacccggctgtcggtctgttcgcctcgttcaccatggctgtggtcatttcgatcgtcggcggccggcgcgcgatgatctccgccgccaccggcgccgtcgccctcgtcatcgcccccctgaaccgcgagcacggcctgggctatctgatcgccaccgtcatcctcgccggaatcatccagatcggcctcggcgccctcggtgtggcgaagctgatgcggttcgtcccccgctcggtgatggtcggcttcgtcaatgccctcgccatcctgatcttcatggcgcaggtccccgaaatgcgggacgtcccctgggccgtgtatccgctgatcatcggcggcctggcgctcatggtgctcttcccgaggatcaccacggtgatcccggccccgctcgtctccatcgtcgtcctcaccgtcatcaccgtcggcgccgccatcgcggtgccgacggtcggcgacaagggtgagcttccctcgtcgctgccggtgccgggactgccggacgtgcccttcaccgtggacaccctgaccacgatcgccccctatgcgttcgcgatggcgctggtcggcctgatggagtcgctgatgaccgcgaagctggtcgacgacatcaccgacacccactcctccaagacccgtgagtccatcggccagggcatcgccaacgtcgtcaccggcttcttcggcggcatgggcggttgcgcgatgatcggccagacgatgatcaacgtcaaggtgtccggtgcccgcacccgcctctccacgttcctggcgggcgcgttcctgatggtgctgtgcatcgtcttcggcccggtcgtctccgacatccccatggccgccctcgtcgcggtcatggtcatggtggccttcgcgaccttcgactggcactccatctccccgaagacactgcggcggatgcccgccggcgagatcgccgtcatggccatcaccgtgaccgtggtggtcgccaccgacaacctcgccatcggcgtggtcgtcggctccgtcaccgccatggtcatcttcgccaagcgcgtcgcccacctcgcccgcgtcagcgccgtcaccgatcccgacaacaccaccgtcgtgtactccgtgaccggcgagctgttcttcgcctcctccaacgacctcgtcggccggttcgactacaacgacgaccccgaccggatcgtcatcgacctctcagccgcccacatctgggacgcctcctccgtcgccgccctcgacgccgtccagaccaagtacgagcaacgcggcaagaccgtcgagatcaccggcctcaacgacccgagcgccgacctccacaccaagctcaccggcgaactcaccagccactgacccccgcaccccgcaatctcgcagccggggtcccggcatcagcgccggggccccggacgttcccggggctcggctccggagaaggccgcgaaggtccacaggttgtccccgggacccgcaccgtgcacatgaacaccgcggcacccgacccgaacggggtcgggtgccgcggcggttcgaggactccgccccagccgtgacgaccaccggtgcaccgcgtccacgtcatcgctcaccccgtaggccgcacgggtacccggccctcagagtgtttgccagatccgtgtcagcgacgacgtggtgaggacctggtccggacgcccctgcccggcgacgcggccgtcctggagcaggaggcaggcgtccgccgctcgcgccacttcaaggtcgtgtgtggcctggacgacggtcaccccgtcggagacgagcgccgtcagcagcgacccgatccggtccctcgcctccgggtccaggccggtggtcggctcgtcgaggagcagcaggtccgactcctgtgccaggccctgggcgatgagcgcgcgttgccgctgcccgcccgagagctcgcccagttggcgtgaggcgaggtcgccgatgccgagccggtcgagcatcgcgtccacggtcgagtggtcccgtgcggtcagccgccgccacggaccgcgctcaccccagcgtcccatctccacggtctgccgaacggtgagcggaagagtgtcgccgaccgctccgcgctgcggtacgaaggcgggcggccggtcaccggtgcggaggagatcgccggatgtcggcttgatcacaccggcgagtacgccgagcagggtcgacttgccgctgccgttcggtccgacgagtgccgtcgtcgtcaactcggctatctctccgcttacttggtggagcacggggcgccctggatagccggcgcacagctccgagaagcggagggaggtggtccggtcgatgggcggggcggaggaggggtgcggtgttttgaacatgattttcattgtagtctccggggcatggattggttgacggtcccgttcgaggtgaccttcgtgcagcgcgccctgtggggcggaatactggtatccgccatctgcgcgctggcgggcacctgggtggtgctgagggggatggccttcctcggtgacgccatgtcccacgggctgctcccgggcgtcgcggtcgccgcgctcctcgggggcaatctgatggtgggtgcggtggtcagcgccgccgtcatgacggcaggcgtcaccgcgctgggccgtacgcccagggtgtcgcaggacaccggtatcgggctgctgttcgtcggaatgctctcgctcggcgtgatcatcgtgtcgcgctcgcagtccttcgcggtcgacctgaccggcttcctcttcggggacgtcctcgcggtcaggcagcaggatcttctcgtgctggcggcggcgttgctcgcggcgctggcggtatcggtcttcggtcaccgcgccttcctggccctggcgttcgactcgcgcaaggcccacaccctggggttgcgacctcgcctggcccacgctgtgctcctcggcctgctcggcctggcgatcgtcgcctcgttccacatcgtgggaacgctgctcgtcctcggactgctcatcgcgccgccggcggccgctctgccctgggctcgctccgtgcgcggggtcatgacgctcgccgcgctgctcggcagttcggccacgttcggcgggctgctgctgtcctggcatctgagtaccgccgccggtgcgaccgtcgctgccctcgcggtgagcctgttcttcctctcccacgtgctgtccggcctgcgtgaccgtcgtacgcgtcaggtccgctccacggcacctctactcgaagtcaactgaaagaagccagaggcgatcatcatgaccgtccgcagaaacgtcactccgtgggcagcggccgcgctggtgctcaccgcgctgatcgccacgagttgcgcgggggaggagcccaacgccgcgcgatccgcggcgagtcccccgtccgccacaccccacgggtacgtcgagggggcccaggaggccgccgagcagcagtcccggcttctcgtgaacgatcccgacagcgggaagaccagggtcctcgacctcgtcaccggcaaggtgcacaggacggccgaggtgaaggacgccgttcggctgggcacggacggcaggttcggctacctccacgcccccgacagcacccatgtgctcgacagcggcgcctggaaggtggaccacggcgaccacgtccactactacagcgcggcgacgcgggacgtgggtgagctctctgcgggcagccaagcgcagatacgcagtgatgtcgccgtgaccgcggtgaccgacgagaacggccgcaccgttctctacgaccgcggcaaactggagaaggggcggatcgcgacttctcgtacgctgcgcggcacttacaccggtgccgtcgtgccgtacgaggaacacctgctcgccttcgcgaacaaggggggcgccacggaactcgtcgtcctcgaccgacagggtgaacgcgtggcttccccggacgtgacgtgcgaagcaccccggggagacgccgtcacccggcgcggtgtgatcctcggctgtgccgacggtgccctgctcgtgcgtgctcaggacggcgcgttcaccgccaaggagatcccgtacggaaagcacgttccggcgcaggaacgagccaccgacttccgccatcgacccggcagcgacacccttaccgcctcggccggtgacgacgccgtctgggtcctcgacgtcaccgagcggacctggaagcgggtcgacaccggacccgtcgtcgcggtcaacacggctggcgagggatccccgttgctcgttctggagaccgacggatcggtgcacggctatgacgtcgtgaccggaaagcagaccgcgcggaccaagccgctgctgacaacagggaaacggggcaactccggcggcagcaccccggtcatcgaggtcgaccgcagccgcgcgtacgtgaacgaccccgagggcaagaaggtgttcgagatcgactacaacgacggcctgcgcatcgcgcgctccttcgacctggacgtcaagccggtcctcatggtggagaccggacgatgagccgaaccgaggtgaagcgtcgtgctgggacgggcgcgcgcccgcgacacctggtggcgggtctgctcgccctcgtgacagctgtggccgccaccgcctgcaccactggggacgaccggcccagcatcgtcgtcacgaccaacatcctcggggacgtcacccgcgagatagtcggcgacgaggccgacgtcaccgtcctgatgaagcccaacgccgacccgcattccttcggtctgtccgcggtgcaggccgccgagctggaacaggccgatctggtcgtccacaacggtttgggcctggaggagaacgtcctgcggcacgtggacgccgcccgtgagtccggtgtcgccaccttcgcggccggcgaggtggccgacccgctcaccttccacactgccgacgacggcggccccgagggcgaggaagggcagcccgacccgcacttctggaccgaccccgaccggatgcacaaggtcgccgggctgatagccgaccaggtcatcgagcacgtcaacagcgtggaccccgacaccatacgggccaacaccgaccgctacgcgaagcaactcaccgacctcaccggctggatggagaagtccttcggccgagtccccgcggaccaccgggccctggtcaccaatcaccacgtcttcggctacctcgccgaccgcttcggcttcgaggtgatcggcgcggtcatccccagcggcaccacccttgcctcacccagctcctcggacctgcgctccctcacccaggcgatggagaaagcaggcgtgcgcaccgttttcgcggactcctcccagcccaaacggctcgccgaggtactgcgaacggaaatgggcggcggggtccgtgtcgtggaactccactcggagtccctcaccgccaagggtgcgggcgcggacacctacctgcggatgatgcgcgccaacaccaccgccatggtcaacggcctgaccggcgcctgaccccgccccactgatcctcccggcacacccgcccatcgggcgccggctcgtcgtacccccatgccgccaccgcgcggtgcagaaaggaacagaccgatgaacaagtcgatacgcggcagggctctcacgggcacggcactggctctggccaccgccacggtcctgaccgcctgcggcggagagagctcctcctccaccgactccaagtccgatggaaccgcgagcgccacgcccgcggtggcggtcgaggagccgctggtcgccaccttcgacggcggcctctacatcctcgacggcgacagcctgaagctcgccaaaaccattgacctgccaggcttcaaccgggtcaatcccgcaggtgacaaggaccatgtcatggtctccaccgacagcggattccgcgtcctggacgccaccggccaggccctcaccgacatcgagtacaagggcgccaagcccggccacgtcgtccgtcacgccgcgaagacggtgctcttcaccgacggcaccggagaggtccatgtcttcgaccccaccgcactgagcggcggcaagaagccgtcagggcgcacctacacctcctccgaggcgcaccacggtgtcgccatcgagctggccgacggcaaactcgtgagcactctgggcaccgaggagaagcgcaccggggccctggtgctggaccggaacaacaaggagatcgcgcgcagcgaggactgccccggagtccacggcgaggccgccgccaagaacgaagccgtcggcgtcggctgcgaggacggcatcctgatctacaaggacggcaagttcaccaagatcgcctctcccgacgactacggccgcatcggcaaccaggccggcagcgacgcctcgcccgttctgctgggcgactacaagaccgaccccgacgccgagctggaacgccccacccgcgtctccctcatcgacaccgagaagaagaagctgcgcctggtcgaactcggcaccagctactccttccgctcactggcccgcggcccgcacggcgaggccctggtcctcggcaccgacggagccatccacgtcatcgacccggacaccggcaagatcgagaaggagatccccgtcgtgggcgactggcaggagccgctggactggcagcaggcgcggcccaccctgttcgtgcgcggacacgtcgcctacgtctccgagcccggcaagaaggcgctgcacgccatcgatgtggagacggggaagaagatcacctccgtcaccctgccgaagagcaccaacgagctgtcgggcgtcgtcgccggacactgacatcctgaccgcgcctgtgccctcgccgtcccggctcgacgccgtgacggctagggcacacgcaaccacggcagcgcgctcgaccgtgacctcagcaccctctccccgagcaggggcctgcgttcctggaaccggacctacgaggcttaggagcggttgtacctggaaacgactactcccgagcgaccgccacttcggcagtcggccgacaccgggagaggccttacgtggacgcgcccttatacctgaggcccagggtcgagccgccgctcgatgcactgctgacggaccgggacttcctgcactcgctcgtcgacgcgctgggttcgccgctcaacgtgctgctccccgaggccgtggccgagaacgccgccagcttccgcgcagtctacgaccgccaccgtctcaccggacgtgtgtacttcgcgcacaaggcgaatcgttccagcgccctgctgcggcggctggcggcggaggacccggccgccgtcggcgtcgacgtcgcatccgtggaggagctcaggcacgcgctggggtgcgggttcaccggcaaccgcatcatggccaccggccccaaggacgccgcgttcctctggctggccgcccgagtcggagcgaccgtcaacctggactcacccggcgaactggaacggctctccggcctggtccgcgcgcacgggctcggccgggtcgccgtgctggtacgcctgtcaggtttcgagtacgcctccggccgcgagggagcgggcacccgactgctctcccggcgcagccgtttcggcactccgttacgggacacggaggcgctgctgtcggccctcgaacgcaacgcggaggcagtggagttcgtcggcgccgcctaccacctcgacaccaccggcgtcgaggagaaggcacgggcgctggagcagtgcgtgctgttcatggacgcatgccgggcacgggggctctcaccgcgcgctctcgacatcgggggcggattcggcgtcggctacgtcgccgaagcggaggagtgggaccggtggaccaccgcgctgaccgaggcggtgctcggtgtccgcccgccgttgacctggcgcggtcacggatacggcctgcgcaacgagggcggtacggtgcgcggtgccgccgcgctgtaccccgcgcaccgccccaccgcaggccccggctacctcgacgagcttctctctctgcccgcgccggtgctgggccgcccgcccgccaccctcctgctggagcacctccacgacctgcacatcgaaccggggcgctcgctcgtcgaccagtgcggactgtcgctcgcgcgcgtgctggacgtacgtcccgcggacacggactccggtcaccacctggtgcacctcgccatgaacgcgggtgacatgagcctggaggagcacggcgtcctggtggaccccgtcctgctgccacgggatgaagccgaggccggcgacggggagccggccggtgtctacctcacgggcaacctctgcctggaaggtgacctcatcacgcgccgtctggtctacctgccgcggctgccagtggcgggggacctgctggctttcgtcaacaccgccgggtacgcgatggacttccacgcccaccgcgcgcagcggcagccgctcgcgcggacggtcgcggtggagcgacggggtgaatcctggaactggtgcccggacgaggactactggccgatcacacccgtgggggagcagccggatgaggtatgacagcatcaccgaggccataggcaacacgcctctggtgcgcatagatcccgccgtgcacggactgcgcaacatcgacctctacgccaagctggagatgctcaacccgttcgggtctgtcaaggaccggcccgcgtggcacatggcccggccccacctggagaccgccaccgacggcgaggggacggtggtggagctttccagtggcaacaccgccaaggcgctggctctgctggccggtatgcacggcgtgaggttcaagagcgtcaccaaccgcatgcgcgtacccgagatcaaggaactcctgctgctcatcggcgccgagatcgaggaacttcccgggcgcagcgagtgcctcgatccgaccgacacggacgacccgctgacacacttccaccgtgcgctcaccgacccggggagcacgtatctgcacaccgatcagtacttcaacccccgcaacgtggaggcccacgcggagggcaccggccccgagatcgtgaaggatctggacggccgggcgccggactggttcatcgcctgcgtggggacggccggttcgtcgaccggtgtcgccagggtcctgcgcgagcacgacccgcgcgtgcgggtcctcggcctggtcgcccacaaatcggacttcataccgggcatccgcaccatcgacgaggtccaccaggtcggcctgttcgacccggcgacgtacgacaccatcgagtcggtcacctcggacgaggccatcgacggaatgatcaccctgatccgccgctgcggactgctgagcggaccgaccggcggtgccgcctaccaaggtgcggttcggcaactgcggtacgccgacgaggagctggacgggacggggcagcgccgcacggcggtgttcatcgtgtgcgaccgggccgagagctatctcagctatgtgcgtcagcggcgcccggacctcctgggccgaacgggccgtgggcggtccgcggcggccgtcaccgacgccgaggcccgcgcggaggctcgcgtcatcgaagtggacgacgcccggcgttggtctgcacagggcgatcctcgcccactcgtcgtcgacctgcgcagcccgcacgcctacgccgccctgcacatcgaaggctcggtcaacatcgtcgacgaggtgttcgaggacctgctccgtggcggacttcccttcagcaagcgcactcccgtactgcttgcctgtcccgtcggcgagaagtcactgcgttacgccgccgcactgtcccggatgggccacccggacgtccgcagtctggccggcggggtcgtcgcctggcgggacgccggcgcaccgctggtgcgcgaatgagcccggcggacccgcccccagagcctgagaacccgctctggcagcgggaagccagggaacagttccccatcgtcaccgcgcaccccgagctggcctacctcgacagtgctgccacgtcccagaagccacatgccgtgctggaggccgttcagacctacctcacgacgtcgaacgccaacgccggccgcggcagctacccctgggccaaccggacgaccgaactggtggaggcgacccgcgaacgggtcaaggagttcctccacgaccccgaaccgggccgctccggcgtccacttcaccagtggcaccaccgagggcctgcgtaccgtcgcccgcgactggctcgtgccgtacctcagcgacggggacgagatcctcgtgccgtacgccgaccaccgggccaatctggacccctggatcgaggcccggcggctcctggccgagcgcggcgtccaggtccgcgtgcaggcgctgccgtaccaagcgggctccggagactacgaccaactggccctgcaacgggccgtgagcccgcggacccgcttcgtggccgccacccacgtccaccacgtctacggcggcgacatgaacgtgcaccgtatccgtgaagcggtcggcccggacgtggccatctgcctggacgcggcgcagagcgtcggccacctgcccgtccacctcgacgacccgtccctcgatgtggacttcgtggtcttctcagggcacaaggcgatggctctgccaggctcaggagcgatctgggcgcgcaatgtgcgggggccggcgttccggccggagggctggcagggcacgcccaacacggccggcatcgtctcgctgcgggccgccctggactggctcgacacgatcggaccggagcgcgtcgcgcactggacgacgacgctcaccacccggttgacggacgggctcgcgcgtctggggccgtacgagatcgtcggctgtcaagcgagcctctccgccgactccgccctgcccgccgagcagcgccgacgcggcatcgtcaccttccggcaccgcgacatcccctcgggcgacctcgggttcattctcttcagccacggcttcatggtgcgggccgacaacctgtgtcaggccggctccgagggccgggacgcttcggtgcgcgtgagcctgcacgtgtacaacacggtggaggagatcgaccggctgctggccgtcctcgcgtcgttggcatgaatcgcaattgataatcgttaccatctgtagatccgtcggcgcccccgcacggacgagagacagacgaggtgacgcaagctatgggtgtgagcatggcgacggccaggacctgggtcgagcgctgggaacgccagcaggagcggtacgcggtggaccgcgaggagcgattcaccgtgatcgccgatgtcgtcgaacacgccgtcgtcggccgcgccggccccctgctgctggacctcgggtgcggccccggctccctggcctccaggctcgccgcccgcttcccgtacgccgagatcgtggccgccgacatggaccccgtgctgctggaactaggacgtacccaccatgccgacgccgcccgctacgtcgacaccgtcatcggcgcggacggctggaccgacgccctccagctggaccgccccctggacgccgccgtctcgacgaccgccctgcactacctgaccgagccgatgctgctgcgcacctaccgcgccctcgcgtccctgctgcggccgggcggcgtcctcgtcaacggggaccacttcccaccggacgcggcagcctgttcggagctcaccgcccacgtgggccgtcgcaggtccgagcgcacgggcggccacgcgcgcgacgactggcggtcctggtgggacgccgcggccagggaccccgaactgaccgacctgctcgatgaacgccgacggcgcaacgccctccactccggcagtggtggcgacgagcaggtcacggtgagccgacacgccgcactgctgcgtcgggccggcttcgcccacgtcgcgccggtctggcagttcggggacagcaccgtactggtggcggtcatggggggcacaggcgaactttccactcccgtcggaacctgaggccggcggctgaagcagatcgatcgccgccgtccaccggcggaccgtgctgaccccgacgccgagctgggccgccttgacggcgtaagggtgcagcatcggtgttcccggcgcgcagtccgcacgcggctcaccctccagcgccagcgcggcgtcgccgagccggtacccggtgaggagctcctggaggtgctggacctgcaccgtcaggtcttcgtcctcctcatcggccaggccgctcagcacagctgcggccgccgtctccttctccggaccgacgtcaggaccgcggtggtgggatgagagagcagcaccgagatgtcgatctgcctcagcttcggtggcccggccagccctgactgccgcaggagggctcctgctggctcaatgcaggtgaagtcccgacggccgatccggcccgcctacgctgccccggtgcgcaacaccaaggcgttcaaggaagccattaccgagacactcgcggagttggaccgtcgcggcgtggatctcgcgcccgcgaccgtggcggacatgatcgagcagcagatcactaccgtgtccgagcggctgcgcattcacgtgcgctctgcctggcgatacttcgatgcgtccgccacggccgaccgtctcgcgaagagccacgctttctacgaggagagcagcagcgagaaggacgtcgggcagccccgatgccgcccatggacaaccccgagctcgccctggtcctcgccgcggtgccggactccctggtccagaccggcggcgacctgtacgccgtcatcatcaacgtcgcggtcgacgcctggatggccggccacatccacggcgaggacggctgcgaaggcgaccgcggcgacatccgtgcggccgttgccacgtcacggcaccggcaggtgttgcaccctgtgtctgtctacatgggttcgacaaaaggaacccgccactccgggcgcgggtcagcgccaaggctcgtccagtactccgtcccacggacaatccgtccgtcccggacggtccagaacgacgccgcacggaacaccccgatgccttcgtgcgggacctcgacctcggagacaacctcgtcaccgtcggcgacgatccgcagcacgcggatcgcccagccctccggatactcacggttcaccgcaacgtagttcttgccccccaccatgcgttcaccgctgaccggccactcgacgacggcgtcctccgcgaccagcccggcgacgccatcccagtcccgcgcctggatccggtcccacagcgcttctaccactctcaacgactccatatgacaaatcctgccagacgcacccccgacagacgtatggaccgccgccgtcaatgagaccggctacgccgtcacccgccgctgcctcgtcgaaggaacccttcgaggaggacctgcgcgtgcgctcctggcatatggcccctgggggacatcgtcctagcgctgtaccggagcctgggccgcctgggcgaagtgcagcacgacggccttggctccggtggcgacctcatcgaccagagcgtcgctccgagggtctgccgcatggcgcctggcccagatcatggcgaacttgatgatctggtcgacgtcgctaggacgcagcaggatcgcgtcgcctgtacgcagcggctcgggccggcgatgctgccacagccggtagaagcgaccgtccgcgtcgttgaagcccaggtgccggtcgccgtgcggattgatcaggtgggtggtgaacggcagatcgttcgggcccggctgccagggctgttccggctggctcaactcatcctccgtcggcttcgatgatcacaacgtgcggagtgtgtcagcaacggtcgggagcgggcagggcttccggccgggtcgcccgcctcctcgcgccggcgaccttgtcgcccggcagtttcgcgagctccgcaccgactggagttgccggattccagcgtccccggcgaggcgaagggctgtccggcgaaggtatttcggtgagctatgcgctatggaattgcccatcccggcttatctcgtgggtttcgcccgccggaacgggtcgatatttctatttgccgcatgctccacggttccgtccgcgcacggaatgcgcgacgctttgcgagtcgtcctgtcggcgggtcttcgtccggctctcggggaggtcggcgacgcgccggcgggcccgccggcgtccgagcaggaccggcatgtccggcgaggcttgcgccgaactgccctcatccctccggaccgggccccggcccgcctgcgcccgccctgcggagagcggttcctgacgtgttgccggggccgcgaacgccggaggaccggtgaacggggccggggcggttcagccgcgttccaggagatcggcttcccggccgagggcgacagcgtgcgcgagcgtccgtgcccgaagtacggtccgggcccggtccagcaggcgccccaccgtctccggactgaacctcaaggcctcggcgatctccacttgcctgcggccccgggcgaagaggcggagcgcggcgagttcctcggccacggccaccggccttttccggactaaggacaggcggcccagaatcgaggagaagcagccgtggagccgcacgcagaacgagcgggccgaccaccaccgccgcggtagcaagggcggtcggccccttgtgatcgcggcgcctgctacgaggccggttcggcccagagttcggtgctgtgatccccgatgagagcgccgatgtgggtgagtgcgtcactgaccggctgcggggcgagtcggcgcccgtcacgcaagcgcagtgcgacgtgatcgtcagcggcctccttggcgccgatgaccgcttggtagggaaccaggcgggctcctcggattcgggcgcccaggctgccgcggtccggtcccgcgatctgggcacgcagtccgagacgggtgcagtgttgggcgagggctgcggcgttcgccatttcggtgtcggagatcgggagaatgacgagctgggtgggagcgagccaggcggggaaagcgccgccgtgctgttccatgagatgggcgacggctcgttccacactgccgatgatgctgcggtggaccatgaccgggcggtgtttggcgccgtccgcgccgatgtagtgcagatcgaactgctcgggctggtggaagtcgacctggacggtggacagggtggactcccggccggcgccgtcggtcacctggacgtcgatcttggggccgtaaaacgcggcctctccctcggccgcctcgtagggcagaccggagcggtcgagaacgtcggtcagcagggcggtggaccgctgccacttctccggtgcggcaacgtacttgccaccgggccccgggagagagagccggtaacgagtgggggtgatgccgagcgcctcgtacgcctggcggatcatctccagcgccgcctgcgcctcctcggcgacctgatccagggtgcagaagatgtgcgcgtcgttgagctggatggcccgaacacgggtcagtccgccgagcacgcccgagagttcggagcgatacatgccgcccagttcggccatccgcaggggcagttcgcggtagctgtgggagcgggagcgatagatcaccgcgtgatgggggcacaggctcggccgcaggacgacctgctctccgccgagatccatcggcgggaacatgtcgtcactgtagtgcgcccagtgccccgagatctcgtacagctcccgcttgccgagtaccggtgagtacacgtgctggtagcccgcccgccgctcggcggcacggatgtactcctccagggtgtgcctcacggccgcgccgtcgggcagccagtagggcaggccggcgccgatcagcggatcggtgtcgaacagacccagttcacggccgagcttgcggtggtcgtgcagggtggtggtcatcgcggtctccttgctggttgcggagcaagtgaccgggcctacgacgaagccccggggcacttgccccggggcttcggatcagatcatctgtcagcgcgccgggacactctccggcgtcgtcgtcatagcagcgcgcttcatgtcgcagacgttagcaggatgtaccgcggtccacacggtcattcctcggtcaggagatccgccgggcagtccctgaatgagagagcggctccgtctggggcgggccggggatgcggggtgatcagcttcgtggccggggttctccttcatccggttgagacggtgacgcgtcgacggtgaagacaggcatgccggggtcgaccagttgaggccgtccgtcggtggggatgctctggaggctcttgagcttggccatcgccgcgtcgaagctgacctgaagtccctcgacctcgccgagccgtccgcaggtgccgcgcgagaccttgcggagttcgaactgctgctggaagtcgggccactccttctcggtgggctcccggtattcctcgacgggacgttcggcccggcggcggtcgaggaagccgcggtaggtgcggatcaggtcgtcctggaagacggcgaggtatgcctgagtggtcgtcagagttttgtgtccgaggatgcgagcggcgatgtggacgggaagcccgccggtcacggcctcggtcgcgaacatcctgcggaagtcgtggggcgtgtagcgcatggggttgcctgcctggtcacgcagccccatccgttccagggtcttgcggagcaggctggcgacggtgttctgacccatgacctgcggctgccagtagtggcggcgctggaagaggtgcggcagcattggtccggtgacgcgttcgtggtcgtcgtagcgggccacgagcgggatctggccgccgttggcatcccggaggcgttcgatgatcgtggccaggacgccggccagttccgggctgaccagcagcagccgttcctcgttgctcttggacgggacgatctgcaacagcgggacgatctcaccggtgtcggggagcttgtaggagaccagcgcgaggtgcgtgatctcggtgaggtcctcgacgcgtactccggtgtgccgcagggactcgatgacggcgccgcagacagatgatgctgcaggcgaggtcgagcagtgtggtggaggtccgctcgctgttcgtagcgggtgcgcaggcgcttgatctcgtggagccgggcgaaggtgcgctcgacgccccggcgcaccttgccgagtccggagccgtgggcgactccacgtcgggcgatcatcggcttgatgccgcgcttccaatggcggcggcggtacttgtcgtagtcgtagccccggtcggcgaacggccggcggggcctgtgccgggggcgttctcgcgctcctcgggtcggcggtatcggagccaggaggggcagcggttgggtgacatcgtgtcggttgcccccagtgagcgtcacggtgagcggtgttccgtagcggtccacgatcacatggtgtttggagccggggcgagcccgttcgacgggcgaggggccgacgtggtccccctgtgagggcccggatgtgggagccgtccacggcagtcgtccaggtccagcagttccgcacggcgcaactcggtcagcagcgaggtgtgcggacggggccggacgccggcctgggtccggtcccgcagccgccgccaggccgtgacccccgaacagccgacgactgccgtcggtacatcgcgccatgcgacaccggtccgcagcacgtagacgatgccggcgagagccacccggtccggaacccgcagccgccctgcatggcggtaacgccgcgcggagcgggaggcaacaacggagccacccgctcccacgggtcatctggaacaagatcaacatgcactcggacaccctgccaccaagatcgtgatggtcctgggtgtggtgcacccgtcggccgactcgatgagcttattgaatatggaagtcattatctactactgtctggctgtgtcgcatcggcggtcgcggatgtgactgcggaggaggggctctcatgacgttgtcgcgccaggcgccaggcgccgggagggtcggcgcggagcgggaccggtgcgtcggggccgggcaatgcgtgctcgccgcaccggccgttttcgaccaggacgagcacgacgggctggtggtcgtcctggtcgaggagccgtcggcgtccctgtcgaacgccgttcacgaggcggtgtgggcctgcccgtccggggctctcaccttccggtagcacgacgccggtcccgttgcgccaagggcgttgcggcccggccgcgcatgcgttcgttcatggccacccacccgcctggggggtggcgcttcatgtgccgtggatgtcttcccggtgctcggttcagctcagcggaacgtcaaggagaagcatgtccagacagatcgatcgccgcgccttcctccgtcgcggtgcggcgggtgccgcggctctggcggtaggacctggcctgctggctgcgtgctccaccgacgagcccggctcgaacccgaagtcgggatcgggctcctcgccccgttcgggcggcaccctccgggccgctttcgtcggaggcggcgcctccgagacgctcgacttcttcaacggtccgtccgcactggacctggtgcgcgcccgtgcctggcacggcaccctgggcaacctggaccccagcgggccggacggggtgcgctacggcgtgctcaagggcatcgacatctcggacgacctgtcgacgtacacgctgcacgtgcgacccggcgtccgcttcaccgacggctccgagctcacctccgccgacatcctgcactcgctcagcgccctcgcggccaagagcaaactgcccgtgtaccggctcgccgccgccaacttcgacctcgcccgcgccaaggccgacgggggcctgaaggtcgttctgcccaccctgcggcccatcgccgacggccgcatgatcctgtgccagggcaacttcctcgtcgtcaaggacggcaccaggaaattcgcccagggcatgcccagttgcggccccttccggctgacggagttcacggccggtcaggggtcggccttcgaacgctacgacgaccactacggccacgttcccaccctggacggtctggaactgcggtcgatcgcggactcgaccgccagggcgggcgcgctcaccagcggtgagatcgacttcgcccacgacctctcacccgtcaccgcgcgcacgctcgcggacagcgcgaaggtcgagctggcctccacgcagagcccttacctggtcggtctgtccttccagatgaacatgagcgtcaagcccttcgacgacccccgggtcagggaggcgttcaagctcgcggtcgaccggaaggccatggtcaggacggtcttctacggcaacgccgaggtcggcaacgacctgccctccatcggattccccgactacgccgaaggcgtaccccagcgcgcccacgatcccgagcgggcccgtgagctgctcaagaaggccggcgccgacgggatgaaggtgacgctgaccaccggtcccgagactccgggcatggtggaaatggccgccctcttcgtcgaggacctgaagaaggtcggcgtgcgggcatccgtccgcgaactgcccgggggacagctctacgccgacttcccggcgtacgcggcgctgccgttggccgctgcgtaccagatgcccgttccggcgctgtcgacctaccagatgagcacggcgggcgggtcgccgtcggcattcggctggaaggagtcggagaccgacgccctcgtggcgaaggcccgtgccgaacgcgacccggtccacgcgaagaagctgagcacgcaggcgcagcgtacgcgctggacgcagggcaaccaggtgctgccggtcttcaagccgaacctgaacgcccaggccaagggcgtcgacggagtacgggacgacctcttcgaacagttccccggattctcccgggcgtcgctggcgtgaggctgctcgccttcgccttccgccgcctggcgggggccgccgtcctcctggtactgctgtcggccgtggtcttcgcggccacgacggtcctgccgggagacgccgtcagcggagtcgccggcgtggacgcctccgcggcgcaacgcgccgaagtgcgtgccgaactcggcctggaccgacccgtcaccgagagatacacggactgggtggccggggcggtccggggcgacctcgggcgcggcttcgtgggggagcggtcggtcaccgacgtcatcgcgacccgcctgcccaacagtctcctcctcgccgcactgacgctcgcggtcaccgcgccgctcgccgtgctgctcggtctgtggaccgggctgcgcggcggcgtcgccgaccgggtggtctccacgtccgcccagatcctggccgccgtacccgagttcgtcatcgccgcgctgctcgtcgccgtactggcggtgtggctggaggccctcccacgtgtctcggtcatcccgctgggaggtacgccgctcgatgtcccgcacgcgttggtcctgcccgtgctgacgctcagcgcggtcggtctggcggtggccaccagactgttgcgggtctccgtggcggacaccgcggccacgccgcactgcgaggtggcccgactcaacggtgtacgcggagtgcggcttgcggtgcggcacatcctgcccaacgccgcgggaccggccgtacaggcgctcaccctcaccacgggtgcgctggtcggctcggcggtggtggtggagaacgtcttcgactacccgggcatcggccgagagctgcaactggccgtcgcggcgcgggacgtgccgatggtgcagggcatcgccaccgcgctgatcgcggtcatgctcacggtgctcctgctgggcgacctgtgcacgcgtctgctgggagcacgggagggacatcgacgatgacgaccgtcgtgacaccgccgaggaggcggactcgcccggcgcgtccgggcacgccccggtaccggcggccgccgctgctcacctgtgccggcacgctgttcctgcttctgctcgccctgctgggaccgctggccgcgccgtacagccccaccgcccagctcgccgcgcctttccagccgccggacggtcagttcctcctcggcaccgacgtgctgggccgggacgtggtgagccgtgtgctcggcggaggccggtccatcgtgctgaccgcgctggccgggacggccgcggccggagccgtcgggatggccgtcggcgtcctggcggccatggtgtcccgcaggctcggcgatctgctggtccgctgcgtggacgccctcgccgtcgtccccgcccttctggtcgtcctggtcctggccgccgggttccccggcagcgacgcggccctcgtggcggccgtcgccctggccaccgcacccttctccaccagaatcctgcgcgctgcgggggacacggtgctgagcagcgggtacgtcgaggcggccctggcccgcggcgacacccggctggccgtgctccgccacgacgtgctgcccaacatcgccggaccggccctcatggacacagtgctgcgcctggtcgcgtccctgcacctcaccgccaccgcgggctttctcggcctcggtcagggtggagcggcgcccgactgggggcgcatggtgagcgagaacgtccccggggcgacgctgatcgccacgccgttcctcgcgccggccctgctgctcgtagggctgtccgtgtgtgtcgggctgctggccggacggctggcggaagcggtggggcgggggatcgcatgaccgggaacgggacatcggcacgccgggtgcgggagggtctgctcgccgagatcagcgggctgacggtcggtccggtgtccggcggtccgcctgtcctgcacgacgcctgcctgtcggttgcgccggggcaggtactgggggtcgtgggcaggtcgggatcaggcaagagcagcttggcctacagcctgctcggacacgtccgacccggcctggaggtgcggtcaggaactgcccaggtggccggactcgacccttttacccctgcggacgccggtcggctgcggggacgcgtggtgtcgttcttgggacaggacccggcatcgtcgctcaaccccgcgctccagatcggcacgcagatcgcggaggcggtacgcctgcgctcggccgtgaagcgtgcgaacgacgtccgggcgcgggtcgaggaactgttgctgtccgtgcggctgccggccgaccgggcgtttcggcgacggatgccgcggcagttgtcgggagggcaggcccaacgcgtcggcctcgcactggccctggctggtacaccccgcctgctggtcctcgacgagcccaccagcggtttggacacggtcctggccgacgcgatgcgcggcctgctggccgaggtcctctccgagggtgaccgcgccgcgttgctggtcagccacgacccggcgtggatcgcgtccgtggcggacgaggtgatccgcctggagggagggcggatcgtcacggcagggtcggtgaagagaccggtgcctgttctgacacagacgaaagcccgcaccggctggtccggtccgccgcggccgcaggaggtcaccaccgagggagggctgcacgtgcgcgggctgagtgccgcccacggccgcgttgccgtgctgcacgacgtctccctcaccgtcccggcaggctcgtgcaccgccgtggtgggcccctcgggttcggggaagaccaccctcgcccgctgcctcgcagggctccaccggcacgcacgaggcagtgccgagtggcgggaggccggtacggagcgaggacgcggcgctgcggtgcaactcgtcgcacaggacgcccgcggcgcactcaacccccgtgaatccgtgaagaccgcgcttctccgccctctcaggggaatcgggcgccgacccgccgaggaagcgctcgaagaagccgtacggctgctcggcctggtcggtctggacgagggtgtactgacacgcagaccgggtgagttgtcgggtggtcagcgccaacgcgtcgccctggcgcgcacgctggcggctcagccgcgcgctcttgtctgcgacgagatcacctcggcgctggacccggacacggcgagcggaatccttgacctgctggactcgctgcggtcgacgacgggcctgacggtcgtgatggtgacgcacgacctgacggccgtcgcccgccgtgcggagagggtcgtcgtcctggacgcgggaagggtggtcgaggatggccccgtcgaacgggtgctcgtggccccggagcatccccgcaccagggaactgctcgcccacgccggcgatgccctcctcgccgtaccggagtagcggcgggtgggggacctctcacgggcggcaggaggagcgccccgctcaccgggcgctcctcccggccacgtcttacgacaagagcaaccgctgtgtcagcgccgccttgtccacctttccgaccgcggtgagcggcagtgcgggaacctgcacgatttcgtccggcgccttgtgcccggccagcccgcgttccttgagatgggcggcgacctcccgcgctccgggagccgagccctcgcatacgacgaaagcgacggaccgctcaccccaccgctcgtccggcacaccgaccagggccgacgcggtgatcgccggatgcgtcagcaactcctcctccacctccaccgcggcgatcttctcgccgccccggttgatctggtccttgatccgccccaccaccacgagatgtccggtgggcaggcgccgcaccacgtctccggtccggtagtagccgtccggggtgaacgccgtgcggttgtacttctcggcgcggtagtagccgcgcagcgtgtacgggccccgggtgaggagttcgcccgccgtcccgtccggcacgggcatgccgtcactgtccaccaccagaacctcgtcgtccggcgagacgggccggccctgggtggcgcagaccaggtcctcgggatcgtcaaggcgcgtcaggttgatcaggccctccgccatgccgaagacctgttgcacggtcgccccgagcgccggtcccagcgtgcgggcgtgatcctccggcagccgtgccccgccgacctgcaccaccgcgaggcttccgaggacccaagacccggacgcggcctcgtccatccagtgggggacgagcggcggggtcagggaggtcagggtcacgccctcccgttcgacgagggcgaacgccgtctgcgggctggggtccggcgcgacgacgaccgttcccccggccatcagcgtgcccagcacaccggggcaggcgaaggtgaagttgaacccgatcggcagtaccgccaggtacacggtccgcgcgtcgagcgcacagacgtcggcgcaggcgcgggcgttgtaggcgtagccgtcgtgcgtgcgcgggatgagtttgggaagccctgtggtgccgccggacagcaacaggagagcgacgtcggagggggcggctccgccgtcgtcgaggccgtgacccgaggcggccggcggggccgagcggagcccttcgaaggagacgaagtcctcgcccggccccggatcgccgaccacgaggacatgccgcagcgagccctccggtccttgttccgcccgcacctcgcgcatcagttcgcggtggtcgaacctggcgtgcagatcgggcaccacacaggccacggccccggccacgcgcaccagatgaccgatctcccggcgccggtgaccgggcatggcgtgaaccggtaccgcaccgagccgctgcaaggcgaaccagaggagtacgaactcggcgcggttcgggagctggaccaccacgcggtcgccccgtccgatgcccagtccgcacagtccgcgggcgatgaggtcagcctcggcgtccagctgggcgtaagtccagcgacggtcgccgtcgacgagcgcgacgcgccctccgcgcccggccgcccagtggcgcaaccgggccccgaaggtgacgccctcccagtggccgacggctctgtaccgcgccttctcggcctcgggccaggtccgttgtgtctcgctcatggggctctgcctctcatcgccgagcctcgtggctctggcgccgggtctagttatgtgattacgatgtgaactatagaaatgataatcatttcaatctagggctcggccccctgcgtgacgaacctcccgccgcctgccgccctcgacaccacccgcacctatccgatcggaaggccccatcagtgagcgacgaagcgctcgtccaggcgcggacagcggaaggcgaccccgccggcagcgacccgcacgaaccggccgcggtgcgcgcggcggtcgcacgcgcactggagctgacgccacagcaactggccgacgaccgggacctcttcgagctcggcctcgactcactgatgctgatgtccctcgtcggcacctggcgacgggcgggcagcaacgtcaccttccaggacctcacgcgtgagccgaccctgcgggcctggacggtcctgctcgggcaagcgcggcccgacggcgacgcacccgcctccgcacgtcccaccccgtcggacgcgacggccgccgaggagcagtccggctccttcccgctggccaccatgcagcacgcctactggatcggacgtcaggacggacaacccctcggcggtgtcgccgcgcacttctacgtcgaactcgacggccacgacgtggatccggcccggctcgatgccgccctgcgcgccctcgtgcggcggcacggcatgctcagggccgtcttcgacgatgagggccgccagcgcttcggtgccgcaggtgcggccctcaccgtccacgatctgcgtgcacgcaccaccggtgaggccgagtccgagctggagcgactgcgtgagaacaacacccacgcccgcccggacatcaccacgggcgaggtcttccgtgccgccctgtgcctgctccccgacggcgggacccggctgcagatcgacctggacatgatggccggtgacgcgctgagcctgcgggtcctcctgtccgacctgcgccacttctacgagtgtcctgaggatccgccgcgcgagatgggcctggactaccgccggtacctcgcggagcacgacgtccggcgaagggccgaacgcgaacagcatgccgcctggtggcgagagcgcctgccggacctgccccgcgccccccggctgccgacgaccgtcgacccgctcaccccggtcagcgcggacgacaccacgctcacccactcccgccgcctgcaccactggctcggccccgccgacaaggccgcccttatcgctgcggcccgccgacacggcatcacccccgccgccgccctcgccaccgccttcgccgaggtcatcgccgcctggagcgacagccggcgcttcctgctcaacctcccgctgttcgaccgggagatgttcacccccgaagtggccgacctggtcggtgacttcagcagctcggtcctgctcgacgcggacctgagcgcgccgcacccgttctcccggcaggcgcgcggcctccaggaacgcctgcaggagggcatcgcccacggggcgtacggcggcgtcgaggtgctgcgcgacctcgcccgcgtcgagggcgccccggtgctggcacccgtcgtgtacaccagcgccatcggcctgggcgagatattcgagcaggacgtccagaagtccttcggccgcccttcctggatcatttcgcagggaccgcaggtctacctggacgcgcaggtcaccgaactcgacggcggtctcctcctcaactgggacgtgcgtgacggggtgttcgagaccggcgtccccgacgccgcgttccacgcctaccgctgcctgatcggccgtctcgtgaccgaccccgaagcgtgggaccggccggtgaacggtctgctcgcgaccgacgtcctgccccgccgcgcggtggcggcagtgcccgccacgccggcccctgcccgcgccctgcacacccgcttcttccggctggcggagaccgagccggaccgcgccgcggtcatcagcacgacgggtgacgcgatcacctacggcgaactcggtggccgagcacgacagatcgccgcgctgctgcgcgaccacggggtgcgggagggagacacggtcgcggtgactctgcccaagggcgccgaccaggtcgccgcagtgctcggcatcctggccgccggagctgcctacgcacccgtcggagtggaacaacccgccgtacgacgagcccgcatccacgccgtggccgaagcgtccgccgtactcaccgaccgggaccacgcccacgtgtgcgcggaagcctcctcggctccggtgctgctcctggaggacgcggcgaaggcggaacccgcacaggtcgtccagccggatcccgccctgcccgcctacgtgctgttcacctccggctcgaccggactgcccaagggcgtcgaggtgtcgcaccgagcggtcgtcaacaccatcgaggcgatggagcaacagctcggactcggcgccgcggaccgcacgctcgcgatctccgcactggacttcgacctcgccacctgggacatcttcaccccgctgtcgctcggcggccagatggtcgccgtgggacaggagcaccgccgcgacgcccaccactgggcgcggctggtgcgtacgcacggggtgactctggtgcagtgcgtgcctgccctgctggacctgctgatggccgccggcgaggacgacggcctcggcgactccccgcgcatggcgctgctcggcggggactggatcggactcgaccagccccgcagactgcgggccctcgtacccggctgccgtttcgtggcactaggcggcatgacggaggccgctgtccactccacggtcttcgaggtggaggagaccgacccggcctggaagtcggtcccgtacggtgttccgctccgcaacatgcgggcgcgtgtcgtggacgggcgcggccgcgactgccccgatctcgtccccggcgagctgtggatcggcggccccggggtggcgaacggctaccggggcgaccccgggcggaccgccgaacgcttcgtcgagcacgacggcgaacgctggtaccgcagcggcgacctggcccgctaccggcccgacggagtgctggagttcctcggccgcgccgaccaccaggtgaagatcggcggccaccgcatcgaactcggcgaggtcgagtcagcgctggaggacgaccccgtcgtcctgcacgccgtcgccaccgtcctcgacacaccggcgcgacacctcgccgcggccgtctccgcccgcgacgaggcacccgacccggagaaggtccgcctccgggcggcggaccgactgcccgcctacatggtccccgagcgcatactcgtcatgcgcgacctgcccctgaccgccaacggcaaactcgaccgggccgccgtccgccaagcgctgaccgagaccgccggacaggacggaccgcgcacctccgagcctgtcggtcccgtggagacggccgtggcggccgagtgggccgacctgctcgacgtggccgacgtgggacgcgagagcagtttcttcctgctgggcggcgactcgctcgtcgcgacccgcatgatcggccgactgcgcgcagccggattccccggcgcccgtgtggccgacctcttcgcccgccccgtgctccagcacttctgcgagacactgcaccccgcgacgaccccccacgagcaggcagcggtcctcgtgcccgacccgtaccacgcccacgagcccttcccgctgacggacgtccaggccgcctaccacaccggccgagactctcgtttcaccctcggcggcgtcggcacctggcactacacggagttcgacggcacggacgtcgacctgacccggctggagcgctcctggaacaccctcgtcgcccggcacggcatgctccgtgccgtcgtcgaggacggatgtcagcgcgtccttcccgaggcgccacccgtgcgcctccccgtgggggaggcgcacgggggcggcgcgaccgaggcgctcgcggacctgcgcgcccgcctgtcccgacaggtccgtgaccccgcccggtggccgctcttcgccatcgaggcggtgcgctaccgcgaggacgaggatgccgggaaggaggacggtgaggtacgcacccgcatcggcatcggcctggactacctggtgctcgacgcgctctccatcaccacgctctacgccgaactgaacgcgctctacgccgatccggaccaggaactgccgcccatcgatgtgacgttccgcgactatctgacccgcctcccggcggacccggaggcggaagcgcgtgcccgcgcccactggcagtcccgcctgtccgaactgccgccgccccccgcgctccccttcgaccgcgaccccgcgactctcgacgcgcccgtcttcacccggcgccgactgaccgtgcccgccgaggactggcaggcggtcaagcgggacgcggcccggcgcggcctcaccccctccaccgtcctgctcgccctgtacgcggaaaccctggcgacctggagcgggagtgacgccctgactctcacgctcaccctcttcaaccgccgtgacgtccatccccacatccaccgggtgctgggcgacttcacctctctgtccctcgccggataccggcgcgagggcacatcctggccggcggcggccagggtcctgcaacgccgtcaggccgaggacctcgaccacgccgacgtgccgatcgactggctgctgcgggagttcggccgacgcacgggcacagtggacgcggccgcgcccgtcgtgttcaccagcgccatcggcgtcggtgacgcgacgctggccgcaccgggcaccggctttcccgccaaggtctggggcatctcccagtcaccgcaggtctgcctggacaaccaggtcaccgaggagtccgggaacctggtcgtcacctgggacgccgtcgaggagttgttcgccgaaggcgtgctggacgccatgttcgccgcatacgaacggctcctgcggcacatcgtcgccggcgactgggaggcgccgctccccggcctgctgcccgcctcccagtacgaacggcgggctgccgaggcacgggaggccgccctcgaaccggtggctcctcgcctgctgcacgacgcgttcttcagccacgcgaccatcactcccgaccgcaccgccctcgtcacgacggcagggcgggaggtgacctacggagccctcgcccggcaggcgctgcgcgtcgccgcggcgctcggtgacgcgggcgtacggccggggaacctggtcgccgtcaccctgcccaagggcccggaacagatcgcggccgtcctgggagtcctcgcgaccggagccgcctacgttcccctcagcctcgaacagcccaccgcacgactggaacgcgtgcacgccaccgccgggttcgaggtggtcctcggaacctggcccgccccggaggcagccggcccccgcagcgtgtccttcgcggacacgcagcaccacgagccgctgcccaccccctgtacgacgtctccgcagacgctcgcctacgtgatcttcacctcaggctccaccggcgagcccaagggggtcgagatcacccacgccgcagcctggaacacgatcgccgacatcaacgcccgccacgacatcggcggggacgaccgcgtcctcgccctctccgcgctggacttcgacctgtccgtgtacgacgtcttcggcctgctcgcggtaggaggctccctcctgctgcccaccgaggaccagcgccgtgaacccgcccgctggccgagcctgttggatcagtaccgcgtgaccgtctggaacaccgtgcccgccctgctcgacctgctgctcgacgccgacgaacaggacggcgcggaaggcagccggatcgcagggcttcggaccgcactggtctccggcgactggatcggcctggacctgcccgcccggcttcgggcccggaccgcgcggccctgctccttcgtcgccatgggcggagccaccgaagccgccatctggtccaacaccctcaccgtcaccgatctggacgcccagtgggtctccatcccgtacggacgccccctgaccgggcagcactaccgggtggtcgaccgggccggccgggactgtcccgactggacgcccggcgaactgctgatcgggggtgccggactggctcgcggctacctggccgacccggcccgcaccgccgagaagttcgtcgagcaggacgggcgacgctggtaccggacgggtgacctgggccggttccggggtgacggactgctggagttcctcggccggctcgacagccagctgaagatcgcagggcaccgcatcgaggcaggcgagatcgaggccgccctggaagcacacccggccgtcgcgcgggccgccgtcgtggccgtgggggagcgcaccgccaagcgcctggtcgccttcgccgtaccgcaggaccccaccacggtctccacgcccgccaccgagtccgctccttccggtccggtcacacccgccgaggatccggaactcgccgagaggctcttcgtcctgttggcggaacgggtgccggtctacgccgtcccgtcccgcattctcctgctccccacgctgcccctcaccgcgaacggcaaggtcgaccggggagccctggccggcatggcgggcccgcagacggcggccaccggtgccgaaccgccacggggcgagaccgaagaagcccttgccgcgctctggcacgcatacctgccgcaatgggtgccggaccgcgacgtcaacttcttcacggcaggcggcgacagcctcaccgcactgcgcctgctgaccgcgatcgagcgccgtctcggggccaccgtgcccgcccgccgcttcttcgccgcaccgaccatcgccgcgctcgccgcggacgtcacccgaacgctcgcggccgacgcgaccacctatgagaccggagagctgtgaacatcgttgaactgctggcccgatacgccgacgagggcgtggtgctctgggcccaggacggacaactgcggttccgggccccccagggccggctcaccgacacgcaccgcgccgaactgcgcacgcacaaggacgccatcctgcgccacctggaggcaggggagcccacactgcggagcgaccccgacaaccgccacgagccgttccccctgacggacatccaggccgcctacctcatcggccgcaccgacgcctacgcctacggcggcatcggctgccatgcctacgtcgagctgcgctaccccgacctcgacgtggaccgagtgaccgccgcgtggcgcgagttggtccagcgccacgacatgctccgtgccgtggtccatcgcgacggccaccagcgggtcctgcccgaagttcccgccctcgtggtcgggaccgacgacctgagcgcgctcccgtccgacacggccgaggcagagctggaacgcacgcgagcacgtctgtccacccgcgaggcccccaccgaccggtggccgctcttcgccgtgcacgtcacccgtaccgccaggcaggctgtgctccacctctccttcgacatgctcgtcgtcgaccacgccagtctgcgcatcctgctcgccgagttccaggggagctacggcggtgccgccctcgccgacccaccgcggatcaccttccgcgactacgtcctggcccgccgcgccctcgccgacagcgacgcacacacccgcgaccgtgcctactggaccggacgcctcgacacgctgccgcccgcccccgaacttcccctcgccgaacactgggaggcaggtgtgggcgatcacggggggaccggacctacgccggctcccgacggcacggtgacgttccgccgactggagaccctgctgtccgcggccgaccgggaccgtctcaccgggcgggccacgcggcgcggactgacggtgtcgaccgccctgctcaccgcatacgccgagacggtcggcgcatggtcccgcaccacccggttcacgctcaacgtgcccaccgtcgaccggcccgctctgcacgacgacatccaccgcctcatcggcgacttcacctcgctcgaactcctcgccgtcgacctcgacgccccggccaccttcaccgaccggaccagggcggtgggggagcagctcctcgaagacctggcgcatgcgtcgttcaccggctcggaggtgctcgccgaactctcccgccgcgccggctccccggtgctgatgccggtcgtcttcaccagcgccctgggcaccggcgccacctccgagggagtgcctcccggggtgacgtacgccgtgacccggacgccgcaggtatggctcgactgccaggtcatgcagcgcggtgacgcgttgatcctgtcctgggacatccgggaggccgcactcgcccagggagtggccgacgccatgttcgaggcgtacacggcactcgtacggtcgctgtcggccgagggcgaagccggagaggccgcctgggacaccccggcccgcattcctctgcccgaggcgcaggcggcacgccgacgcgcggtcaacgcgaccggggggcccctgccggacgccctgctccacgaacccgtaatcgcccaggcgcgggccacaccggacgcgatcgccgtccggacccccgacctcgctctcacctaccgacagctcgtggcccgcgcgagcactctggctcgtgcactgacggactccgggctccgtccgggggaacccgtggccatctgggccgacaagggctgggagcaggtcgtcgcggtcttcggcactctcatggcgggcggcgcctatctgcccgtcgacaccgctcagccaccggcccgtcgggacacgatcatcgcggacgcgggcgttcgcacggtcctcacccaatcctggctcgccgagatcgacgacctgccggagagcgtcgcggccgtcgccgtcgacctcgtcgtacccgaggccaccgcggccgcgccggacgtgcgtggcacccgatgcgacccggacgacctcgcctacatcatctacacgtcgggttccaccggcacccccaagggcgtgatgatcagtcaccgagccgccctcaacactgtcgaggacatcaaccggcgctacgccgtcaccgggaacgaccgcgtcctcggcatcgcggggctgggcttcgacctgtccgtctacgacctgttcgggccgctcgcggtgggtgccaccctcgtcctgcccgcgtccgaccggcgaggggacccctcccactgggccgaactcgtccgcgaccaccaagtgaccgtgtggaactcggtccccgggcagctccacatgctgtgcgactggctccgctcagagccccccgccggcgacgcctcgctgcggctcgcgctgatatccggtgactggatacccgtctcgctgcccgaccaggcccgtgaactcctcccgggactggacatcatctcgctcggcggagccaccgagggctccatctggtccatcgcccacccgatcgacgaggtggacaccgcccgcccgagcatcccgtacggcaagcccctgaccaaccagaccttcgccgtgctcgaccggcacctgcggccccgccccgaatgggtgccgggcgagctgtacatcggcggcgccggcgtcgccctgggctacttcggagacgaggagcgcacggcacagcggttcctcaccgaccccgccaccggagggcgtctgtaccgcaccggcgacctcgggcggtacctccccgacggaaccatcgagttcctgggccgcgaggacgcccagatcaagatccgcggataccgcgtcgaactcgccgaagttgaggccgccgtacaggcccacccggcggtcgcggcgggcgccgtgatcgtcgatgactccgcggcgggcggacggcgcctcgccgcgttcgtggagacggcccgcaaggacggggatgccggccttcccggagcaccctccggggacggctacgatcccgccgcggcgaccagggcacaggcgcgtacggtggccgccgacgccgtacgtcaagcctcggccgccgtcgacaccgcgcggctcacggacttcctcagcgccctcgacgaggtggccgtcgccgagatgacccgcgtcctcgccgcctccggaacattcgccgacggtgcgtcgcgcacagcggaggaagtgggcacggccctgcgcgccacgccccggcaccggcacatggtgcgccgctggctgcgcgccctggccgtacgcgaccggctcacccaccagagcccggacgacacctacaccggcctggtgcccgtatccgagaccgagaaggagcgccgctggcagcgggccgcggcactggagcacgagatcggctggagcacggagctgctcaccgtcatgcgtacgtgtgccgagcgactgcccgagctgatctccggcgagacggccatccaggaactgctcttccccggagcggccacggatgccgcggatgcggcctaccgcgacaacctcgccgtccggcacctcaaccgcgcggtggtcgccgcactgcgcgagatcgccgccggccacaccggcgaggagcggatgcgcgtcctcgaagtgggcggcggcgtcggaggcaccaccggtgaactcgtgcccgtcctcgccgagttcggcgtggactatctgttcaccgatgcctccgccttcttcctgaacgaagcccgcgagcgcttcgccgaccatgcctgggtccgctaccagcgcttcgacgtcgacgaggacccccgcgcccagcacctgctgcccaacaccttcgacgtcgtgatctgcgccaacacgctccacgccgccgccgacgcggacgccgccgtgggccggctgcgggaactgctggtgccgggcggccagttggtgttcgtggagaacacccgcgaccagaacctccccctgctggtctccatggagttcctggaggtcgccggccggacctggaccgatgtgcgcgagcacaccggacagtccttcctcacccacgcccagtggcgcgaactcctcgacgcacagggggcgtcggaggtcacctcgctgcccgacgcccgggaccccctggccctcaccgggcaggaggtcttcttcgccaccctgaaggacgaccgctgtcacgttcccgcgggtgagcttgcccgcacggcggccacccgacttccggagtacatgcttccgtcggtgtggcaggtcgtcgacgccctgccccggacggccaacggcaagaccgaccgcgcccgcctgcggagctggctgccccgcgaaagcgcaccggtcgtcgtggacgaacagccgaaggacgagttggagaacagcctcgccgacctgtgggcggagctcctcgctgtcgaacatgtcacccgcaacgacgacttcttcgacctcggcggcgactccctcctggtcgcacgcatggtgggccgcttgcgcgaacgcgtaccgcaggcggccgacctggaatgggaggtcgtcctgcgccacatgctgcgccgccccacggtcgccggtctcgccgggttcctgcgcggtctggccgatcccgaggacgcgccctcggcggacgccgtgcgcaccgacccggtgatccacctgcacggcgcccgctccgaggacgagccgacgaccgtcctggtacatgcgggaaccgcgacgatcatgccgtaccgggcgctggtcaccgagatcagacgccgctcaccaggtctcgccgaggtcgtcggcgtggaggtcccggatctgaagggattcctcgccgcgcctcctgagggactcatcgagcagatggcggccgactacgcccgcgccctgacggcggacggccgcagccgcttccacgtcgtcggctactgtctgggcggcctgatcgccaccgaggtggcccgcaacctggccgagtccggggccgaggtggagagcctcaccgtcatcagcagccacagcccccgcttccggctcgacgacgaactcctcgccgagtactccttcgccgtcatgatgggcatcgacccggccgacctcggcttccccgacgaccagtaccgggtcgcagcggccgccgacgccgtccttgccgccagccccggtgtgctgccggacggcggactggccggactgcccgaggagttcgacgacgtggcggcgcgattccgggaactggcggaggtcccccgcgcgacccgcatcgagcggatgtgcgcggcggtccccgcctcggcgggcacctacgaacccgatcacatgacgcggctcttcctcgccttccggcagagcgtcttcgccatcacccgctacgacgccgagccctacgcgggcgacatcaccttcctgcgccacgacggcgcctaccccttccccggcagcaaggacgccgtcaccacctactgggaggaactgacgctgggagacctggacatcgtcgacatcggcggcgaccactacagctgcctgtccgtcgagcacgcgcccggcatcctcaagaccctcggtgagctgacccagggggcgatcacccgatgaacaagccagtgatcggggtcctcggggcctccggtgcggtcggccgggccgccgtacgggagctgcgcaggctcggccacaccgggctccgcctgggagggcggaccgtgtccgccctgagcgcggtcgccgaggaggaccccaccggccacgacgagacggtccgggccgacgccaccgccccggacggtctgcgcgtcttcaccgagggctgcgacatcgtcctcaactgcgtcggacccacttaccggctccgggccacggtggcctccgcggcactcgccgccggtgcccactgcgtcgacgtggccggggacgaccctgccgccgaagacctcctcaaggcaggtgatccggccctcgacggtcgcaccgtcgtcctctccgcgggagccctgcccggtctttcgagcctcctgccgcgctggctggccgggcggggaccgtccggggccgcagcgctgaccgcgtactgcgggggcctggagacctgttcaccgaccgtggcgcacgatctgatgctctccctgacctccggtggcgcggacggtgcggcctacggcgaggcgctggcggccgtccgcggcggacggcgcgtgtcacgtgtcctgcgcacggccgaggacaccgaacacgaggcgttccccggccgggtcgcggtgcagccctacctcagcggcgacaacgaacgcctcgccaccgtcctgggcctggaccggctcgactggtacaacgtccaccccggcccggccgtacgcgcgctgctcaacgtcctgccgggacgtctcgcagccggagaagaccccgaccggctcgcggagcggctgatcctggccgccgacctcgacctggccgggcgcaggccctactacgtcatggacttcgcgctttcgggaacggcgtccgcacggccggccaccgcggggctgaccctgcgcgccgccagcagctaccgcctcaccgcggccgtcggcgccctcgcggtggaagcggtagtgcgaggcgaagttccggcgggcgtgcacttcgcctgcgacgtcctggatccggacaccgtggtcacgcacctgcgatcccacggggctgccgacctccggctcaccggcgcggcggccgaagccgaacacgtggaagaaggcgtgctgtgagcgaagcgtcgcccctgcgtgtactggtctgcggtaccaacttcggccgcttctacgccgaggcggtacgtcggcgccccggctacctgctggccggcgtcctgagccggggttcggcagcgtcccgcgcgtacgcccagagcctggatgtcccgttctacacggacgtcgacgaccttccggaggacatcgacgccgcctgcgtcgcggtgagctcctccatatcgggtggcccgggcaccgagctggccagagcactcatggaccggggcatccacgtcctccaggaacaccccgtccacctcaccgagctgacggacaacctcaaacacgcccgcaagcggggggtgcagtaccgcctcaacacccactacccgcatgtcgctcccgtccgcgccttcgtcgaggcagcccgccggctcgtccaacggcagcgaccgctcttcgtggacgtcgccaccccggtccacctgatgcatcccctggtggacatcctcggtcaggcgatgggcgcgctccggccctggcggttcgcggacccggcgccgctgcccgccgatatcggaccgcagccgttccgttccctgcacggcgtgttcgccggcgtacccctcaccctgcgggtgcaccaccagctcgacccgtccgaccgggacaaccacgccctgcactggcatcggatctccgtcggaacagagggcggagtgctcaccctggccgacacccacggtccggtgctgtggagccctcggctgcacatcggccgggacacggaccggcgattcgtcctggacggtccgggaaccgggcgactggggctcggcaccacggccgtggtcggcgccgcggggaccttccgtgcggtcttctccgacctgtggcccgaagcgatcggtacggctctcgacggtctccgcggagcggtcgcccagggtggggacgccttgcgcgcgggccagtacgacctggccgtgtgccgcatctggaccgacctcgcggcacggctgggaccacccgagatcgtccggccggccacaccccggcccctgacggtcagcgacgtcttcccggtgccggggggcttcccaggcgataccacgtcccgctcggaaccgtcctcgcacgtcgcgggtccggcccccgccggtgagccgaccggcttctcgcccgaggcggtttcggtccgtcccgcggacgccgcgccgtactctccgtcggccgagttcttcgacctcttcgccgccgagcacaccgcgacctccagcgttccggcggtcgccgccctcctcgccgaagcggatctgagcgcggggccggtcgtcgacatcggtgcgggcaccggtctggtcaccgaggccgtcgcccgggcccggccggacgcgcagatcatcgcctgtgaaccgtcggtcggcatgcgggccgtgctcaccagccgtgtcttcagtgacgaagacctgcgtacccgggtgaccgtcaccgcggactccgctcccgacctggagcttcccgaccggatcagcgtcgtcctgctgtgcggagtcctcggccacctcgacgccgaagagcgggccaggttgtggcggcggctgcgtcaacggctggcacccggcgggctcgtgatcgtcgaactcatgcagttcgaacgtcccttggcgctacccgagacccggctcgccaccgccacagccggacgccaccgctatgagtggtcgttcggcggagcaccgtcggaggcggaggacggaacgatgcgcctgcattccacctggcgggtctaccgggacggcgccgcccgcgcggaacgcgaagtgcgcgactcctatcgctgggcgcccttcggactgcgagacgtggcggccgaatccggcatgacggcacgcgccctgcccacccgccccggagcac

SEQ ID NO: 2830 - DNA, 31234 bp, Unknown
  Kingdom: Bacteria, Phylum: Actinobacteria, Class: Actinobacteria, Order: Streptomycetales, Family: Streptomycetaceae, Genus: Streptomyces
  misc_feature (30966)..(31011): n is a, c, g, or t
tcaacgcactgcgccggggcgacaaggtcaacgtgatgcgcgcggaccgcagaaccgcggtgttcacggtggatgcggtgaagacgtacacgaaggacaagttccccgacgacaaggtgtacggggagaccgggcggcccgaacttcggctgctgacgtgcggcgggcgtttcgacgaaaaggcaggatactcggcgaatgtggtggtcttcgcccacctcacgtcactgaagaaggcgggctgaacgccgcccccagactcggccggtacctcggggacgaggtaccggccgccctcatgaccgaagcggaggccggctcgcccagaccctcgccggtccagggcccccttttcgggccccggccgcgtgttggtgggcccgcacgaccgtcgagtcgacgcacacgatcgaccggtcgacctccccgtccgcatcggagtgctgctggacgtgcaccaggagccggtcccacgttccgtacgccgaccagcggcggaaccgttcgtagaccgtcttccacggcccgtgccgttccggcaggtcccgccaggcctcacccgtcggcagcttccacagggatcccgttgaggacctgccgccggtcccgcaccggacgacccctccgagacggagccggcaacggcccgatcaccgccaacgcctgatccctcacttcaggacgacgcaccacgaacgacctgacggccaaccgtcattacggacacacccagccccaccgcccggcgtgccagcacctccacctggacagtggtcgtagccgacccggctcccgcctcggataccgtgttcctttacggggcgccataacggatgtgacgccccccaccggaggtagtcagcgtatgagttcaaagcgcagcaagaatccagccctgcccgtacttgacgacgcattccgactcgcgtcggtcaaggacgccgaagagtcctcccgtgacttggccgcgcggctggccaccaccgagctgcgccgcgtttcccacccgggccggatcacctgggagcccaccgatcaggccgagcccgtaccggtcccgccgaccgtggtcgacggtgacggggacctgtggctgcgggaccggggcactggcacctggaccatgcccgagttcgacgcgaaggagttcccggcccgctgcggcgaggttctgacgtggaacgagcttgccgtcgagttcggcccgctgaccgcactggccgacgaccgccgcatcggcggcagacggcgctgactgcgcagcattctgggatgaccgcgcccctgaagcggccgttacgggtagctgggagctccagctcaccgccgagctcgacgatggcggggagcaggtgagcgtggtggtggcgtgcgacggcctcgagcagcgtggtgcgcgcctggcgtcacccgatgccctcggtgccgccgacgtcggtggaccagccgggtatcggtcggccttcagccactgaccgcgctgagcatcaaagccgcggaggcccgtctcccgccccggcgggagacggggcggcgggaagggttacccaggtgggcggcccgcgtcgagcggcatctcgatcttgtcgagggcgcgcacgaccacgtgccgcggatcgaacatgccccccgcccccggcgcgccctgtctgccgaccgggggcagaccagagtgtcggaccgaatgctcggccatgctggaggtacgcccctgcccatggtcatccaccgctcatcggcgaccaaaccgccacgaggccggtccgggaagcctctgggcaccagcttcccctccagacaacgaaggtcctgacctgccgtgaacgggtgtcaggaccttggtgttgccgggctgcgttctctgatggttcgggcggcgcggccggctcgaccatctgccaggaacacctgtgttccgggcggtatcaggcacgagccgtcaggttggccgtcgctgggcggtgcggtggtgttcggcgttgatgcgctgggcttcttcgagctggtcttcgaggatgacgatgcggcaggcggcctcgatgggggtgccctggtcgacgagctcgcgtgcgcgggcagcgatgcgcaactggtagcgggagtaccggcggtggccgccctcggaacgcaggggcgtgatgagtcgtgcttcgccgatcgcccggaggaagccgtgggtggtgccgagcatctcggcggcccggcccatggtgtaggcggggtagtcgtcgtcatcgagacggccgaacgaatcgtttgctctcacttgcacctctctgtggaacacgctggaggggccctggtgccatatggcaccagggccccgaaggaactgctacaccatcagtcggccgtgatcggctgcgccgactctgtgtttccgcatgcccgccccgggagaggtcgggggttgcggggatcgcggctgcttgaccggagaccacctcactatcgatgtcctgcggtacccgggcccacgtcttgcacccgggcgatcctgatggcgaccaactcctccgttcttccctcttgctcaattgcttgcgtactgctggtgatgcgtcctgctcagtgacctgtggcagcgtcactcttcggcagccagccccgtcgcccgtcctgcgtcggctccggctcagaaccccactgccgaacctcccggtgcgcgcgtccgcagccgacgccttcaccgaggtgctgctcctgctccactgctggtgtactgccactacgcgaactgcggtacttctcacggcggcccctgatcactgcgggccacccggtgcggtcgtcagccccgtcgccgtcctgcaacaaccctggcttcgaaactccaccaccgcaccgtccttcgaacggcaactgcgtgtactgctgcccgccagttcgtgtctgccgggccctgctgatctcggctacgagagaaaccataaccacgcccgaaccgaatgtctaccttgcccaagggagatttccacctacccggtagatgaggtaatcgtgtgccgccggggtgtgaggcggtcatgacggggcagaagcggcaaccaggcaacgacgagccgaggggaccagggatgaacacgacgcgcgtcggcgcccgccccgcacccaagctgccaccgacgcgcgcgacagggccgatccttcctcgaagccttccagtcggccgtcactccggaagcggccgacgccatgctcctggtcgtctcggaacccgtttcaccaccgccctgcgggcctcggtcacgcaaaaggttctggacccggccgtggccgccttcaccgtattgcccaggaactccggttcctgggaccgtggtgcgatggtcgatacccattcacgcaggtacctgctactggtccgcaggacgttctggtgcggcgtcctgctcttcggcctcggtctgagtgccggctggtccgccagaagtcaccgggtgacctcgtgggactgcgatccgacgtgccggccctcgcccagcacagcatgggaagccgtcgccgacgcggccctggtatccatcgtgctcgggaccgccctcgccgtcgccgccttcctgatgatcatgctccgccggccgcgctccctgcctgacaaggacaagcgctagcctccgtacagacgtacagacgtacagacgtacagcgttcggcctggcgcagcggtgccacgatctccgggacgccggccggccgtggcgggattcggcgagttcgggcaaggaggcatgggaggccgttccggctcgggagcagtcggcgggacccggccggatccgccggcccggttccatcctcgacgccctctactcgtcaccagacagtgccgcgtcgaccgccgccagggcgtgcagccgagcggtggggaagaccggcaccgggctgtcctcggggccgatcagcagttcgatctccgtgcagcccaggatcaccccctccgcgccgtccgccaccaggccccggatgatctcccggtacgcctcacgggattctgcacgcacctcacccaggcacagttcgccgtagatcacctcgtgcacaagcgcccggcccgccgcgtccggaacgcgtacatccagcccccggtcccgcagtcggccccggtagaagtcctgctccatggtgaacgccgtgccgagcagacccaccttccgcacccccgccgcgcggaccgcgtccgccgtggcgtcagcgaggtgcaccagcggcaccgagaccgccgatgccaccgcgtcggccaccttgtgcatggtgttggtgcagatcagcaccatgtcggccccggcgctctgcaccgcgcgggcagcgtcggccagaacctcaccggcctcctcccagcgctcctccgtctggagccgctcgatctcggcgaagtcgaccgagtagagcacgcacctcgccgagtgcagcccacccagccggttccgggtgtactcgttgatgatccggtaatactccgccgtcgactcccagctcatgccgccgatgagcccgatcgtcctcactgccgcgtccctcctccgaccgtcattccgtcatcgtcccgttcaatcgtgcgttttcccttgacggaacataccgaggcggccaaggctggccctcagcgttgacaacgttgtccatcgcggcttcatcgtacggctgtccccctcggccgtccgacgaccgccgcgagtacccccagaggagaaccaccgtgggcccgaccccccttcccctcggccgccgccgactgctccagatcctcggcgcgtccggagccgtggccgcgctgccgctgagcgcgggctcgccgtcggtggccgcgtctcctcccgcaggggcgggcgggagcggtgccgaggacgacgtcgccgccacgtactaccgggtcctgttgcggcacacccgctggtccgagacgcagtgggacgaggcccagggcatctacaccgacaagttcttcggcttcgcggtggtcctcggccacgccgtgctgctgacacgtggcaactacgacgcagaggtcgcgggggtggaccgggacacgctcaagcgacggactctggcgacactgcggcacttcgcggcctccaaccggctgaccggcggcacgcaatgggggcgcaccctcttcttcgacaccacgttccagtcgtacttcgtgctggccgcccggctgctctgggacgaactggacgcgcggacccgctccctggtggacaccatcgtccgggagcaggcggcgtacacccacgccctgggcaccggggacgacccggcctccgggtcctggacaccgaacgggatgacgggcggacatgtcggcgacaccaagctggaggagatgggcatctacgcccaggccctggcccccgcactggcctgggccccggacgaccgccgacgctccgagtgggcggccgactacggagcctggtcgcgcaacgaggccgggctaccggaggccgacctcgccaacccggcccgcgtggacggcgtgccagtggcccgtaacaccgcccggaacgtctacgacacgttcatcgtcgagaaccacggctccttcggcccgcactaccaggcggagctgtggcggacctcggggcgcaacgcggcgcacttcttggccgccggggagccgctgcccgaggtgctgacccggcagccgaacgccgggccgctgtggcggaccctgctgggcgtgatgtcggacgcgggagaaccgctgatgccgatggtcaacgaccgtgaacacctctacggccgggacgtgatcccgctggcgttcctgtcccgggtgatgggcgaccgcgcggcggcccgcgccgaagtggagctggcggcacggctggaggcgtaccaggcgtacccgccggagcaccggctggcgaagttctccggtgagccgaagtacgagccggaggcccgcgccgagctggccatcagctacctgctgcacgtgtggcccggggcgggccggcccgccgtgccgctgtcgcagcgggagctgttcgcgtacgcctccggagtgacggacttcggggaggggcccggcctggtatcgcaccagtcccccgccgcctgggccggtgcggtgtccaagccgaagttcgtgaagttcgcgtggcagccgggccacgacgactggttgttccggatcagtggcgctacgccgatgtttctgccttcgacggccgtggaggtcaccggccgctcggtgcgcacgcacacccggctgcgtgacggcttcgacgggagcgcgacgctgctgcggctgaaggacggcttcgcgggcttcaccacgctgcccaccggcgcggtggtccacgccgccgacggcccggacaccgtgggcggccggctcgaggtgcacaacctcaccatgccgggcgtggcgggcctggacggcaagcggacgtaccgcttcgccgaggggtcggccacggtcgcgtcccgggactcctcgggtgactcgacgggccgcgtcgacgagctgtcgttcgaccgtacggcggtccgtcacctgcgggtccagggcgtgacgcccgatccggcgtacggctactcgcttttcgccgtggaggcgcgggatggggccgacggacctgacctagcgcgcggcggccgggccaccgcgtcctcctccgcgccgggcaggggaccggagctggccgtggacggggacggcacgacccgctgggcggtatccaccgccgaccggccgcgccctgacagctggctcgccgtggacctcggggagtcccgccccctggaccgggtcaccgtgcgctgggagagcgcggcgggccggagctacctggtgcaggggtcggacgacggcgagcggtggacggacctggcgagcggcccggtcccggcgctgcgcagcaccggtggctggctggacgtggacggccgtgcgggcctgctggtacgcggcgggcgcggtccgctggcggtgtacggggacacgatcgtcctggcggagggtggcggtaggggcccgctgctcgtggaggcccactgcggggtgtccgtcggcggcctgcgtgaactcgcccgccggccggtgcccacggccggggacgagaaggtgcgggcagcggtgacggacggtcacctgagcctgttcaacctgtcggaccgggcggtgagcaccccggtcgtcctggtgcaggagggccgccgccgggaggtctacgagggcgagcaggtggtgacccgggacgggctgcggtacgaggcgcggctggaggcggcctcggcgctgctgctgccgccccggttcaccctggtaccgctgtcgggccgggcgctgccgaacgggctgcgggtggaggtcgtggacgccgccacggtgcgcctgaccggaccggtctgccgggtgcgggtcgaggcacaggggcacagcacggtggccgtggtgcggccgggccggggtacggaggtcacggtgcgcggggcccaggcgtatccgacgacggacctcgccctgggccgggccgtcttcccgaacgcgccgctgccgacggggatgtcggagccgtcggcggccgtcgacggtgagccggacacggtgtggcggccgggacgcgacggccgcctggtcgtggacctcggggcacggcgcgcggtggtccgggtggaggcggagtggtcgaccgggcgacccccgggcctgtccgtggaattcagtgacgacgggatccgctaccgccgggcgggcgcgctcaccggtcatggccgggtgcggagtctgccggccacgggctccccgcgttatgtggcgctgcgggtgtcgggcaccccggaggggcgcggtggtctcgtgcggttgtcggtccgctgacggaccggccccactggcacgccggtcacgtgggtggaccagtgcccttgccacgcggtcctgcacggcgggaagtcgtacggcaggtactgccatggacgggaaagggaccggaagcgccggaaggggaggcccgtcgtcgggacgggggcacgcccggggccgccgccgacccttcgaacctcacgccgggccgggcagtacgcgtccccaccgctcatctccgcccccggtccccggctcccctgcgccggcaggcgctgttcgacaggcaccgtcgcacctcgccccgaggcagtcaggtccgccggtcaaaccaccgatacgtacgcacgggaggcaagtcggcgcaccgcgatgcggacggcgcggtggtggccctgcagcaagcccttccggcttccacacgctcccggcatgagcctgtgcgccgctgcgacagcgttctccccccaccccgaagtgacaccatgtcgggcgtgccctcgggcaggtacaccgcggccaggagttccttacccggggaggcgagggccattggttccggggggacatcgtcggcggccgggccaacgtctggatccacggtgactacctggaggagcacctctgaccgccagcacaaccacatccaacggcccgaaaaggaaggcacctcgtgaacaccaagcgcaccgccgtgacgaccgccgcggtactgacgctgctggggacgctgttctcatcaccggccgtcgccgcgccaccccagggcgacttcaccgccacaggcgtgaagatccgcgccagttacagcactacctcatccgtccggggacacggcaatcccggcgacggatacacctggatgggcgggcagagcaacgcggaagcggttccctgcccggacggcagcgtcaaggaccactggacgtatgtgcacaacaaccgtaccggtgtcgagggctacgtctccgattgcttcatcagggagttctgaccgaagcagctgaacggagcgggagcgagggccgggcgcgcacgcgggtgtgcggctcgcggtcggatcagcggtcgcgaaccttccgctcggggtcggcatcgtcgtcgggttcagctgaacatgctgaggtagtgctgttcgtgggcagggtggtagtcgccgaagtcgatggatgccgggtcgccgccggtctcggcgacgacgagccggtcgaggtagtagtcccagccggggccgactccgcccgccatcgccgggtcgtcgccgacggactgggtaaaggtgagcgtggtggtgccctcgtgctcgacgagcgtgagagtcatgtgccaggcgagttcctggccaggcacctgtgacgtgagaaccagacggtggggggcctggcactcccggatggtgagaagttcggcctggtgctcgtcgccttcgtagagcatccggaagtcgaccgatccggtcgacgggtcgccggtccattcgccgatccatcgggccagacggtccggctcggtgaccgccgcccagacatccctgacgtcggcccggaaggtgcggtcgaaggcgatgctgtccaggccgtcgatgctcacgcgacgcccggtgggggtgctggtcatgcagattcctcctcggagcttgcagtgccgggagcggcgtcggtgccggcccggcggtcgtggacggttctgcggacctcaaggtcgagggcgtcgaaagcactctcggggatcggtgggcggtgcttggcgagatcgtcgagcagggcgtgtaccggggcgaagcccgggcggtcgagcgcgtagtggcgctcgcgtccgcggtcctcgacggtggccagccctgcctcggtgagcagtcgcagatgtttgctcaccgcagggcggctgatcggatggcgtgccgcgaggtcgaccactcgggccgggccggaggcaagggcgcgcagcaggtcacggcgtatggggtcggccagggcgatgaacgggtccacccctcattggtaacccatgggttaccaatgggcaagtcctcgggcagtccaggtagacacagcttgcgcagatgatcgggtccgcgggtcctcgtcgtcgagagtcacgtgcgcggtggagccgtcgacggggccgccgcgcagctccaccgtgctcaaaggttgagaccaggtcgaggttggcgtgacggcggcggtctgccgcacagtggtgcagccaggcgatggctcgttcgacgaccggcggaagacaccccggcccccggctcctcggccgcagcggtgacgtcaacatccagttccgcgaccgcagccgcaacaagcagtagcgggagcgctgcccgacgtcttcggtctcgtcgaccctgcccggccccaccaacgcctgcagcgccggccttcgccggatcaggccggatcgcctggtcgcggccgtctcccggccacctcccgcatcattgcggccagggccaggaagaccgtaaggttctggaccatctctacggggagcctgacccacggctttccgtcgccgcgctgatggatctccaaccagccgtttttcacggtgacccggtcgacctcgcgccagccgagctggtggtcgaggtacccgacaccggcgggatcgatgtgggtcccgaagaagtcgacccgctcgcccgccttcagccgatctctgtcctgcggcagccggacgcgcgtgaatgcctggtccaactcgtcgatgaaccgtgcgccccccttgtacgcgtcggtcaccctgatctcggcgccctcacggggacgcacccagagttcatgtgtggtggcgctgacgatcccgttcgtcaccttggtgctgcgccgccgaatgccgtcgatctcgtcccacgagtacgcctccggcacgtgcccggcgacctcccggacgatgccgtgctggtagtgacctacccagacctgcgcctgccgtctggtgagcgcgaggaagaggaagtacccggctgcggcgaccaaggcggtccctacgatgagcagcggcaggccgtagtaccaggctccctgactctgctgggcctccaccgcggacgagatccccagccagagcacgggcagtccggccagtgtcggcaccagcaccacgagccacgggaagtgcttgggctcggtccacaccagcccccggcgcgacccgagctcgaagtcccgtgcgactctgcgcatggcgggtggaacaggagtggaaccacgatccgacacaagccccccaaggccagacagcgaagggccattgtcagggaaaggagcccgtacgggaagagcaccccggcccgacgcagcggttgtgcggagatcgtatgtagtccatgagcagcaccaggcggactctcacagcgagtttgtgcatccccgcacgggcaatcgtgcgtgttctcacgcgggctggatcgttggatcgatcatgcagatcaaacgggtggcgtggccagtcggcgactctcgctgtcatcagtgccagtcagacgcagccacaacgatcacttcgctccggcctcctcggggtcgggctctgcccgctcgggagcggtgagtcggtgacatcgagtgtggtcgacgcacaggcgatcaacctgcgcgtgatgcgacgtcaggttgacgcggtgctggaggtcttcctggctgagaaggaccggggagcggctggccgggggcatccgccggaggtggtgcagaccctccgcgacttcctggcggcgggtgggaagcggatccgggcgctgctgtgtgtggtgggctggcacaccgctggcggacgcggggatgcgggggcggcagtgcgggtggcggcgtcgctggagctgtttgtggctttcgctctcatccacgacgacatcatggacgactcggccagccgccgcggctggcccgcggtccaccgcgtgatgcgagcccggctgggagctgatgagcgagcagaacggctgggcgcgggtggtgcgctgttggtaggcaatctcgcgttgatgtgggcgcaggagttgttgcacaccgctccgatcgagtccgggcggcagcggttggtgcacgagctgtacgacgcgatgctggaggaggtgatgtacgggcagtacctggacgtcatggggaccggccggggcgccgacgacatcgaggcagccctgcggatcgtccgctacaagaccgccaccgcgacgatcgagcggcccctacagctgggcgccgccgtggccggggccggtgaggccgtgatggagaccttcaccgggttgggtctgccgctgggcgaggcgttccagctgagggatgacctgctggacgtcttcggcagcccggacggcgcgtgtgcaccgggactcggggatctgcgagagggcaaacggaccgtcctgctggccctggggctgcgcttggccgacccggcccagcgggaacggcttgattacctcgtgggccgcgccgacctggaggaacgtcaagcggcggaaatccggagcattctgcaggcaacaggggctcgggaggagaccgaaaggatgatcgcctctcggtacgcgcatgtgctgcgcgtcctggaccgggccggatttccgcccgctgccgatcacgcattgcgtggcctggccgccaaggccacccggtacacctcctgacaccgcggccgagcgctgcgcgcgccggcgtcacttccgtgcggccgcggaccatgccgtccgatccgagcagagagtccaatcgatgaccgagcaggttatgcaccgcgtcgccggatatgagcgccccttcaacacgctcttcgaggagtacttcgacacgttgagcgccagactggacgtgccgtcgttcagccgtttcacccccgactgcctggggttgctgcgggacgtctccctgcgcggcgggaagcggctcagggccgtagtggtgaacgaggcggctcgcctggtgaccgatgagccggtcgaagggctggacgctgctgcgctgagcctcgaactgctccacgtttccggtctggtgcatgacgacgtcatcgacgacgggcctgtccgccggggaggcacgtccacctactacgcctaccgtgagaggttcccccaccatccgcgtacagcggtcggtctcaccgtgctcgcgggtgatctcgcgctcgcgatgtccttgcaggtgctgctggaggcgaaggtacccgcgggggtgcggcaggccatggtcgaggtccagacccgggccgcggccgacactttcatggggcagatcatcgacgtcgaacgggacttcatgaccggcccggacgaggaagtcctgcactgcgtggccgactacaagggcgcacgctactcgatcctggcgcccgtgcagttgggcctgctggccgcaggggaacagccctcccgcttcgagaaggagctgcgggagtacgcgcggctggtcgggatcagcgagacaatgcgcgacgactacctggacctgttcggggaggccgccaccgtgggcaagcagtcgggcaccgacatccgcgacggcaagcgcagctacaccctccacgccctgctggcggccgtcgatggccaggaccgtcgagtggtggaagccgcattcggcgatgcggcctgcacggcggaatccatcgccgccatcagggagatcggcgaacgctgcggcgtagcagcccgcttgcggaccgacatgcgccgctacgcgcagcaggcgtccagcgtggccgctggatggcagcccaggtggcgggaggatgcggtcgccttcttcgagcagctgccgctgtggagcgtcgagcgagccaggtgaccggcgaccgcaccaccgacgtgacctgccgggccggtatgcgtctcgcgcggatcggcgagatcgggcatggcaccgctcaggtgcaggaccgtcccgagcgtcgagttggcgtccgggtgctccgccagttgtccggccctgatcgtggtgagatcaacagggctgggatctgcgaaccggttcgtctgtctcatcccacaagcgggtagatgggtccgctgacgactgcgccggtcagcatcccggcggcgacctggccgacggtgtggcagcgcagccggacgcgggaccagccgatcagcaccaccaggggggccagcaccagcatccaggggccgaagaccgtcatgagaatggtcagggcgctggagccgatggccgagtgcaccgacactttccagaagaacgtgatcgccagcagggcgagcaggacggcgaccatcgctgtcaccagcgccgtcacaacagcgggggcaccccccacgtacagcagcgcggtgccggtgaggaccgaggtcatcacgccgggtgcggcgacgatgcggtcctgcctgcgccgcatgtgccggtcgccccacaaccggcggcgctcaccgaggtgaagaatcagcgtgggccccaccgcggtgaacaccgcggcgaatgctccccagcccaggccggcccagccatcagcgtgccagcccagcagcggggccaggacgagcatccagttccggggctcaccgccgtcactgagcagccacgcccagcgcgcttcaccgcgcggaaccagctcattcgccaccacgtgagcaggtccggcaacgggagagttcggtggagcggttggcgcctgatgggttttcgacactcgggatgtcccgcccctcctcgtggtggtgtcgccgtgcgcggcatccgttcggcgtggaaacgacgcgtacacctgaccggtcacggcaccggcgcggcctggtcggcacccgccggagctgctttccgcgctgtgcgcggctggcggcttcgggcccgggcggtgaaggccatgcccagggcggccatgcccacggcccagcagcaggccggtgatcggcaccgcctgcggctgcggccaccgacgtctgcaccgccgcgtcgggcggaaggaacgcgctgcagcacgtcgaggtgggcgcggttgggcgcggttgcagtcactcgagcagggcgtgcacgacgaccgccgttggggtgtcctcgtcgagggccgcgaattccgctgcgagatcccggcgaggtcccgcgagctgttcccggagggcggccatcgccccgggcgtgaggatgctggagcaggccatcagcagggaccgccggctgtcgggcaggccgtcggcgagcgtcctatattgctgcggcatgtcgagcgcgggcttgcggccgagacgcgggccgcctgctccgctgtcaggaaggaacctcccagtgatcgagatcgacgtcgtcggggcgtttcgttgccgcatacgcatagccaaaaccttcggcctgagggtcggcgctgcagcttgcttcggagtaggccggatagccatatccgtgcaggatgggaaggcgtcgtgagcgtcgcttcgcatacacgccatttccgtctggagaaccgtcatcgttggtgttgccctcaacggtgtaaataaattccgcatcatacgcgacgacgaggccgacatgcatctcctctatcgcacggatgaagacctgtgccccaatggcaggatacgaggagcagcgaccgcactccttgaaccaggagagcgtttcctttggcgaatcagtcagcggggtgagtagccccatgccggctttgtggaatatccagcactgaaacgtctgacaccagctgagcccctgggaccattcaaggccgggcacctctgccgagtatttctgaatattcgtggagcgtccgtcgacgagattttccctgtatcctacctccctcatggcgatggccacggtcgccggagcctctcgcataactttgacctcaatccgcatacggcgattcatcgatattctgagccgaacatggcgacgcctggacccacctcacgctgctatcgccgtatattggatacccgtaaccgaggatgacttcactacgacgatcgcgtctcttccgatatactccgtccccctctcgggatccgttgtcattcgtgttcccttccacagtttcgatgcagtcggcgtcatagtggacgacgagaccgacatgcatgccttcttcagtacggtaaaaggcctgagtgccaactcccggacgcatggagagccggctcctttctatgaaccactgaagggccgtccggcaggatgcagttactggcgccgcctcgggaacacctgctctgtgaaatatccaggactgaaatgtctgacaccaggggagcccctgggaccactcaagccccggcacctcggccgagtacttctgcacgttggtcgagcggccattgattagtttttcccggtagccgatctcatcgaccgccaccgcaaccacctcggatacctgattcacaggattcccttcagtgggcagggtcgaggaagatttttccgatggtgcggcgagcccgcagatcctcatgcgccattcgggccaaggacaggggataggtgcggccgacgagaggattgatcaggcccttgtgtaccagatcagtcaattccttcatcggcacggtgtgcagttcgggccggtccatgcagtgctgtagccagaagccgattaccgccttggaggtggacatcagttttcctggctgaatgggccggggaggcagtcgcgacgccattccataacacacgagccggcccagtggagctaaagcttccagggattcttcgaagacatagccgccggtcatctccaggatcacgtcgatcggtaatcccttgttcgcctgcaccaatcggtcggccaggcccaggtggtctccgtcgaccgccacgtcggcgcccatcttctcggccagcgcgcgcttccgtccgttcgaggcgacagcgatcacacggccggcaccgaagacccgagcgagttggaccgccatcgatcccgttcctccggcggcggcatgcacaacgacggactcgccctcggccatccgcgcggcggtccgaagcaggtgccaagctgtcagcccctgtaccggcagagcaagcgccgaagccccggggacgccgggcggcacctcgtagatgtgccggaccggagcagcgactcgctccgcgtaacctccgctcggcacgatggcaaccacccgccgcccgtcatcggtgcggccgtagacctcggtgcccggcacgtacggcagctcggcttcggtcatgtaggagttgtcggcggtatgggtgtccgcgtagttcactccggccagttcgacctctataagagcgtggcctgcgggaacgaagggctcaggcacttccgccggcaggaggacctcgggtcccccgaagcctgagatctgtatagcctgcacggcttcctccggaatacgtccgctactcggctgccacatggtcgggaaacttctcggccaggtagcgatgcacggctctgaccgacgtgaacgttgcaaggtccgatcgctggagctgaatattcaggtcatgtttctcttcgagcagatgttgcatccacacgaacgtcagcgagtcgacggtgatcgcggaatccggatccacagtggcctcgtcgtcgatgttcaggcactcattgatcatttcattgacatcttccagcgagatcatctgctactccttcgtgatttcctgctgccatgtgatcggatcagcgcagagcccgaacaagggggcaagccaaccaaaacgggcggaagttgcagggtcgatcggtcgctgcgacgagccttctcgaagagctgccgaccgcaccgcgtctcgtcgaagcagcagggcgaccgcggcgtcgccgtccggaaactcagtgccgctcccgttcagctcccgcgcctgggccgtcgcgcacgcgacacgtgcgctcggcgcaagctcggcaccaatgacgatggcgtgctccgcttgctcggtggaaagcaggaactcggccatacgcagcgcatcccctgcgacgtcatcctcggccgagatacaggagagttgaccgtccagcccgtaatgccgagccagcctgctgaggatggatgtgttggcggactggaagaaccagagagcgttgggacgtttgccttcgacctcccgcagcatggggccgtccacggtggccgcgtcgccgaactgcgtggcgagaataatcggcgtacccggggccattgcttgttctcctgcttccactaccgggtccaagcagcggcgcgcggtcgtgtgcaccagtggtgcgaatctggaggagaagaagcccggaacactggccaaggtctcgggggcggcacctggcagtccttcggcggctgccccccacggcgccaggcaggaggaggagaccaccaccgacccgttcagccgtgggagttccgagcccttcttcatatgctcctgccgaagatcagggcggcattggcaccgccgaaggctgcgttccaggacagcgcgtaggcaggtgtagccggtcgggcttcgtgctcgatgcagtccatgacgcagtcggagtcacgctcccggaatccggcggtcgggggaagtagtcctttgaccagtgcaagtacggtgatcacggcctcgacggcgccggtcgcttcgagcaggtgtccggtcatgctcttggtggagctcatgggtggaggcgacgggcactgtgagaacgccgagtgcagggcgagcgattcggctcggtcgttgagttccgtcccggtgccatgagcgttgacgtaaccgatgtcgtgctgccgcagacccgccttgcgaagcgctcgtcgcgctgccgtcgccaagcctgcgcctctcgggtgcggttgcacgtgatggtgggcgtccgacgacagcccccagcctgccaagcgggccagcggtgcggctccccgcccggcggcatgctctgcggactcgagaaccagcacagcggctccgtcgccgagcaacaggccgctgcggtcccgtgagaagggcctgatcacttcgtctgtcgtgagtgcctcaccggagtcgaacttggcgaacagatcctgagtgacgaccgaggcgccaccgcagacaacgctgtggacggaacctgcgcggatgagttccgccccgtaggcgagagcgttggtcgaggctacgcaggcattgcagaacgccaaccggggccgacccagtcggagctcggtcgcgaggcgagcgggtaatcgagccggccaggtgtcttccaagcccgtgctgtcggggagctgcccgtcgcgcagaccctcccagaagcctctgctcgccgcgtggtcgccgttggtacccaggagcacgggggcgtcggcgccgtcgtggcccgccatgtccagcgcttcacgggcgcaggcacgcaagctttccatctgggtggggacggggccgctctcgtatgtggctgcgtgggagccgtgatatgccgagacatcgaagcgccgcaccctggagaaacccgacgtgccggcgaacactgcggccgagagcgccttcgtcccgtacccgaatgcggtgaacgcaccgatcccggtcacaacaacgtcgctcatgccacctcccctgaagtgatcgagtcacgggtgctgcctctcccgggcggagtcgattcaccttgcgtgacaggacctggacggaaagattccacagggaacctcgacagaaaacccttactgcctggtatggccagaatcaacgggacctgacctaaaatcatctccgagaataagccaccttgggaattgcccttgcctcgcaattgatatctgggcatcttgtccatgaccagggctatccccagctgaccatgtcctggttacggggcggctgccccggagaatgttgttggattccggtgtcggcctatcagaggggtcaggtccaggtggctcgatcggtagtcgtgactgggggcagccgaggcatcggccttgctgtggcaaggcaattccagcggagcggagaccgcgtcgcagtgctccatcgcggcaccggccgtgcgccggaggagacactcggaatcacatgcgacgtggcagacagccagcagatttcccaggccttccgcgacgcgaccgagcggcacggtcacgtcgaggtgctcgtcgtgagcgctggcatcgtcgatgaccacctgctgatgggcatgcgggacgagcagttgcacaacgtcatcggaaccaatctctacggcgccttctacgcggcccgatgcgcctacccgtcgatggtcaggatgggccggggccgcatcatcttcatctcttccgtcgctgggctcagtggatcggcgggtcagaccaactacgcggcgagcaaatcggcactggtcgggctcacccgttccctcgcacgggagttgggtcatcggggcgtcacggtcaatgctgtcgcgccggggttgataccgacggacatgacgaaggatctcccccagacacgactcgatgagatcgtcgcggacaccccgttgcggcgcaccggccatccggaggaggtcgcggccgcggtgcagtggctcgcttctcccgaagcgggtttcgtgaccggggccgtgatacccgtggacggcggcctgggtatgggacattgacgggtgcggaaaccacggaaaccagggctcgtccccttgatggtcagcatcttcacggtcgacctgggaacgagcatgaccgctgtcgctcttcctctgctcttgatcagcgattacgggaccaccctggccgcaggcctgaccctggccatcaggctcctgcccagcattgccgccggaccgatcgtaggcaggatcctggccagtcgggacccgcgctacatcgctctgatcagctcgctgctgtcggcactctttgccgcgctcatcccggtctgcgaatctctgtggcagattcaggtcctcacactcggcatcgggctgaccgtcatgctcgcgagccccgcccgcctggttctccggccggcggtggtgagcgagggcgacgagcggaggggcaacggcctgctcatggcggcgcaacgggtctccacgctctccgggccaccgctggtcggcgtcatcgtcgctctcggcctgccgctgggggtcgctttcctcctggaggcggcaacctcgctcgtcgcggcagtcatgatgctccgggtcccgcccctgccgtcggccccgagcgaagaggctccggtcacggacgccaagagccgcagtgtgctcaagagcgcctacatcaccagcacgcggacgctctggagagtcatttcggccgacgctttccttcgcggtgcgacccttacctcgttcagctatctcctggccgtgacgctgggccggatgatgctggtcgtcatgggggcgcagcactactccgacgtctccggcttctacggctggatgctcgccgccatgggcgtgggcggcctgtgcggcagtctgctcatcggacgtttcaagcgaagcagcacgggatctctttacatcgccgtgatgctgatcgaggcggtgggatggctgtccctgccgtggctgccgaacttctccatcgccatgtccgtcatgtgcatcatcgggatcatggagtccgccggctatgtcctttactacgccgaagtccagatccggatcccgcggagcatcatgggctactactacgccgcactcatccccgtgggcgacgccttcatgttcctgggaagcgctttaggcgcgtggctcgcaggtgcgtccattccggctgcggcaatgatcgtggccggagtgatggggattcccatgcttctcaccatccggtggtacttcgaaccgccgggcgacatcagagagattgccgcgagcgtggacatcgcgaagcctgccgaaagaagggaaaggaaatgacggacgagcacacgcccggccatccgcatgcagaccggctcgatgtatgagcacccaagggcgaccaatcccggactggtggggtgcggatctactgcggcgaggacctgacgacgcgacatgggccctggcggaccgctccgtcactcgcggcgaactacgttcacaggtaagcgcgtcggctgcgcgcctggctgcccagggaatcgaggccggctcatccgtcgccatccgcatgcagcccagcctcaccctcctctacaccctgcttgccgcctggacgcgcaacgcgcaggtcatccttctcgatatccggctgaccgactccgaggtcagccggctgctacggctctgcgagccgcagttcctgatccactccgagtgcccgggcggcctgtcctacctgatggaaagcgtgcctttcaccgtcgggcggcgcaccggtggtcgccccgccacagacggcatctgtctcatccaggtgagctccggctcgaccgggacgccgaaagtgatcggacgcaccggctcctccctgctgcgggagctggagcgatacacagcgctggacggcatgccggggccacgcgatcgcgtcgtactgctcaactccgtcatccacaccatggggttggtcggcggaatcctgcatggtctgaactccggcgcgcacatggtctttccttcccgcatgcgggcgggggacatcgttgacgctgtcaggagatcaggggcttcggccatcttcggtgtgccggtgcactttgccctgctcgcacggtttcccggggagagcatgtccggtctgcgtcttgcggtctcggcgggagagctgatgcccggaaaggtctggacgggattccacgagcggtacggcctgccgatcagtcctgtgtacggcaccacggagaccgggctcatagctgcggacctgctgaccggccccctcccaccggccatcgggaggcctgcggccggcatcgaggtgaaggtcgcggcgggtgaactcctggtgcggatggagcgcactccctatctcttgccggaccacgccgaccggttccgcgacggctggctgcatacgttcgaccgctgcgaccaggatgagacgaccgggctcctgacctaccgcgggagagctgactcagtggccacggtcggcgggctcaaggtcgatctgaccgaagtcgagcaggccctcctgctccaccccgccgtacgagaagccgtcgtggtctttggaggcggtctggaggcgcacatcggcggcgacgccacgctcaccgcgacgcaactcaccgactggtgccgttcccggctcgccgactacaagatccccaagatcttccgtctctctgccgaggtcccgcgcaacgccaacggaaagatgatccgcgatcgtgatgttctgaactcacgaaaggatgccggtgcgcacactgatcattgacaactacgactccttcactcacaacctcgcccactacatcagcgcgatgaacggcatcacgcccctcgtgatcaggaacgacgaacctgactgggactcttcggcacttgacggcttcgacaacgtcgtgatctcacctggtcccggcaacccggccgaggccgctgacttcggtatatgcggtgacgtcatccgtgcggcgacggtgcccgtcctgggcgtgtgcctcgggcatcaaggcatatgtcatgcccacggcgccaagatcatccccgcaccggaaatctttcacggccgtgaatcacgcgtggtgcacaagggggatgtgctcttcgctcatgtcccgtcaccattcaaggcggtgcgctaccactccctggtagcgacagacttaccggaggaactggaagccaccgcgtggacagaggatggtgtgctgatgggtgtcaggcaccgggagcggcctctgtggggtgttcagttccaccccgagtcgatcggaaccggccacggtcggcgcatcctgcggaacttcatgggcatcacacgcgccgccgaccgacggcgctcgccgctgccggcgcatcgccacagcgcagagtggcgtatcgacgtacgaaagctccccttcgaggcgcctgtcgaggctacgttcaccacgctgtacggggacgcttcccatgccttctggctcgacagtggagacgcacaaagccagaaggggaggttctccttcatgggggacgcctcgggaccactggcccgcgtcgtcgaggccagggtagacccgagtcaggtcgtggtcacctccgcgggtgccgagaaagtcgtcaccgggtcattcttcgagtggctggaacgtgacatgcgcgcccatcgtgctgacgtcccgccgttgcccttcgacttcgcgctgggctgggtcggctatctcggatacgaactgaaggcggagtgcggcggcgagcctgtgaaccggtcgccgcatcccgacgcgtcgatgatcttccccgaccgtgcgatcgccttcgaccatgagcggcgcgagacctacctcctggctttggtgcgcaatgacgacacgactccttccaccgtgtggttcgacaggactcagggccatctcgaggagctggccgccctgtcgcggccctcctccgcagggctgtccgagccctccagcacgccaggagaggtcggcagctggcggctccggcacgaccgggagcgctacatccggctgatctccgcctgccacacggagctcggagcgggtgaatcgtacgagatctgcctgaccaacatggtcaccggcaggggaaggttccacccgctgcctgcctaccgccggctccgcaaagccaacccggtaccgttcggcgcgctcttgaggctgggagaactctcagtgctcagctcgtcgcccgagcggttcctgcgcgtgggcgcagacggggccgtggagtcgaaacccatcaaggggacccgaccgaggtctccatccccggctgaggacgagcggctacggatcgagctggcgcaagatcccaaggaacgcgccgaaaatctcatgatcgtcgatctggtcagacacgatctcagccagtgcgccgagactgggtccgtctatgtcgaccccctgttcgaggtggagagcttcccgaccgtccaccaactagtgagcaccgtccatgcccagctgaggccggaccgcgacccggtgctctgcgtacgcgcggctttcccgcccggctcgatgaccggcgcaccaaaagtgcgcacgatgcgcatcatcgaccagctcgaacagggaccgcgcggaatctactccggggcgctgggctatttctccctgtccggagccgccgacctcagcgtcgtgatcagaactttgatcatgacgcgggaccggatctcgttcggcaccggcggggccatcaccacgctctcggacgcgcaggccgagttcgaggaaaccagagtgaaggccacccctctccttaccctgttcgggaaagactttcccggggacagcaccgctgcaacgacggggggagagcggtgatccctgaacctgcccgggaactcatccggcgcaccaccgacacctcgtccctgccctcgaccttctcgatgttcggccggtcatggttgctcatcccgggggtcttcgctcccgtctacgacttgtccactgccctcttcaccacctggctgcccttggccgaagagaaggacgtcctggaggtgggatccggcacgggcgtcacttcggtcatggccgcgctgcgaggctgccggcgcgtcaccgccctggacgtcgaacccgccgccgtgagcaacaccgagcagaatgcacaacgccatgacgtgggcaaccgtgtacgtgtcctgcagagcgatctgttcacgcagctcacggaaggcgatctctacgacctcatctactggaactccagctttatcgaggcgcccgtggatacggaacagctcagccctgtcgaaagagcggtggtcgacccgggataccggacacacgagcgcttcctggcggaggcaccccaccacctgaagcccggcggacgcatcttcctggggttcagcaccctgggaaaccgaacccggctggaggaactggccaacgcccacgacgtcaccgtccgcacccaccgcgtttcggagagcacgatatccaatgacgtcagctatcaactcctcgagctaaggaaagggccccacagccatgaggacgaacgcgagtaagagggttgcggacttcgagcgtcacgcagctgatccgaccacccggcggcagaatcacgaactggtggtcaacgagtactacgagctggtcaacgacgcctgccagtccttctggggacccactcaccacttctccctttacacccgggatgcgaccatcgccgaagccgcggagcacaccgagcggctcctcgcagaacgtgccggcttcggccccggcatgcgcctgctcgacatcggttgcggcgtgggcgggccagctttcaccatagccagccactccggcacccacgtcacaggtatcgacatggtgccaagccgggtggaaaccgctcgcgcgggagctgcggagcgccgactcacgtccgtgacgtccttcgaagtcggcgacgcgatgaacctccactacccgtcggcacacttcgacggtgcttacaccatcgaggcgttgtgtcacgtacccgacaaacagcaggcccacagggaagcggcgagggtactgcgccccggggccgcctgggtcggctacgactggatcctgcaggagtccgcgtccccggccgacatcgaacgcttcgcagagcccatctgcagactccacggactctcacacctcagcacgatcgagcacgtcgaacgggacctggaggcagccggcttcaccgtcgaggagctctgtgaagcctccgcgctcggcgatctggaaccgaactgggcccagctggagcacttcaccgaagccgttccccgggaacaactgcctgcccgtctcaaactcctcgtacggggtgcggaagcactcgtggccggagcccgcgcagacgtcttcggcatcgtgttctggctggccaccgcaccccggtaagcagacgaaccgctccgtcacgtacacagacgagccgcgttcgccgaagacccaggtgcatgggtcacgagcatggtcagcgccggtcggggccggggggcggcctgcctgcgccggcccggcgcaaggtcgggggcagccttcctcacgcctcgtcaaaggtctcgagcaggcgctcgtacgccggcttcggccgcagggccccgtcccacggcagggaatcggccgtgcgcggaggatagatcttggtgtcggcggtggatccgtaccggtcggtgaatccccatgtggagaacgatgtgcagttcggctcctccaggcagacccgcagcttgcccgccatctcatcagcctgggtctgccgcccgtcctcctcgtcctcgcctatggggacgtccatctccgacacccgcgcctgaaccccgagctccgccagatcccgcacatggctgcggaaggtctccgggtcgatgcggtcgccgggtgcgtactcatggttctggaaacccacgccgtcgatcggtacgccgcgttccttgagccgcttgatcagatcgtaaagggcgtcccaccgctcgccttcctcctcgaccccgtactcgttgaggaacagccgtgccttcggatcggcccggtgggcggccctgaacgcctcgtcgatgtactcctcacccatggcctcgaaccatgggctctgctgggagcgcagaccgagatccccgttggtgtagctctttccgtcgtcggacatgggctcgttgaccacatcccattccgcgacttttcccttgaagtgcccggcgaccatggcgatgtgccggagcatggtccggcgcacctcctcggggtcgtcgtgctcccgcatccagtcgggcagagcctcgtgccagacgagcgtatgggcgtgcaccttcatgtcgtttgcgcgggcgaagcgtacgagtaggtccgcgtcgcggaagtcgtagacgccccggcgtgcgtggaggaactgtggcttgaacgcgttctccggagtgagcatggagaactggctccccgcgagcgcccggtagcgtgagtcggtgagcagcgggttctcggccagggcggtgccgacatcgaacggccgccccacgtctgcggctcgcgcacgcagcgagtcgtcggactgctcctggcgtagctgcggcgccttgatcacgcggagcgagtcaccgctctccgcgcgcgcggtcagctgcgtcagacgccatccctcgcggcgctcgtcttcgcccgcgtccgcctccagaccgaaccagacagtgccctcggcgaagacccccgggtcctgcacggttcccagccgccgcccgtcggcttctacgcggaatgtgtcaccgatgctcgatacggcgagcgtcaccgtcccggagcagccgcagtcgaaatccttggaggtggccggctcatcgcccccgccgtcccatatctgtaccttcactcgaccgtcggcggtcacgccgacgcggagtgagggccgctcctgccgccactcgtcgtagatgaccgggactcgtccgtacagccgcagccatgaggcgccgtcatcgtcacccacaccggacatgcgcgcggtgacggtgaagtcgccatcggacctgagatgcgggccggccaggttcagcggggggttgggctggccgccggaggagtcctgctccacgatgtaccggtccgatgcgctgacccgcaggatgtcgttccgcgcggtggtgcccggcatctgcgtccagtcgtggttccgcagcaggtcttgttcgtttccgccgcccgcgccttcgccctgccccgtacacccggccgccaccgccatgacgagcaccacggcggtcagtcgctgccacagccccccaccaaggtccacggtttctcccactctcttgttcgagacgagatcaacgtctcgaagccgggccacagttcatcacgcatgaggtacggcggccttgtgtggcacgtcccagctcgtgtggcggagcgggcccggaccgtcgcggcctgcgcgcaaggcgcgtcagacacgcgtgtgccagcgaacctcagggcgtccacggagcgcagtccaagccgtcgccacgctgcacaatcacgccctggccgcatgatccacacgacaccagaaccccgctccaccggcccagcgccgggcttctgcatcacgggactcgtccgaagccggccggcctgaggtcagttcgggctaggaccccagctcagcgcaccctccctcgcgccttcagctgcgtcgcgggcagctccggggccggaatcggagggccgttgtagcccttcacctcgccgaaacgggtgccgttcatccagtcctcccgagcctgcgcgatctcctcgtgggagcgtccgatccagttccagaacatgacgagctcctcctcgaacggttcgccgcccaggagcatcagccctgcgtcggagacaccgcgcagaggcagttcggtgcggccgcaaccgaggtagagcatcgagccgggcagtacgcggacgccgtcgacctcggcctcgcccgacatggacaggaccgcgtactcgaagtcggggtccaggggcaggcgggcctcggcgccaccggccagagtcacgtcggcgccgacgatcggggtgtacgaggtgccgggcgaggccgcaccgtccagttcgcccaggatgacggtggcggtcacgccgggggcggtgacgaccggcaggtccgtgtggtgctggaagtgcggctcgatggagcggtgcgcttccgggagggccacccagagctgtgccccgtgcagcagccgggcatgctccttcgggctctcctcggagtgactgatggcacggcccgaggtcatcaggccaagctcgcgggggcgtaccgtctgcaggctgccgaggctgtcccggtggaggacttccccgtcgtggagccagctgacggtctggaggcccatgtggggatgcggcgggacctgcatgccgggctcgtcggcgatgtcgtcgggtccgtagtggtcgacgaaggcccaggcgcccaccatgcgccgaccgaggttgggcagcaggcggcggacctcggtgccctcgccgagctggacgcggcggggggcgagaagctcacggacgggctcgccgacgacgaagccacgccctccgcagacggagggcgtggcctggcgatcgagattgctcatagctctcaacctattccgtaggggcgtggagcaccgggtcccacgccagacgtttagtggaatgttcaaccattgtgcggtgttgtcatggctgaacgtacggcggggcggtccggagtcggcccgcaccacacgaaggaggacacgtgagcgagaccgagacctactacgagttcggcaccgccgccgaccggtgggaccgggcgcagatgttcttcgaggccaaggagtacctgacggccgcgcggatcctgggcggactcgtcgaggaagcacctgcgcaggtcgcgccgcgcctgctgctggcccgctcctactaccactccgcccggctggggaaggcggagaaggagctccgggccgtcctggagctcgacccggtggagaactacgcgcatctgatgctgggccggacgctggagcgccagggacggagcgccgacgcggcaccgcacctgcggatggccgccgccctcaccggcgacttcggccccggagccgtccgctcctgagccaccccgctccacgggccgggcccgcaccccacacgggtgcgggcccggtctcctttacccgccggcacaggcatcggacaatgggatctccaggacgaaggggtggggagatgcacggattcaggagtgccgcattacgccgggcacggtcggccgcgctcatcgggctggcggtggcggtctcggcgggctgctccggcggcgatgacggaaggaacgggaaggcggcggagcagacccctcgcccgccgggaacccacagctggaccagcagtccgtgcgatctcctcacgggcgcagccccggccgagggcttcaccctcggcagcaccaccgactccgccccctccgacgtccgggaggacatcggcgagaacggtgcgcggccgctctaccagcagaccgggtgcctcgcggacatcaaggccctcgacggcacgttctggaagctcagcaccacggcctcggtctacgaggactccgaaccagcccgtcacgcgtaccgcgtcaaggaggatctcgaccgtgcgcacggtcgnnnnnnnnnnnnnnnnnnnnnnnnnnnnnnnnnnnnnnnnnnnnnngagcaccgaacacgacgtgcagaaggatctccaacacatcgtcgagaacgcggcacgccgcacggaggacggcctgcgcgatcacgacgcctcctccgccgcaccatgaaccctgccccctgctcccctgctccctgcgcttggcgcccgatccctgcaccttgacgcccgacgcgcgacgccccgatgtccgacatcttgacggccgcactgcccggcgggc

SEQ ID NO: 2831 - DNA, 10645 bp, Unknown
  Kingdom: Bacteria, Phylum: Actinobacteria, Class: Actinobacteria, Order: Streptomycetales, Family: Streptomycetaceae, Genus: Streptomyces
gtgtcggcgacggcgtccaggaaagacccgatcagggcctcggggtcggggagccgaggaggctcggaaccggggaccggcgccgcgtgaccctcgggaggcagggcgccggcgaccgcccgcagatgcgcgacgtcctcggcgtccctcggacccgcccgccaggcgtcgtgaccgtccgccgtgagtccggggaggagcctgccgcgggcaacgagctgaaggccgtgcagagcggccgcgccccagcagcgggtggcggggtgggcggatccctgatgacgggcgcggacgagcaggggcagcgcgtcggccacggacaacagcgccgcgggcaccgcgacggcgcggacgctcccggcaccctcagccgggtccttccggacgacggtgagccgggcggtggtgtacgggacggagtcgggacgaccgggggtctccgcgtacccggagggcgtcccgctccgcccccgcgagccgtcgtcgtgccacgggtcggcgttcgcgagcgggtcccagaaggcgatgcggccgtcccggggcaccggaccgggcaggaagaccgcagcgcagcgcagcaggcgaccggcgtcggcggtccgggacgtgtcctcggtgcctcgcggctcgccctctcgggtccgtgccgtcatgcccgccaccccctccccctgcttccgcggtctccgtcggcacggaatgtgctgactccgcgagtctaggcgggaggtctgacactgcggacgcctgccgcatcaccccaggtcagcgctggcgggatcgggcgggcgcatgtcctgctccgcgagtggaccgccacgctcagtgatgggcgaacggctgctccgaggaggacggtgccgccggggacacaggggccgacggtacggccggttcttcggaggcccgcgtttcgggaagcggcgcctccgcctccgggggcggtgatccgttccccgaggacgacgggggctgcgcggtgacgccgttcaccgacgactgccgcccggccgggaccgcgccctccaccgccggctgctgcgcgcgctccaggaaccggagcagttccaccgggaaaggcagcaccagcgtggagttcttctccgccgcgacggcgaccacggtctgcagcagcctcagctggagcgccgcgggctgggcggacatctcgccggccgcctgtgccagcttcttcgaggcctggagctccgcgtcggcgttgatcaccctggcccgccgctcccggtcggcctcggcctggcgggccatggaccgcttcatggtctccggaagcgagacgtccttgatctccacccggtcgatctgcacgccccagctgaccgccggactgtcgatcatgacctccagtccctggttcagcttctcgcggttggacagcaggtcgtccaggtcgctcttgccgatgatcgaccggagcgaggtctgggccatctgcgagacggcgaaccggtagtcctccaccgcgatgacggcgttcgtcgggtcgaccaccttgaagtagatgacggcgtccacgcggacggtgacgttgtcccgggtgatgccgtcctgggcgggcaccggcatggtgacgatctgcatgttgaccttgcgcagccggtcgatccccggcacgaccatcgtgaagcccggcagccgcacgttgtcccgaagcctgccgagccgcagcaccacaccgcgctcgtactgccggatcacccgcgccgccgaggccacgtacagcgctccggcgcagagcaccgccaccaaggcgatcaccagttcctgaaccatgacggccccctgggaggaaggggagcggtcacctgcgtgaccgcggaacaccttctacggcatagcaccttttgcagctttatgccccatttgggggaatggcgaacctccgtcgcaccgcggctcgcccggtcggccgcgcaccggatgccgggccacccccgggcaggcagggtggccagcgccagcacgtcttcccgacgtaccgaatcgccggacgagcaccggacgagcagacgaggacccgcccatgtccgtgaccgccaccgttccccgccgccgacgccggctcgggatcgccgccggagcctcgctcctcgtcctcgccgtctcgggctgttccgggctcggccgcaccgcggtgggtccggtgacgtacacgacggagcgggaagcggtgctgcaggtgaacagcccgtcggtgcgcggctgccaccggatcgccccggcgggagcccacgaggtggagaacgggacgctggtggacgtcatcctgtaccgcacacgtgactgcacgggcggcgggacgacgtacgtaccgaccaggttcagcgatgagacggcgccgggcagcgggccgtggcgcagctacagcttcgtacactgagcgaccgcgacgggcgtggcggagccgaccggccacggcgggtcagagcacgggccgggccagcagccaggtgccgtcgtcggtgaggatgcggtccaacgcgagtccggccgtcgccagatgccgggcgatgtcctcgtcggacagctcccgcgacaggaaggtctgcgtccaccgcgcgtcgtcgaagtgatactccgcgcgcaccgagcgcacgccgtcgcccaccggatccgcggagacgatccggatcagaccgccggacgggtcggtccgctcccagggcagctccgaacggtgggccgctccctcacgctggacgaggacgatcccgtcgtcccgcacatggtcgcggcagacgcgcagcatcccgtcgcgcacccggtgctcgcccgcgtggaccaggaaggagccgagcagcaccacgtcgaaccgctcgccgccgaggtccagcgactcgatggggcttcgcaccccgcgcgccccgacgatctcctccagcatctccggggactcgtccaccgccgtcacgcggaacccgcgccgcaccagcggatgtgtcacccggcccgccccgcagcccagttcgagaatgctcgccccggcgggggccacgctcgcgatcacgtccggctcctcgccgacggacagtctgcgatacagctcgaccgcgcacccgtccggcgtgatggctccgggaccggtcccctcgtacccctcgcgtaccagtgattcgctcatgaaggacgaacgagccgtcgccgagcgaggttccccacccatcacgccgggtcagcgccggagtccacagcgtagcgacgctccccggggcgcgttcccgttcctcccccatgcagccgcgtcctgttccgtatgccgccggacgggtccatgctggtggagtgaggtgatcgccatgcgtaccggcagtgaacccgcgaccgcccgcagtccgctgcggatgcggttctggctgagcctgtggggcatactctggaccctcttcggccttcttgcgttctccctgaccggacggccgggctgggcggcggcctgcgcggtggtgctgctgctcgcgatcctggacctctgcgtgatcacgtaccggatgcgccagggcccgcactaccagccgggccgtgacgtcccgccgtacgagccggaccacggcgacggccgtccacgccggccggggcccggcacggacgaccccgggaagaacggaggatgggcgggcccttcttccggacgctcctagaggtcctccggccgccgacagtccggtcgatcaggcccgctcgtcgaacttcgcggcacggaggtactccggcttcggatcgagcgcagccgccaggcggaagtgccgggtcgcctgctcggggcggcccgcccgctcgaaggtacgggccagcgcgaagtgggcgaacgcgttgtccggctcgcgctccagcaccagctcgaattccagctccgccgggcgcagttgggcggcggcgaagaaggcgcgggcccggagcagccgggcggcggtgttctccggatgcgcggcgatcaccgagtcgaggagcttgacggcaccccgggggtcccgggcgtcgagcagttgctcggccgcacggaagtcgatgacgtgggtctgcggattcctctcgggcacggtcgcgtccttcccttccctcgcgagtttccaacgtccgccccggagccggtattccggcccgggcgtcccgtacgtcggactcagcggacagcggcggccctgcggaccaactcgtcccagacggtgcggacctgtggctccagcgcctccagcggcccgtcgttgtccacgaccaggtcggcgacggcccggcgctggtcgcgggtcgcctgtgcggccatcctggcacgggcgtcggactccgtcattccgcgcaacgtgacgagccgttcgagctgggtctcggcagaggcgtcgacgaccacgaccaggtcgtagagggaggagagcccgttctccgtgaggagggggacgtcgtggacgacgacggcgtcctcgggggcagcccgttccagttcggccgcgcgggcgccgaccagggggtggacgatcgcgttgagcgcggccagccgccctgcgtcggcgaagacgagcgcgccgagcgccggacggtccagggcgccttcggcggtcaggacacccggcccgaactcctcgacgacggccgcgagcccgggagtcccgggctcgacgacctcacgggcgatccggtcggagtcgatcaggacggcgccgtactggacgagcagccgcgacacttcgctcttgccggcgccgatgccgccggtcaggcccactttcagcatgggccgcagcctacgggccgggcggcggcgctcagctctcgccctcccgctcggcgaggaagcgctcgaactcgcggccgatctcgtcggcggacggcaggtcgaccggttcggcgacgaggttgccgcgcgtctcggagccggcgacggcgtcgtactggtgctccaggccctcgacgagggagaccagctcctcgtcgccctggccgatctgccggtcgatctcggtctgcgtgcggtgtgcctcggtgcgcagggagtgcgcgagcgcgggcagcacgagaccggtcgccgcggtgatcgcctccagcgcggtcagcgccgcgtccgggtaggaggacctggcgacgtagtgcgggacgtgggtggcgaccccgaggacgtcgtggccggactccatcagccggtactcgacgagcgcctcggccgaacccggcacctgggcctcgtcgaaggggctgcggtggccgggcatcaggtcggtgcggttgccgtgcggggtgatgccgacggggcgggtgtgcgggacgcccatcgggatgccgtggaagttcaccgcgagccggacgccgaggcgctcgacgatctgctcgacggcggcggcgaaccgctcccactccacgtccggttccgggcccgacagcagcaggaagggcgctccggtggcgtcctggaccacccgcacctccagggccggggtctcgaaggacgtccagcggtcgcgccggaaggtgagcagggggcgccgcgcgcggtagtcgacgagccggtcgtgatcaaagcgtgcgacgacctggtgcggcagcgtttcgagcaggccgtcgacgatctgctcgccggtctcgcccgcgtcgatgtagccgtcgaagtggtagagcatgaccaggccggccgactcctgcgccagcgccatgtcgacgacggccaggcccttcggctcccattcgtacaaactctgcggatcaggcacggttaccgctcctcctcgtgttcctagggaagaacacgaagggcggcacacgcattccccgtacccgggcctttccccggcgagggcgggtcacggcgcgtcagttgcccgtgccgcacgagcggttcggccgctccggcatcacccgccgatcctggtccagaccttgacgcgccacgccgccgtccctaccgtcactgggcaacacgttcagacacacgtctcgaattcatgtacaagaacgatgtgggagcgtaaccgcttcccgcacgagaacatccggactcctccgacgggaaggcacccccatgcgcacccgctcccccctcaccgtcctgctcgccgccaccctggccgccggcggtctcaccctggccggcgccgggaccgcgaacgccgcggtcatcgacgtcagcaccgcggcccagctcaagtcggcgctcaccacggtctcccccggtgacacgatccggctcgccgacggcacgtacaccgggaacttcaaggccacccggcccggctcctccggggcccggatcactctcaccggctccagcagggcagtcctgaccgcgggcggcggctacgggctgcacctgaacggcgcctcgtactggaccgtccagggcgtcacggtcaagggcggccagaagggcatcatgaccgacgcggcgaacggcgtcgtgatcgactcggtgaccgtgcacgacctcgacatggaaggcgtccacttccgcacgtccagcaaggacggcgttctgaagaactcccggatctacgacaccgggcagaacggacgcggcatgggcgagggcgtgtacgtcggttcggccggcggcctctccgaccgcagcgacaacgcgcagatcctgaacaacaccatcggccccgacgtcggcggcgagagcatcgacatcaaggagggcacgaccggcgcgaggatcatcggcaacaccttcgacggcgacgggctgaccggcgccaactacgacgactcctgggtcgacgtgaagggcaacaacgtcctggtcgagggcaacaagggctcgcgcaccaccaacaacggctacgagacccacacccagcagagcggctggggctgcggcaccgtcttccgcgacaacgcctcgaacctctccggggccaccggcgacaagcaactcgccatcaacgtcaccaacaacagctccggttgccgcaccaccgtgtacgcgagcaacaccgtcaccggtggcaaggggctgaccaacatcgccgtcaccccgtaaccggccggccccgcggacgcgagtgaggcccgcccccgaaggggacgggcctcacttaccgctgtacagctaccgcaggcgatgagccgccggggtcagagcgtcagctctggccgcccgcgagcttctcgcgcagcgcggcaagggcctcgtccgacgccagggcgccggagttgtccgccgactccgaggagtaggagccgccgccaccgccaccgctgccgccggaggcggccggagcagcgccggccggggcagcagcgccctcggccgcagcagcctcgtcggcctcgcgggacttgatgacctgggcctggtgctgctcgaagcgctgctgcgcctcggcgtactgggtctcccagacctcgcgctgcgcctcgaagccctcgagccagtcgttggtctcggggtcgaagccctcggggtagatgtagttgccctggtcgtcgtacgacgcggccatgccgtacagcgtcgggtcgaactcgaccgaggccgggtcgccaccgaaggactcgttggcctgcttcagcgagaggctgatgcgacgacgctcgaggtcgatgtcgatgaccttgacgaagatctcgtcgttgacctggacgacctgctccgggatctccacgtggcgctcggccagctcggagatgtggaccagaccctcgatgccctcgtcgacgcgaacgaacgcaccgaagggaacgagcttggtgaccttacccgggacgacctgaccgatctggtgcgtccgggcgaactgctgccacgggtcttcctgcgtcgccttgagcgacagggagacgcgctcgcggtccatgtcgacgtcgagaacctcgacggtgacttcctggccgacctcgacaacctcggaggggtggtcgatgtgcttccaggacagctcggagacgtgcacgagaccgtcgacgccacccaggtccacgaaggcaccgaagttgacgatcgaggagacgacgccggagcggacctgacccttctgcagggtggtgaggaacgtctggcgaacctcggactgggtctgctcgagccaggcacggcgggacaggaccacgttgttgcggttcttgtccagctcgatgatcttggcctcgagctccttgcccacgtagggctggaggtcgcggacgcgacgcatctcgacgagcgacgccgggaggaagccacggaggccgatgtcgaggatgagaccacccttgacgacctcgatgacggtaccggtgacgatgccgtcctcttccttgatcttctcgatggtgccccaagcacgctcgtactgagcgcgcttcttcgagagaatcaggcggccttccttgtcctccttctggagaaccagggcctcgatctcgtcgccgaccttgacgacctcgttcgggtcgacgtcgtgcttgatcgagagctcgcggctcgggatgacaccttcggtcttgtaaccgatgtcaaggaggacttcgtcgcggtcaaccttgacgatgacaccgtcaacgatgtcgccgtcgttgaagtacttgatcgtctcgtcgatcgccgcgaggaacgcgtccgcgtcgccgatgtcgttgaccgcaacctgcggagtggtggcggtggtctcggtgctgctcgtcatgtgggaaagggctccggtacggacagagagtcgtaggtactgctacgccgaaagcccgtatcgcctctgcagaagccggacagcctggaaagcgcgcaatccgtttccggagagacgcctcgacaaccgaggggacatgcaacagacgcgagcgcggcctgctaggtctgaggcgcgcaggctcgcagcgcaacttgtagcatacgggggcagccggacagggtcaatgcgcgaaggcgcacacccggggcagatcgccccgatcccggcacaactcgtgttctccgaggccgcatcggcccgagaacactacggcacggcgccgcggacgcgcgtccgtacccccggggtgcgccccctggtacgtaccgcgcgcggcgggtgaaggcaaactacaacgacgggcacgatgagccaagagatccacgggacctactccgcagaagccgcgggacccccggagccggaagccacgcgccgtgcggcggacgaggcggagagcagccgggccagccgcggctggtgggaccggaacgccgacgagtaccagagcgaccacggcggcttcctgggggacgaccgtttcgtctggggtccggaagggctggacgaggcggacgccggcctgctggggcccaccgcctccctgaagggcctcgacgtcctggagatcggcgccggtgccgcacagtgctcgcgctggctggccgggcagggcgcccgcccggtcgcgctcgacctctcccaccgccagctccagcacgctctgcggatcggcggggacgtcccgctggtcgaggcggacgcgggccggctcccgttccgggacggggccttcgacctggcctgctccgcgtacggggcggtgccgttcgtcgccgacccggtgcgggtcttccgcgaggtccaccgggtgctgcggcccggcgggcgctgggtgttctccgtgacgcacccgatccgctgggcgttcccggacgagccgggaccggaggggctgtccgtcgccgcctcctacttcgatcgcgtcccctacgtcgaacaggacgagggcggtgacgccgtctacgtggaacaccaccgcacgctgggtgaccgggtccgggacgtggtggcgggcggtttccggctggtcgacctggtcgaaccggaatggcccgcctggaacgaccaggagtggggcggctggtccccgctgcgcggcaacctgatcccgggcacggcgatcttcgtctgcgagcggggctgagccgctgaccggccggggcgcgcggaaccctgaggtccctcccgtacgacactgggggcgtgatccgcaccgaagccctggaccgcctgcccgtccgcaccgccgtgcccgccctgcggcgcgcgctcgacgaccggggcgtcgccgtcctgtgcgccccgcccggcaccggaaagacgacgctcgtcccgctggtgctggccgggctgaccggtgagggcccggtgcgccgggtcgtggtcgccgagccgcgccggatcgccgcgcgggcggcggcgcggcggatggcctggctgctgggcgagcagccgggcggccggatcggcttcacggtgcgcggggagcgcgtggtggggcgggacacggtggtggaggtcgtgaccaccggggtgctgctccagcggctccagcgggaccaggagctggccggggtggacgcggtgatcatcgacgagtgccacgagcggcacctggacgccgacacggtcgccgcgttcctcctggacgtacgggaggcgatccggcccgatctgcggctggtggcggcgtccgcgacgacggacgcggagggctgggcgcggctgctcggcgacgcaccggtgatcgaggcgcggggcgtctcgcatccggtggaggtcctctgggcgccgcccgcccgtccggtgaagccgccgcacgggatgcgggtcgacccggcgctgctgacgcatgtggcggcgaccgtgcggcgggcgctcggtgagcgggagggggacgtgctctgcttcctgcccggcgtcggggagat

SEQ ID NO: 2832 - DNA, 6561 bp, Unknown
  Kingdom: Bacteria, Phylum: Actinobacteria, Class: Actinobacteria, Order: Streptomycetales, Family: Streptomycetaceae, Genus: Streptomyces
tggatgtagtcgcggacgcaggtgccgtcgggggtggggtagtcgtcgccgtacacggagatcgactcgcgctgccccagggccacttggaggaccagcgggatgaggtgggactcgggcgtgtggcgttcgccgcaactgccgtaggccccggccacgttgaagtagcgcagcgagactgcggccaggccgtgggcggtggcctcgccgctgatcatgtggtcgacggcgagtttcgacgcgccgtaggggctggtgggtgcggtggggtcggcctccgtgatggggctggagaccggttcaccgtaggtggccgcggtggaggagaagacgagggtgcgtacgccgtgctcgcgcatcgcggcgagcagggcggtggtgccgccgacgttgttgacccagtacttctccgggtcgacgacggattcgccgacctgggagaaggcggcgaagtgcaggactccgtcataggaggggtccaggtggcgggcggcgtcctggatgcggccctcgacgaacgcggctccggccgggacgcccacgcggaagccggtggagaggtcgtcgaggacggtcaccgtgtgcccggcctccagcagatgctgggcgacgacgctcccgacgtaaccggcgccgccggtgaccaggtacttcttcggagggttgctcacgttcggggggttgctcacttgctcgctacctctcgcagtcgctgggccgcggcttccggcggcacgtcgttgatgaacacgctcatgccggactcggaccccgcgaggaacttcagcttgccggaggtccggcgaatggtgaaaagctccagatgcagcgcgaagtcctcccttccggggaccccgaacggcgcctggtgccaggcggagatgtacggcgtcggcggctcgccgggtccgaagatccggtcgaagcgcctcaggagttccagatagacctgtgggaactccgtccgcgcctcctcgtccagttcgcgcaggtccgggacgcggcggcgggggtacaggtggacctcgtagggccagtgcgccgcgtacgggacgaaggcggtccagtggtcggcggcgaggacgacgcgtgacccgtccttctcctcgcgggcgaccacgtcgtcgaagaggttgcggccggtctcctcgcggtggcgggcggccgagcggagcatcagctcggtgcgcggggtgacgaaggggtagccgtagatctggccgtgcgggtggccgagggtgacgccgatctcggcaccccggttctcgaagcagaagacctgggtgacctggtcgagtgcggcgagtccggcggtgcggtcggtccaggcggcgaggacgagggcggcctgttcctcggtgaggtcggcgaaggacgcgtcgtggtcggaggtgaagcagacgacctcgcagcggccggagtcgccggcgagggaggggaagcggttctcgaacacggcgacgtcgtagtcgctgtcggggatctcgccgacgcgtccgtcgcgcgtggggcagagcgggcaggcgtcggccggcgggtggtaggtgcgggcctgacggtgcgaggcgatggcgaccgcgtcgccgagcagcgggtcgcggcggatctcggacgaggtcgagacgggatccagcggtcgatggtcgacggcgtcgcggacggtgtcgtcggcggagtcgtaatagatcagctcacggccgtcggcgagggtcgtaaccgtcttcttcaccagggtcctccaccagatcctcccaacataatcgcacataacaaatcacaagcgaacacctccgtcaatggccgcgacacccgtggacgtccggccacccaaggacgtcatacccggacattcacccgcactcgatcacgatcgaacaaagaaccccaacgagagtgttcatttatcgaacacggaggcgtaagttccgtcgggttcacgttcgcgcaacgaagcgagtaccccccatgcagacactggccgaagggctccggctccccacgaacgggctcgactacgccatcctggcgatctacttcgtcgtcgtactgggcatcggcttcgcggcccgtgccagtgtgaggacgagcctcgacttcttcctctccggacgttcactgcccgcctgggtgaccgggctcgccttcgtcgcggcgaacctgggagccaccgagatcctcggcatggcggccaccggcgcgcagtacggcgtcgcggtggtgcactggtactggatcggcgcgattcccgccatggtcttcctcggcctggtgatgatgccgttctactaccgctccaaggtgcgctccgtgccggagttcctgctccagcggttcgacaggtccgcgcacctgctcagctccgtgctcttcgccttcgcggccatcctcatcgcgggcgtcaacctctacgccctgtcgatcgtcgtggaggcgctcctcggctggccgcagtgggtcgcgatcgtcgtcgcgggcctgttcgtgctggtctacatcacgatcggcgggctctcctcggcgatctacaacgaggtgctccagttcttcgtcatcctcgccgcgctgatccccctcaccgtcctcggcctgaagcgggtcggcggctgggacgccatgagcgactcgctgacgaagcagcacggcggggacttcatgaccgcctggggcggcaccggcatcggtgacgccaacccgctgggcgccaactggctgacgatcgtcctcggcctcggcttcgtgctctccttcggctactggacgacgaacttcgccgaggtgcagcgcgcgctgtccgcgaagaacctctccgccgccaagcgcaccccgctgatcgccgcgttcccgaagatcttcatcgtcttcgcggtgatgatcccgggcctggtcgccgccgtgatcgtgcccaggatcggtacgccgggctccgacctcacctacaacgacgcgatacccctgctgatgcaggaactgctgcccaacggcgtgctcggcatcgcggtgaccggcctgctcgccgcgttcatggcgggcatggcggccaacgtgtcctcgttcaacacggtgttcaccaccgacatctggcagcggtacgtggtgaaggaccggccggacgcctactacctgcgcttcggtcggctgatcaccgcgatcggcgtactggcctcgatcggcacggcgttcatcgccgccagcttctcgaacatcatgagctacctccagacgctgttctcgttcttcaacgtcccgatgttcgtcgtcttcatcatcggcatgttctggaagcgggcctcgatgaagtccggtgtctggggcctggtcgcgggcaccgcggccgcgatgatcaactacttctggatctacaagggcgggatcatcgacatcccgtccgaccagggcgccaacttcgtctccgcgatcgtcggattcgtcgccggagccgtcgtcatggtcgccgtcaccctcttcaccgcgccgaagcccgaagcggaactggccggcctggtctacgggaccgaatcgccggaccccgacgaggcactcgacgaggccgacagcgcctggtaccgcaagcccgcgctgctcggctggggcgcggtcgtcctcgccgccgcctgctacctcccctactcgttctgatcggaggaactcaccatgtccgacctgcacaaggaagtctccgagctggagcgcaagtccgcgaccgcggcccgtctcttcgacatccggcggatcatcggcggcctgttcgtggtctacggagtgatcgtcaccatcgccggcatcagcccgtccgacgccgacctgaagaaggccgagggcgtccacatcaacctgtggacgggcctcgccatgctggcgctcggcctgttcttcctggcctggatgaagctgcgcccggccgaggcgccggctgccccggaaacggacccggagccggggtccgacgcgggctgacccgcccgccgtccgttcgccacggcccgcaggggccgtacgtcacccgcgctgtccggggatgtacggcccctgcggcgtgccgccgttccccgcggcccgctccagcagtcccgtacgggccgcgagggcggccgcctccaggcgggagccgaccccgagtttcatcaggacccgctggacatgggtgcgggcggtgctcggggcgatgtccataccggccgcgatcagccgggtgccctccccctcggcgacccgcaccagcacctccgcctcgcgcggggtgagcatccgcagcagccgccgcccctcgtcgtccggctgggccgtcgggttgagcagttcggcgaaggccccccgcagcagctgcggggcgatggcgctctcccccgcccgcgccttgagcatggcccgctcgacgccctcgatgcgctcgtcgtgccggacgtaccccgtggccccggcggcgaacgccgcggcgatcccgcgcgggctgggcaccggtccgaggaccaccaccgccacctgcgggcgctcctggccgatgcgcacgatcgggtcgaagaccccgggggcggcgggtgacgccgtaccgaacaggcagacctccggagccctgctgaccaccagttccgctgccccggacgtcggtgccgccgccgcgagcacccggtgcccgcgcagtttcagcgccgaggcgagtgcctcggcgagcagccggtgatcatcgaccaccatgagccgcacacccacggtcctcacccctcaaagcccagtgcgcccggccccccggactcctgccccggcaagctacacgcttgttcgacgccgcgcggcccttacgtgggagaagccccccggaatgccgaattctgcgccgtcggtcctcgttgacctgcgttcagggctcgttgaccggcatttcgcgatcacttcaggggcggaaaacgatcggccccgccggtgaggtgatcggccggcggggcctgacgctgcgggacgctccccgaggggggtgcgcggtgatcagtcggtgcggtaggcgacgacgaggtagagcttctcgtcggcgtcgaccgtgctgcgcttgctgaccagccgcttggacttgaagaaccgcccgtccttgtacaggacctcggagtggtcggtggagaagcggcgctccgcctcccgcaccgcctcgtcgctcgggttctccatcagcagggtctgcttgaaggtctcgccgtcgatggagacgatctggccgcccttgtcgtacggaggctccttgtacgcgatgacgttggtgccgtccatccgcagcgggatcaggctgtaccggtcgcccgcgtcggcccggccgccgaggagcttcccggtggtcaggtcgaaggcgacgacctcgttggtctcgccgtactcgctggtgccgtcgtggttctcggtcggcacgtagagccggttgttgccgacggccaggttctggcagcgctcgacctcggtggagccgcagcgggccgcgtactgctcggcgtcggcggggatgcgcacgatcagcttgccggtcgccgcgtcgatcgagaagaagtcggagatgccgctgccgtcgccggcggtgtcgccgacgtcggccgcgaccaccagcggcttggtggagacgatgctcgcgtagtcgacgcccgcgggcatctggtacgaggacagcggcgcgccggtcgtcgggttcagcgcctgcacggtgagctgcgggctgtcggacgtgccgcacttgcggaccacggcgagggcctcgccgcccgcgtaaccgcggtcgtagcagccgtccgcgccgaccttcggcttccacagctcggcgccgtcgtccagcttgaaggcggcgccgcccgacgtgccgcccgcggcgacggtggtcccgctgagcgtgacctcgtcgaagcggatcggcttgtcaccgccggtggcggaggtgacgcccttgctccacaggagcttgccggcggtcatgtcgatcacgccgacctggttgcacgacgggtacttgttcgccttggtcgccttggtctcctcgaagacgatcgccgtcttgaagtccttgctcatgtgccgggaggcggagcagacctcgccgggcagcggaacggaccagagcttggtgcccttgtcgcggtcgtaggcggtgatctcggcgacgccggacttcacgtacgccttgtcggtgacccaggagcccatgaccgtggtgatgtcggtgaccaccggctccgggagctggaaggcgaccttcgacttggtgctggcgggcgccttctcgtcgccgccggccaggccgtcgccctcgccgcccttggcctcaccgccggtggcgccggacgaggaggcctcgttcgtgccgtccttgtcgtcaccggtggcggcgtagatgatcccgccgccgatgatcagcaccacggcgacggccgcggccacgatgatctgcatctgggtggtgaacttcttgccgccgtcgccggccggctgcggggccccgtactgcggctgcatcggctgggtcgggtagccgtaaccctgctggggcatcccgggctggccggcgggtccctgcgggtagccgtaaccctgctg

SEQ ID NO: 2833 - DNA, 8437 bp, Unknown
  Kingdom: Bacteria, Phylum: Actinobacteria, Class: Actinobacteria, Order: Streptomycetales, Family: Streptomycetaceae, Genus: Streptomyces
gcgcctcctgcaccacccggaacgccgtctgctcgacctccggcggatacggccgcagctcaccgtccaccgacagctcgacggtcatccccgcctgccgcgactgcgccaccaacgcctccagctcgtgcagccggggcccgtcctcggaggcggcggtggcggcggccgcgacggccgcccgcctcaccgacgccagcggtaccgcccccgcggcggccgacgcggtcagcgcgtccccggtgcgcagcaccccgagcatctcgcgcagttccgtcagcgcctgccggcccatgtccccgaccagcgccgcgttgcgcacggccttcgccgggtccttcggcgcgacggcctggagggcggcggcgtggaccaccatcaggctcacccggtgggcgaccacgtcgtgcatctcccgggcgatccgggtccgctcctccgtacgcgcccactcggcccgctcctcggcccggtccgcgagcagcgacagctcccgctccagcgaatcggcccgctcccgcaggctctccatcagccggcgtctggcgcctatgtagaggccgaacagcacggacggggccgtgagccccaccgccatgaagacggacatcagcgggacgtaccagtcccccggcccgaagtcggcctgctcggccacgctctgccgcagccgtacgtaggtgacgatgaacgtccccaccagcgccatccccgccaggacgacggtgatccggcgcggcacctcggacgcggccagcgtgtagaggcccacgagggccatcaggaagcccatctcggcgggcgtcatcgcgatcgtcacgagcaccacgacgatcggccaccgtcggcgtaccagcagcaccgaacccgccagcagtccgaacaccacgcccaccggcaccggtatcccggtgttccgggcgaactccaccccctccaggccacactccagcgccgataccagcgccagtcccacgtccagggcgacactgcgtcgccgctcccaccaccagtagccgcgggtggtcgatcccgccgcttcccggtctgcccccgttgcggtcatggcatccagcctacgggcggacgcattcccatttccggtgaccggcaacggcacgtaccgggccaggagtgcggagcttcgtcgtcgcggagaaggtgctccgtacggcatagtgttgggtgccgatccggcggaccgggagaatgtccggttcgatcggaattattcccccatggtgtaatcaggcagcactgcggtttttggtaccgtatgttcaggttcgaatcctgatgggggagcctcggcacacgggccccgaccacaccggtcggggcccgcccccgtttcgtgcggaaacacccccggtatcctgcggatgaccaccacccgaagccgaagggcacatccgtgagcgcaaccagcccggcagccgtcgtcgtcctcgcagcgggtgagggcacccgcatgaagtcgaagacccccaaggttctgcacgagatctccgggcgctcgctcgtcggacatgtcgtcgccgccgcccgtgagctggacccccagcacctcgtcgtggtcgtcggccatgccagcgagcaggtcaccgcgcacctgaacgccggcgacgcccccgtgcgcaccgcgttccaggccgagcagaacgggaccgggcacgccgtccgcatgggtctcgaggagctgggcgggaacgtcgagggcaccgtgatcgtcgtctgcggcgacacccccctgctgtccggcgagacgctcggcgcgctcgccgccacccacgccgccgacgccaacgcggtcaccgtcctgagcgccgaggtccccgactccaccggctacgggcgcatcgtgcgcgaccccgccaccggtgcggtcaccgagatcgtcgagcacaaggacgccaccgacgagcagcgggcgatccgggagatcaactccggggtgttcgcgttcgacggacggctgttgggcgacgcgctgggcaaggtgcgcaccgacaacagccagggcgaggagtacctcaccgacgtgctctccatcctgcgcgaggccgggcaccgggtcggagcgtccgtggcgggcgaccaccgcgagatcctcggcatcaacaaccggctccaactggccgaggcgcgccgactgctgaacgagcggctgctggagcgggcgatgctcgcgggcgtgaccgtggtggacccggcgtccacgctgatcgacgcgacggtgacgtacgagcgggacgcggtcgtgcacccggggacccagctgctggggaccacgcacctcgcggaggacagcgaggtggggcccaactcgcggatcgagaacaccgccgtcggggccggggcccgggtggacaactccgtgacggactcggccgaggtcggggcgggagcactggtcggcccgtacgcctacctgcgcccgggcacgcggctggggacgaaggccaaggccggtacgtacgtggagatgaagaacgcgacgatcggggaagggacgaaggtcccgcacctgagctacgtcggtgacgcgacgatcggcgaccacaccaacatcggtgcggcgagcgtcttcgtgaactacgacggcgtcgccaagcaccacacgacgatcggctcccactgccgtaccggttcggacaatatgtttgtggcgcccgtcacggtcggggacggggtctacaccgccgccgggtcggtcatcaccaaggacgtgcccgccggttcactggccgtggcgcggggccagcagcggaatatcgagggttgggtggcccggaagcggccgggcagcgcggccgcgcaggccgctcaggcgtcgtcgcaggagaccgacgggcaaagctgaccggaaacaggtgcgccggtgacggcgtaccgtgatagatgctcacccatttcggctggctcgttgcacatcgggacctatgcgtgcggcgccagatacacgtctgaggagactgtgctgtgaccgggatcaagacgaccggcgagaagaaactgatgttcttctccggccgcgcccaccccgagctggccgaggaggtcgcccatcagctgggagtcggtctcgtgccgacgaaggcgttcgatttcgccaacggtgagatctatgtgcggttccaggagtcggcacgtggcgcggactgcttcctgatccagagccacacggctccgatcaacaagtggatcatggagcagctgatcatgctggacgcgctgaagcgcgcttcggcccgctccatcacggtgatcgtgccgttctacgggtacgcccgccaggacaagaagcaccgtggccgcgagccgatctcggcccgtctggtggcggacctgatgaagacggcgggcgcggaccggatcctcaccgtcgatctgcacacggaccagatccagggcttcttcgacggcccggtggaccacctgttcgcgctgccgatcctggcggactacgtgggcgcgaaggtcgaccgttccaagctgacgatcgtgtcgccggacgcgggccgcgtgcgggtcgccgaccgctggtgcgaccggctggacgcaccgctggcgatcgtgcacaagcgccgcgacaaggacgtgccgaaccaggtctccgtccacgaggtcgtgggcaacgtcgagggccgggtctgtgtgctggtcgacgacatgatcgacaccggtggcacgatctgcgccgcggcggacgccctgttcgcacacggtgcggaggacgtcatcgtgacggcgacgcacggggtgctgtcgggtccggcggcggaccggctgaagaactcgaaggtgagcgagttcgtgttcacggacacgctgccgacaccgggtgagctggagctggacaagatcacggtgctctcgatcgcgccgacgatcgcgcgtgcggtgcgtgaggtgttcgaggacggttcggtgacgagcctcttcgaggagcagggctgaccgcctgagggcggccctgtactgatccactttggggtacggcctccccgccgggtagactcagcgagttgctcggcgagggaggccgtacctgtgtgtacggcggtccgttatcgacgcgctcttcgtagcaggcctgtcgtgggccgggtgaccgttcgtgttccgtctcccgacggctcacccacctgacgaggagtgcaatcatggctgagatcaagctcgccaccgaggtccgtaccgagttcggcaagggcgccgcccgccgcgtgcgtcgcgccaaccgcgttcccgcggtcgtctacggccacggcgccgagccggtccacgtcacgctgccgggccacgagcttcagctggcgctgcgtacggccaacgtcctgatcggtctggagatcgacggcaaggacgcgctggtcatcccgaaggccgtgcagcgtcaccccctccgcagcaccatcgagcacgtcgacctgctgaccgtgaagcgcggcgagaaggtcgaggtcgagatcgcggtgcacgccgagggcgacctggcaccgggcgccaacctgctcgagttcgtgctgaacacgctgctcgtcgaggccgaggccacccacatccccgagtccgtgacggtctccgtcgcgggccttgacgccggtgactcgatccaggcgaaggacatcgcgctgccgaagggctccgtgctcgccggtgacgaggacgccatcgtgatccaggtcgtcgccgcgcaggccgaggagccggccgcgggcgagggcgacgaggcctccgaggcctgagccgtaccgctcaccgttccacctgcttgactgacggggtggtggttcccttccgggagccgccgccccgtctgcctgccatccccctgcgtgcgaggagaccgagcgctgatgtccgacgccaccgacccctggctcatcgtgggcctgggcaatcccggtcccgactacgcggcgaaccggcacaacgtcgggttcatggtcgccgatctgctggcgacgcggatcggcgggaagttcaagcgggcgcagaaggcccaggcgcaggtcgtggaggggcggatgggtccgccgggtccggcgagccgccgggtgatcctggtgaagccgatgtcgtacatgaatctgtcgggcgggccggtgacggcgctgcgggacttctacaaggtgccgacggatcacatcgtggcggtccacgacgagctggacgtcgactacgggatgctgcggctgaagctgggcggcggcgacaatgggcacaacggcctgaagtcgatgacgaaggcgatgggtccggactatcaccgggtgcggttcgggatcgggcggccgccgggtcggatgcaggtcgcggacttcgtgctgaaggacttctcgtcgaccgagcgcaaggagctggagttcctggtggaccggtcggcggactcggtggagtgtctgctcgcggagggtctggagcgggcgcagagcgcgtacaactcctgagggccgtaccctgctcggcgcgcttccccgccttgcacaactcctgacattcctggtgctggtggggcgttcttcggccacaggttgaccaggggtgcgggtctggccaaggatcggcccccatgaaacggagctcttcccagcgtgcggcgctcgcgggccgtcgggcggcgatgggactggtcgtcctggtgctgctggtcgcgggtgcgtggtcgtcgtggaacaccgcgcaccacatcgttctggccaagggccgtgatcatggcaccgtgacggtgacggggtgcggcgaggagacgtgcaccggttcgtacgagccggacgcggcgtcgcgggagcgcccgcgggtgagcctggaccggtccgtcgcggcgcggaagggggatcgtttccccgtggtcgtgaagcccggcaccgatgcggtggtccgcacgggggtgccgggctttctgcatgcgtgggtgccgttgggcggggcgatggtgctggccgcgttcgtgatcggcggcggactgcggatgtcgcggacggcgtggggtgccggtacggcgggggcggtcctgctggtggcgacgttcgtcgcgctgtagcaggaccgcccggggtcttcctcgcggtcagccggtgttgcgcaggcctgccgcgacgccgttgacggtgagcagcagggcgcgggcgagcagcgggtcggcttcctcgccgcgtgccgccgcctggcgctggcgggccagcagcgagacctggaggtaggagatcgggtccaggtaggcgtcacggatggcgaaggtctgctggagcaccgggctggtgccgagcagttcggtggagccggtgaccttgaggacttccctgacggtcagcgcgtgctcggcctcgatggcgtcgaagacgtgcttcagctcgtcggggacgagcgtgtcgacgtagtgccgggcgatgcgcaggtcggtcttggcgagcgtcatctccacgttggagaggaagttccggaagaagtgccagtgctcgtgcatctcgtcgaggacggtgtcgagaccggcttcgcgcagggccttgaggccggatccgacgccgtaccagccgggcacgatctgccgcgactgggtccagccgaagacccacgggatggcccgcaggccgtcgagcgagacgcccgagccggggcggcgggagggtcgcgagcccaggtgcaggtcggcgagctggtccaccggggtggaggcgaggaagtacgcgggcaggtcggggtcctcgacgagcttgcggtaggcgccgtgggccgcgtcggagacggtgtccatcgccgcgtcccagcgggcgagggcctcgtcggactggcggggcgcggtgtgcagggcggaggcctggagggtggccgctacggtcagttccaggttctcgcgggcgagggcggggatgaggtacttgtcggagatgacctcgccctgctcggtcaccttgatctcgccctccagcgtgccccagggctgggcgaggatcgcgtcgtgggaggggccgccgccccggccgacggtgccgccgcggccgtggaagaggcgcaggcgtacgccgtagcggtgggcgacgtcgcgcagtcggcgctgggcgcggtggatctcccactgggaggtggtgatgccgccgaacttggaggagtcgctgtagccgagcatgacctcctggacgtcgccgcgcagggagacgaggcgccggtaggaggggtcggcgagcatctcgtcgaggatgacgtcggcggccttgagctcgtcggtggtctccaggagggggacgatgccgatcttggcccagccggcgtggaggtcgacgagtccggcctcgcgggcgaggacggcggcggcgaagacgtcgtcggctccctggcacatcgagatgatgtaggactcgatgacttcggggccgaagcgctcgaaggcctgcttgatggtgtggaagacgccgagggtcttctcgccggccgcgtcgagcggggccggggtgggggccagcggccggcgggagcgcaactccttggcgaggagcttctgccggtagtcgcggggcatgtcggcgtagcgccaggactcctcgccgagccggtcgaagagctggccgagggcgtggtgatgggcgtcggcgtgttcgcgtacgtccatggtggcgagctggagaccgaacgcggcgagcgtacggatggtgcggtccatccggccgtcggcgaagagggcgcccttgtgcgcgcgcagggaggtctggatgagctccaggtcggcgaggagctcggcggtgccgaggtagtcgcagccggggcggtggggggtgccctcggcaaggcgctcgcgggtgttgacgagcttctgccggatgcaggtggccttgagccggtagggctcctcggcgttcagccgcttgtagcgggggctgatgccggggaggcgctccaggtcggcctggagggagctgaggagttcctcggtggctccggcgtagcggatggagttggagaggaggccgcggaggtggtcgatcatctccagggcgtcggtgatgccgtgctcgtgctggaggatcaggacgtcccaggtgacggcgggcgtcacgttggggttgccgtcgcggtcgccgccgatccaggtgccgaaggtgagggggcgggtcccggcgggcagttcgacgccgacgcggtccagctcggcggcgaggtcctccaggacgtctccgacggcgttggcgtggagttcgtcgaggtagtagatggcgttgcgggcctcgtcggcgggctccgggcggactacccggagttcgtcggtctgccagatgaggtcgatgttctcggcgagacggaggtccaggcgacggcggtcggcctcgatggccggggtctccaggagggccgcgatgcggcggagcttgttgaggaccgagcggcgggcggcctcggtggggtgtgcggtgaagacgggccggacgttgaggttctt

SEQ ID NO: 2834 - DNA, 1956 bp, Unknown
  Kingdom: Bacteria, Phylum: Actinobacteria, Class: Actinobacteria, Order: Streptomycetales, Family: Streptomycetaceae, Genus: Streptomyces
ggcgcggggtcagaacttgatgctgctgatcatccccgccacgttggtcgtcagatcggagatggtcggcgcgatggacgagctcgcgatgtagaacccgagcagcatgcagaccaccgcgtgtcctcccttcaacccggacttccggatcagcaggaagacgatgatcgccagcagcactaccgccgaaatcgagagcgccacggcggttcacctccatcagtacggtcgggacaggagcacacgcggagccagcaggttcctacccaccgagcgctacggatcataactatccgtgccaacgcattgatcggggcacagcagcacgaggggcgcacgaaccgtgcggcgcggccgagttcgaggctaagttcggagccatgacctcgcagaagctgtcctttccccgtcagcaagcacggacccagcgcttcactctcggcgcacctcgcgccttcaccgtctcaccggatgagacgcgcgtgatcttcctccggtcgatgtccggaacggaccgcaccacccggctctgggtgctcgacccggcgaccggcgaggagcgcgtcgccgccgatcccgaagtgctgctgggcggttcggcggagaagctgtcggcgcaggagcgggcccggcgcgaacggacccgggagggttcgtcgggcatcgtctcctacgcggtcgacgcggcggcggagttggccgcgttcgccctgtccggaaaggtgtacgtggccgaactgcgggccgggaccgcgcgggcgctgccggtaccgggcccggtgatcgacccccgtccgtcccccgacggccgccacgtcgcgtacgtggccaagggtgcgctgcgggtcgtgggcgcggggggcgagggcgaccgcgcgctggccgagccggagaactcccatgtcacctacggtctggcggagttcatcgcggccgaggagctgcaccgctaccggggtttctggtggtcgccggagtcggaccggctgctggtcgcgcgggtcgacgacagccccgtacagcggtggtacatcgccgatcccgcgcaccccgagcgcaagcccgccgagatcgcgtacccggcggcgggcacgcccaacgccgaggtgcggctcttcgtcatggacctggagggcgaccgccgggaagtggtctgggaccgggccgcgttcccgtacctggcccaggtgcactggtcctccgcgggtgctccgctgctgctggtgcaggcccgggaccagcgcagccagcagtatctggccgtggacacggagaccggtgcgacccggatcgtgcatgtcgacgaggacccggtgtggctggatcttttccccggggtgcccgcgtgggcgccggacgggcggctggtgcggatcgtcgacgagggtggcgcgcgggtgctggcggtcggggaccggctgctcaccgggtcgcagctgcacatccagtcggtgctggacatcggggagtccgacatcctggtctcggcggtggccggtgaggacgcggtcgagccggagatcgggcagatccacgtgtaccgggtgaacgagctgggaatcgagcggatttccgaaggggtgggtgtgcactccgcggtccgctcgggcgatctctcggtcgtggtctcggccgtccccgaggagcccggagccgccgcgtgggtggtgcgggacggcaagcggctgacccggatcccgagtttcgcccaggagccggtgctctccccccgcgtgacgctcaccgaggggggcgcacaccgaattccgtgcgccgtgctgctcccctcggactaccaggaggcggatggtccccttccggtcctgatggatccgtacggcggtccgcacggccgccgggtggtcgccgcccacaacgcgcatctgacctcgcagtggttcgcggaccagggcttcgcggtggtcgtggcggacgggcggaccgccgtacggatcc

SEQ ID NO: 2835 - DNA, 5555 bp, Unknown
  Kingdom: Bacteria, Phylum: Actinobacteria, Class: Actinobacteria, Order: Streptomycetales, Family: Streptomycetaceae, Genus: Streptomyces
gtgcgcgggcctccgaggcgtacctccagcttgcgcggggtggcgtcgggcgactccaggtcctcgaccagccacagttcgcccgcgcactggtagacgacccggtggccgtcgctcgcggcgttgcgggcgtagaaggcgtcgtggtcggtgtggcggcgcaggtcggtgccgtccatcagacaggagtagaggttgccgacgccctcgtggtcggagaggaacgcgatgcggcggccgacgaacatcgggttggcgaggtggccgtcgatgtccgggagcaggcgttcgccgtgcagccacaggcggcccatggctccgccccggtagcgcttccaggccgccggttcgtgcgggggcgtgccggtgagcaacagggtgcggcgctcgccgtcgatgtcggcgaccgcgatgtcggagaccgggccccaggggagcctgccgccgggaccgccgtcggtggggacgctgtaggcccaggagaagtacgagaacggctggttgtgcgaggacacggcgaggatctggcaggcctcgcccggatcggggctccagccgcagacccgggcgtccgtcgagccccagtgggtgagccggcgggcggggccgccgtccaccggggcgaggtggatctcggggtccagggtgcgccaggtcgtgtaggcgatggaggagccgtcgggcgagaagcgcggatggctgacccgggtccggtcgacggtcacccgccaggcccgtccggggcggtgcccggcgggggcgaggggggcgacccagaggtcgtcctcggccgcgaagcacagcaagtcctggtgaaggtgcgggaaacggagatacgcgacgtcgtcactcaccccccaatgttttcggtgcgcggggtccggggcaacttgtggtgcacgacacaagcgaaacgatttcgtttcgctggactgtgcgggtacggttcaggtgtacgaaacagtttcgttcgatgttgagcgggactgctgatcgggactgccgagccggacaccggcaggcaaggcgagcgcgaaggaggtcggcacatggcacgcaccaggctgacccccgagcgcgagggcgagctgtacgaggcggtcctcgacctgctccgcgaggtcggttacgacgccctgaccatggacgccgtcgccgcccgcacccggtcgagcaaggccaccctctaccgccagtggggctccaagcccgagctggtcgcgaaggcgctgcggcacaacaagccggggagccttgcggacatcgacaccggttcgctgcgcggggacttccatgccgcgctgagccggaccgacgactgccagatggagaaggacgccgcgctgatgcggggtctgagccatgccgtccatgagtaccccgagctgctccaggccctgcgcgagctgctgatcgaaccggagatgaccggtctcgaccagttgctgcaacgggcggtggaccggggtgagctgcgcccggacaatccggcgctgaagtacatcccacacatgctggtcggcgcgctggccgcccggcagctgatcgaggaccgtcctgtcgaccaggcgttcctcatcgattacgtggactccgtggttctccccgccctcggtgtctgacgtccccgtcccacccgcacggccctctccccgacgctccacctgacacgccgctctcgtcgtcgggctggttcctcatgcccaatttccactcatacgacctgaccgggagtacgcccccgtggccactttcctctacaagctcggacggctcaccttccgccgccgccgcttcgtcgccctgatctgggtggcgttgctggcggtcgccggaatcggtgcggccaccgcgcccgccgccacctccagctccttctccattcctggtacggaggcgcagcgcgccttcgacctgttggaacagcgcaaccccggcaccagcgccgacggtgccaccgcccgtgtcgtcttcaaggcgcccgagggcgagaaggtgaccgatcccgccaacaagagcgagatcaccggcatcgtcaaggagctgcggtccggctcgaagcagatcgcctcggtcgccgacccgttcgcggcgcgagccgtgagccagaacggttcgacggcgtacatctcggtctcctacaaggtcaattccatggagctgaccgacgcgacccgggactccctggagggcgcgggcaaggaggcgcagaagagcggcatgaaggtggagatcggcggtgacgccctccaggtcatgccgcacaccgggaccgccgagatcatcggtgtcgtcatcgccgccatcgtgctggtcatcaccttcggctcgctggtcgccgccggactgccgctggtgaccgcgctcgtcggagtcggcatcggggtctcgacgatcaccgcgctggccagtgtgctggacctgggttccaccacctcgatcctcgcgatgatgatcggtctcgccgtaggcatcgactacgcgctcttcatcgtctcccgctaccgcgccgaactggccgagggccgggagcacgaggaagccgccgggcgggccgtcggcacggccggatccgcggtcgtcttcgcgggcctgaccgtggtgatcgccctggtgggcctcgccgtcgtcaacatcccgatgctgacgaagatgggcttcgccgccgccggcaccgtggccatcgctgtcctcatcgccctcaccctcgtcccggccgccctcgggttcgcgggcaagcgggtcatgggccgcaaggcgcgcaaggccgccgaggcggcggagaagagccccgaggccaagccgaacatgggtacccgctgggcgcgattcgtgctgcgcaagccggtctgggtcatgctcgtcggcgttctcggcctcggcatcatcgccgtaccggcggcctcgctggagatgggcctgcccgacgacggagcgcagccgaagtcgaccacgcagcgtcaggcgtacgacatgctctcggacggcttcggccccgggttcaacggtccgctgatggtcgtcgtcgacacgaagaacagctccgacggcaaggctgccgccgatcgggtctccgaggagatcgagtccatcggcgtcagcgccgtcatcccgcccgccttcaacaaggccggcgacaccgcgacgatcacggtcattccgaaggaccggccgtcctcccatgccacggaggaggtcgtccactccatccgcgacgcgggtgcggacgtgaagtcggacaccggcgccgaggtgctggtcaccggcgccaccgcgatgaacatcgacttctcgcagaagatgaacgacgcgctgctgccctacctggcactcgtcgtcggcctcgcgttcctgctgctgatgctggtcttccggtcggtcctcgtcccgctgaaggcggccctgggcttcctgctctcggtggtcgcggccctcggcgcggtcgtcgcggtgttccagtggggctggctcggctcgctcttcggcgtcgagcagaccggtccgatcatgagcatgatgccgatcttcatggtgggtgtggtcttcggtctcgcgatggactacgaggtcttcctcgtcacgcggatgcgcgaggcgtacgtccatggcgagagccccgggcaggccatcgtgaccggtttccagcacggcgcacgggtggtcacggccgccgccgtgatcatgatggcggtcttctccggcttcatcggctccagcgagcagatgatcaagatgatcggcttctcgctcgccatcgccgtcttcttcgacgccttcgtggtgcggatggcgatcgtgcccgccgtcctggccctgctcggcaagcgggcctggtggctgccgcgctggctggaccgggcgctgcccaatgtggacgtggagggcgagaagctgcggaagcagctgaccgacgagcccgggtccgagggcggggagagcggcgagcgcgagctcgtacgcgtctgacccgatacccatgggccctgacaggccctccgaactccgggatccgcgtctgagcggagcgcggccccggaagcgccggttacctgtggggacggggaccggggcacagtgaaagcccccgtgcgaacagcacgggggctttcctcttgcggggccgccccccctggccgagggcgagggcgaggccgggcgacgcgcgggctgagcgaggcgcgggctgagcgccgcacgcgatcagtgcgccgccgggtcgcggtggaacagcgacttcgaccagaggtagccgagcgcggtcagagccaggcaccagccgacggcgagccagccgttgtggccgatctcggtgccgaggagcaggccgcgcagggtctcgatggccggggtgaacggctggtactcggcgatcggccggaaccagccgggcatggtgtcggcagggatgaaggcgctggagatgagagggaggaggatcagtggcatggccatgttgccggcggcctcggcgttcggactggccaggcccatgccgaccgcgatccaggtgaacgcgagggcgaacagcgcgagcagcccgaacgccgccagccactccagagcggtggcatcggtggagcggaagccgatggcgacggcgacggcgccgacgaggaccaggctggcgagcacctgcaggacactgccgacgacgtgcccgatgatcacggacccgcggtggatcgccatggtgcggaagcgggcgatgatgccctcggtcatgtccgtggagacggacaccgcagccccgatcacggtggatccgatggtcatcagcaggatgcccgggacgacgtacgcgatgtagtcggagcggtccgcaccgccgatgccggcgctcatcacgtcgccgaagatgtagacgaagagaagcagcatcatgatcggcgtgagcaggaggttcagggtgagggaggggtagcgccgggcgtgcaggaggttgcggcgcagcatcgtggacgagtcgcgcacggcgagggcgagggaactcatcgggcagtctccttgggctggtcgtcgtcgcccgtcagggcgaagaacacgtcgtcgaggtcgggggtgtgcacggtcagctcgtcggcctcgataccggccgagtccaaccggtcgaggacggagcgcagttcgcgctggctgccgtcactggctatccgcagcgcgagggcttcgtcgtcgcgggtgacttcccgcagtgcgtcggcggcgctccggtaggtgtcggggtcggtgaagcggagcttgacgtggccgccggggatcagtcgcttgagttcctcggcgcttccttcggcggcgatcttcccgttgttcaacagggcgatgcggtcggcgagttcgtcggcctcttccaggtactgggtggtgaggaagacggtgacgccgtcggagaccaggttgcggatgatgccccacatggtgtggcgggagcgggggtcgaggccggtggtcggttcgtcgaggaagatgatgcgcggggagccgaccagcgtcatcgcgatgtcgaggcggcgcttcatgccgccggagtaggtggatgcgggcttcttcgcggcgtc

SEQ ID NO: 2836 - DNA, 3544 bp, Unknown
  Kingdom: Bacteria, Phylum: Actinobacteria, Class: Actinobacteria, Order: Streptomycetales, Family: Streptomycetaceae, Genus: Streptomyces
gtgctgctggtcctcgccgggctgggcttcggtctgtcgggcgcggcgtcggcaggggacgggggcctggtcctcgacctggtcggagcggccgtcgcgtacgctcccgccctgtgggtgaccgtcggtgtggccgtcctgctccacggctggttcccgcgtgcgggagcggcggcctggatcgtgcccgtgtacgcgttcctcgtcgggtatttggggccgatcctccaacttccggactggacgaagaacctgtcccccttcggccatgtgccccaactcccggccgcagggatgaactggaccccgctgctcgccctgagcgccgtcgccgccggactgatcctgctggggctgatgggcttccgccgccgggacctggagaccaagtgacgtacgacaagaccctgatgacggatcgttaccatcccgtccacagaaggtgattgatcagtagagccggaatcgccgacgcggccagccaccaccgcgcacctcggcgggggagcaaggccgtcgcgggcagcagccacagcaggaacggctgccagatgcgctcggtctccgccttgctcataccggagaggtccgcggcgagcagagctgccagcgccgccaggacgaggagcgccagcctcccttccggggagaccgccgctgctgagccgccccgcagcgcccgtgcggcgccgatcgcggccaccgcgctccgacgcagtccggcgacggcggcgagcccggacgcgagggtcgcgcaggccaggttggcccagacccagtagccgtacgggcggacacctcccgcgccctggtagtagcgctcgaccaacaggtggtacgcggtccaccagttgaacccggcgagggtgaaggccaccgggaccacgagggcgccgagcaggaacaacggcaccgggcggacggttcgggcgagtaccagtacggccagcaggacggccgccatcagccccagcccgtaactgaggtagcaggtccacccgaacagcatgcccccgcccaccgccgccacggccgggaagcggacccggcgggtggcggccagcgcgagcagcgccaccgaccaggccgtgacagccgcgaaatacccgtcggcggagacgcccgcccagacggctgccggggcgaggacgaggaagggcgcggcacggcgggccaagcgctcgccgaccagtacacgcatggtgatcagggcggccagcgcccccgaactgcccacgacgacgcagaagacggccgcccaggcgccgccgccgagaccgacgcggtccagccacacgaaggtcagcgtcgcgcccggcgggtgcccggcgatatgcgcgggccagttgccgggctcgccgatcacgatgtggttcgtgaagtcgcgcagggtggcgggaatgtcctcgaagcggtcgatgacccgcaggtactcgtgcttcgtggtgaggcgcttcgcgacaccccggtgccagccgtcgatcagcgccatcgagaagacccaggccgtcgacccggcccaggccgccgccagcagcccgcgccagggcagccgggcggcgagcgtcgggccgtgagcgaccaccaggaccgccatgatcagggcggccggagtgccgggacccaggacgcccacgccctgccgggcggtctcgacgagctgagcggtggcccgggcgctcaccatcatcgactggtaccagatgtcgtcgtcgacgatgtagcgctcgcggcggcgctcgtcgcgctcccgccggaccatgccctggctttcgaggaacgcgatcgccttggagatggacgccggactgacctggagacgctgggccagctcgggtgcggtgagactgccggagtcggtgagggtgagacaggacagcacccgggacatcatcaagggcatgcccgacgccatgacgacggtcgtgaacagttcctcgtactcgcgcacggcctcggcgtcgcgcccgtagggctgcgccgaatcctgcggctcccggggggcggcctgcttccgccggtgcgcacggcgttcggtggcacggtgggccagatcggcgcggtaggcggcagggccgccgttgcgcatcacctcacgcgtgatggtcgaggtcggacggtccaggcgcctggcgatctccgcataggcgaggccgtcggccagtcccagcgcgatctgctgacgttcctgctgagtgagcctgcctccaggcatcgcggttctccttcgtggtccacggagcctccactatagcgttcaccctcatcctattgctacgcaacggtagctgacgttgcgttaagcccgatgggtattgcaacgaattcaatgccctgacctgcatacttagggattgtttgcaacgaacctgttgagtgattcataaaggcaacgtagcttttccttcatcggaaacgacgagcgcaaggagagcacgatgcagaagttcgacaccaccgccccggtcaccgccgtcctggacatccccgccgggcgcatccagttcatcgccgccgaccgggccgacaccacggtcgaggtccggcccgccgacgcctccaggagccgggacgtgaaggccgcggagcggatcgaggtcgcctacggcgacggcgtcctgcgcatcgcggcccaggcggccgagaaccggaccctcggcggctccggctccgtcgaagtgaccgtccaactgcccaccggctcccacgtcgaggcgcacacggccgccgccgaactccgcggcgtcggacgcctcggcgatgtcgccttcgacggcgcctaccgccggatcaagatcgacgaggcggcgagcgtccgcctcaccgcgatcgagggcgacgtcgagatcggccgactgggcggtccctcggagatcagcaccacacggggcgacatccggatcgccgaagccgcgcgcggcacggtcgtgctccacacccggtccggcgacatctcggtcaccgccgccgccggcgtctcggccgccctggacgccggcaccgcccacggccgcgtcagcaacgccctcaagaacgacggcaccgccgaactcgacatccgcgccaccacgtcccacggcgacatcgccgcccgcagtctctgaccgaccccacacatcctcggaggagcaacagccatgacccatccggccatcgcggcgaacgggctgcggaagtcctatggagacaaggccgtcctggacggcatcgatctggccgtcccggccggcacggtcttcgccctgctcggccccaacggcgcgggcaagaccaccgtcgtcaagattctctccaccctcatctcccccggcgccggctccggcgagatccgcgtcggcggccacgacctcgccaccgacccgcaggcgatccgcgccgggatcggcgtcaccggacagttctccgccgtcgacggcctgatcaccggagaggagaacatgctcctcatggcggacctccaccacctgtcccggcgcgagggacggcgcgtcgccgccgaactcctggaacggttcgacctggtggacgccgcgaagaagcccgc

SEQ ID NO: 2837 - DNA, 644 bp, Unknown
  Kingdom: Bacteria, Phylum: Actinobacteria, Class: Actinobacteria, Order: Streptomycetales, Family: Streptomycetaceae, Genus: Streptomyces
caggaggccagctggtccggccgggtgcggggaacccagtgcttggccggaagtgagcggcgcaccagcgtggggacccagtcctccagcccgtcgtagagccgctcggagaggaaggagtccccggtcggcgtgatcagctgaacgggtgcgtgagcgtaggcgtccgtgcggggtctgctcagccgggcgcggacgttgtcgcggtagagccaggccccgtgcgccgcgtcgtccggcagggaggcggtggggtagtcgcccgcgggcaccttctccaagcgctccaggatccggggccatcgcttcccgagcgggccgcgccaggcgagctccggcaggaccggcgtgtggagcaggtacacgtaccaggatttcgcgccctggccgagcagttgaccgacccggcgtggggtgggatgggtcatccggcgcttgatccagtgcccgaagtggtccagggacggcccggacatcgaggtgaaggaagcgatcctcccctcggtccggccgaccgtgacgaactcccaggcctggacggacccccagtcgtgaccgaccacatgcaccggccggtccgggctgaccgtgtcgatcacggccaggaagtcatcggtcagcttctccagggtgaagccgccgcg

SEQ ID NO: 2838 - DNA, 10281 bp, Unknown
  Kingdom: Bacteria, Phylum: Actinobacteria, Class: Actinobacteria, Order: Streptomycetales, Family: Streptomycetaceae, Genus: Streptomyces
acaccaaggcgttcacggcgacggccgtgatgcggctggtcgtggacggacgcgtccgactcgaccaccgggccggcgactacgtaccgcagcttgccggacactccgtcaccgtacgccagttgctcaaacagaccagcgggctgccggagtacaccccgctggtcgactggagccggcccggcacgtccgaggactacctggccctcgccctggcggagccgccggtcttcgaaccgggtggcgactggggctactccaacaccaactacctggtgctcggcatggtgatcgaccaggtgacgggggtcggcttccgcacgtacatcgagcgcgaggtcctccggccgctgcggctggccgacacctactggccggcgccgggcgagctggccctgcgcgggccgcatgcccgcaactacggtgtccacccggccgatccggcagcggggcgggtggatgtgacggagctgcccggctacgagttcggcgcttccggggggctcgtctccaccccgggggacctgaacgccttctgggacgggctgttcggcggccggctcctgccggggtgggcggtccgcctgatgacccgggacaccagcgacatcggcggtcgcgacgtctacccggcggggagcaggtacggctacggggtcgcttccgtcccgctcagctgcggcggtgtctactggggtcacggcggtgatctgccgggcggctcggtgggcggtggccgggcctcggggggccgctccaccgtgaccgtgtacaccaccacctggacggccgagggcgagggcctgcgtcacctccagggtgcggtggacgcggccctgtgcaccgggggccgctgagcggtgggtgggtcgccgccgtgtaggggcggctttaccatctgacgccgagccgctgcgggctgcgagaggtcgtcccggtccgccacgcgaccgtgtccatgggggcggccagtcgcaggtccgggaagcgggcggccagacggtgcagggcgagttgtagctccgtgcgggccagccaggcgccgaggcagtagtgggggccggcgccgaaggagagtgtgggggcctccagtggtgcgaacaggtcgtggagggtggcgggcgggaagacctccgggtcgcgattggccatgccgcagtcggcgagcacgatcgcgcccgccgggatcgtcaccccgccgatctcgacgtcctcggcggcgtgacgggtgctgccccggtcgtcgcccagcgggacgaggtggatgaggcggtccacgaggcgtccggcggcctcctcgtcggcgccgaggcggggccagctctcacggcgttcacccaggaggtagagcagcgcgttgccgagcatggtcatcgtgctgtcgtggccgccgacgaccaggccgcacaccaggctgaccaactggacctcgggaacgcccccttcctcgtcggccgccgcgaccaggctgctgatcaggtcctcgcccggcgtccggcgccgctccgtgaggaggtccgcgccgaacgcgctgaactccttgagcaccgatgccacctgttcgccttcgtgggtgccgtcggagaaggcgtgttcgctccagtgccgcatccggccccacgcggactcgtcgaggcccatgaggcggctgatcaccgccaccggcagcggaagggtgaactccgccacgacgtccgccggttgctgtcgcgtctccagccggtcgaggagctcctccactatcgcggcgatccacggccgccagcgggcgacggccctcggggtgaacgcgcgccgcagggtgcggcgcagccgcagatggtcggggccgtcctggttgaacatcaggtcggggtcgttcacgaggtcgggtacgccggagagggagggcgcgtcgggggcgtacagctgcgcccggccgaaccgcgggtcggagagcacctggcggacgtcgtcgtagcggctgaccagccaggcggggtcaccgcccggcagctcggcggggcggggcggcccgggcacctcgaagagcaggcggtgcatcggctccggggctggtcgcgtggggtcggtggtggtcaacgtgcctcctgggcagggccgttggatcggtgggggggagagaacagcggtcagagttcgacgagcaccttgccccggttggccgcccggtcgccgtagaggctgccgtaggcgtcggggatcctgtcgaagccgtggtgcagggtgtggtcgcagacgacctcgccgcgccggacacggccgcccaggtcggtgtggaggtcctgccagttctgttcggtgaaccactccagggagaagatgccgcggacggtggcgcgggggaacatcaggtagggcaggagccgggggccggtttcctcgttgccgacctgggtcgcccactgccagcacaccgccacctggctcccgatgttgagcatggggaacacggcgtcggtgacggcgccgccgaggttgtcgaagtaccggtcgacgccgtcgggggcggcccgggcgagtgcttcccggacggtgtccgcgccgtccccgtggcggtagacgatcacggtgtcgaacccgagcccggtgaggtagtccgccttctccggggacgaggtggtgccgaccacccgggccccggcgagcgcggcgagctggccgacgagggcgcccaccgagccggaggcgccgctgatgacgagggtctctcccgggctgatcgtcatgtacttcgtcagggtcccccaggcggtcatgccggggccgcccatcacactgagggcggtcggcagcgggagggcgtcgtcgtaccaccgggggtcgagcctgcggtacgcggggaagaccatggggaacgtgccggtctgccagagttcgggcacgccggtgctgatcacatgggtgcgccagccgccgaagccctgtacgaggtcgccgacgcggtgggcggcgcgcggtcccgcctccaccacctccatgatcgagtcggcgcccatgtgccggccgatcggggtgtcgagggcgatgccctggaggtaggggtcgacggagacgtacagcgtgcgcaggagcatctcgtcgggggcgagggtcacgtcgacgttctcgacgaccttctcgtagacgcggtccacgtcggggactccctcgacgtgttcgcggaccacccatttcgcgatcttcatggtttcctctccgtcggtggggcgggacggacgggcacggggatgacccggtgggtcggtggcggtgcggtgaggtcgagcgacgcggtgaagggcttgtcgtcgtcgcggcagacgaactgcatgacgtggcgtccggcggcggcggcccggatgaggccgccggtggtggcccagacaccggactggtagaagtcgcgcagtccggggagccccgggccgtgtttcttgatcagctcttcgagcgtctcgccgctctcgacgaagggctgccagccgagcacggtcccgtcgtagttgccggtgtagcggacctgggtgagggggctggagacgtcacggacgacgatcgcgtcccgcagaccggggtagcgctgttccaggaagccgacgagtgtttcgcgggcccgccgtttcgccgcgtagtagccgcgcccgtgccgtacgggcagggtgtgcagctcctggccgccgcgggtgcgggtgatctgttcggggccctcgtccagggcgcgccagggggcgatgtcgcagaagtaggtggcgtagacgacggtggtgccgtccggggacagttcggggtagtggcggctgcggaactggacgttgatgctggggtggcggatgccggtcagttcggcggccgtcgcctcgtcgaggaggtaggtggtgcaggggtcgccctcggggaaggggcgggagaggccgaggaagagcgtgaagtagccggggaagaccatgccgggctcgtggatggtctcggtgtagagcttgcggtagtcctcgcccaggtacttgccctccaggaacttcatggtcgtggtgtagccgtcgcaggccgacacgatgatgtcggcgcgcagctcctggccgtcgctgagccggacgcccaccgcccggtcgtcctcgacgatcaccgtctcgaccttcgtgttgtaggagacctcgccgccgagccggcggtagcgggcctcgatcgactcggcgaggccgagggagccgccctcggggactccggcggagaggttggcgtgcgaggcgagctggaaatggaaggggaggacggggaaggccgggtgcttctcgtagaggatgaagttgaaggcctgccgcaggagggggtccttgaacttcgcggagaagtcgctcatgaggacggtgatcgtggtgcggacggagttgaagtacggcacgaacgaggcgagcatccgccagcgctcccggcgtcccatcagtcccacgggtttgaggaaggggtagaccgcgagcgccttgcggaagctgcgcagttgggcgcagaacttccgtacgaggcgggcgtcggcgggcgagatgtcgatgaggtgggcttcgagccggtccgggtcggagtagaagtggacggcgcggccgtccgtgccgcgcacgatgttgaagacgtcgaagtggcggatctccttgccctggagggcgccgagctccagccagatctggtgcatctcgttgcctgggccactgccgaggagccagctgacgcaggcgtccagggtgaagccgccgcgctcccaggcggtgcagcagccgccggggatctcgtgcatctccaggatgcgggtgcggtagccgttcatctgggcgtagcagccggtggagagcccgccgagaccggccccgatgatgatcatcgtctcccggggccggcgtgcgccgccgggccggggcccgttccttcccccgctcatgagccctcgctctcccgtgcggaccaccggtcgagctggggcaggtgtcccagcttcccggggtgccagggttcggcgcccttgctctcccaggcccggaactccaggcccaggtcgcggcagaggtactggacggcgaagcggccggtggaggcggcgcggatcaggccgcccatgccgacccactgtccggccatggagaagttgctcagtcccggcagccgcatccggtccttgccgacgaggcgcgcggcgacgtcgtcggcttcggagaacgccttccaggcgagaatggagccgccgaggttgccggtgtagcggtgggtcgtggcaggggtggcgacctcgacgatgtcgatgcgctccgcgatgccgggggtgcggcgttccaggaagtcgcggacgaagtgggccacttcgcgcttgcgccggcggtactccttgcggtccctgctgcgcaggtccttccagctggcgtagtcgctgaagtaggtgcagtgcaggacggagtggcccggcggtgcgaagccgccggagtagcgggagcgtgcctgcacgacgaggctgtcctggagagcccccgggaggtgggcggcgtcgtccgcgccgaggaggtgcgtggtgctgtgcgcctcctcgggctccacgtcgccgcgcaggccgacgaaggcggagacgacggcggggaagagggtgccgcgtcggtggaggaggtcggtgtagagcttgtcgatccgggggccggtgtaccggccgcccaggagtccgtagacggtggtgtggccgtcgcaggcggagaccacgtgttcggcgaagtaccgtttcccgttgcggagttcgatgccgatcgcccggttgtcctcgatcaggatccgctcggtgcgggcccggtaggtgaccgttccgcccaggtttcggtagcgctcctcgacggagcgggcgaggccgagcgaaccgccctgcggaaagcccgcgttgccgtgatgggcggccgccatgttgaagaggtacggcagcatcgggaagccctcggggtcctggaagaagatgttgcggaacgccttgcgcagcaacgggtcctggaaccggtcggcgaacacgtgcatcggggtggcggcggttcgccagaacagccggaaggcggggagcaccgtgcgcagggtctgggcccgttcgcgtgcggtccgcagcgcgggcgcggtcaggaacgggtacagctcgatgtcgatgaagcgccgcaggtcccgggtgaaggcccggatgagcggggcgtcggcgggtgagacctgcaggaggtgggcctccaggcggtcggggtcgttgtagaacgtcaccgaccggcccgacgcgtcctcgaccttgttgaacagctcgaagttggtgaccgtctttccgtcgagcgcgccgagttcgctccacacccggtgggcgtcgttgcccggggcggtgccgatgagccattcgatgcagtagtcgaagaggtacccgtcgcgggaccaggcggtgcagcagccgccgggcagcacgtgcttctcgaagatgcgggtcctggctccgctcatctgcgcgtagacgccggtggagaggccggccacccccgcgccgacgacgatgacgcggggcggggtgcccggggtgcgttccctgctggtccagtcggtggagtcgtcatccgccatgggccgcgtctcccctcaggacggaacgcaccagctcggcgttgcggggcaggtgtttggcgtcgagcatgtcggcgtggacgccggagccgcgcagtacggcggtggcgccggtggagctgccgtgccaggtcccgtgctccccggcggcgtagagggcggccttctcctcgtcggtgatcacgctgaccgtcgcggcgaccgtgccggtgttgggggtgcgtccgcagaaggcgaggtattcggcggcgtgggcgagggtctcgtgggcgacggcctcggagccggtgtgcttgcgtacgtggtcggcgagttcgctctcgaaggcggcgatgcccgaggcgtccggttcgtaggcggcgaggatgcggcgggagtcgaggatgacgacgtggtcgacgtggcggccgcgccgctccagctccttggccgtctcgaaggcgaggttgccgccgagggagtagcccaggagcaggtaggggccgtcgggccgggtggcctcgatcaggtcggcgtaccgggtgaccttgtcgtcgccggggaggtagttgaagccggtgacggtgtagtcgggaaggtgtgcggccagaccccggtagacgagcccgtggccaccggcgggcgggaagcagaagagggcgggggcctgtccggcgttgaaggtgaggctgggcagttcgtcggcggtggcgccgaggaggacgtcctccacggtggcggccatgccgtgcagggtggtgacctggtagagcctgctgacggggacgccgacgccgaactcggtgcgcaggtggtggaggagttcgatgagcttgatcgaggtgccgccgagttcgaagaagtcgtcctccaggccgacctgttcgcgtccgagcagggtcttccagtgccgggcgacgccgacttcgtacagcgtcacgggtttctcgtacggccggtccccctcctcggcccgcggggcgggcagggcggccgtgtcgaccttgccgttggccgtcagcggcagggcgggcagctcggtgaagtgggacgggatcatgtacgagggcagcgagcgcgccaggtggcgacgcagggcccggacgtcgagggccgcgccgggtgccggtacgcagtaggcgcagagcgccgcgtctcccccggtgtcggtgcgtacggtgacgacggcccgggcaagcgggggccactgggcgagctgcgcctcgatctcgccgatctcgatgcggtggccgcgcagtttgacctggccgtcggtccggccgagcaggtggacccggccgtgcgcgtcccaacgcgcgatgtcgccggtgcggtagagccgttcgggccgggtgtcggcggcccggccgagcgcccgggtgacgaagcgttcctcggtctgctcggggtctccggcgtagccgagggcgacgccgtcgccgccgatccagagttcgccgggcacgcctggcgggacgggttcgccgtgggcgtcgaggatgtgaagggtgctgttgggcaggggccggccgatcgggaccatcgcacctggctccaggtcgtcgacgggcccctcgaagaacgcgctgtcgatggtggcctcggtgaggccgtaggagttgacgaggcgggtgccgggtccgcagagctcggcaagccggcggtactcccccacgctccaggcgtccgagccgaccaccagcagccgcaggaagtccagccgcagcccttcccggacgcagtggtccatcaggccgcggacgacggcggggacgaactccgcgcagtcgacccgctcctgacgcatggtccggtagagccgggtcgtgtcgaagaggaggtcgcggtcggccaggacgagggtgccgcccgagcacagggcgcgcaccaggtcgccggtgaacacgtcgaaggacggttcggccatctggaggtgcgtccgtacgtcggtctccagccggtactcctggcgccaggcggcgtgggcggaggcgaggttgcggtggctgacgcggaccgccttgggacggccggtggatccggaagtggtgatgacgtacgcgggagagtcggggccggcctctcccgccggtccttccgggtgcggttcggtacgcccgagcgcggcgagggtgagcgtcgggacggtcagggccccggtctgctccgcagtggcggcgtccgcgacgacgacgagtgccgcaccggtggtcgtcacgaggtgggcgagccggtcggcgggctggtcgggcctgagcgggaggtaggcggcgcctgccttgagcacgccgagcagggcgacgatcagctcgggcgacttgtccaggcacagcacgaccaccgagccctcgccgacgccgagcgcccgcaaccgggcggcggtgccggccgcctgccggtccagctccgcgtaggtcagccggtgcgccccgccgcgcgcggtgggcatggtgacggcgacggccgcggggtgctcggcggcgatgcggccgatcagcgtctggaccggggtgaacggctcttccccgggtccggcggacggcagggccgggcggctccactccccgacgagccgctcccgctcccggtcgccgagcatctccagccgggaggcgggctgttcgcccggcgcacgggtcatccggtcgaggagccgggtgtagtgggcggccatgcggcgcatggtctcggggaggaagaggtcggtgttgtacttgaacacacagtggaagcggccctcggcctcgtcctcgtagacggacagcgttatgtcgaactgcccctcttcctccggcagttcgatgtactccagccggtagccgtactgctgggtggccaccttgtgggtgaggaggatgaacatcgcctggaagacggcggagcggctggggtcgtgctggaggcccagctcctcgacgaggaggacgaaggggtactcctggttgtccaggccgccgagcacggtccggcggacctgttgcagcagttcgccgacggtcgggtcctcggacaggtcggcgtgcaggggcagcggattgacgaagtagccgtagacggaggcgaagtcctgccgggtgcgaccggtgaccgggctgccgacgacgatgtggtcctgcccggagtagcggtgcagcaggaggtagtacgcgctcagcagcaccatgaacggcgtgacgccgtgggcgcgggccagggcgtggacgcgggcgctgagggcgtcgtccaggacgaagaactcggaggccccgttgtgggtctggaccgccggacgcggcttgtcgacgggcaggtccaggagcgggacctcggccgacaggtgggtccgccagtagtcgagcatgcccgccgccccgggtccggccaggaaggcgttctgctggttgaggaagtcgaggtagcgggcctcgatcggtgggagccggtgttcctggttgcggcgcaacgcctcgtagacggcgaggagttcctcgatgaaggtgaaggtggagatggcgtcggagacgatgtggtggacggccttcatgatgatccagcggtccggtccccgtttgaagagccggaagcggaccagtgggtcgtgggcgaggtcgtagggcttgcggtactcctggacgatcgtcgcgtggatggactcccagtcctcgccctggacgtcgaagagggcgaggtcggtcgcggggttttcggagacccgctgcacggcctgtccgtcca

SEQ ID NO: 2839 - DNA, 8494 bp, Unknown
  Kingdom: Bacteria, Phylum: Actinobacteria, Class: Actinobacteria, Order: Streptomycetales, Family: Streptomycetaceae, Genus: Streptomyces
cgcctcgacgtccatgtcgatgaactgctcgtacatctcgtaatggacgatgcgcgccacgcccaccacgccggaggagagcacgaacccgcccgcgatcaggccgagcgtccgcgcgtgggccgcaccggcgaccgcgccgacggccgccaccaggagcatcaggatgtgcgtcacggcgaaccagccgggcggtccctcggtcagcggggtggtcaggggttccccgccgatgaaccacgcgggatagagctcggacggatagacgaacggctgccggatctcccaggcggcgaagagcaatccctggaagccgaggagcaggaaggcggccaccccggcgccgcgccccggtccggcagggcgctccgcgccctccggcacgggtcggcggcctgccgcgcccgcgacgatcatggcgatcccggccgccagggcgacgtacgtggtgagcagcgcccggtcgcggaggtcctccggcgccggagcgtcggcgatggtccagacaccgggcagccgcagggcgaaggtcaccacgccggtgacgatcaggaccgaagcggccgaggcggagcggagtgccgccacggcggcggcgacgtaggccggcagcaggacgaggctggtggtcgaggtggtggtccgcgtcgcgtcccggaagtccgcggtgcccgaccagtactcccagaccggccgcagcccgtcggcggcccggatgtcccgcaccagccaggcgatgacgagtagtgccggcaccgcgcacagaacggcgccggtgattcttgctccccgtgtaagtgtcacccggtgatactccattgccccgaacggatgaacaaggccgcgtgggggacaggacgggaccgtacggggcgggccggaagcggcgggcgaccggccggagcgacaagacgacgctccggccggaccacggcacccgcacggccgtacgctgttcagcatggaacgttcgtatatcggtgcggcgacagataagttgcctgcctgttaacgaatctgacgccggttcacgccattccgccctcggtgttccccggcttctcctcgggctccggcccggtgtcccccggcttctcgggccccggctccgtcggcccagggacctccagctcaccctccggcggcaccacccgcttctcctccgcgaagtggcacgcggagtcgtgccgggccggggtgtcgacgagccggaactccgcggggaccgccagcagcgggacctccagtgcgcaccgctcctgcgccttccagcaccgggtgcggaagcggcagcccgaggggatgttggcgggcgaggggacgtcgccgtgcaagatgatccgctcccggtgggcgcgggccgtcggatccggtacggggacggcggagagcagcgcctgggtgtacgggtgggtggggtggtcgtagatctccgcgtcggagccgatctccacgatccggccgaggtacatcacgccgacccggtcggagatgtgccggacgatcgagaggtcgtgcgcgatgaagacgaagctgaggctgaactccgcctggagccggtccagcaggttgacgacctgggcctggacggacacgtcgagcgcggagaccggttcgtcggcgacgatgatctccgggttgagggcgagtccccgggcgatgccgatgcgctggcgctggccgccggagaactggtgcggatagcggttgatgtactccgggttgagcccgacgacgtccaggaggtcctgcaccttctgccgccggctgcccttcggggcgacctcggggtggatctcgtacggttccccgatgatgtcgccgaccgtcatccgcgggttcagcgaggtgtacgggtcctggaacaccatctggatgttgcggcgcaccgccttcagcgcccggccggacagcttcgcgatgtcctcgcccttgtagcggatcgcgccggcggtgggacgttccaggtggacgagcatcttggcgacggtcgacttgccgcagcccgactcccccacgatgcccagcgtctcgcccgcgtacaggtcgaagtcgacgccgtcgaccgccctgaccgcgccgatctgccgcttgaagaggattccctgggtcagcgggtagtgcttggcgaggccgcggacctggaggatcgggtcgccctccgcgtacggagtgacggcgtcctcccgcgccttggacagcagggtggagccggccgcgccaccgccggtccccgcgttctcgtcgcggtcagcgtgcatcgagcgtctccttccagaagtggcaggcgctccggcgctgctcgttcacctcgtagagcggcggcacatcgctgcggcacacgtcctgggccatcgggcagcgggggttgaaggcgcagccgggcggaatgcgggtgaggttgggcggcaggcccttgatcgcgtagagctcccggcccttctggtccaggcgcgggatcgactggaggaggcccttggtgtacgggtgggcgggggccctgtagatgtcgtgcacgggggcggtctcgacgatgcggcccgcgtacatgacggcgatcttgtcggcgacgtcggcgacgacgccgaggtcgtgggtgatcaggatgaggcccatgttcagctcgcgctggagttcggcgaggagttccatgacctgggcctggacggtgacgtcgagggcggtggtcggctcgtcggcgatgatcagggacggctccagggccatcgccatggcgatcatgatgcgctggcgcataccgccggagaactggtgcgggtagttgccgacccgctccttggcggccgggatccggacccggtccatcagctcgaccgacttggccttcgcgtccttgcgggacatgccgcggtgcacgacgaacatctcgccgagctgctggccgacggtgagcaccgggttcagcgaggacagggcgtcctggaagatcatggccatctcctggccgcggatcctgcgccgctcctccggcttgagcttcagcaggtcctggtccttgaagaggatctccccgccggcgatcttcccgggcggcatgtcgaggatccccatgatcgcctgggcggtgacggacttgccggagccggactcgccgaggacggcgagcgtctcgccctcggccaccgagtagttgaccccgttgacggccttggcgacgccttcgcgggtgtggaactccacgtgcagatcgcgcacttcgagcaacatggcaaccggctcctcagcgcagcttggggtcgagggcgtcgcgcaccgcgtcgccgagcatgatgaacgcgagcacggtgaccgccagcgctccggcgggccagagcagcatgtgcggggcgttgcggatgtagttggaggcggcggagatgtcgatgccccaggagacggccgggtccttcaggccgaccccgaggtaggagagggtcgcctccagcgagatgtacgtgccgagcgcgatggtcgccacgacgatgaccggggcgatggcgttcggggtgatgtggcgcagcatcatgcgggagttggaggcgccgagcgcgcgggccgcctggacgtagtcgttctgtttggcggtgatgaccgagccgcgggcgatgcgggcgatctggggccagccgagcaggacgatgaagccgacgacgggccagacggtggagctggtgacgacggagaggaagaccaggccgccgaggacgacggggataccgaagaagacgtcggtgaggcgggagaggatcgagtcccaccagcccccgaagaagcccgcgagtccgccgaacaggctgccgaggatcgcgacgccgagagtggcgcagacgccgacggtcaccgaggtccgggtgccgtacacgacccgggtgtagacgtcgcggccctgcgggtcgaagccgaagggatggccgggctcggagcccttctgcgcgtcgtcgagattggcctggagggggtcgccgctcgcgatgagcgagggccagatggagatgatcaccaggaaggtgatgaccagggcggagatgatgaagaccgggttgcgccgcaggtcgcgccaggcgtccgaccagaggctgcgcggcttgccggccgggcccgtgccgtcggggcccgccgggttcttctccaggctggtgccctcctccagcgcgaggtccatggggccgccggctcccgccggggagatcgctccgtccgatgactgcggctcaggcatagcggatcctcgggtcgagtacggcgtacaggaggtcgacgatcaggttggcggccaggaagacgaggacgaggatcgtgacgaacccgacgacggtctgggagttctggcgcaggatcccctggtagagctggtagccgacgccgtggatgttgaagatccgttcggtgacgatggctccgcccatcagggctcccacgtcggtgccgatgaaggtgacgacggggatcagcgagttgcgcagcaagtgccgtacgacgacccggcggcggggcaggcccttggcgacggcggtgcggacgtagtcggcgcgggcgttctcggcgatcgaggtccgggtgagccgggtgacgtaggcgagcgagaccgaggcgaggaccagtcccgggacgagcagttcgtcgagggtggggtccgcggagaccgagggcttgatgatgccccacttgacacccaggaggagctggagcagcagaccggtgacgaaggtcgggacggcgatgacgaccagggtcaggatgaggacggtggtgtcgacggggcggccgcgccgcaggccggtgacgacgccgaggctgatgccgatgacgacctcgaagacgatcgcgacgacggtgagccggatcgtgatggggaaggccgtggccatcagctcggtgaccttctgaccgttgaacgcggtgccgaagtcgccggtgaacacgttgcccatgtaggtgaggtattgctgccagaccggcttgtcgaggccgaactcggaacgcagttgagcggcggtggccgggtcgcactggcggtcgccgcagaggcccgcgatggggtcgcccatcacgttcaccatgaggaagatcaacagcgtggtgccgaagaagacggggatcatctgcagcagccgccggatcacataacgtcccatgaggggctccgggggtcgggtccagcagttgcgggcgggtggtggtgcgcggacggccggggcgcgtgtcgggcgtcccggccgtgcgcgtctcagcgcgtcacttgacggtgatctcttcgtagaccgggacgctgaacgggttcagcgcgacgttgtccacccggtccgagtagccggcgctgccgttctggtaccagagcgggatgaccggcatttccgtgacgaggatcttctccgcgtcctggaaggtggtgacggccttcgccttgtcgctctcggcgttggccttgtcgatcaggtcgtcgaactcctggttactccactttccgtcgttggacggggcgttggtgtagtagagcggctggaggaagttctggatcagcgggtagtccatctgccagcccgcgcgccaggcgccggtgagcttctgggtggagacctgggcgcggaagtcggcgaaggtgccgacggggccgccgacgcaggccttgttgttgcccatgacgttgttgatgctgttgcagacggcgtcgacccattccttgtgggagccggtgtccgcgttgtacgagatcttcagctggccgccggggatgccgccgccctcgtcgatcagcttcttggccgcggccttgtcgtacgtgcactccttgccgcagagacccttcttgaagccgccgtcgtcgccgaggaccggggaggtccagtcggaggcgggggtgcgggtcttctggaagatctggtcggtgatctgcggccggttgatcgccatggagaggccctggcggaccttgcgggcgtcgtcggtgtcccactccttgtcgtagaaggggaaggccagggtctggatgatgccggcgggggtgttgatgtaccggtcgccgaggtccgcctcgacgttgcggagctgggaggcgggcacgtcgtcgacgaggtcgaggttgcccgaggtcaggtcggtgtaggcggtgttgttgtcggtgaagaccttgaggtcgacgccgccgttcttcgccttgtcgtcgcccgggtagtcgtcccacttgcgcaggttcatcgaggagcccttggcgtacgactcgatggtgtacgggccgttcccgacgggcttggagagccaggcgtcgtggtcgtcgtagaacgccttgggcagggggacgaaggcggagtagccgagggtgtcgggccacagggagaacttctgggtgagcttggcggtgaaggtcaggtcgtcgacgaccttcaggccggacagggtctcggcggaggcggagccggactccgggtggaccttgtcgtagccctcgatgtactggaagaagtaggcgttcttctggttgttcttcagtgcggcgccgtagttccaggcgtcgacgaaggacttggcggtgaccttctcgccgttggagaacgtccagccgtccttgagtttgatcgtgaagttctgggagtccgtcgagtcgatggactcggcgatcatgttcttggcctcgccggtcttcgggtcgtagcggatcagtccgcggaagaccatgtcgaggaccttgccgccctggacctcgttggtgttggcgggttccagcgggttctgcgggtctccccaggaggagctgacgatgccgtcggagccgctgctgccgccgtcgtcaccgccaccgccgccgcaggccgtcgctgccagggcgacggccaccgcacatgcggcccacctgacctgtgtggctccgcgcatgaagtgcctcctagagtcatcgagtagctcaatgcctcatatcacctcataacaccctgtaccgcatgtgggcttaccccgtacgggcgggggcgcgggcggacgcgacgatgcccggtcccccgcgggggaccgggcatctgccgttcaggaacgaaagcgactacgccgcgtgcacgacgtcccgctcctcggcgaagtggcacgccgactcgtgcgtggcgggggtggctcccgcgacgaagcgctcggggatcgccagcagcggctcctccgtggcgcagcgctcctccgccttccagcaccgggtgcggaagcggcagcccgagggcgggttcgccggtgacggaacgtcaccggtcaggatgatccggtcgcgtccctcacgggccgacgggtcggggaccgggaccgccgacagcagcgcctgggtgtaggggtgcgtcgggtggtcgtagatctgcgtgtccgtgccgatctcggccatcttgccgaggtacatcacgccgacccggtcggagatgtgccggacgatggacaggtcgtgcgcgatgaagaggtaggacaggttgaactcgtcctggagcttctccatcaggttgatgacctgcgcctgcaccgacacgtcgagcgcggagaccggctcgtcgcagatgatgatctccgggttgagcgcgaggccccgggcgatgccgatgcgctggcgctgaccgccggagaactggtgcgggtagcggttgatgtactccgggttcagcccgacgacgtccaggagctcctggacgcggcggcgccggtcgcccttcggggccacctcggggtggatctcgaaggtctccccgatgatgtcgccgaccgtcatccgcgggttcagcgaggtgtacgggtcctggaacaccatctggatgttgcgtcgcacggccttcaacgcgcggccggacagcttggtgatgtcctggcccttgtagaagacctcgccggcggtggcccgctccagcgtcatcaggagcttggcgaccgtggacttgccacagccggactcccccacgatgcccagggtctcaccggcgtacaggtcgaaggagatcccgtcgacggccttgaccgcgccgatctgcttcttgaagagaacgccctgggtgagcgggaagtgcttgacgaggttccgcacctggaggatcggctcgccctggctgacgggcgcgtcgatggcggccacggcctccgcctcggtcgcgacgtccacggtctccacgtcggagacgttcggggtggcgtccacgggctccttcttgagctcagccatggatcgtctccttccagaagtggcacgcgctgccgcggccgacgagctcaaggccgtcctgctcggtcaccggggcgagcggcgggacgtccgtacggcagatgtcctgtgccttggggcagcgcgggctgaaggcacagcccgcggggatacgcgtgaggttgggcggcaggcccttgatcgcgtagagctcctggcccttctggtccaggcgcgggatcgagtccagcagacccttggtgtacgggtgcgccgggcggctgtacagctcgcccaccggggccgtctccacgatccggcccgcgtacatcacggcga

SEQ ID NO: 2840 - DNA, 1620 bp, Unknown
  Kingdom: Bacteria, Phylum: Actinobacteria, Class: Actinobacteria, Order: Streptomycetales, Family: Streptomycetaceae, Genus: Streptomyces
agccgaccaggccgagctgccggcgcgaacggcgggcgcccacggcgaacgcgggaccggccaggagcacgatctccagaagcgccatggcggtcaccgtgaggaccgccgcggtcatctccgcgtccgtgtcgtacgggtcggtcgtcgcggccatcgggacttcggagtccggcggcgggtccagggcgacctggcgggagatgaccaccacgcccttctcgttggcggcgaggatgtgccgccaggtcacgcccgttccgggcggaccctggaccagccacttcgggtcgctcgcctggggcggcaggatgctcttgtcgcggtcggcggtcttctgccacggggcgatgaccgagccggggaccgcgtacagggattccgccttcaggtcggcggggagttcgaccgcgccggtgagggtgtaggactggtcggggccgcgcacggtgacgcggccgccgatggacagtccggacgcctcgatgaagtcctcggtcgcggcgatctcgtccttggcccgggggtacgcgccgtcggtcagctcgatccggccgcgcagcatcgggtcggcgatgcgcagctcggtgatctgggtgtcggtgatgccgtgacgggtggtcaccgacgcgggaacgctccgctcggtgaggtgccgcgagccctcggggaaggtggcgggtacgtcgaccggcctctcctgctcctcgggagtcgggtccggggcgccctggggtgttccccagttgatgccgtcgggcatctgctgcagcttgaccgggcccatgctcgtggccgagaaccgggcgtcggccgctcccagctcaccggtcagctcctcggccttggtgggcagggcgctgcggtaggtgaggtcggcggcggtcacaccgaggaccggcagggcgatcatcgcgacgaccagggcgctgcggcccttggcccgtacggcgtcgcgccgggctatgcggaaggcggcgcgccagccggggagcgggttcacgtggcggcctcggcggttccggcggagagcagggagtcggccccggtggtcagcgtctggtcgacgatcgagccgtcccggaggaacacgacccggtcggcccaggcggcgtaccggggctcatgggtgaccatgacgccggccgcgccctggtcgcagcgggtgcgcagcagggcgaggacggcctcgccggtctcggagtcgagcgctccggtcggctcgtcggcgagcacgaggcgtcggtcgccgacgagggcgcgggcgatggcgacgcgctgctgctggccgcctgacatctcgtcggggaagcggtcggcgatctcctccagcttcagctcggccagcgcggagagggcctccttgcgggccttgcgcacggagacgccgtcgagttcgcggggcagcgcgatgttctcggcggcggtcagggcggggatgaggttgtagtcctggaagacgtagccgacgctgcggcggcgcagggcggccatccccttgggcccgagggcggcgatgtcctggccctcgatgatcacctggccgctggtggcggtgtcgagcccgccggccagggtcagcagggtggacttgccggacccggaggggcccatcacggc

SEQ ID NO: 2841 - DNA, 17321 bp, Unknown
  Kingdom: Bacteria, Phylum: Actinobacteria, Class: Actinobacteria, Order: Streptomycetales, Family: Streptomycetaceae, Genus: Streptomyces
ggcggggtccgggcggggcgtcacgcggcggctgccagctgctggttggcgtaccgctccagttcgtcgccggtgacggcttcgacgagggcgcagaggatgatctcggcggcgttgggggtgacggcattgccgtactggcggaccttgtcgcgcttggagccgaggacgatgtagtcgtcggcgaagctcatcgcccggccgatctcgtgtggctccagcattcggaagcggacgtcgttgatgtcgacgtcgccccggacgagggcgtaccggtcgcgggtggagagggtgccgatgggttcgcggacggtccgggcggtcccgttggagtagtaggggacgaggaggtcgttccaggtgacgagcgactggtggccggcggtcgtcagcgctctcacgggttcggtgaccggtgtgctcaggtatcctgcgtcaccgcgtaccgagttgttccgcatgaccatggcgggcagttccggggtgacgagcccgtggtggttgccggaggcggtggcgagggcgtcggtgacggaccgggcgacggatccgccaccgcggagctcggcgatgaagggcagccaggcgagcccggtctcgttgcgggtcgtcatggtgcgcagcgggtcgttggctgagcgggcttccttgccgtcgcggccctcgacggggacaaggagcggcgggaccgcccgaccgcggtccgggagctcgaccgggcgggagaacttcttgaggccagcctggatgcgggcgatcgtcttgtcggcgaggggcttggcccggtctccgatgcgctgcccggggatggtccagtcgattgccgcggcggcggggagcgcttcgggttcgacgatctggttgcggcaggtggtggacgggcagcggtagacgtactgctggcggtagcgacccatgtcccggcccggggtcttgaacacctgcatggcctgcacccacgcatcgcagccggagcaccaggcgcgggggcggagccacttgtcccagtctggggtgcggccgagggattcgtgccagtagccgacgtacaggcggtcgcgggactgcggggcggcgtgcacggaccgcgggttcgcgtgcatgctgttcagggcgataatgcgggtgcggtagcccatcttgtggagttcgccgatccaccggtcccactggtcccaggcccggacgtcggtgacgttttccacgacacccgctttgacaagcccgccacgctcctggacgccgcggaggtacagcggcacctcctccatgagcgcccgggactcttcctccaggtcggccggctcctcctccgcctgctcgacgagaaggtcgaggagcgagccctgcatggcggtgtcgaagttgcggcgcttgcccttggcgacggaccagttggtgcactccggggaggcccagaagatgtcggtgacgggccagtcccagacgggggcggtgcggatgtcgccgcggtagtggctcgcctcgggaaagttcgcctcgtgggagtcgatggccttcgcccagtggtttgcggcgcgggtgacctggacgccggggacggagtgcgcgccttggctgctgcctccggccccgcagaaccagtccatgaccgtgagtgcgttgccgtcgtttcggtaggtcatcagagccctcccgtgggcggtatctgccgaatctgagcgcacggaaccaggcccttgtgggccgcggttttcgtgattcgccgtcggcaatgtctggcgttcctggggtccactctgccacacttctttaaaggttggccaggatgaacagaaaggaagtgttggtgatggcttacactctggccatggctactgggaagggcatcgagaccgcagacgacggcgttgcgactgtcggcatgaccgacgcgcgagcactgctgaccagcctcattcgcgaggtcaggtacggcggcagagtcggcgccttcactgaacgcggcgcccgccaggcctacctggtcacacccgacttctacgaacaggcggagaacgaccggctcacagtggaagcgctgcgtcggtacatcgacgagttgccgagcgaggaacaccgcctcgggctggtcgatgacatcaggcggtacaaggctgacctcaaagccgcacagaacatcgcgtccgccgactgacgtcacgtcccctcctccctcccccgccacggcggggctttgtcgtgcctggatcgttgtgcgtaagtccggccctgtcaccgggcgttgagtttgtgtaggcctctgacgtgcgcaaaccctctgtctcgtgccgctggtgagcgatttgccggagcgtctcctcggtggcgcgtcagccgaaaactgggcatggcggaccacccgtgtgggtgatccgccggtgttcatgcgacccgcttctgctgtgcgccggccttgcggagttcgcgttcgccgagtccgccccacaccccgtgccgctgaccggtgctgagcgcgtaggccaggcattcggtgcggacttcgcaggccaggcaggtcttcttcgcctgccggctgcttccgccgcggtccgggaagtgggcttccgggtcggtctgggcgcagagggcggactcccgccacgacaggtcggggatcatgccgccgcctcctgctcgtcgacggccaccgggtgccggcggagttcgtggtggaggtacgggagggtgatccccagccgttcggcggcgtgctcgaaggtgaagccctgagcaagaagctcccggccgtcgtgggcgatggactcaccgcggcgggaggcgctcgcccgggaggcgctgagtcgggacatgaactcgccgcgaggcaggtggttgtgctctgccttccactgggcgtgggcctgttcgcaggcctcgcacactggaatgttctgctgccggtgcgaccaccagccgcggtccgtgccgcagtacccggtccactcggggcgggcctgcgggtcatcgatggtgtcgtcgtcccaggcggcgggcggcgcccacttgttggcgatggcacggttctttgccctggtgttggtgccgggggtctccgagagttcccggtaggcgttcttgactctttcggcgacggtccggcggagcgaggggtatccggccgcgaggggctggatgcgggcgacggcggtgttggacgctgcggcgatgtcgatgagggtgtggccgagggcgataagggcccggacccggcggacggtgccggtggagtcgatgtactggccgcctgttgccgccggctgaatggccatgatcttcgccagggttttcggggagatctgtgcgagccggccgaaggcgatctgtcggatgtgggcaccggatgttcctgctgcgcgggcgatgtcttcccacccggacgtttcgtggagttcctggaggcgcttcgctgcgggagccgcgtcgacgaggggcgggatgccgcggtgccggttaagcctctgctgcttcttgacccggttccgggtgattcggcagggctcgcaccggcagggcgggcggattccgtactggccgttggcgcgtgagtaggtgccgtgggcggccaggggccgactgcggcggggttgcgtggtggtggtcatcgttcttccccctcgttggcgaggtctgcggtggcgttgtactgggcttcgagtcgtgcgttgatgagcgcgtcgggcatggcgaggtaggcgtcggcccggtcggcgacctggtggagtcgtgcggcacgggcggtgtactcgcgccggtcggcttggtcgtggagccactggtcgtagcggcggagcgcccactgcccggcgcgccaggcggtgacgaccaaggcggtggccagcacgcccggcccgtagtagagggcggcgttgatggtctggtcgacgacgctgtgaaccgcggcatgcgcctggccggcggcgaggatcgtgtcgaggtcgctcacgccgcactcccctgggctcgggcggtgcgctcggcggcgacggcgagaccgcggggcgacagctgccacacggagatgcggtgcccgtgggtgctgggctgtgtggaggggaccatctgcccggtgtgctcgatgaggccgccctgccgcatcgcgttgatcgcagcaccgaggaagccgtggcccagttcggggaggacttcgcggatgttgttgcaggagaacggcccgcgacggccgaacgcgaggacggcctgctcaacgaggaactgggaccaagtggactgggcggctatgtcggtgaggaggaggtccttctcggcggcggcgtggcgttcggcgacggacaggcggcgggtcatgaggcttctcccaggtcgtcgaaggagagggcggtctgcgggcgggtgccacctcgggcttcccaggcggtgcggtaccggtagacgccgctggagcactcctcgcgggcgtggaagatcgcggagtgctcgggaaggtccgggcgccacaggttcgggccgggaaaccgggtcgacttctgccggcgcgtgatgtgctcgccgcagctcatgcagtgccctgcggggatctccatgaggacttcagtgcgggccatttctcggtcggcgctggtctcggcctgctcgtggcggcagggcgggagttcgccgcaggcccggcagatcaggtagtgctcggggaggatctgccacgtgtagtgggcgggcgcttcgaggtgcacgggcttggcggtggggtcctggtcggggacggcgacgacaacgaaggggcgcaaggaccacgtggcccgctcgggcttgtcgccgctggggttcttctcccaggcgcggaggcgcccggcgaacatggcctcgcgctcgtcgtcccagtcctggagtcggtcgatgatctcgacgatgcgccacggtgcccgctcgtagatgaagatgacgccgggggtgagctggacgtatccggcgatggcgagcttctcgtggacgcggtcctggtagcggcgggacgcggtggaggattcgccgatgcggttccacttggtgacgggcgggttgatgccgcccttcttcgtggtctgacgtgggtaccagcgggctgccatgacgtgcttccttccgtgtggtgtgctggggtccggagccgctcgcattacgggtgcgagcggctccggctgtgccggtgggctagctggcggatccggcctgcgcgacggccggccaggtgctggacgacggctcgtcgacgacctcggccgggtacgcgccgtccgcgtcgggctccacagagctggccttccgggcagcgacggcttcctcgtccttgcgggcggcgatggccatgagctgcttggacagctcgtcctcgcccttgaagtggacgtgcttcgcgtcctgcgcctgcatccagatgtcacggacgtcgtcggaagtgagcgccccctcggccagggcgaggtagtccgggcgcggcgcttcgagggcggcgaccgcccgcgtcccggacgggtcgagggccatggcggtggacatcggcccggccagtgcctgccgcggggtcacgccgcggagctcgaccacgacgacggggaacttcttcgtcttcccctcacgcaccacctgacggggttcgatccgcagcgtcaccggcacgaagcccttgccgtcggtcccggcgaggaccatgtcgaccatgccgccccactccgcagcggcgtagaaggagtgagtctcggcccgccacatgcccatcccggacaggtcggggagcatcacgttgaagcgggacgtcgccgagcagacggtgcccttcttctgctggtgccagtcctcaccgaactgggccaggcagatgcaccgctggcgggaaaggagttccgtctgcccgtcgcaccggcgctggcaaccgcccgcactccagagctcgttgtactggttcagcgggtccccgggcgtgatgagcgcctcgatcgacgacgccttcgtgatgacccgccactgggcggtggtggagttcagcggcttccacgtctccggggtgccgccccacagctcagcggccttacggacgtgctcttcggagtgggaggtgacgacccaggtcgcggacttcacgggccggttgccctgggtgtagccggtgcggagccggccgtgctcggcggcccgccgctggatattgaggagtcgggagcccatggtcaggcgacctttcggtagttgcgccaacgtgcggggacgggctggtcgggggcgaggagcgccgggtacgaggacggggctgcgtggtgccacagcgcgttctccagggccccgcggaatgcgcggtgggcgtcgcggccggcgggcatctcgacgagggcgtgggacttcgcccgcaggttgaggacaccggccttctggatctccggcatgggctcttcggtgtcgtccggcagcaggaccgtctcgcagtagcggagggcggcgagctgctgcgtgttctccgggtagacggacttggcggaacgggtcgccgacgtcttgaagtcgatgagccaaagttcgagctggcggtccgggccggtgggcagccagatcatgaggtcggcggttccggcgtagccgaggcgccggtgcaggcaggtgatctcggctgcgacgacgtgcttgtcgatgtcgacgccccagaagctgaggaacagctctagctggtgcaggtagggggcgacttcgcgggtgacggcgaacggggcaccgaggaggcgcttctccgcggcgtggtggatgacggtgccgaggtcggaggcgacgtcgcgggcgtcctggtggatctgcttgagctgcttggtgagctcggcacggtcggtgatggcgcggcgggcgacctgcatgcggttgtcgaggatccactcgatggtgagcttgacgccccacggcatgagcgaccgggtcttgttgaccgaggtgtcgaggacgttggtgacggacaccaggtcggggccgccggccgggtcggtgtagtagcggccgttgtcggtcgcgtgggcgtggcgggggctcgtcatcgctggccgtcctggtctttgaggcagtcttcgcggacgggcccttcgggttcgcggctgaaggggccgttggtgtcgtcgcagcggacgcaggcgatcatgtggttctccagttcggggttgctgcgggccgcctgggggttggcggcccgcggcgggcagacggagccgggctcacacgcctgccggtcggtggctcaggtggcgggcaggtagtggacctgaacggcgtggtcggcgttcggctcggcgtcgtccatgtgccagtccgcgtcggcgtcctcgggctgccactcgaagaccacgttccggaggcggagttcggcgacctcgtcgcggatctcgctctcgtcctccatgccgtggatctcgcggagatacgtcgcgatggcggcctcggccttggcccggtccggggtgagggcggccatgtcgccctcttcgaactcgacgacgggcacgccgtcgaaggcgtggtcgaacccggcctcggagccggtcggggtgaagcggcccatggggaggtcgggcacggtgatgacctcgtcgaggtagcgcaggttttcgtagtcggggcggacgtagatcccggaccgtgcgccgtcgaggcggatgcggaggcagcggggctggtcgtccgcgatggcggtgatggtgccgacctggtcgcgggggatgtggcggaggtcgtcgcggtagctgaaggcgatgcgacggccgacgacggcttcgacggggatggcggtgggctgagtcacggcgtgctcctgggatgatggggttgggtgcccccgccgaattcgcctcggcgggggcgctcgtgcgaggcgggttagctggcgtccggatgggcgttgaggaagatgccgggcgactggatcagggcgtcccggacggtcccgccgtcggtgtcggccctgatgtcgtcgaccggtcgcgcccagtcggtgatgtccctgatcgcccacgcggcgtcgtcggcgtcgccggggtactcgaacttcgcgatctggtagccggagtggtggccgagccgccacacgtaccggtcgccctctttgaggagctcagcgggctgccggtagacgaacaggccgggctggggctcgatggcctggacgaggacgggcgttgcgtgctggcgggcgatcacctcgtgggtcacgacttcctgcgcggtggcatccattgagtccttctctgaggtggttgggcgccgggccgggggccggtggcatccgccggcccggcgggttcaggcggctgcggtcgtcggcagctggttgagcgggatgcgctgcgtcgtctcggagtcgacgggcggcacgtggtctgcggtgcgggcgccgagacggatgacgtggccgtggtcgaaccggtccgccgtcgacccgtttgccgtcggggcctggccgcgagccgcttccagatcccggaccagggcgcgcaggtcgcggatctggccgtcgcggatcgtgatggtgtcctccgcgaactgcagctgggtttccaccgcacgacgggcccggttcgcatccgacgtctggttgatcagctgccggatcatggcgtcggcgtgcagcagcttctccgtcagccggcccacctgcgcggcgagcaccttgcacttgtcggctgcccggtgctttggccggctgtcgcggtgcaggcgggatatgacgttgctcatggcttgcccttccgggtccagaggctgggggccaccgccatcaggcagaagatgacgccgatggcggtggcggtgatgacgtaggcggtcaccggcggatcctgcggcggagccgatggacccggcaggcgtcgcaggtgcagcagcccgggtgcgttgccgccttctgagcccgtgcggcagcaagccggcgaatcagcccggcctcagcccgtgcggtcatgcggcgggacgggaactcggggctggtcacgtcaccgcgcatcacgcaccgtccttctggaggctgcggatgaaccctcggaaccccgactgctccagggggctgggaggcaggtggtgggcggtcaggaccggtgccaccgccgcagcgatgtggtcctcgacgtagccggcggccaccgtcgccgcgtagtccacgtcgaccgcggcccggtactgggcggccgacggtcgggggctgaccgggatcagcgggccgtggtcccggtacacgtccgggagcggcaccggggaatccggcaggcccggggagaccagcaggggctccccggaggcggtccactcgccgcgccattcccactcgacaccgagcacgtccacgaagcagcgggtcaggtcgaaaacggaaccgtcgtactcgaaggtggtcatcacgccgcctccgccctgtgctggaaggggacgccgacgaactggtgcccgtcctcggcagccacctggtcggcgacgtcggccgcctggtagcggtcccgttgcatgtccgccagatcagcggcgacgtcggcgagccggtcgagctggtcgagggacgcgtcggtgacgtcgactcgcagggcggcaccgatgcggaggaacgtcttgccgtcctcggtctccagggcgatcgggcgatcgccccacgagagcgtgatggtggtcatcggttcctcctgcgggtggtggtgtggtggtggaggtcgacgaacgcggggacggtggcgtccgggtcggcgtcgtagaggaggtgtcggttctcggcgagggcctcagcccgtcgctgggcttcccttgcggcagcgttcgcggccgtggtcgcatccacccgggcgatcagcacgtcgagcgggacgtccatgcgctccaggtcggcggcagtcacgacgcaccgcccgtcggtttcggtgccggagccgggcgcgccgtcggacgccacccttcagcgaccagtcggtcaaccatctggttcttcaggtccagctcggcctgcggagagagcgggcgcggcctcggggcgggagaggcgctcacagggcacctgcctcacgctgcgacgggaagtcgtcgatgtacggcgtcgacagatactcggccaccttcgcctcgtgcgagtcctcgtcctcggcaggccggacgcgagcggcgtcggcgtactcgtcggaccagtagtggttcttctcgctgttccggtggtcgccgccgtgccgcacgaggagagcgcaccgggaggtgccggacgagaccgtcatctgcgacgggcagttcgcctgcccctccagctcggcgatccggcaccacgggcaggcgtgcgtgtactccgagtccaccatccagtcggcgtgctgaccggcggggcactgctgcgggttcagggcctcgtaaggctccaagtccttgacccgctgggccagctcggcacggagacggtccacctcggccatggcgtctcgcacgagaccgaagaccggagagacgtagtcgatgccgccgaactgccgggccgcgttcgcgaggtgggcgcggatgtggctgtactgctccggcgtcattggagccgtggggttcgtgtcacccgcagcagcaggtgtgggattctggggcacggggcccgcctttcgtcttgatcggtgagggtgggtctcagaggccgttcccggacttggtcgttacgggggcggcctcacagctgccgtcaggcagcggcggcggctcggtcggagtcgacgtagtcgctgttcatccaggcgtcgagctcgctgatcttgtacgcgtagcggcggcggccgatctgcttgcccttcggcccgacctcgtcccgccgccagcggtagagcgtcaccacgtggacgcccatgtagtcggccgctcccgcactccagagccagcccttcggcggatcctttggcgtgttcgccactgattcactccttactcggtcgattcaggtcgtgggtcattcgtttcaggtttggagacggcggaggcgcgaagaggacgttgatggcgactcccaccgcttccgcgatcgctatggcgtcatccacgtcggccgagcgctgccggccggtcaagagcttctcgacgaccccctgcccgacccctgccgcttccgccagggatcggaccgagaaggggccacctcggccggggtttgccatgcagtgcttgaggaccggaatgctgcgcagagaccagcgtcggctcacgattcccccgagtggtgcggaactgtttgcctaacagagtgaagcatagtggagacgtttcgtctagaaatctgagacacccaacaggcgagaacaggcgaacctcatggcgggatagcgtcaccgcgtagacgaaccgtctccaatcccggatggttgtatggactgagctggtacttttccgggtgccagcgaccatctaccgagacagctggggcgagagttgacccgaagggaagaggaaatgacgtcagcggccaccgaccgggagaccgggacggacgagccgaacccctccggtgcgctctccgagctcatccgcgaggcaaacgtccggggcctctcctaccgcaagatggcggcccgagccgccgacccggagggagatctcaagctcacctccgcctacctgcagcgactcgtcgagaaccccccggtcaagccccccaacccggcgcaactccgcgccatcggtgcagcgctaggggtcagtgactccatccccaagcgggccgccgcagaacagtggctggagtaccaggccaccgaactcgccggttacggggacgaggtccgcatcatcgttgcccacctggcggggatgaccgacctggatctcaagcgctggcgcgccatgatcgaagcggatgaacgcgcccggcgcgacggggcttagcaggcgcggagcggcgacaggcctgaagtccgcaagtcgtccagactgaccattttctgcaacttaatgtctcactgcgctcacgcggcgtaccctttcacaaccgcgtgcgccgggctcattgcgctcgcgctgcaccacgctaacgggagggcgcatgctgcagatcgtgtacgaagccaccaccgacatcgacgcccagcaggtcgtccagatcgatgagacccgcggccaggtcaccatcaagatccacgcagaggccccggtcgacgaagccgcacaagccctcacccgcgaagtgcgcgacttcctcgcgaagaacacctggttccagatatggcgcggccggatcatcagcgccgactccccggaccacccgctcgccgtgaagtatgaagtcgacgacctcgtcgaccggatgaaggccgtcgagatcagggaaacctgcggtctcgtcacctaccacatggcccgcaccagcagcatccgcctgctcgtccacgcactcaatcgggccctggagtgcttcctggccggcggccagtggttccagttctgggagggtgagatcgtcaccatcgactcccccgaccgcatcacggtcggctctgccagctaggggtcctcatgcccggatacgtagaagaccgctggtacaagaaggggccacccgacgcgaacgggaaggccacccgcgtcgaaacagcccgctacgggcaggggaagcgctacaaggtcaccggcatccccggagtcagggcgcgcagcttcgagcgcctgacaggtcctcacggtgccaacgcgtggctcgccaaagcgcagcaccaggccacagccggggaattcgtcgacccccgccgcggcgagatgctcctgcaggagtacatcgagcaggagtggtggccgaacaaggcctacgacgacccggcgaccagcaacaccgtgcacagccggatctggacacacgtcatcccccacctcgggtcccttcagctgaacgcggtgaagacaccgcagctgaagcggtggctgacgaccatgagagggctggccgggcccgggacaaccaacgaggcatggaactacctggcgtccatcctgcaggccgccgtggacgacgagcggatcacgaagaactactgccgggcgcagaagtccgtccgtccgccggcccgcccctctccgaagccgcgggcgtgggacaaggctcaggtgctggcggtgcgcgaggccatggattcgcgctaccggatcgccgtcgatattggtgtgggtgccgggctccgggcgggcgaggtcttcggcctggccctggaggacatcgacgaggaaggcgagcggatcctggtcaggcggcagatcaagaagatcggatcgaagctctgctacgccctgcccaaggggcagaagacgcggagcgtgccggtgcccagctacctgttgaagcgaatctcggagcatctcgctgcacggccggcgcagatggtcagccttccgtggtccaaccctgccccgggagagaccgaccgcgagaaggagctacgtgcccctcgtgagcacgctctgatcctgcctggcgcaatgggcggagggatgcgccgggacgcctgggacacacgtatctggaagcccgccctcgccgcggccggcgtcatccccgccgccacagtgacgaaggtgcccatgaaggcgaagccgggagcgcacaagacggtgcacacctatgtggagagccgtgagaacggcttccacgcgctacgccacaccttcgcctcggtgcagctggatgcccgcgagccgatcgtggcagtctcaagctggctcggccacgagaacgcggcgatcaccctgaggatctacgcacacatgatgccggaggccgacgggcggggaaggtccgcgatgcaggcctggttcgaaggctccgcgtaaaagatctccccagtcgctccccagccctctaccggatcacgaagaacgccccatccactgaatcggatggggcgcttttcgtggggtcagatcaaccccagcgaggccagtacacatcgttgacctggagagattcgctgaggccagtagacgtaacacaccccgcccgtaccgcttctgaccttgccgcccgcgtcgtagcgcttggtccgcagccagatgttctcccattcgcgccgccggtagacccggcgtaccgcgtcgttgtcgggggacgcggggtcgttggcgatgacgtcgccttcgggggtgaagccgatgaccgtcatcaggtggccggccgtcccgtatccggcgccggtcagttcctccttcaggaaggactgggaggtgatgacggggatgccggcgcggatcagccgctccacgtcggtgagcgagccgagccgggtgacgacggcgttcaggtcacggtacgtggcggcgtaggcggcgttgaacggccagttgccgcagccctcgtactggtagtcgtaggtctggcgggcggcgtggcagacctggggatcgggcaggccgggcttgacccaggccaggtcctccgcggtggggcggcggccccagtgctcgatgatcatctgcgaggaggtggggctgcaccacgcctcgccgccgttgtcgtactcggggtactgcccgatgtggacgttctgcgagtagcggggcacgggcagttcgcgggcgagggcgggggtgctcgcgggcacggtgaagcggtcgggcacgtcggaggccatcgcgccgacccgccagacggtcggggtgaggcggctgccaggggtgcggtacagcgtgagccgcagccggtaggagaccaggcggacgccgctcgcgggatcgtccaccgagaaggtgtccgtccacacggagctgtacgggtcgccctggccgtcgacggacgtacggcggatgtcgccgtcgcccgccgcccagcggcccatcacgaaccagggggtcgcggtgccgtccccgtagacgccgctcagctcgacctggatccaggtgccggccggggtgcgggcgttccacgaggcgatcacctcggtggcggggacggcggagcggtgcgcggcggaggtccaggtggcgtagtcccaggcggccgtcctgccggtgtgcgggtcggtgtagtcggtacggcccgccgggacggcgatcaccacgccgggccggggccccggaagcacccgggttccgtcgcccgtgccgcagcgccagtcggtgtaggtgtgccagaaacggttgtccacgagggtctccgggacggcggaggagccggcgggcgaggccggggcggcggacgcggacgcggcggagcccaccgtgccggcggctgccgccgcagcgagcgcggcggtcagaacggttctgcgcgaagtcggactggtcatggtgtgacccccggtcggatgcggaaggtggtctgcgggtgccgtgcggtgcgccaactatcccggctcgcggccggatcgggccagcggttcggcaaccgccgccggaccaatatgggtctggaccactggcgtgacctgcggcggaccccgtccggtttcgtgccggaacgtaccctggagccatggacgacctggcccgccacgccgatgacctctcctcgctgcccccctcctgcgggccggtgcggctcgtcgcggtcgacgggcacgccggttcgggcaagagcaccttcgccgcccgcctcgcgacggcgctgggcggtgcgccggtcctccatctggacgacctcgccacgcacgaggaactgttcggctggacggggcggctgcgggatcaggtgctcctgcctctctcgcgcggcgggagcgcccgctatgccccgtacgactggacggagcagcgcttcggtccgacgcggaccctggagccggccccggtggtgctggtggagggggtcggcgcgggacgccgtcaggtgcgaccgtggctcgcggcgctgtgctggatggagctggaccgggagacgtcctgggaacggggccggcggcgggacggcgccggactcaccgggttctgggacgggtggacgctcgccgaggcgcggcacttcgccgaagatccctcacggccgtacgccgacgcgctggtacgccagttgccggaggggtacgcgtggctgccgggaccccgcgcgacagcgggagcgaaccgaaccgtcacacacggtagccacagcctcccgccatactgagcagtcggaaatcggcccggaagtgccccaactctgcttgaccggggggccttacaggtcttacgttctcattgtgcggcttttcggagcccccatggacgcgaagcccccggttgttcccccgtgatcgggggcttcgctctgtgctcccgccgccgacccggcgaccacgcagagcgattcactcaccctgggtcaccgtcgcgggggtcgatcatcgagcgtccgcctccccgcgcgcgggtacgatgcacctcggtgtggtcaattcccttcctccacgccgtgattcagcacgctccggtgggcatgctgtgcgggcgggacatcctgggggcacggtttgtgggggacctgatggacatcggcacacagggcgctggagcccctgccgacctcgcctggctgcgcggcatggacgcctacacgatgggcgcctacccgcaggccgaggaggagttcagagccgcggtgcggttcgatccgggcatggcggacggctggctcggcctccacgcgctgcgcatcgacaccaccacggccctgttacgcatgtaccggcaccgcgaccgcttcggcgagcagcgcgcacgccaccgacgtgcgctcaactcctggtactggctgggctggtgggtgcagccggtgctggagagtcagcgcgatctgctgctggcgcacgcctcgcactggctggacggacgtcatgtgccggagctggaccgggcattggccgggctgccgccggtggacgcggatccccaggtgaggttcctgcacgcctgccgctcctatctggtcaaggactgggagcagttggtgcgctgcaccgagcagctggtcgacgatccgatgctgggcatcgaggcgggtctgttcggcgggatggcacgggtccggctggagatgttcgggcaggcggagcccctgctgtcggcggcgctgatgcgctgccgcagcgaacagccgcagcgcaaggagctgcgctactggctggcgcgggcccacgagggcaccgggcgcagcgcggccgccctgccgctgtaccgggcggtgcaccgggtcgacccggccttcatggacacctccgcccggctcgccgcgctcgtggagggcgacgggtacgacgagtcggcggacctggccgccgtgaccctgaccggtttcggttcgggcggatcgggggcgcagccggagggcgacgcgctgctcggcaccgatctggtggacgggcgggaaccctggccggtgagcgacgcggggctgctcggcgacgacccggtgc

SEQ ID NO: 2842 - DNA, 5728 bp, Unknown
  Kingdom: Bacteria, Phylum: Actinobacteria, Class: Actinobacteria, Order: Streptomycetales, Family: Streptomycetaceae, Genus: Streptomyces
tggccgccctgggtgccgccgccgggcgcctggtacgcctggggcgggtggtacggccccgacggccccggtgcgggctcacgctcgccgggcaggggcccggtcgcgtaaccctcgtactggggctgaggtcctcgtgtgtccgtcacagtgcccccttgggagtccgtggcagggccacgggcaccgttcgctccagctccggaagcggccgaaccggcgcccgtggctccactcacgctctactcctcgtgctccccggtcgaaggctccgtgccctcgacagtgccctcgctcacgccctcggcgtgaacctcggccagctcgccatcgacgtcatcggccccatcgacctcttccgcctcacgaccggcctcggcattgcgcgcgatgccgacgacggcgtcgcgcttgcccagattgatcagttggacgcccatggtgtcacggcccgtctccctgacttcattgactcgcgtacgaatcacaccgccgccgagcgtgatggcgagaatctcgtccgtctcctcgaccaccagcgccccgacgagcgatccgcggtcctccacgatcttggcggccttgatgccgaggccgccgcgaccctggacgcggtactcgtcgacgggagtccgcttcgcgtacccgccgtcggtagcggtgaagacgaacgtaccgggccggacgacattcatcgagagcagttcgtcgccctcgcggaaactcatccccttgacgcccgaggtggcacggcccatcgggcgcagcgcgtcgtccgtcgcggtgaaccggatcgactgggccttcttgctgatgagcagcagatcgtcctcggccgacaccagttcggcgccgatcagctcgtcgtcgccgccgtccggcatctcgcgcaggttgatcgcgatgacaccgcccgagcgcggcgagtcgtagtccttgagcgcggtcttcttcaccagaccgcccttcgtcgccaggatcaggtacggcacggcctcgtagtcgcggatcgcgaggatctgggcgatcttctcgtccggctggaaggccagcaggttggcgacgtgctggccgcgcgcgtcccggccggcgtcggggagctcgtacgccttggcccggtagacccggcccttgttcgtgaagaacagcagccagtggtgcgtcgtcgagacgaagaagtggtcgacgatgtcgtcttcccgcagcttcgtcccgcgcacgcccttgccgccgcgcttctgcgagcggtagtcgtccgtcttcgtgcgcttcacgtagccgctgcgggagatcgtgacgacgatgtcctcctcggcgatcaggtcctcgatggacatgtcaccgtcgaagggcaccagcgcggagcgccggtcgtcgccgaacttgtcgacgatcgccgccagctcctcgctgacgatggtgcgctgcttggcgggcgaggccaggatctcgttgtactcgttgatcttcgcctggagctcgtcgtgctcggcggtgatcttctggtgctccagcgcggccagccggcgcagctgcatctccaggatcgcgttcgcctggagctcgtcgatctccagcaggcccatcaggccctcgcgcgcgatgtccaccgtgttggaacgccggatgagggcgatgacctcgtcgatggcgttcagggccttgaggaggccgcgcaggatgtgcgcccgctcctccgccttgcgcagccggaacttcgtccgccggacgatgacctcgatctggtgcgtcacccagtgacggatgaacgcgtcgatcgacagcgtgcgcggcaccccgtcgacgagcgccagcatgttcgcgccgaagttcgtctggaggtcggtgtgcttgtacaggttgttcaggacgaccttggcgaccgcgtcccgcttgaggacgacgaccaggcgctgccccgtacgcgaggaggtctcgtcgcggacgtccgcgatcccgccgaccttgccgtccttgaccaggtcggcgatcttctgcgcgaggttgtcggggttggtctggtacggaagctccgtgacgaccaggcactggcggccctggatctcctcgaccgcgacgaccgcgcgcatggtgatggagccgcgcccggtgcggtacgcctcctcgatgcccttgcggcccacgaccagcgcgccggtggggaagtcggggcccttgatgcgctcgatcagcgcgtccagcagctcctcgtgcgaggcctcggggtgctccaggtaccactgggcgccggcggcgacctcgcggaggttgtgcggcgggatgttggtcgccatgccgaccgcgatgcccgcggagccgttgaccagcaggttcgggaagcgcgccggcaggaccgtcggctcctggttgcggccgtcgtagttgtcctggaagtcgacggtctcctcgtcgatgtcccggaccatctccatggacagcggcatcatcttgcactcggtgtaccgcatggcggcggccgggtcgttgcccggagaaccgaagttgccgttggagtccaccagcggcatgcgcatcgaccagtgctgcgcgaggcgcaccagggcgtcgtagatggaggagtcgccgtgcgggtggtaggtgcccatgacgtcgccgacgacgcgggcgcacttgtagaagcccttctcggggcggtacccgccgtcgtacatcgcgtacagcacccggcggtggacgggcttgaggccgtcccgtacgtcgggcagcgcacgcgagacgatgacggacatcgcgtagtcgagataggagcgctgcatctccgtctcgagcccgacgggctcgacacgcatgcccacaccggggacggtctcttcctcgggcatcacgggttcaggtgtcacaggggtgttctcgtcggccattgctggtcaaagtcctttcgagctgcggcgtcgctggtacggccgactcagatgtcgaggaagcggacgtccttggcattgcgctggatgaacgagcgccgcgcctcgacgtcctcacccatgagcaccgagaacaggtcgtcggcctgcgccgcgtcgtccagcgtgacctggccgaggacccggtggtcgacgtccatggtcgtgacgcgcagctcttcggcgttcatctcgccgagacccttgaagcgctggatcgagtcttccttgatccgcttgccgttctgcttgccgagcgccaccagggcgtcgcgctcccggtccgagtacgcgtactcgaagtcgtcccgaccccacttgatcttgtagagcggcgggcgcgagaggtagacgtggcccgcctccaccagcggccgcatgaagcggaagaggaaggtcagcagcagggtgttgatgtgctgaccgtcgacatcggcgtccgccatcagaatgatcttgtgatagcggagcttctcgatgtcgaagtcctcgtggaccccggtgccgaacgccgagatcagcgcctggacctcggtgttctggaggatcttgtcgatccgggccttctcgacgttcaaaatcttgccgcggatgggcaggatcgcctggtacatcgggttgcggcccgacttcgccgaaccgccggcggagtcaccctcgacgatgaagatctcgcacttggtggggtcgttcgactggcagtcgctgagcttgcccggcagcgaggcgctctccaggagccccttgcgccgggtcaggtcgcgcgccttgcgggccgccacacgtgcggtcgaggcggcgatgcccttgcggatgatgtcggcggcctcgttgggattccggtcgaaccagtccgtcagctgctcgtggacgaccttctgcacgaaggtcttggcctccgtgttgcccagcttggtcttcgtctggccctcgaactgcggctcgcccagcttcaccgagatgatcgcggtgaggccctcgcggacgtcctcgccggtgaggttgtcgtccttctcgcgcagcagtttcttgtcgcgcgcgtaccggttgaccagcgaggtcagcgccgcacggaagccctcctcgtgcgtaccgccctcgtgcgtgtggatcgcgttggcgaaggagtagacgccctcggtgtactgcgtgttccactgcatggcgatctcggccgagaggagacggtccttgtcctcggcctcgatgtcgatcaccgactggtgaatgacgtcgcccttgcgggagttgaggtacttcacgaaatcgacgatgccgttttcgtagtggtacgtgaccgagcgggcggtctcctcctcggccggctcgaccgcgtccgcgctgtccgcacccgccgtcgccttcgccgactcacgctcgtcggtgagcttgagggtgaggcccttgttgaggaacgccatctcctggaagcggcgcgagagggtctcgaagctgtactcggtggtctcgaagatgtccccgtcggcccagaaggtgaccgtcgtaccggtctcctcggtggcctcgtgcttggccagcggtgccgtcgggacaccgagcttgtagtcctgggtccagcggtggccgtcggtcttgacctcgacggcgacccgggtggacagggcgttgacgacggagacgccgacgccgtgcaggccgccggagacggcgtaaccgccgccgccgaacttgccgcccgcgtgcaggacggtcagcacgacctcgacggccggctttccttcggacggcacgatgccgaccgggatgccccggccgttgtcgatcacacgaaccccgccgtcggggaggatcgtgacgtcgatggtgtccgcgtggcccgccatcgcctcgtcgaccgagttgtcgacgacttcctgcacgaggtggtgcaggccgcgctcaccggtcgagccgatgtacatgccaggccgcttgcggaccgcgtccagcccttccagcacggtgatcgcgctggcgtcgtacgaggcggagacctcgccgtgctcaccggctgtggacggaatgttctcgttggggttgccggaatcggccacgaagcgccctttctggcacagcacaggccgttctccggacaggcgggagcggctgcgtcgttcggcttgtatcgacgactcccgcctcagcggcgggattactcaccagtctaccggtagcactgacatgaatgggggtttgcgggtacctgagtacgcatgtgccgccctgaatgagcggctgacgactccccatattcgggaaggggctccaaggggccctgacgggctttgagcgcttcggcctgtcaacctctcgctacggtgagggacgctccggccgtaccgcccggtttcctcccgcgcgaacccggacgaacccacccacacgtccgcccggtacacgacaattttgcaccgaaagtgcagctcagcgcggtgagcgatgatccgtacgaaagcggcggaaggcgcggagaacccgaccgcgagcccgcgccggcctggccgcctccactcggcggcccgggccctcacccgtaggtgtcgcccggccccttgctgccgggcgcccgcaacggcccgaaccggcgctccgggccccccggcccgaccaccttgatcatccgtacggtgccctgccccagatccgcgttcagccgggccaccagttgcggagccagcagccgcagctgcgtcgcccacgccgtcgagtcgcagctcacggtcagcacccgggcgtccggatcgtcgtcgtaccgcagaggcacgcagtggttcgccagatcgtcgccgacgatctggcgaaccact

SEQ ID NO: 2843 - DNA, 12697 bp, Unknown
  Kingdom: Bacteria, Phylum: Actinobacteria, Class: Actinobacteria, Order: Streptomycetales, Family: Streptomycetaceae, Genus: Streptomyces
  misc_feature (12487)..(12488): n is a, c, g, or t
cggaaccgcctcagaggaccgcgcccgcacgcagcctctcccgcgcctccatcagcgcgaagcccaacagattcagcccccgccactgctgcggccgctccacccgctcgtcgtccgccgcgagtccgatgccccagatccggtccagcggagaagcctccaccagcacccggtccccggtgcccaggagatagccgcccaactccgggtcctgcccgaacttgtgcgtgctgcccgccaccaccagggcgaaccgctcccgtatccacacgtcctcgtcgaagccgcggaccaggcgccccgccttcttcgccgccgccgggctcgtcgccgacaccgcggcccgctccgcctccggatcaccgaagagccgcgccttgccggccatcatccagtgctcggcactcgcgtagatcaccccgtccaccgtgaacggcgacggccaccactggctcaggcaactcgcgccgatccgcccgtccgggcgcgggcggtgcccccagaacggcagatacttcacccgcttgccctgcgccacgtccgccagaagctcatcgatcggtgccatggcatgtgagtgtggcatccgccactgacactccgtacggggatttccgcaccgacacgacacatagtcgacagattccgtcgcgtaaccaaaaggcaacaacggaatcacttgttgggcttgaacccctctgtcaggatcggcactcaattcacgaagaagctacgccgaccccgcccagcgggtacagcggcggaggagagcgtcatgagcaacggcttccaggttcaggaccgcttcgcggaaggtgcgcagtacatcggcggcaagctgctccccggtacgtccggcaaccaccacgaggtggtgaaccccgcgaccggcgagagggtgttccgctacgagctggcgggcgccgacgacgtggacgcggcggtagccgccgcccgcgccgccttccccggctggtccggtgccacccccggcgaacgctccgaggcgatgcaccgcttcgccgccgtcctcgccgagcaggcggacgacttcgcgtacgccgagtccctccagtgcggcaagccgatcaagctctccaccgagttcgacgtccccggcaccgtcgacaacgccgccttcttcgcgggcgcggcacgccacctggagggcaaggccgccgccgagtacgacggcgaccacacctcctacgtacgccgcgaggcgatcggcgtcgtcggctccatcgccccctggaactaccctctccagatggccgcctggaaggtcctcccggccgtcgccgcgggcaacaccatcgtcctcaagcccgccgagctgaccccgctcacctcgctgatgttcgcccaggccgccaccgaggcgggcatccccgacggcgtcatcaacatcgtcaccggcgcgggcaaggacgccggcgagcacctcgtcggccaccccgacgtcgtgatgacctccttcaccggctccaccgccgtcggcaagcgggtcgcggagatcgccaccgccaccgtcaagcgcctccacctggagctcggcggcaaggcccccttcgtggtcttcgacgacgccgacctggaggccgccgtccacggcgcggtcgccggctccctcatcaacaccggccaggactgcaccgccgccacccgcgcctacgtccagcgcccgctctacgacgccttcgtccgggacgtcgccgcgctcatggagaccgtccggctcggcgaccccttcgactccgccaccgacctcggcccgctgatcagccacgcccagcgcgaccgcgtcgccgccttcgtcgagcgggcccgcggctacgcccaggtcgtcaccggcggcgaggcccccggcggcgacctcgccgacggtgcgtactaccggcccaccctcgtcgcgggcgccgcccaggacagcgagatcgtccagtcggagatcttcggccccgtcctggtggtgctgcccttcgacaccgacgacgagggcatcgccctcgccaacgacaccccgtacggactggccgcctccgcctggacccgcgacctgtaccgcgcgaaccgcgccacccgcgagatccaggcgggctgtgtgtgggtgaacgaccacatcccgatcctctccgagatgccgcacggcggctacaaggccagcggcttcggcaaggacatgtcggcgtactccttcgaggagtacacgcaggtcaagcacgtcatgtacgacaacaccgcggtcgcccgcaaggactggcaccgcacgatcttcggggaccgatagcagctgccgcacgatcagggccgacaggtcctggcggcctcccacccgaaagggcaacgcgtatggagagttacgagcccgagcgcctctcgtccgcccaactggcggccatgaggcgatccctgaccagcggccggggcgccctcacccgccgctccctgctgcgcgcctccggcatgggcgcgctcgcactgggcggcatggccaccctcggcgcgtgcggcatcccgcccgccaagcgcgccgacgccggcacggcctccgacgaccactcggccaaggagaaggaagtcaccttctccaactggaccgagtacatggacgtcagcgaggacgagaagggccgccccaccctggaggccttcaccgagcgcaccgggatcaaggtcaagtacaccgaggacatcaacgacaacgtcgagttcttcgggaagatcaaaccgcagctcgcggccggccagaacaccgggcgcgacctcatatgcgtcaccgactggctcgccgcccgcatcatccggctcggctgggcgcagaagctcgacccctcgaacctcccgcacgccttcgccaacgtgtccgcccagttccgcacccccgactgggacccgggccgcgcctactcctatccctggaccggcatcccgaccgtcatcgcgtacaacgtgaaggcgaccggcggccgcaaggtcgactccgtcacccaactgctcgacgacccgaagctcaagggccgcgtctccttcctctccgagatgcgcgacaccatcggcatgaccctcctcgatcagggcaaggacccggggaagttcaccgacaccgacttcgacggtgcgatcggccgtctccagaaggccgtcgacaagaagcagatccgccgcttcaccggcaacgactacaccgccgacctcagcaagggcgacatcgccgcctgcgtcggctgggccggggacatcatccagctccaggccgacaacccggacatcaagttcgcgatcccggccgccggatacatcacctccagcgacaacctcctggtccccgcgcaggcccggcacaagaccaacgccgagaagctcatcgactactactacgagccgccggtcgccgcgcagctcgccgcgtacatcaactacgtctgcccggtcgacggcgtacgcgacgaactcgcgaagatcgacgagtcgatggcctccaacacgctgatccttcccgacaaggagatggcggcgaagtcccgctccttccgctccctgagcgcgaaggaagagacggcgtacgaggagaagttcgccaagctcatcggcgcctgaccaccggacccgccgccggccgcatcgcgagacaacggcccggcccggcccgtccgtcgtcacccctttccccgaactccccccgaacacactgggactgcgacccatgacacagcagcagaccgcgggcggcgatgtccgcctcgccgggatcagcaagacctacggctccttcaccgccgtgcagccgctcgacctgaccgtgccccagggctccttcttcgccctgctcggtgcgtccggctgtggcaagaccaccaccctgcggatgatcgcgggactggaggaggccaccaccggcacggtcttcctcggggagaaggacatcaccgacctgcccccgtacaagcggcccgtcaacaccgtcttccagagctacgcgctcttcccgcacctggacatcaccgagaacgtcgccttcggactccgccggcgcggcgtcaagtcggtcaagaagcaggtcgacgacatgctggagctcgtccagctcggggacttcgcccgccgcaaaccgcaccagctctccggcggccagcagcagcgtgtcgccgtcgcccgcgcgctcatcaaccacccccaggtcctgctgctcgacgaaccgctcggagccctggacctcaagctccgccggcagatgcagctggagctcaagcggatccagaccgaggtcggcatcaccttcgtgcacgtcacccacgatcaggaggaggccatgaccatggccgacaccgtcgcggtgatgaacggaggccgcgtcgagcaactcggcgcgcccgccgacctctacgagaacccgcgcaccaccttcgtcgccaacttcctcggcacgtccaacctcatcgagggcgaggtcctctccgcgggcggcgacctggtggtggccgcgggcggcggcaagctcaccctgccccgcgagcgatgttccggccccaccaccaccggcggccggctcctcctcggcatccggcccgagaagatatccctggcgcacgtggacgacgcggactccatagccaccggccgcaaccgcgtcaccggccgcatcgtcgactccagcttcatcggcgtctccacccagtacgtggtcgagagcccggcgggcaagtcgctccaggtgtacgagcagaacatcgacaggcgtgcgggactccttcccggcgccgaggtgatcctgcactggaaccccgcccacaccttcggactcgacgccgaccaggacatcgacgccggcgtggagagcgtggaggacgcggcgtgagcctcaccgaggcgccgcccgcgcccccctcgcagccggaggagccaagggaacccaagctccgcaagccctccacccgtaaacgcctcgtcccctactggctgttgctccccggcatcctctggctggtcgtcttcttcgccctgccgctcgtctaccaggcctccacctccgtacagaccggctccctggagcagggcttcgaggtcacctggcacttccagacgtacgtggacgcgctgcgcgagtactacccgcagttcatccggtccctgctgtacgcgggcaccgccacggtcctgtgcctgctgctgggctacccgctcgcctacctcatcgccttcaaggcgggccgctggcgcaacctggtgctcgtcctggtcgtcgccccgttcttcaccagtttcctcatccgtacgctggcgtggaagacgatcctcgccgacggcggcgcggtcgtggacgtgctgaacaccctgcacgtcctggacgtcaccagctggctcggctggaccgagtccaaccgggtcctcgccaccccgatggccgtcgtctgcggcctcacgtacaacttcctgccgttcatgatcctgccgctctacacctcgctggagcggatcgacggccgactgcacgaggcggcgggcgacctctacgccacccccgccaccaccttccgcaaggtgacgttcccgctctccatgcccggcgtcgtctccggcatcctgctgaccttcatcccggccagcggcgactacgtcaacgcggaactcctcggctccaccgacaccaagatggtcggcagcgtcatccagagccagttcctgagggtcctggactatccgacggccgccgcgctctcgttcatcctcatggcgatcgtcctgctggcggtcaccgtctacatccgccgctccgggacggaggacctggtctgatgcccgtactgcgctggatacgccggaacctggtcgtcatcgctggtctgctgaccctcgcgtacatgatccttccgaacatcgtcgtgatggtgttctcgttcaacaagcccaacgggcgcttcaactacgcctggcagcggttctcgctggacgcctggaaggacccgtgcggggtcgccgacctgtgcggctcgctctccctctcgctccagatcgccttctgggcgacgctcggggcgaccgcgctcggcacgatgatcgcgttcgcgctggtccgctaccgcttccgggcgcgcggcgcgatcaactcgctgatcttcctgccgatggcgatgcccgaggtcgtcatggccgcgtcgctgctcacgctgttcctgaacatgggcgcgcagctcggcttctggaccgtgctgatcgcccacatcatgttctgcctcagcttcgtggtcacggccgtcaaggcgcgcgtcatgtcgatggacccgagactggaggaagccgcccgcgacctgtacgcgggccccgtgcagaccttcctgcgggtgaccctccccatcgccgcccccggaatcgcggcgggagcgctgctcgctttcgcgctctcgttcgacgacttcatcatcacgaatttcaacgcgggctccactgtcaccttccccatgttcgtctggggatcggcacagcgcggcacgcccgtgcagatcaacgtcatcggcaccgccatgttcatcattgcgatatcggtggttctggtcggccaggtcatagcaagccgacggaagaacaacgctcgaccctgaaattcctgaaggagttggaaaccatggccccagctgccatgcgtactgctgccgcacgatcgatcgccggcgcgaagccggtctcctactggctcgacgacccggccaaacccgatgcgctgcccgccctcaccggcgacgagcacaccgatctgctggtcatcggcggcggctacagcggtctgtggaccgcgctcatcgccaaggagcgggacccggaccgggacgtcgtcctcatcgaggggcacgaggtgggctgggccgcctcgggccgcaacggcggcttctgcgccgcctccctcacccacggcctggccaacggtgtggagcgctggccggacgacatcgcggagctggaggagctgggggagcggaacctcgacgccatcgaggccgcggtcgccaactacggcatcgactgcgagttcgagcgcaccggcgagatcgacgtcgccaccgaacctcatcagcttcaggagctgcgggaatggcacgaggagatcgtgggcctcggcatcacgggcgtggacttcctggaccgtgacgccctgcgcgccgaggtcgactcgcccaccttcctcggcgggctctgggaccggcgcggcgtcgcgatgctgcacccggcgaagctcgcctggggcctgaagcgggcctgtctggagctgggcgtgcggatccacgagcacacccggggcctggacctggtccgctccggatccggaatggcggtccgcaccccgtacggccgggtcttcgcgcgccgcgtcgcactcggcaccaacatcttcccgtcgctcgtcaagcggatccgcccgtacaccgtgccggtctacgactacgcgctgatgaccgaaccgctcactcccgagcagctcgcgtccatcggctggaaggggcgccaggggctcggcgacagcgccaatcagttccattacttccggctttccgcggacaaccggatcctgtggggcggatacgacgcgatctatccgtacggaggccggctcagtgccgatctcgaccagcggccggagacgttcctgaaactcgcggagcagttcttcacgtgctttccgcagctttccggactgaatttctcgcacgcctggggcggcgcgatcgacacctgttcccgctttaccgcgttcttcggcacggcccatcaggggcgggtcgcgtacgccgccggattcaccggtctcggcgtcggatcgacccggttcggtgctgatgtgatgctcgatctgctctccggcgaggagacggcacggacccgcctggacatggtccgttccaagccgatgcccttcccgccggaacccttcgcctgggccgggatcgagatcaccaagcggtcgctggcccgcgccgacagcaacggcgggcaccgcaatctgtggctgaaggccatggacagactgggcctcggcttcgacagctgaaccgcgtccggcccggatcggatgctgtgacccacctcactgccaactggtggcctcaacccgcgtcatagtcagcgccgaacgctctctcgcacgtgtacgcaccggcggaaccccgccggtgctcacgtcaacgggaggctggtcatgactggctcggaaacgaaagccgcggtcgagtggctcacatcggtggcgccggacccggccgcctgccggtgggagtgggagcgcaatccgcaggggatcgcgctccttcccgccggcaggcgctgggacgttctgatcctcccgggggagctgggctaccccacgctcgacatcctcacccgtctgatcgaccgcccgggccccgttctcgccggcttcggggagtcccgtctgggcttcttcgtccagccgggcacggtctcccgctggatcggcacggggatcagagggtgcggccagggcgcctggatcgtcgtcccgtatccggggcgggccggcaggggagtgcgctggctcgtcccgccggacggctcggggaccctcaccgatgccggactcctcgaactcgcgatgcacgaggcggcgggcgcggccgccggggacgcccgcggagagggcccggagggctgagccggctgccagaggtcttgacaacctgattggtctggaccatgttgtgcgcacgccactccccgaatttccccccgcgcggaggctgttgtggaacgcaccggaccaaccgtcagattttccggacctctggccgtctgctcggccatcctgctcgccgccggcgccctcgtcgccacggcgccggcggcgggcgccgccgatgtggacctggcacgcaacggcggcttcgaggcgggcctggacggctggaactgcgcggcctccagcggggcggccgtctccaccccgacccgcagcggcgcctccgcgctcaaggcgaccccggccggcaacgaccacgcgaagtgctcccagagcatcacggtcaagcccaactcctcgtacacgctgagcgcctgggtgcagggcagctacgtctacctcggcgcgtccggcaccgggaccaccgacgtctccacctggacccagtcccccggtgcgtggaagcagctcaccaccaccttcaggaccggcccctccaccacctccgtgagcgtctacacccacggctggtacggcaccccggcctactacgccgacgacctcaccctcgtcggccccggcggcgagcccgtcgtgatcccggccgtccccgccggcctgaagaccaccgcgctcacctcctcctccgtcgccctctcctggaacgccgtctccggcgcgagcggctaccacgtctaccgcggcggtacgaaggtcgccacggccaccggtccttccgccaccgtgacgggcctggccgcctccaccgcgtacagcttccaggtcacggccaccaacgcggccggggagtccgcgaagtcggccgccgtcaccgcgaccaccacggcgggtggcggaggcggcgacaccaagctcccgccccgcgccctcgtcggctacctgcactccagcttcgccaacggctccggctacacccggatggcggacgtgcccgactcctgggacgtcgtcaacctcgccttcggcgagcccacctccgtcacctccggcgacatccgcttcgcgctctgcccggtcgccgagtgcccgaacgtcgagtccgaggcggagttcaaggccgcgatcaaggccaagcaggccgcgggcaagaaggtgctgatctcgatcggcggccagaacggacaggtgcagcttgcctccaccgccgcccgggacgccttcgtcacctccgtctcgaagatcatcgacacctacggcctggacggcctggacatcgacttcgagggccactcgctctcgctgaacaccggcgacaccgacttccgcagccccacctcaccggtgatcgtcaacctgatctccgcggtgaagtcgctcaaggcgaagtacggcccggacttcgtcctcacgatggcgcccgagaccttcttcgtgcagctcggctaccagttctacggctccggcccctggggaggccaggacccgcgcgccggttcctacctgccggtcatccacgcactgcgcgacgacctgaccctgctgcacgtccaggactacaactcgggcccgatcatggggctggacaaccagtaccactcgatgggcggcgcggacttccacatcgcgatgaccgacatgctgctcgcgggcttcccggtggcgggcgacaccggcaaggtcttccccgggctgcgtcccgaccaggtcgccatcggcctcccggcctccacccaggcgggcaacggccacacctcaccggccgaggtcaacaaggcgctcaactgcctcaccaagaagaccgactgcggctcctaccggacccacggaacctggaccgacctgcgcggcctgatgacctggtccatcaactgggaccgcttcaacaactgggagttctcgaagaacttcgacgcctacttcggcaactgacccaccacaggggcgcgagcacccaaggccccaggcaccaactggccagcacgtccagcggccagtggtagccgtgcagcaccagaccgatgcccgtcgccgtggtcaacaggatcgcggcgacgggcatcatccacgcccggagccaggacgcctcccggagccacgagggacggggaaggctcaacagcaccagagccgacgccccgtacgccacggcggccgtcgccgtatgaccggacgggaagtagttgaccgcctccgtcagcggcccctgccgggcggtggccaccttcagcgggatcaccagcgcgggcaccgccgccatggtgagggccgcgtacacggcgagccgccgggcgccgcgccacaacgcgtacgcgaccgcgcaggtcagcaccggaagcgccaccggcatcccgccgaggtcggagaacacctgggtcagcgcggccgggccgtgcccgaacagctccccgcccacgcgctcgtcgagccgcagcagcggaccctcgacggcgacctgccaggtgatcagcgcgaagaggaccgcgagcagaccgaggacgcagagaacgagaggggccggccacccgggaacagggggggttgttccgggatggccggcgagatcggttcgccgcgcgccccggggggtgtggggcgggcggccgtccgatcggtgaggagtcccggagccggaggctccggtgtgcgcgaacgcacgcccgggacggcgctggggaagccccggcccggcgtcggccgcggtttcccgcgaccgaggtgtttctctcatctgcagaaaccgtacggcagtgaaggggcggccgacagtcaccgccgcctcccgccattgcccccgcacacgttcttcacaggccctcacccggatggcggacggaagcggcgaaaggccgccgccgctcgttcccgggttcgaaggatcagagagtgccgaatgcctgctcgatcacgtcgaggccctcgttcagcaggtcctcgccgatcaccagcggcggcaggaagcgcaggacgttgccgtacgtaccgcaggtcagaaccatgacgccttcggcgtggcaggccttcgcgagcgcgccggccgcctccgggttcgggtccttcgtgccggacttcaccagctcgatcgcgatcatcgcgccgcgcccgcggatgtcgccgatgatgtcgccgttcggcagcttcgcccgcatctccgccaggcggcccttcatgacctcctcgatccgcttggccttcccgttcaggtccagctcgcgcatcgtctcgatggccccgagcgcaccggcgcaggccaccgggttgccgccgtacgtaccgcccaggccacccgcgtgcgcggcgtccatgatctcggcgcggcccgtcacggcggacagcggcagaccgccggcgatgcccttggcggtggtgatcaggtccgggacgatgccctcgtcctcgcaggcgaaccactggccggtacggcagaagccggactggatctcgtccgcgacgaacacgatgccgttgtccttcgcgaactgcgcgatcgccgggaggaagcccttggccggctcgatgaagccgccctcgccgagcaccggctcgatgatgatcgcggcgacgttgtccgcgccgatctgcttggtgatctcgtcgatggcctgcgcggacgcctcggcgccggcgttctcggcaccggtcggccagcggtagccgtaggcgaccgggacgcggtagacctcgggcgcgaacgggccgaagccctgcttgtacggcatgttcttcgccgtcatgcccatcgtgaggttggtgcggccgtggtagccgtggtcgaagacgacgacggcggtgcgcctggtgtaggcgcgggcgatcttcaccgcgttctcgacggcctcggcnncagctcggcgagctgctcgcagacctcgacgtacccctcgtacggcgtgaccatgaaacaggtgtgggtgaagtccgcgagctgcgcggaggcccgccgcacgacggcctcggcggacgcgccgacggaggtcacggcgatcccggacccgaagtcgatcagacggttgccgtccacgtcctcgatgatcccgccgcccgcacgggcgg

SEQ ID NO: 2844 - DNA, 6984 bp, Unknown
  Kingdom: Bacteria, Phylum: Actinobacteria, Class: Actinobacteria, Order: Streptomycetales, Family: Streptomycetaceae, Genus: Streptomyces
agtcgcagggcagaccgtcccgaactggacggtctgccctgcgacttcttctactccgtcaccgactgcgacccgggagcggtcctcggggtggccgcccagcggctgatggaccgattcgcccagctcgccgtcatcgccgcccgcgaggccgtcgccgacgccggactcgaccctgccgtctgggacagcgggcgcgtcggcgtcgtcatcggctccgcccacggcggactgcccttctacgacgagcagcacgccgcgctggccgggcgcggaccccgccgggtctccccgaagctcgcaccgctcagcgtcgtcaacggcgcggccagcagcgtcagcctggacctcggcgtccacgggcccagccaggccgtctccaccgcctgctcctccggcaccgtcgccatcggcaccgcccaccagatgctccgctccggtgcctgcgacatcgtcgtcgcgggcggcgcggaatccacctgcacccgcctcctgatcgccagcgcctgcagcctcaaggccgtctccacgcgccgcgaggaccccgcgagcgcctgccggcccttcgacacccaccgggacggcttcgtcgtcggcgagggcgccgggctgatcgtcatggaacacccggaccacgcccgcgcccggggagccgccgtccgcgcccgggtgagcggctacggggcttccagcgacgcccactccgccgtggcaccggaccccgagggcctcggcatcgaacgcgccctgcgcaccgcgctcgccgacgccggcctctccccggccgacgtcgggcacgtcaacgcgcacggcacctcgacgctctccaacgacctgatcgaggcgacgatgctccgccgggtcctcggcgacagccccctggtgacctccaccaaggcgatgaccggccacaccctcggcgcggcgggcggcatcgagaccgcgctcaccgtgctcgccctccagcggcaactggtgccgcccaccgtcaatctggacgcacccgacccgcagatcccgatcgacgtggtggccaaggaggcccgcggcgcctccttcgactgcgccgtcaagacctcgctcggcttcggcggccacaacgcggcactcgtcctcaccagggcctgagcggaagggaacgcaggagcatatgcccgaggagatcatccggaccctgtcggtcgacggagtgcgctacagctaccgcgtcctgccgggcgcccaccccggtgagcccccggccaccgaaccgacgctcattctcggcggcgcgctccagggcatgttcggctggccccagatggacgaccacctgggcccggcgaccgacgtgatcaccgccgacctgcccggcatgggcagcgccgacccgctcccgtccggccccagcgccgatctgctgcgccgggccgtgctcggcatcgccgacgacctcggtgcgccccggctcaacgtcttcggcttctcctacggcaccgccatcgccttcggcttcgcccgccgccatcgggagcgggtggcacgcctggccctcggcggggtcccggtccacatcgacgcggcccaggtcgcctgctgggagcgggcccggcagcagctggccgccggggaccgcgaggggttcgccgcgacggccgccgacgcgttgatgtgcctggaccccgaacgccccgtacaccggcgggaactggcccgccggtatgtacggcggtccttcctgcacgcgctcacccactcgccgcacgcggcggactcgttgtaccgggcgctggccgaccggcccgacttctccggcggtctcaccggcgtaccggcgctggtcttcgccggggagcacgacacggtgacgccgcccgcgcggcagcgggagttcgccgcgacgatcgagggcagccggttcctgacgatcggggagtccgaccactgggtggtcctggagcgggccgacgaagtggcctcgctggtctcccggttcttcatcgggcgggagccggtggccgacgagaccggtgccgtcaccctgccgcgccaggcgggtgccccggccgggcggacctgaacgcggccccggcggggcggaccggcgatccggcccgcaccgccgaggacgtgcctcagtacgtcagtgccagaagccgccgccgaccttgacccgcaccacctgcgggtcgtggtcgctcgcctggtcggcgaactcggcgttgatgtgcaccacgtcgtagtcggggcgccggatgccggggctcgtcaggatgtggtccagggtctgcgagttgccgtcgaagacatagctgtaccgctccgacgaggggagcgtcgtgatcagcggcttgagcgccctgccctcggtgagcgccttcatcgtcggggagaactcgaagtcgttgaagtccccgagcgcgacgaccttggcgttcctgtccgccttcagcagcgcggcgacgaaggtgttgacctcggctgcctgctggatccgcttcgtctccgaggaacgcgtcggctcctggtagcggccgtgcagcgactggtcgccgcccttggaggcgaagtggttgccgatgacgaagaccggcttgccgcggaagacgaactcgcccaccagcggcttgcggctgtccgcccacgccgggctcgccgggttgatccggcccggggacgcggagagctcgacgcccttccaggtgtcgacggcgcgcaccggggtggtggcgtcgccgcccgcgcggtcggtgaaggagacccgctgcgggttgaagaggaggacgttgcggatgttgccgccgggctcgccgccgtccttgttgttctccggggcgatgtagcgccaggcgtagcgcggcccgcccttcgcgacgatcgcgtcggtgaaccgcttcagcgtcccctcggaacccgtcgtgccgtcgttcaccgcaccgttgtcgtcctggatctcctccagcgagacgatgtcgggggaggacaggttgaccgcgacgccctcggccagggtgtcgaacttggcctgggcgtcgcccgcgtcgaggttctccacgttgtacgtggcgaccgccagctcgttcttcttctgcttgcgggtcacctcgcgccgcagcttcttgtcgacgatggtgcccagctcggtggcctgcacgttgtagccgccgtagctcgcgtagtcgagcacgccggtggtgcggcccttcagcacgtccccgacgttcgccgtggggaccggccgcgccgggtccagcgacatcaccttgaggcggccggtgttctggtcctcgtacgaggcgtagagcgtgccgccgcgccgggtcgggttctcccccggcttcacggtcacccagatctcgtcgtacgcggtcgtcgccccggtcacccgggtgtcggcgaactcgacccgggagccctccagcgcctcgtacaggtccagcgcgtaccgggacggctccaggggcagtgcgtcgatcgccccgccgcccgccgagggcacgtaacggccgggcaccgaacgggcgtcgaggacgaccggagcgggcagcgcgttgccggaggacaggacggtggtgcggggcgcggtgatctgggtgagggactgggtgccggtacccgggtagtactccgcgaccttgccgctgaccaggaccgcgtcgccgaccttcacggccggtgcggtggagccggtgtagacgaacaggccctcgccggtgcgcgcgtcaccgtcgggggccgtgtcctggatccagaagccgcgcgagccactggcccgcaccccgatgacgacgcccgggacgccggtcaccgacgtgccgtccagcggggagacacgggtggtgccctggatgtcgtggatccgtacgtcgccggggtcggtggggccgggctcctccggctcctgcccgccgccggaggtctcgcccttggcgttgaccggcgtcggggtgcccgcggagaggtcggccgcgttgtcgtcggtgtcggcgagcgaggcggcacgcgcgacggacgccgtggcggacgcgccggcgaccgggccgccgccctcccggacgaccgcggagccgtagccgaccaggtcgacgatccggggggccgccgcacagtccgccgccgacttgcaggtgagcggggccgtcccggaaaccagggcgacggtgccgctccccgccgccatggcgaccgtgccggtggcgtcggcggtgggcagcgcgacggttccgccggtcccggcggcctgcgtgaccaggtagcggctgccgggtgcgatcgacccggacagctcggagacctgccactgcgagccggccgacgggctgcccggcaggtactggacgctgaggccgccgacctcgaagggcgcggagccggcgttggccagctcgacgaagtcccgggtcagcgtcgcgccggagttgcccccgccgccgtacacctcggagatgacggcggtggcggacggggccgcctgggcggcggcgggcagggcggtcaccgcgagagcgacggcgacggcgccggtcagcagaacggaaccggatctgtgtatctgcacgggaggtgcccccaactgagtagtaggggcaaaaactatgcgcgtagaacgggcatgacaaggcgtcgggggttaattccgggtgtatcccggatgagaaccccgtgcgggtgcctggtgaggtccgggagaggaccgcgccagacacccgcacggcagcgcccgccccggccggtcggcctcggcggggcggacggagtcaccgggtcactggcggatgcgctcgcggatccagaccccggcctccttcaggaccccggttcccgtccagttgttcccgtcgcaggtgccggtcttgaagacggctccggaacggtggtcgtcggagtagttccagttggtccaggagatcttcttgcgcttcatcaggtcgaggtagcgctgcgacatggtgaagtcgttggcgccctcgcccgcgtagttctgcgtgccgaactccgtgacgaacacgggcagtttgtcggaggcccggtcgagtgcgttcagatactcctcgcggtgcgaggccgcgtagaagtggaaggtgtacatgatgttcgaggcgcggacgggattgttcacgacctccttctcgtcggacccctcggacaccccgaaggaggaccaggcgcgcgtcccgacgagcaccaccgcgtcggggtcctgggcccggatcaccgggatgatctgctcggcgtacgacttgatgcccgaccagctcacccccgagggctcgttggcgatctcgtagagcacccccgggtggttcttgtactttttcgccatcgccgtgaagaaggtcttcgcccgcgacaggttcgcgttcgggtcgcccggggagagcatgtgccagtcgatgaccgcgtacatgccgcgcgcgtgcgccgcgtcgacgaacttctgcgcacgggcggtgaacccggccgggtcggtctcgtacccgccctcctgtacgtacgtggagacgcgcagcacgtcggcacgccagtcctgggccagggcgttgagcgatccgtccgtgacgcactgggcgtaccactgggtgccgtgcgtgctcatcccgttgagggcgaccgcctggccggagtcgttgcagagctgacggccgcagacggagagctgtccgttggcggcgagcggggtggcggcggtgggggagacgggggccggtgcggctcccgcccggacgggagccatcagtgcggtgacgacaccgagcgcggacgcggcgagcagggccttgcgtgccattctgcggcgtccggtcgtggggacggagccggtggggggagtggtgcgctggtgcatggtggtgctcccttcggagggggtgggaggcgccatgtcggcagaactgaaagtaaagcttccttccaattgtcgtcaacagcgttgggaaactttcctgcctattaacacgcgtggcggaagggcctgttgggaccctcccgccacgcgtgcgcccctgtgcgccggtatgtcggtgtgccgcccggccctcccgggtcgctcagccctgcggcagcggatagaccgccagcgagaacgaatggcccgcggggtccccgtacaccctcacgtcccgggggccgctgttgttgtcgccggtgtcgacgggccgcgcgcccagcccgatcgcctcccgctcggcctcgtcgatgttctcggggtcgaccaggatccgcagatgagcctgctgcgagtcctccgggcgcggccagctcggcggggcgtagccgtgatcgcggcggatcgccagccggacgccgtcgtttccgacgatctcgacgaaatcggggtcggagccgatccgtatctccgcgtcgagcaggccggcgtagaactcggccagctccacgggctcggcgcagtcaaggacgaggacgctcgttttctccacagtcatgcgggaacgagtacccccgccgggcgcggacacgccgcaccggacccgtccgggaatccggaagccgggccaccggcgcggacgcgtcccggatgaggaaacaccgcatgcgacctaaggtgcgaaccatggctcagagcgcggcgcatcccggtccggccgggcgcgacgccgcccccggcggccccgacccccggcggtggcaggcactggcagtctgcctggtggcgggcttcatgaccctgctggacgtctccatcgtcaacgtggccctcccctcgatccgggagggtctgaacactcccgagtccgacctccaatgggtgctctccggctacgctctcgccttcgggctcttcctcatccccgccgggcggctgggcgacgcgcggggtcgccgggcggtcttcatggcgggactcgccctcttcaccctggcctccgccgcctgcggggccgcccagtccagcatgtggctggtgatcgcccgactggtgcagggcgtcgcgggcggcctgatctccccgcagatctccgccctgatccagcagatgttctccgg

SEQ ID NO: 2845 - DNA, 5028 bp, Unknown
  Kingdom: Bacteria, Phylum: Actinobacteria, Class: Actinobacteria, Order: Streptomycetales, Family: Streptomycetaceae, Genus: Streptomyces
ggtcagcgcgtccagcaggggtgctcccccggaggctccggcctccgggcccacgaggttcacggagttcacggggtccccagagttcacggggtccacagggttcacggggatcatcgtgcggctcctccggtcgggatcgggacccgcggggagtgcgggccgatgcgttgcaacgtaccggcgagccggacgcggtgagcgacgtccccgctcggacgaggcggcccttgcgactgtccgggcgaccccctcaccctctcaccccctaaaacgggttcaatccgcccaaacggtcctacggtggccgagtgaccgagccctcagaagccaccgcagccgccgagccccgtgcacccggcggccccgcggccacgcctcccgccgctaccggcccccggtccgtcaccacccgggcgacgctcgccggagtggctgtctccgccctgctgatcctcgcgatcgtgctcggcagccgcatgctccacaacttcgactcggccctcctcccctacgccgtggccacagtcttcctcgccttcggcgtcgcctaccggtacaccgtctggatctccgcccccggagcccggcgcctcttcaaacagggctggcgcagcctcttctccgtggacaacttccgcagggccccgacggccctgccgaagatgatcgccacctatctgggcttccagaagttcctcggcgcccgctcccacgcccgctgggcagctcaccagctgatcttctggggctgcatcctcgccgctctgatcaccttcccgctcacctggggctggttcaccttcacttccggcagcggctcggggcccggatacgagatgcggatctggggcttcaagatcctcggattcgactcgctcaacgtgctcggctggctcatgttccacggcctggacatcgccgccgtcctcgtcatccccggcgcctcgtatttcctgtggcgccgcatgaaggaccgcggcgccgccaccggccagcgcttcgcctacgacctggtaccgctgatcgcgctcatcgtcatctccgtgacgggactgctgctcaccttctcctcgatcttcctccacggcggcggctaccagttcctcgcgatcctgcacatggtgtcggtcgtcttcacgctcatctacatcccgttcggcaagttcttccacatcgtccagcgcccggccgcggtcggcatgcagctgttcaagtacaccggccgcaaggacgacgaggtgttcgcctgccgccgctgcgaggaacccatcgacaccggcccctatgtcgagaacctgcgcggcaccatgcgcgacctccggctcgacttcgactcctgggccgaatactgcccgcgctgcaagcgggtgctgcgcggcagcgcctatctctcccatgtgaagaagggcttcaagtgaccgcggatccgcgagctgctgccgaccgccgaacgttcatccccctggatccctccctctcccctcccggcacccgcgccttccgggacgcgggcggcatcccggccgaccagtggcatgccgaccagaacggcgagacgctcgtgccgacgcactgctgcttctgcggcgtccagtgcgggatgtatctgcgcgtggaccgcggcggcaaggtcttcggcgtcgaaccccgcaaccacgacatcaaccggatgcggctctgccccaagggcatcaacgcctaccagcaggtcaaccaccccgaccggctcaccgccccgctgatgcgccgctcccgcgacgaggagttccgagaggtctcctgggaggaggcgctcgacttcaccgtctccgagatcaagcgcatccagcagacccacggcaacgacgccttcggtctcctcggcggggccagcctgttctccgagaagacctatctggtgggcaaattcgcccgggtcgccctcatgacccggcacgtcgactacaacggccgcctctgcatggtcagcgcggcgggcgccaacaagctggccttcggcatcgaccgggccggcaaccccttctccgacatcctgctcaccgactgcctgctcatcgcgggctccaacgtcggcgagtgcttccccgtgatgacccagtacgtctggggagcccgggaccgcggggccagcctcatcgtcatcgacccgcgcgagaccgccatcgcccggaccgccgacatccacgtcgccctcaagcccggcaccgactccgccttcttcacctccgtcctgcacgtcgtcatcgaggaagggctcaccgacgagaactacctcgccgcccacgccaccggctgggaggaggtcaaggccaaggccgccgaatacccaccctcccgtgccgcggcgatctgcgggatccccgccgagcagatcgtccaggtcgcccggaccttcgcccgcgcgcccaaggccatggcctggcacgcccggggcatcgagcaccactcgcagggcgtcgagaactgcctctccgtgatcaacctctgcaccgccaccggccacatcggcaaacccggcgccggctacggcaccatcaccggccagggcaacggccagggcggccgcgagcacggccagaagtccgacctcctccccggcggacgctccatcatgaacgaggagcaccgccgccagatctgtgagatctggggtatcgaggagtccgacctcccgaccgccgggacctccatgatggaaatggtctggcagatgcagcgccgcgagatccgcggcctgatcggcatctgcaacaaccccttcgtctccctgcccaactaccgggtggtcaaggaggggtacgacaccatcgagttccacgcgcaattcgacttcttcctctccgagaccgccgccaacggccatgtcgtcttccctgtcaccacctgggccgaggacgaaggcgtgatggccaacgccgaagcccgcgtggtcaagcacaacaaggcccaggacccgccccccggcgtccgcaccgacacctgggcgatgtgcgaactcgcccgacggctcggcgtcggcgacaaattcgacttccccgactcccggtcggtcttcgacgagctgcgcgtcgcctccgccggcaccgtcaacgactactacggcatcacctacgaacgcctggaggagaccggcggcatcgcctggccctgccccaccaccgaccaccccggcaccccccgcctcttcgaggacgggaagacctaccaccccgacggcaagatccacctccaggtcgtcgaatggcacccgccgatggacccgtacgacgacgagcaccccatgtcgctcaccaccggccgcaccgtcgcccacttcctctccggcaaccagacccgcaggctcggcgccctcgtcgaacagaccccgcgaccctgggccgagatccacccctcccacggcttccgcaacggcgagcccgtccgcgtcgtcacccggcgcggcagcgaggtcttccccgccctggtcaccgaagcgatccgccccgacaccgtgttcgtcccctatcactggcccgtccccaccgcggccaacgccctcaccatcgacgccctcgacccccggtccaagatccccgagtacaaggtgtgcgcctgccgcatcgagcacgccgagcggatcgacgaggtacccgccccgccggtcgctcccggccatgtcgcctacccggagacccaggtctcccgtaccgacccgctgcctcccacggcccctcagggccgtggcacctcggagaggagctgaggccccgtgatgggcagaacgatcttcatcgacccggggcgttgcatcggctgccaggcctgtgtctccgcctgccgcgaatgcgactcgcaccgcggaaaatcgatgatccacctcgactacaccgacgagggccactccgtcgcctctctccccaccgtctgcatgcactgcgaggacccggtcgccccgtgcgccgaggtctgccccgccgacgcgatcctggtgaccgcggacggcgtggtgcagcaggccgacaccacccgctgcatcggctgctccaactgcgtcaacgcctgccctttcggcgtaccgaagatcgacctccaggcgaagctgcagatgaagtgcaacctctgctacgaccgcaccgcctacggcctcgcccccatgtgcgccaccgtctgcccgaccggagctctcttctacggaaccgtcgaggagctccaggccgagcgccccggagtccaggtcgccgacaccttcgtcttcggcgagaccgaggtccgcaccggcgtggccatggtcgtccccgccgaacgggtccagtggccggtccccggcgggcttcccgtcgtcgagatcaacgggaaggacgtccgccgatgagcgtcaccgatcagcagccgggtgccgagcaccccgccgggggagacccgcgcgaggcgctccaggaccggatcgccgccgactccctcaccacccgccgggactacctccggatcgtcaccaccgtctccggcggtctcgccgtcggcggcatcggggtggccgccggcatgctccaccgccacggtgacggcgaggagggcaggacccccgaggcgaagcgcatcgccgggggactcctgcccggcgagtcgatcgctttccgctacccgggcgaggaggaccgggccgtcgccgtccgcctcgacgacggcaccctcgtcggctactccgccgtctgcacccacctcgcctgcgccgtgctctggcgcaaggacaggggtacggagggcgagctgtactgcccgtgccacgaaggagtcttcgatgcccggtccggcgaggtcaccgcgggaccgccgccgcgcggtctgcccaaggtcgtggtcatcgagcaggacgacggcagcatctgggccgtggggaccacccgctccggcgagagcatcgagggaggcctctgccgccagctcggcggcgaccgccccgacctcgcctcccgtatcggctgccccgacatcggaggcggagccgaagccccgccccgggccgccggtgcacgagcgcgcaaccgg

SEQ ID NO: 2846 - DNA, 5089 bp, Unknown
  Kingdom: Bacteria, Phylum: Actinobacteria, Class: Actinobacteria, Order: Streptomycetales, Family: Streptomycetaceae, Genus: Streptomyces
ctggccggcgccgtcgtcatgatgacgacggcgccggccaggagcgggttcctcatcggatcagccattcctcagggcgtagtgcgcgctgacctgcgaagcgctcagcgtggtcgggtagacggcggtctcgtcgatctgcccggcgaagaagttgctggtgggtcggctcggccagccggacaggctgtccccgccgacccgccagtagccggggttgccgtcgttgccggagaccaggatgttcgacgcgcgcagctgcccgtcgacgtacagcgccatgccctgacccagggggccctgggtggcgacgacgtggtgccactgtccgtcgttgtaggcggccggggtggcgacggtccgtgccccactgctctgcacgccgaacacgagccgtccgtcgttgcgcatgtagacgttcttgtcctgacgggtgctgttctgctgcgtcatgttcccgaagccgatgatcttcccgcctcgggtggtggtggtcctgatccaggtctccaccgagaagcgggccggtgcggcgtgccgccggttgctgtacgcgtagtcgtcggcgccgttgaagccgatcgccgtcgagggcccggcgaccgctgccggggtctgccggtaggcggggccgttgcgcaggaagccgttgtccaggttgtcgctgctgtcgtgggcgaacgtggaggtgccctcgtcgtagcgccagtagaggcccgctccgtcggatctgatccgggccggatacgcctccgtcgcgttcgccacggtcgcggactgggccggagacttggcactggtgttggtgccgtcgctcgcggtgatccggtacgagtgggtctcgcccggctcgacgtcggcgtccgtccaggtcagctggggccggtcccagaagacggagtaaccggccgtcgtgtggaccggggtgttcgatccgtccttgtagatccggtaggtcagctccccgtcgtcggtgtcgaagctggtctgccagttcacgtcgatccgccccggggtcagcgtggacaggctgacgttcggcacccagggcgtgcccgtgtccgggccgtccgcgaaccgggtcagaccctgttgcggcttgctgttgacggtggtgaactcgccgcccacccacaggtagtggctcccgccgctgctcgcctgggtcatcacgcgcggtccgaccggctcgccgatgccgtcgttggtgtccgggaaccaggggagcagcttcgggtcgtcgaccgactgggccagcagatgcttgcgctgctggtccgggaaggcccccatactggagcagtcgtgggcatggctgccgctgtacagcacacccgagtgcaccagcaccgcctgggtcgcgccgaggcaggtgtcccgccagcgctggtcgaagtcgtcgaggtccagcgcgatgcgcccgtcgaacaccccgccgccggtgccctcgttgccggtgtagaagccggtggcgtcggtggtgatgtcctgcacggtggagttgttgtggatgaaccccgggtaggccttggtgagttggccggtggtcgcgtcgaccacggccagggcgtgggtggtcgtgccgttgatgcggaagaagtctccgccgagcagcacgtgctgcccgtccggggtcacctcgacggccctggccacctcgtcggcgttggccgtgaagggcagcagcgaggctccggtcgtgacggcggcgaagtggttcctggtctgcccgccgaccgtggtgaagtcgcccgccagatagaccgtgtcgtcggtgacggcgagcccccgcacggtcgccgagaccccgatcttgaaggagttgctgaccgtgcaggttgcggtgtcgatcgccgcgatgttgctcacgccgactccgttcaccgcaccgaactggccgcccgcgtacagggtttcgccgtccggggacagcgccagggcgcggacggtcgcggtccccgaggagatggtgaaggacagtgagcagtcggtgggcgccccggtcgccgcgtcgaacgcggcgaagttcaccgcgggctgttcgcccgttccgggagcggcggtggggggccgcagggtggagaaggtgccgcccgcgtagacgacgccgtcgccggcggccatcgaccagacgatgccgttggtctgccaggtggtgaggtcgtccgcggtgatggcgaccggtggtgtcagcgccgccgccggagaggtcccggccgcggtcgcggtcagggctccggccagcaggccgagagcggcggaagcggcccgcacacggccgcgtcctccggttctctgccccgtacttccgttcatcattcagctccgaaggtgagattcgagctgcggcctggaggccgcggatcctgcctcgcccgaccggacgcgcggactgtccgtcccgcggccggccggggcgagtgagtaggcggagccgagggccccgcccggtgccggcgcggagagctccaccgggtggtcggtggagacggcggtcgcgccggtgatcgtcccgagcgcgggcgcggctggcgccggccgggaggtgtgggtgaccgacggatcggtccgggctccggtgaccggcgcccggtggtggctgtcggccgagccgtccccgggcaggtcgggacctccggtcggacccgcgggaacgcgccgcccggcccggtcatctgtccacccggacggcggccccggtcagctggtcgtccagccggcggatgtcggcgtcgaccatgatgcgggccagctcccgcgacttcacctcgggcttccagcccagcagttcctcggccttcgaagcgtcaccgatcaacgcgtcgacctcgctggggcgttcgtacttcgggtcgtaacgcacgtgctcgcgccagtccagtcccgcgtgctcgaaggcgaactccaggaactgccggacgctgacgccctcaccggtggcgaccacatagtcgtccggggtgtcgcactggagcatccgccacatggcgtccacgtactccggcgcgtatccccagtcccggaccgcgtccaggttgcccaggtgcagacggtcctggagcccggccttgatccgggcgacgccacgggtgatcttccgggtcacgaaggtctcgccccggcgcggcgactcatggttgaagaggatgccgttcaccgcgaacatgccgtacgcctcgcggtagttgaccgtggcccagtaggagtagaccttcgccacgctgtacgggctgcgcgggtggaagggggtcccctcgttctgcgggggcgggctggcgccgaacatctcggaggacgaggcctggtagacgcgggtctggatggcactggcccggaccgcctccaggagccggacggtgccgagccctgtgacgtcaccggtgtacagcggggcgtcgaacgacaccctcacatgcgactgcgcgcccaggttgtagacctcgtcgggctggatgtcgcgcagcaggttcaccagggccacgccgtcggtcaggtccgcgtggtgcaggacgaaggagcgctccggctcctcggggccctggtagatgtggtcgatccgctcggtgttgaagctcgaggagcggcgtatgaggccgtgcaccgtgtaccccttgtcgagcaacaactcggcaagatacgaaccgtcctggccggtcactccggtgatgagcgcggtcttcgccacgattcccccttctctgctgatcgcctcggcggcgacgttcaccgacatatcggaattggtgcgttctgcggcaaagtgtcaccgcagtccctttctgctggcacaatccgagccatgacgaccgaactccccaccccctcccaggaatccgcccgcccgctactgcggcccggctcccgcatattcgtcgcgggccaccgcggcctggtcggctcggcggtggcccgccgcctcaccgacgacggccacgaggtgctcacccgcggccgcgacctcctcgacctgcgcgacgccgcgcggaccggggcgtatctgaaggaggtccgcccggacgccgtggtgctggccgccgccaaggtcggcgggatcatggccaacagcacgtacccggtgcagttcctggaggacaacctgcgcatccagctcagcgtgatcgcgggcgcgcacgcggccggcaccgagcggctgctcttcctcggctcgtcgtgcatctacccccggctcgcaccccagccgatccgcgaggacgcgttgctcaccggcgagctggagcccaccaacgaggcctacgccctcgccaagatcgccgggatcgtccagacccagtcctaccggcggcagtacggcgcctcctacatcagcgccatgcccaccaatctctacggacccggcgacaacttcgacctggagacctcgcacgttctgcccgcactgatccgccgcttccacgaggcgcggcgggacggtgcccccgaggtgaccctgtggggctccggctccccgcgccgcgagttcctccacgtcgacgacctcgccgccgcctgcgtcaccctgctggaggcctacgacggcgacgagcccgtcaacatcggctgcggagacgacctcaccatccgggaactggcggagaccgtacgtgaggtgacgggataccagggacgcatcggctgggacgcctcgaagcccgacgggacaccccgcaagctgctcgacgtcacccgcctctcctccctcggtttcacgccgaagattccgctgcgcgaaggaatcgcccgcacctacgcctggtggctcggacaactcccgtccggacagtgaccgttcgccgccgccgagggacgtcccgcggcggcgcaccggctgtgctcctcgcatccgcacgcccccgctctcagtacgccccgcggccgtcggcgacggcgcgcacggtgcgggcgagaagtcccatgtcggcggccaccgaccagttgtcgacgtaccagagatcgagcgagacggtctcctgccaggtcagatcggagcggccgctcacctgccacaggccggtcagccccggcttcacggcgagccggcggtgctcccgctcgtcgtagcgcgaggcctcctccggcagcggaggcctcg

SEQ ID NO: 2847 - DNA, 10813 bp, Unknown
  Kingdom: Bacteria, Phylum: Actinobacteria, Class: Actinobacteria, Order: Streptomycetales, Family: Streptomycetaceae, Genus: Streptomyces
ggccgcagcgggggccggagcttccggggatgtcggtgtcccgcctcccggtgtctgggccaggacctccagcacgccctccccgtacgtcgcgagcttcttctcgcccaggccgctgacgccgcccagctccgcgagcgagctcgggtgcagcgtcgcgatctccctcagcgtggcgtcgtggaagatgacgtacgccgggacgccctgctccttcgccgtcgcgccgcgccaggagcgcagcgcctcgaagaccgggaccgcggactcggggagatcggcgacggccgccttgcccttggcacccgtgccgccgcccgccgaggacgacgagcgggtcgtgggcttcttgggttccttgcggagcagcacgtcccgctcccgccccagaaccgtcgcgctctcgtcggtcaggaccagcgtgccgtactccccctcgaccgcgagcagtccctgggccagcaactggcgcaccacaccgcgccactccgcctcggccaactcctcaccgatgccgaagacggagagctggtcgtggtcgaactggatgaccttggcggtcttgcggcccagcaggatgtcgatgatctggcccgcgccgaacttctggttccgctcgcgcttcagccgcaccaccgtggagagcagtttctgcgagacgaccgtgccgtcccaggtctccggcggggccaggcaggtgtcgcagttgccgcaggcgggggccgtgggctcctggccgaagtaggtcagcagctgggcccggcggcactggaccgtctcgcacagggccagcatcgagtccagatgggaggcggcccggcggcggaaggcctcgtcgccctcgccgccctggatgagcttgcgctgctggacgacgtcctggagtccgtaggccatccaggccgtcgacggctccccgtcacggcccgcacggccggtctcctggtaatacccctcgacggacttggggaggtcgacgtgcgcgacgaagcggacgtccggcttgtcgatgcccatgccgaacgcgatcgtcgcgacgacgacgagcccctcctcacggaggaagcgcgcctggtgggtggcgcgcgtcccggcgtccaggcccgcgtggtacggcacggcctccacgccgttgcggcagaggtactccgcgatcttctcggtggagttgcgcgagaggcagtagacgatgcccgcgtccccggcgtgctcctccttgaggaaggcgaggagctgcttcttgggctcggacttcggcacgatccggtactggatgttcggccggtcgaagctcgcgacgaagtgcttcgcgtccggcatgccgaggcggcgggtgatctcctcgtgcgtggcgtgggtcgcggtcgccgtcagggcgatgcgcggaacgtccggccagcgctcgccgagcacggacagggccagatagtcgggacggaagtcgtgaccccactgggcgacgcagtgcgcctcgtcgatcgcgaagacggagatctcaccccgggccagcagggagagggtggagtccaggcgcagccgctccggcgccaggtagagcacgtccagctcgcccgcgaggaactgcgcctccatcgagcggcgctcgtcgaagtcctgcgtggagttcatgaagccggcccggacgccgagcgcccgcagggcgtccacctggtcctgcatgagggcgatcagcggggagacgacgacgccggtgccccgcctgaccagggacgggatctggtagcagagggactttccgccaccggtgggcatgagcacgaccgcgtcgccgcccgccaccacatgctcgatgaccgcgccctgctcaccgcggaacgactcgtacccgaagacgcggtgcagcgtccgccgtgcctcgctctcgccgtccgtatcggtgccggcgtcggtcaccgtcccggtcacatccatggtcacacccaatgctctgtccccgagggccgcacgcccggccctgtccgtcctgctcgtccccgtccacgataggcggaggcaacgacaacgccggacggtctgtggaaaaccgaccgtccggcgctgctgacacgcatactgcgcggctaccgcacgaacactcccgcctggctcgccaggtccaggaagtactgcggggccaggcccagcaccagggtgacggcgacgccgaccgcgatcgtcgtcatggtcagcggggacgggacggcgaccgtggggccgtccgccttcggctcgctgaagaacatcaggacgatcacgcggatgtagaagaacgccgcgacggccgaggagagcacaccgacgacgaccagcccgccggctcccccctcggcggccgccttgaacaccgcgaacttcccggagaacccggaggtcagcgggatgcccgcgaaggccagcaggaacaccgcgaagaccgcggcgaccagcggcgagcggcggccgagcccggcccacttcgacaggtgggtggcctcgccgcccgcgtcccgcaccagcgtgacgacggcgaacgcgccgaccgtcacgaaggagtaggccagcaggtagaagaggaccgaggagatgccctcggggctggccgcgatgacgcccgcgaggatgaagcccgcgtgcgcgatcgaggagtaggccagcagccgcttgatgtcggtctgggtgatcgcgacgatcgcgccgcccagcatcgtgacgatggccaccgcccacatgaccggccgcaggtcccaggcgaggccgggcagcgccacgtacagcaggcgcagcagcgcgccgaacgcggcgaccttcgtcgcggcggccatgaagccggtcaccggggtcggggcgccctggtagacgtccggggtccacatgtggaacggcaccgcgccgaccttgaagagcaggccggtcaggatcatcgcgccgccgatgagcagcagtgcgtcgttgcccatggtgtcggcgagggccgggtcgatctccaggacggagccgtcgacgacgttggcgatgtccgcgtagccgagggagcccgagtagccgtagagcagggcgatcccgaagagcaggaacgccgaggagaacgcgccgagcaggaagtacttcacggccgcctcctgcgacatcagccgcttgcggcgggcgacggcgcacaggaggtagagcgggagcgagaagacttccagcgcgatgaagagggtcagcaggtcgttggcggccgggaagaccagcagccccgccaccgagaagagcaggagcgggaagacctcggtggtggtgaagcctgcccgcaccgccgccttctcaccgtcgccgcccggtacggccccggcctgcgcggcgaacgagtcgacgcggttgccatgggtggtggggtcgagccggcgctcggcgaaggtgaacaccgccaccatggcgaccagcagaatggtgccctggaggaacagggtggggccgtcgatcgcgatggcgcccatggccgcgatctgggccttcgtggtgccgtatccgccggccgcgaggccgacgatcgcggcgaacgaggcggccaccgccaccacggtcaggaagagctgggcgtggtagcgggcccggcgcggcacgaaggcctccaccaggatgcccaggacggcggcgcccacgatgatcaggaccggcagcagctgggtgtactcgatcttcggtgccgtgaacgagttgcccggtgccgccgatgtcaccccgctcgccgtcgtccacagactgtggacagctgttgcgctcacttggcggcctccacctcgggctgggggtccttcttctgtacgtcggacatggtgtgctccaccgccgggttgacgacctcggtgagcggcttcgggaagacgcccaggaagatcagcacggcgatcagcggaagcgcgaccgccagctcccgggccttgaggtccggcatggaccggaccgattccttcaccgggccggtcatcgtgcgctggtagaggaccaggacgtagagcgcggcgagcacgatgccggaggtggcgatgatgccggccaccggatacgcgctgaacgtgccgacgaggaccaggaactcactgacgaacggggcgagtccgggcagcgacagggtggcgagtccgccgatgaggaacgtcccggccagcacgggagcgaccttctgcaccccgccgtagtccgcgatgagccgcgatccgcgccgggtgatgaggaatccggcgaccagcagcagcgcggccgtcgagatcccgtggttgaccatgtagagcgtggcgcccgactggccctggctggtcatcgcgaagatgcccaggatgatgaagccgaagtgcgagatcgaggcgtaggcgatgagccgcttgatgtcgcgctggccgaccgcgagcagcgccccgtacacgatggagatcagcgccagggtgatgaccaccggcgtcgcccacttgctggcctccgggaagagtccgaggcagaagcggagcatcgcgaaggtgccgaccttgtcgacgatcgcggtgatcagcacggcgaccggagcggtggcctcgcccatcgcgttggggagccaggtgtgcagcggccacagcggggccttcaccgcgaaggcgaagaagaacccgaggaacagccaccgctcggtgctggtcgccatctccagcgagccgttggcgcgggcctcggcgatctcggacagcgagaagctgcccgcgacgacgtagagcccgatgacggcggccagcatgatcaggccgccggccaggttgtagaggaggaacttgaccgccgcgtaggaacgctgggtcgcggcgttctcgtcgctgcccgcgtgggcccggtcgccgaagccgccgatgaggaagtacatcgggatgagcatggcttcgaacaggatgtagaagaggaagacgtcggtcgcggtgaacgacaggatcaccatggcctcgaccatgaggatcagggcgaagaagccctgcgtcggacgccagcgcgaggacttcgtctccagggggtccgcgtcgtgccagcccgcgacgatgacgaacgggatcagcagcgcggtgaggccgagaagcgccaccccgatgccgtccacgcccagttcgtagcggacgccgaagtcggcgatccaggaccgggactcggtgagctggtagcggtcgccgcccggctcgaagcggaggaagacgaccgccgccaggacgagcgtgccgagcgagaagagcagcgcgagccatttggccgcggtgcgccgcgcggcggggacggcggcggtggcgatggcgccgatcgccgggagcgccgccgtcgcggtcaggaggggaaaggacatgtgatcagaccgccctcatcagcagggtcgcggcgatgacgaccgccgtaccgccgaacatcgagaccgcgtaggtgcgggcgtagccgttctgcatcttgcgcagccggccggagagcccgccgaccgaggcggccgtgccgttgacgacgccgtcgaccagggagtggtccacgtagaccagcgaacgggtgaggtgctcgccgccgcggaccaggaccacgtggttgaagtcgtcctggaggagatcgcggcgggcggcccgggtgaggaccgagccgcgcggggcgacgacgggcacgggcttgcgcccgtacatcgcccaggcgatcccgacgccgacgaccagggccaccacggtggctccggtgaccgtggccgcgctcagcggggcgtgtccgtggtcgtaacccgtgaccggctccagccagttgatgaaccggtcgccgatcgcgaagaacccgccggcgaacaccgaaccgaaggccagcacgatcatcgggatcgtcatcgacttcggggactcgtgcgggtgcggctcgtgaccctccgcgtccggctgccagcgcttctctccgaagaacgtcatcagcatcacgcgcgtcatgtagaacgcggtgatcgcggcgcccagcagggccacggagccgaggatccagccctcggtgccgcccttggcgaaggccgcctcgatgatcttgtccttggagaagaagccggacaggccggggaagccgatgatggccagatagccgaggccgaaggtgacgaaggtgaccggcatgtacttccgcaggccgccgtacttgcgcatgtcgacctcgtcgttcatgccgtgcatgacggaacccgcgccgaggaagagtccggccttgaagaagccgtgcgtcaccaggtgcatgatcgcgaagatgtagccgatggggccgaggcccgcggccaggatcatgtagccgatctgcgacatcgtggagccggccagggccttcttgatgtcgtccttcgcgcaaccgacgatcgcaccgaagatcagcgtgaccgcgccgacgatgaccacgaccgtctgggcgtccggggcggcgttgaagatcgcgccggagcggacgatcagatagacgccggcggtgaccatggtcgcggcgtggatgagggcggagaccggggtcgggccctccatcgcgtcgccgagccaggactgcagcggcacctgggccgacttgccgcaggcggccagcagcagcatcaggccgatggcggtcagcttgccctggctcgtctcgcccgccgactccagcaccggcccgaaggcgaaggtgccgaaggtggtgaacatcagcatgatggcgatcgacaggcccatgtcgccgaccctgttgaccaggaaggccttcttcgcggcggtggccgcggtgggcttgtgctgccagaagccgatgagcaggaacgacgccagaccgacgccctcccacccgacgtacagcagcaggtagttgtcggcgatgaccaggatgagcatcgccgcgaggaacaggttgagatagccgaagaagcggcgcctgcgctcgtcgtgctccatgtaaccgatggagtagatgtggatcagcgtgcccacaccggtgatgagcaggacgaacgtcatcgacaactggtcgagctggaaggcgatgtcggcctggaagccctccaccggaatccagctgaacagatgctggtgcagggcccggtcctcggcgtccttccccagcatgtcggtgaacagaatgagtccgacgacgaacgaggcaccggccaggacggtgccgagccagtggccggtcttgtccagccggcgtccgccgcagagcaggaccgccgctccgagcaggggcgccgcgacgagcagcgcaatcaggttctccacgtttccgaccccttacagcttcatcaggctggcgtcgtcgaccgaggccgagtggcgggagcggaacaacgacacgatgatcgcgagtccgacgacgacttccgcggcggcgacgaccatcgtgaagaacgcgacgatctgcccgtcgaggttgccgtgcatccgggagaacgtgacgagcgccagattgcaggcgttgagcatcagctcgacgcacatgaacaccacgatcgcgttccgccggatcagcaccccggaggcgccgatcgcgaacagcagggccgcgaggtagaggtagttgaccgggttcacttggcggcctccgaattctccgccggggacgcgggattggctccgcgtgccacggcgtccgcgtcctcacgtccgagccgctccccggagcgctgctccagggccttgagatcggcgagggactgctgcgagacgtcacggatctggccgcgctgacgcagcgtctgcatgacggtcagctcggacggcgtgccgtcggggagcagaccggggatgtccaccgcgttgtgccgggcgtagacgccgggtgcggggagcggcgggaggtgcttgccgcgcacgcgctcctcggacatctcccgctgggtcttggcgcgttcggtgcgctcgcggtgcgtgagcaccatcgcgccgaccgtcgcggtgatcagcagggcgccggtgatctcgaaggcgaagacatacttggtgaagatgaggttggcgagcccttcgacgttgccgccgtgccgggcgttggcggcgccgagcccgttgaacgtggacagcgaggcgttgccgatgcccgcgatcagcaggacgccgaagccgagcgagcacccgagggccagccagcgctggcccttgagggtctccttgagggagtcggccgcggtgacgccgacgagcatgacgacgaagaggaacagcatcatgatcgcgcccgtgtagacgacgatctggacgatgccgaggaaatacgccccgttggcgaggtagaacaccgccaggacgatcatggtgccggcgagcgagagcgcgctgtgcacggccctcttcagcaggaccgtggagagcgcgccgatcacggcgacggtgcccaggatccagaactggaaggcctcgccggtcgaggtggtggtggctgcggccagcgcgttcacgctcccacccccttgtcctgccgggcgtcggcggcccgcgtcgactcgatggggtcctcgtcggccttgtcgctctcgcccttggacaccgccgtctgacggaccgtgccgggcgccgcctcggtgaccacaccccggtagtagtcctgctcgtccatgccggggaagatcgcgtgcgggctgtcgaccatgccttcctccaggcccgcgagcagctcgtccttggtgtagatgaggctctcgcgggtggtgttggcgagctcgaactcgttcgtcatcgtcagcgcccgggtggggcaggcctcgatgcagagtccgcacaggatgcagcgcgcgtaattgatctggtagacgcggccgtagcgctctcccggggaatagcgctcctcctcggtgttgtccgcgccctccacgtagatcgcgtccgccggacaggcccaggcgcacagctcgcagccgacgcacttctccaggccgtccgggtggcggttgagctggtggcggccgtggaagcgcggcgccgtcaccttcggcgtctccggatactgctcggtgagccgcttcttgaacatggccttgaaggtcacgccgaagccggccacggggttctggaacttgtcgcccgactcccccgcccggcccgaggacccagcggatcccgatgagcccgtgagctctggtttctcagacaccgccggcctcctttccgtcactcgcgtttccgtcactctgagtatccggtccaccactgacaacgagctcccgctcccgtcgtggtgtacgcctgggcaccggcggcaaggtctgtccgggcagcggaggcaccgggaacccgcccgccatcgggtcgaaggcgggctccgggccggccgcttcctcctcggcccggtgcctgcggtcgcggaacatgtcgacgacgaacgagatcagcaggatcgcgatcacggccgcaccgacgtacagcacgatccgggagaagtcgtagccctcgttgcgcagggcgcggacggtggcgacgagcatcagccagaccacggagaccgggatgaggaccttccagccgagcttcatcagctggtcgtagcggacccggggcagggtgccgcgcagccagatgaagaagaacagcagcagctggaccttgaggacgaaccagagcatcggccaccagccctggttcgcgccctcccagaaggtgctgatcgggtacggagcccgccagccgcccaggaagagggtcacggagaccgcggagacggtgaccatgttgacgtactcggcgagcatgaacatcgcgaacttgatcgaggagtactcggtgttgaacccgccgacgaggtcgccctccgactccggcatgtcgaacggcgcccggttcgtctccccgaccatcgtgatgatgtagatgatgaaggagaccggcagcaggatgacgaaccaccggtccgcctgcgcctccacgatcgccgaggtcgacatcgacccggagtagaggaacaccgaggcgaacgcggcacccatcgcgatctcgtagctgatcatctgggcgcaggagcgcagaccgccgagcagcgggtacgtcgatccggaggaccagcccgcgaggacgaggccgtagatgccgaccgaggcgaccgcgaggatgtagagcatcgcgatcgggaggtcggtcagctgcatcgtcgtgcggtgcccgaagaccgacacctggttgtcggccggcccgaacgggatgaccgcgatcgccatgaacgccggaatcgccgcgatgatcggcgccaggacgtagacgaccttgtcggcccgcttgacgacgacgtcttccttcagcatgagcttcatgccgtcggcgagcgactggagcatgccccaggggccgttgcggttggggccgatgcgcagctgcatccaggcgacgaccttgcgctcccacacgatggagaacagcacggtcaccatcaggaaggcgaagcagaagaccgccttgatggcgacgagccaccaggggtcggtgccgaacatcgagagatcctcggcggcgaggacgacgccctcgggcgccgtcgtgagtgcggcgaggccagtcacgctcgtacctccgatggttcgacgggagcacccggtgcggcggcggggccgatccgcaccaggccgccggggttcgcgccggtgtcggcggggatgccgcgtcccaccgagttcagcgggacccagaccacccggtccggcatgtcggtgaccgcgagaggcagttcgacggtgcccgcggggccggtgacggcgagcaggtcgccgtccttgacgccggactcggcggcggtgaccgccgagagccgggcgacggccgcgtgccgggtcccggccagcgcggtgtcgccgtcctggagccggccgaggtcgagcagcatccggtggcccgcgagg

SEQ ID NO: 2848 - DNA, 1844 bp, Unknown
  Kingdom: Bacteria, Phylum: Actinobacteria, Class: Actinobacteria, Order: Streptomycetales, Family: Streptomycetaceae, Genus: Streptomyces
ggtgcgcccgcgggcgcaccgccggtcgccatgcggtgtccgcagacctcgcaccagtcctcggaacccgactggtgtccgttcgggcaggtcggcatgtcggcgcttccccctctcctgttccggccccggaggccgtcatgctgtcgatcgcgggcgtcgttgcccaacgcatacgtagggttgctctgtgctcacggcccggtggtcgtccgatgaccgtgccgtactacttcttgacgcgaacggtcttggtggagcgcgtttcgagggtcatctcgtccgcttccgcaaccttcgccttcagtcgcacagtacctgtcgcggcatcgacgacgtcgaccaccttcgaaagcagtttcgcagtgtcctggttcccggacgccgacgccagctgcaccgcacggcccagtttcgccgtcgcgccgtcgaagtcgcccgacttgcgtgcgtccagaccctgctggatgacttgtgccagttccgcctgacccgtgtagtgcgcgacctgcggattgatcgaggtcgaggccaccatgtcgtccgtccacacggcccgtacgagtccctgcgagagcgtctgcggagcgcccgcgcccgaggggtcgggcaggatcagtgagaccctggcggccagcatctcctggccgatcccggcctccggcaccaggacgcagacgtggtagtcgcgggactcgtcaccccaggaaccggtcgggtagtccccggcccggggaccggcctcggtccgtcgcccggtcaggtccgcgaccgtgggcgcgacctgcttcacgaaccggatctccacccccaccggcgtccagagccgcagcgccacgtccgcgacctccttgtccatggcgttctccatcatccgcgtgaagtccgcggccaggcccgccgggtcggcgacgatgtcggccgtgccgagaagggcggcggcgatgccggtgacctccttcacctcccagtcggtgcccaccccgcgggcgtcgcaggtgaaccggccggcgcaggagtccagggccgcccgcaggtcctcgggcgcctcgtgctcgttgcggccgtcggtcagcaggatgccgtgccggatgtccacctcggccgcgcccagcagccggtcggccagccgcagccaggtgccgatcgcggtgcccccgcccgcgctcagcttccgcagggcgtccttggcctgggccttcgtctgctggtcggcgaccgcgagccgcccgttgcccggatagacgtccttggccacatgcgtcccggcgaccaccgcgaaccgggtgccctcgcgcagggcgtcgatggccgccgccgtcgcgtcgcgcgcgttgcgcatcttcgtcggcgggtagtccatcgagcccgaacagtcgaccatcagcaccacggccgcgtcgggaccctgccccggcctgtacgcgggcgcgggggccgaacccgccagcggtatgccgccggtggtgccgccgccggtcgaggtcacggtgacgatcgcgttgacctcacgtccgccctcgggcaggaactcgttctggtacacctcgacggagaactgcggcacgttcgacttggagaagttggccatctggtcggctccttgaggctccacaggggatcaggtgaagaggggacgcgggcggctgacacggggtcggggcacggacggaaaaccggctcaaacggtctcgcaggccgatcctgccccttgcggccgtacggcgaacggcacaagcgccactgttacgttgtcgtggcccccgccgtcgagagcgtgcccgacgagcgcctgggccgcgtgcagcggctgttcctgggcgtcggccgggacggcggcggcc

SEQ ID NO: 2849 - DNA, 6533 bp, Unknown
  Kingdom: Bacteria, Phylum: Actinobacteria, Class: Actinobacteria, Order: Streptomycetales, Family: Streptomycetaceae, Genus: Streptomyces
gcggtacgtgccggaggcggcggccgcgacgagggtgggcagaaagcgggcggtggtcgcgccgtcgcggcagtagacgtcggcgtcgggggcggcgggtccggcgggacggccctcgacgtgccagcggtcggcttcccggccgacccggtagccgaggttctccaggccttcggcgaagccctcggtgtcgtccgagcgcagcggcctcagcagggtgctggtcccgtcggcggcggcggccaggaagagggcgcgggcggtgacggacttggagccggggatgtcgatgacggtcacggccctcatcctgccctgcggcgagcaggccgggcggggtgcgtccggtgcgtggacgcgccctgcccggcggcgcggctcagcgcaccggacggtgccggttctcccgggcggagggtcccggggtggcgtccgcgatccaggggccctcgccgctggggtcgacgacgccctcctccagccaggtgtacgtccccgacagcacgccgtcgacgacgcgccggtcgaggtcgtcggtgttggaccacaggcgggtgaacagctcctcgacccggatgcgggcctggtggcagaaggcgtccgcgagctggtaggcctcgcggccgtgctcccccgtcccgcgcaggtactcggcgcggacgcaggcggcgctcatcgcgaagagttccgccccgatgtcgacgatccggccgaggaagccctgcttggtctccatccgcccctgccagcgggacatggcgtagaaggtggacctggcgagcttgcgcgagcaccgctcgacgtaccggaggtgcccggagaggtcgcggtgcccggcggggtggaactcggcgtacgtacgcgggagctgcccgggtcccgcgacgagcctgggcagccagcgggcgtagaacccggcggcgttcgcgcccgctctggccttggcggagaacggcttgtcggggtcgatgatgtcgcccgcgaccttgaggtgggcgtcgacggcctcgcgggcgatcagcaggtgcatgatctcggtggagccctcgaagatccggttgatccgcatgtcccggagcatctgctcggcgggcacggcacgttcgccgcgggcggccagcgactcggcggtctcgaagccgcggccgccgcggatctggaccagttcgtcggcgatgagccagcccatctcggagccgtacagcttggcgagggccgcctcgatacggatgtcgttgcggtcctcgtcggccatctgggaggagaggtcgacgatggcctccagggcgaaggtggtggccgcgatgaacgagatcttcgcgccgaccgcctcgtgcttcgccacgggcctgccccactgctcgcggacggcggaccattcgcgggcgatcttcagggaccacttgcccacgcccacgcacatcgcgggcagcgagaggcggccggtgttgagggtggtcagggcgatcttcagaccggccccctcgggtccgatccggcaggcgccgggcacccggacccggtggaagcgggtgacgccgttctcgatgccgcgcagacccatgaaggcgttgcggtgctcgacggtgacgccgggggcgtcggcctcgacgacgaacgcggtgatgccgccgggatggccctcggacgcggggacccgggccatgacgaccaggaggtcggcgacgacgccgttggtggtccagagcttcacgccgtcgaggacgtagtccggtccgtcgggcaccgcggaggtggcgaggcgggccgggtcggagccgacgtccggctcggtcagcaggaaggcggagatggcggtggtggccagccggggcaggaagacgtccttctgctcctgggtgccgaagatcttcaggggttgcggtacgccgatcgactgatgcgcggagagcagcgcgccgatcgcggggctggccgagccgacgagggcgagcgccttgttgtagtacacctgggtgaggccgagcccgccgtacttggtctcgatcttcatcccgagggcgccgagctccttgagaccggcgatcacctcgtcggggatcctcgcctcgcgctcgatgcgcgcgctgtcgacgtgcgtctcgcagaaggcgcgcagccgcgccaggaactcctcgccgcgccggatgtcgtccggcggcggcaggggatgcggatggatcaggtcgagccggaagcgccccaggaacagttccttggcgaagctgggcttgcgccagtcctgctcccgggcggcctcggcgacccgccgcgcctcgcgttcggtgaccttgggcaccatggggacctgaggggtgttgtgtggtgcggacatgagggacctcacctcgccgcgcgtcaccgggacggatcgacacctggacacacggactgctagtcgctgcttactggtccgtatgtaacccgtgtacccgtggttcggcacccgcaccagaccccgcgcacgggtacgcggacgcatacacggacggcccgaacccccgcacaggtgggttcgggccgtccgtttcgctcccccgcccgcactcgctgtccgggcggaaggcgggcgggggtcgtccggggtgctacagggcgaggccggtgaggaccaggacgcgctcgtaggtgtagtcctccatggcgtagcgcacgccctcacggccgacgccggactgcttggcgccgccgtacggcatctggtcggcccggtacgaggggacgtcgccgatgatcacgccgccgacctccagggcgcggtgggcgcggaaggcggtctggaggtcgtgggtgaagacgccggcctggaggccgtactgggaggagttgacggcggcgaacgcctcggcctcgccgtccaccttctggagggacatgaccggtccgaagacctcttcgcaggagagcttcacgtcgtcggggaggccggcgaggacggtcggggcgtaggtggccccgtcgcgcttgccgccggtgagcagctcggcgccaccccggacggcctcgtcgacccaggactcgacgcgcttggccgcgtcctcgctgacgagggggccgacgtcggtggcggcgtcggccgggtcaccggtgacgagggcctcgacggcggcgacgatcttggggacgagccggtcgtagacggtggcgtcggcgatgacgcgctgcacggagatgcaggactggccgccctggtagttggagaacgtggcgatccgggtggcggcccagtcgaggtcggcctcggacgcgtagtcgccgaggacgacggccgcgccgttgccgccgagctccagggtgcagtgcttgcggggcaccgaatccatgatcgcgtagccgaccgggccggagccggtgaaggagatgaccggcagccgctcgtcctggacgagggcgggcatcttttcgttggggaccgtcagcacggaccaggagccggccgggaggtcggtctcggcgagcagctcgcccaggatcagcgaggagatcggggtggccggggccggcttgaggatgatcggagcgccgacggcgatggccggggcgaccttgtgggcgctgaggttcagcgggaagttgaagggcgcgatgccgaggacggcgccgcgcgggaagcgccgggtcagcccgaggcggccggtgccgccgaggtcggtgtcgagccgctgggcctcgccgccgttgaagcggcgggcctcctcggcggcgaaccggaacacggacacggcccggccgacctcgccgcgggcccacttgatcggcttgccgttctccgccgagatcagctgggcgatctcctcggtgcgctccgtcagccgccgtacgacgtggtcgagggctgccgcccgtacgtgcgccggggtcgcggcgaactcgtcgcgtaccgcgtgggcggcggcgacggcctcctcgacctgggcgtcggtcggcacgctgacggtgccgacgaggcgtccgtcgtacgggttggtgacgtcgaagctgtcggcaccggtggcctggcggccggccacccagaaggcgtggggcgaagtcatggaggttccggcccttcggaggtcgtgaggaggtcatgaggaggtcgtgccggggtcgtgacggaggcggacgccggggaaggctcccctctgtggtccacggtagggcgggcaggcgctcagggcgtttgtccggcgtggagcggagcgggcgtcgggtgctccgaattggcggaggcggtgtcgcccgatcgctccggcccggacgccccggggctccccgtacgccggacgagacccggtacgagggtgagcaggccggtcaccgcgagtcccgcgcccagccagaggggggcccgcaggccgaaccggtcgacgcccacgccgcccagcgccgagccgaggaccacgccgagggtgatgaaggagctgtgcacggtgttgacgagcggccgggcgttgcccctgcgctgcacccgcgtgaccagagccggattcatcgtgaccccgacgaggccgatacccagcatgcagagcaccgcccagatcccgaacccggccagcagggcgaacccggacaggaacaccacgttcagggacaggccgccgagcaggaccgggagggcgtaccggtcggcgagccggccgacgacggtgttgccgatcaccgtggcggcgccgtacgccaggagcagcagcgggaccgtgcccgaggagaatccggtgacctcggtgaggatcgggttgaggtagctgaaggcggagaaggtcgcgccgatgaccatggtgctggtgagcagggtgagccagagccgaggggcgcggaagaccgtcagttcggagcggaacgtgccactgccctccggtcggccggtccggtccacgccgatcagggtgcacagggcggcggcgaccgtgagcgcggagatgacccagaacgcggcgcgccagccgaaccgttcgccggtcagggtggccagcggcagcccgagcagggtgccgagcatcagcccgttgaggatgaccgcaacggcccggccgcgtagctcggggcgggagagctgggagccgagcgagatcgcgacgccgaagaaggcctgcgaggcgaccccggtgatgatccgggcgaccaccatggccgggtagccggaggcggtggcggcgagcacgttgccggccaggaagaccgggaagaggaccatgagcgcggtcttgggcggaagccgcagcagggcgacggagagcagcggtccgccgagcgccatggacagggcgaaaacggtgatcagatagccgatctgcgggacggtgacgcccagcccttcggccatctgcggcatcagtcccgcgacgacgaattcactggtgaccatggcgaagatgccgaaggccagtacgtggacggcacgaggcacggtgggttcccccttgtggcgcgataatgttttgcatcgaacggttcaaaatctggacatgggcaggccccgccgcacccgtgcgcggcgaggtgggtgcgctcagcggatcaaggcgtccagcgcggtgtcggcgacggcctggacggccgcgcggtcggctccgccctgcgcggtgacgcgcatgccgccgatgacggcgttgacgtaacgggcgagggcgtcggagcctcgcgcggagaggatggagccgtcgcgctgcccggcggcgatgaccccggacagactccgcagcctgcgggcggcgtcccggtccaggagcctggccgcctccgggtcgcgggccgccagctcgaccgtggagttgacccccaggcagcccagactgcggccgccggggcggtggtcgaactcgtcggccacgaccttgtcgagcaggacgcgcacccgctcgccgggcgagcgggactcgtcctccagtacggcgtcctgggcgtcggccatggcatccagatagcgcgccagcgagcgcgcgaacagctcgtgcttgctccggaaggtgttgtagatgctgctgcgccccagcccggtcgcgtcgcacaggtcctgggtggaggtggcctcgtagccgtactcccagaaggtgcgcatcgcggagtccagggcccgctcctcgtcgaactgtctcggtcgggccatgtcagcactctatggttttgaactgctcgatgcaatacgagcccgcgctcggcgctcacccatcggcgggtgtcgccgcctcggtcgccttgagggcgagccacagctccatgcggacgtccgggtcgtccagcgagcggcccaggatctcctccacccgccgcatccggtagcgcagggtgtgccggtgcacgcccaggtcggcggcggcggcgtcccactggccgtggcgggagagccaggcgcgcagggaggccacgaggtcgccgcggcccttggcgtcgtgctcgtacagcgcgcggagcatgccgtcggcgaaggcccgtaccgcgtcgtcggcgagcagcggcagcaccgagccggcggccagctcctcgtgctcgaccagcgccctgccccgccggcgggcgacggagagggcctgttcggcctgcttgtacgcggc

SEQ ID NO: 2850 - DNA, 2030 bp, Unknown
  Kingdom: Bacteria, Phylum: Actinobacteria, Class: Actinobacteria, Order: Streptomycetales, Family: Streptomycetaceae, Genus: Streptomyces
gcgcgtggtcgtcctcgtggtgtggcggatcaaggacacggtccgggccgtcctcggcatcgaggaccacgaggcctacctgagcgcccaggtcgaggccgcgatggcccgggtcctctcgcagctgcccgccgacgcgttccacgaggacgccccgagcctgcgcgacgcggaggcggtcggcgacgcgctgacccggatgctgaaggcggactgcgaacccgtgggcgtggaggtgtactcggcccagccgaccggcatcgagtacgcccccgaggtcgcggcggcgatgcagcggcggcggatcgccgcgatcgactccaagcaccgggacagcgtgctcacctccgtggtggacgcggtcgacgacacggtcaaccggctcaccacgcgcggcatcgtcgaactcgacgactacgaacgcaaggcgctcgtcaaggacttgacggtcgccttctacaccggccgcagcgggggaggagacggggcctgaggccccgggggagtgccggcgaggccagggggaggcgtggggacggtccgggggcggtccgtccccacgctggaatatgaccctcattggtctggacatgttcacgtcgcgtcaataatctaagacttggtctagaccgcagtacctcgcaggcacagcaccacgcaccaagcgcgcagcagtcgagcaatgctcatggaacctcccccacgttctagaggagcgacagcccatgcggaaaaaggcaagcgcggccgtgatcggtctggcgatagcgggcgtctcggtgctcgcgaccacgagcgccagcagccacggctacacggactcaccgatcagccgtcagaaactctgtgccaacggcacggtgaccggctgcggcaacatccagtgggagccgcagagtgtcgaggggcccaagggcttcccggcggcaggaccggcggacggcaagatctgctccggcggcaacggtcagttcgcccagctcgacgacccgcgtggcggcaactggcccgccacccaggtcaccggtggccagggctacagcttccgctggcagttcaccgcccgccactccaccagcgacttccgctactacatcaccaagaacggctgggactccaccaagccgctcacccgggccgcgctcgaatcgcagcccttcatgaccgtgccctacgggaaccagcagccgccggccacgctgacccaccagggcacgatccccacccagaagagcggcaagcacatcatcctcgccgtctggaacgtcgcggacaccaccaacgcgttctacgcctgctccgacgtcaagttctgacgctccttcagctatcgtgcggcgccatgagaagtaccggcaccgtcgcggagctcgtacgacgtcaatggggtgaccaccggcccgccctgaagcacggccccaccgtgctcagtcatcaccaggtggtcgagggcgccgccgcacgggcggcgctcctcgcggacctccttccgcgaggcggtgagccgcatctcggcgtactgctcgacaacacccccgagttcccgctgtggctcagcgcggcggccctggccggggccgccgtcgcggggatcaacccgacccggcgcggccccgagccggcccgcgacatcctgcacaccgaagccccggtcctgatcaccgagcgcacccacctggagctgccgggtgtacgtcttcgacccggcggccttcgccacgttcctgcgcgcccagccggacctggggacgaagatggcccccggttcgtccggctcctcgaccggatgccggtcaccgcgacgaacaagatccaccgggtggcgctgcgccgggcgggcttccgctgccccggcccggtctggtgggaccggtacggcgacggctcgtacgtaccgctggacgccgggggtctcgcggccctgctggaacgatatgaggaacacggcagagcggtgtgagcgggaaaagcgcagtggcggcctccgtgaagaagaccgccactgcgtgtcgtgcgccgtcagggactcg

SEQ ID NO: 2851 - DNA, 7198 bp, Unknown
  Kingdom: Bacteria, Phylum: Actinobacteria, Class: Actinobacteria, Order: Streptomycetales, Family: Streptomycetaceae, Genus: Streptomyces
gagtagacgccgatgacgttgggtgaaccggcctcgtggcgggcggccgtggtgtgccagtcgacgtccacgccgccgtcggcacgccgggcgaccttgcgggaggcgccgccgcccgcgaggtacggctcggcggcctggagccagtcggcgcggccggccaggaccccggagccgaagggcgcgtacagcttgtggccggagaacgcgacccagtcgacgtccagttcggcgatgtccacggggtggtgcggggccagctgggcggcgtcgagcacgatgcgggcgccgtgcgcgtgggcggcggcggccagttccctcaccggccacagctcgccggtcacgttggacgcgccggtgacgcagacgagggcgggtccgtagggttcgcggtcggcgagcgcccgctccaggctctcgacggcctgggccggggtgcggggcgcgttgaggtaggtgacctgggcgtcgcgccagggcagcagggacgcgtggtgctcggtctcgtacacgaacacctggcagtcggcggggatcgcggcggccagcagattgagggagtcggtcgtggagcgggtgaagaccacctggtcgtccgcgcggcagccgaggaactccgcgaccgtgcggcggctgttctcgaagaggtcggtggagagctgcgagaggtagccggcgccgcggtggacgctgccgtagtacggggcgtacgcggcgacgtcgtcccagacgcgctggagagccggggcgctcgcggcgtagtcgagcgcggcgtaggtgacctcaccgccggtgacgagcgggaccgtgacgttctgtcccagaacgggcagcggggcacaaatcgacgagtcgagggcagcggtggggacagacatggcgaactcccgtaacaggcaggcgaaatccatgcgccggcagtacgcggcagcgcagggagggggaagaaaaaagggtgcgcggaaggagggcgataagccctagcgcattcgcttgctcacagaaggctccctagggaccaggaccccgggggctggcatccgctggatgccgaggggcccgcgcttgccgcagacctcgctgcctgcggcctggtcttcacccggggcaccccgccacggacggagggttgccggacagcgggccggggccgtagtcgctgtcactcatgacctgcgcagcatcttgccatacgtgtgtacacgcgcaagggcgcagtccggcatccggactgcgccctgtctcacaccgtgtgccccggaggtgcctccggagcgcgctcaggcgttgctgaccgccacccagcgctccagagcccgcttggcggcaccggagtcgatggcctcggccgcgacgagcatcttcgccgcgagctgttcggccagcgtgccgggtcccgggtccagggcgaccagggccgccgccgagttgagcagcaccgcctcccgtaccgcgccgcgctcgccctccagcagccggcgggccacatcggcgttgtacgaggcgtcggcgccgcgcagcgcctcgacggggacgatgggcagcccgacgtcgcgcgggtcgaaggcctcctcgcggaccgcgccgtcgcgcacgacccagacccgggaggtggcggtggtggtcagctcgtcgaggccgtcgtcaccgcggaagaccagggccgagttgccccggtcggccagcacacccgcgacgatgggcgccatccgggcgtcggcgacgccgaccgcctgggcgcggacctgggccgggttcgtgagggggcccaggatgttgaacgtggtctgcgcgccgagttccttgcgggccttggcggcgtaccgcagggcggggtggaacttcacggcgaagcagaaggtgatgcccgcctgttcggcgacctcgacgacccgctgcggggtcagctccaggttgacgccgagcttctccagtacgtcggaggacccgctggcggaggaggcggcccggttgccgtgcttgacgaccttggcgccggtgccggcgatgacgatcgcggacatggtcgagatgttgaccgtcttggcgaggtcgccgccggtgccgacgatgtcgacggtccggcccggcacctggatggtgttggcgtgggcgtacatcgcgcggaccagtccggtgacctcgtcgacggtctcgcccttggcccgcagcgcgacggcgaacccggcgatctgcgcgtcggtggcctcgccgctcatgatgcggtccatggcccaggcggtctcgtcggagctgaggttctcgccacgcaggagggggttcaggaggccgggccaggaacggtccgccacgctgtcgccgccgttcggggtcacaacgttcatggtccgctccagggtccacagccggtcaggaaagatggctccaccctatccagccggggggaccgcgaagagccccgtccatcgaatggacggggctctcacggtggcgatcggttcaggcgatcagtggtggccgtggccctcgctgatctccttgtactcctcgggggtggccttggggatctggttcccgtcggcgtagtaccccttgctgagcttggcgcgcagcttctgcaccggggagatcctgcgcttgacgccgttctcgtcgaccgcggggccgagttcgagcggcttgtactgctcgtgcgccgtgagcgtgtgcagctgcgcggggctgagcggctcgtggatctcgacgaactcaccgtgcggcaggcgcttgatgatgccggtctcgcgaccgtgcagcaccttctcccggtcacggcgctggaggccgaggcagatccgcttggtgacgatgaacgcgatgaccggtccgacgaagaagaagatccggacgaaccaggtgatcgagttgatcgacaggtggaagtgcgtggcccacaggtcgtttccaccgccgatgaggccgatgaagtacgcagtgatccaggcgacgccgaagcccgtacgggtcgggacgttgcgcgggcggtccaggatgtggtgctcgcgcttgtcgccggtgatccaggactcgatgaacgggtacaccgcgatcgcggtgaggaccacgccgaagccgaccagcgggatgaacacgcccagggcgagcgtgtgaccccacaggttgatctcccagcccggcatcacacgcaccagaccctcggcgaagcccatgtaccagtcgggctgggcgccggtggacacctggtcgacccggtacggaccgatggcccagatcgggttgatcgtggcgatggccgagatggccgcgatgacgccgaagacgaggaagaagaaccctccggccttcgccatgtacacgggcagcagcggcatgccgacgacgttcttgttggtccggccgggacccgcgaactgcgtgtgcttgtggtagaagaccaggatcaggtgcgccaccagcaggccgagcatgatgcccggcagcagcaggatgtggatcgagtagaaccgggccacgaagtcgtgaccggggaactcgccgccgaacaggaacatcgagatgtacgtaccgacgatcggcacggacaggatcgcgccctgggtgaagcggacacccgtaccggagagcaggtcgtccgggagggagtagccggtgaacccggtgaacatgccgagcacgaacagcaggaagccgaagagccagttgatctcgcgcggcttgcggaacgcacccgtgaagaagacgcgcatcatgtgcacgaacatcgcggccaggaagatcagcgcggcccagtggtggatctgccgtacgagcagaccaccgcggacctcgaagctgatcttcagggtcgaggcgtaggcctcggacatccggatgccctgcatgggctcgtacggaccgtggtagacgatctcgcccatgctcggctggaagaacagcgtcagatacacacccgtgaggatgatgatgatgaagctgtagagcgcgacctcaccgagcatgaaggaccagtggtccgggaagatcttgcgcatgttggccttggcgaggccgtagatgcccagccggccgtccgcccagtcggccacccgctcgccggccggagccttgcgcccgctcgccggtccggcggcggaggggttctttgtcgcagtactcatccgcgctcccagaaggcagcaccgacgggctcgtcgaagtcgccgagcgcctcgaggttgccctcgctgttgacaccgatccgcagctgcggaagcgggtggccggccggaccgaagatgacgcgagcgccgtcggagaggtcgaaggtggactggtggcacgggcagagcacgtggtgcgtctgctgctcgtacaggctgatcgggcagccgacgtgggtgcagatcttggagaacgcgacgatgccctcgtgggcccagtcacgctggcgcttgtccttgatgtcgtccggctcgatgcggacgatcatcagggccgccttgcccatctgcgtctggaagtcgtgcgactccgggtcgagcccctcgggcatggcgaaggccagcgacccgacggtgatgtgctcggggcgcagcggcttcatcgtgttcatgttgatgagctgcttgccctccgcccacagggtggtccggagcttcttctccggcagcggaccgaggtcgcgcagcaggaccactccggagagcggcaccagggcaagcgcaccgaacatggtgttgcggatcagcttgcgccgaccgatcacggactcctcggcgccggccttgaagtcggccaggacctgggccttgacctcgggcggggcctcgatcgggtggcggtcggcggcgacctcgacgtcggacatcagggtgcgcgcccagtggacggctcccgcgccgatgaagaagagcgccgcgcccagggtgagacccagggagaagttgagcgcgctcacatggccgaagggccagatgtagacgatcttgtccaccgggaagatgacgtaggaggcgatgaagcccaccgtcgccagcatcgagagggtgaacatgaacgcgacagcgcgttccgagcggttcgcggcgcgttcgtcgaggtcctggatgcgcggctggtgggccggcagtcccgggtcggcgaacgggtcgtcgtgacgctccaccgcgccctgcgcggtctcctgcaccacgggcaggttgtcttctggaatctgttggctactcatgacttcttggccttagcggtgtgggccgcgacccaaacggcgactgcgacgagcgcgccgagtccgaagatccacgcgaacagaccttcgctgaccgggccgagaccgccgagggccaggccgccggggctctccgactcgtcaccgttcacggtctcgatgtacgcgatgatgtccttcttctcctgctccggcatcgtcgtgtcggggaaggagggcatgctctgcgggccggtctgcatggcctcgtagatgtgcttcgggctcacgccttcgaggtcgggggcgtacttgccctccgtcagggctccgcccttaccggtgaagttgtggcactgggcgcagttggtgcggaacagttcgccgccgttggcgacgtccgcgcccgcggggtcgacctgcttgtcggtcggcgtgatgggaccggcgccgagcgacgcgacgtacgccgcgagctggtcgatctccgcctgggtgtagatgaccttcttcttcggtacctgggcgcccggctgctgcgcgggcatacggcccgtaccgacctggaagtcgacggcggcggagcccacgcccacgagggacggcccgtcggtggtgccctgaccgccggttccgtggcagctggcgcagcctacggagtagagcttcttgccctcttcgatggcgagggactgggcggtttcatcggcctgcgccttgcccgcaggcgcaaacgcggcgtacagccccccggtagccgccagcgcgaggagtagtacgacgaccgccgccagcggatggcgtcgtcgtgcggagagctttttcacggattaccccggtgtcaggatcttctgcgtcgatggtgggcgggtgcgagcccggttacttgatcatgtagatcgttgcgaacaggccgatccatacgacatcgacgaagtgccagtagtaggacacgacgatggcggcggtggcctgatcgtgggtgaacctcttggccgcgtacgttctgccgaggaccagcaggaaggcgatgagaccgcctgtcacgtgcagaccgtggaagccggtggtcaggtagaacaccgagccgtacgggtcggacgacagggagagccccgcgtccttgaccagctcggtgtactccaggacctggccgccgatgaagatcgcacccatcacgaacgtgatgatgaaccaggtgcggagcttcttcacatcgccccgctcggcggcgaagacgccgagctggcaggtgagtgaggagagcaccaggatcgtggtgttcgtcgccgagaacgggaagttcagatgatcggacatctccttccagtaatcgggtcccatcaccgatcgcagggtgaagtacatcgcgaagagggccgcgaagaacatcagctcggaactcaaccagatgatggttccgacgctggtgaggttcggccgattgaccgacgggtgcgcgtgcccggtttctactgtcgttgctgtcgccacgaccgacattatgtcggtcgcttatcccgccctcaccccggggggtgccgttcggtgtgtccgtaccgtctgcaggggtcgcaccctgcgccgaacggcccatcggaacgtcgtcattaccggtgctgacggccggtcgggcggagtacgatccgcgcatcggttcatgccccgagagccccgacgacgtcgatgtcacggaggaacaatgcaggcgaccgccacggtcctggtctacagcgacgacgccaacatccgcgagcaggtgaggctggcagccggtcgcaggcctgccgcggacgtcccaccggtggagttcctggagtgcgcgacactcccggccgtcctcaaggcgctggacaacggcggcgtcgacgtctgcgtgctggacggggagacggctccggtcggcggcatgggcgtctgccgccagatcaaggacgagatcttccgctgcccgccggtgctcctgctgatcggccgtccgcaggacgcgtggctggccacctggagccgggcggaggccgccgtgacgctcccggtcgacccggtggagtt

SEQ ID NO: 2852 - DNA, 12435 bp, Unknown
  Kingdom: Bacteria, Phylum: Actinobacteria, Class: Actinobacteria, Order: Streptomycetales, Family: Streptomycetaceae, Genus: Streptomyces
tccgcgaggctccgtaccgcggcggcgcagcggtcggggctccaggcgcgtgccggtgcgctggcgccgggatggacgacgacgtaggggccgttgccggtcagcggcacggtgtcgggggcgggcagcacgcggagccgcccgtcgtcgccggccggcggggcgaagcccatggccacggcggtgtccagcgcggcctcggcctcgtgacggtcgggaagtctgtggtgccggacgtcgagcagacggccggggtggtcggtgctgtccgcgccgatgcgaggaaccccggccatcctgagcagcagggcggtgggcagcgggctctggtggaacgacgtgaggacgagcgcgctgtcgtacgcctcggcgcgcacgcgccggaccatgccgtcgacgtcggcggcgtccaccggcggagggttcactccttcccagggcgcgtcccagaccagtacgtcgtcgacccccggaagcagccgggcggcggcctcgccgcgggggccgcagagcagcgtgaggtgggaggcgtgggcggcgaccgcgcggacggcggggcccgccagcaggacgtcgccgaagctgtccaaccgtacgaccagtgctttcaccccatgtccccctgccgctccaggaccagccggacggcgcccagcacatcgggggccgtccagcgttcccgctccacctccgaaggaagcgtcgccgcgttcgggacgaggacaccccgtgctccggccgcccgcgcggcgaggacgtcggcgcggatatcgccgatcaccacgcatgcggtcggccgcacaccgagtcgtcgggcggcctcgaccacgagtcccggtctcggtttgcgacagccgcaccggtcctccggtacatgcgggcagaacacccaggtgccgagcgcgcccaggagttcgtcggcccggcggttgacccggacgacgtcgtcctcggagatcaggcctctgccgatgcccgactggttactgaccactccggtggcgacgcctctggcgtgcagcagtgcgaccgcctcgcgcgcgccgggcaacaaccgcaccttctccgggtcaccgttgtacgggacgtcctccaccagggttccgtcccggtcgaagaggacggcggaaaccggacggggggtcgggtgaaggctgctcatcgcgcgcctcccacgggctgggcggcgcggtgcctgacccggccgccgaggcggtgccagcacgcaaggggagggatgagcacgctcgtgacgaccatggtgaccacctcctgcgcggtgcggggaccgggggcgatgcgtgcccaggcgaactccgcggtggccacggcccacagtccggcggcgagcttcgcgggccggggacggcgcgcggcagcgctgaggacggcggctcccgccagcgcggtgatggcggtgtggccgggcagacggcctcgtggcgcctgcgcccggtcccaccagccggctccgtggaggcggttcatgagggcgtcgtctgcgtttccgcgttgggcgcgcaccgaggcccaacggtcgctcgggcgcaccggatggagggtgacgcgttcgccccgtcgaagcgaccagcccgcgtccatgacgcgcagggcgaggtcggcgtcctcgcgaaaggcacgcgggaacctctcgtcgaagccgtcgacttcttcgagagcggcctgccggtaggccatgtcggcggtggcccaggcggcctcttccagaccggcggtgccccgctcccagtccgtgggcctgcggtgcgcgggcaacggcactgacaaccggccctgcactcccccggtgccgtcaccggccgccgcgaggtccgcggcgagccggtcgcaccagtcgggcagcacttggacgtcgtcgtcgaggaacaccacccagggggctctcaccgctcgccagccggcgttccgcgcggcggccgggccccgcccgccggtggcgatggagcgcgtcctgaggtctccggcggaccccagcggcagggcactgtcgggcgcgggccggtcgtcgaccacgacgacctccttcggcggcggaccctggcacgcggcaagggcccgtaggcagtcgtccaggcagggccggccgatggtggggacgaccaccgcgtatgcagcgtgttcatgggtccggttcacgcgaacgcccttccgcgccgcaccgcgaacggtccgagcgccagcaggtccaccggggcggagccgaagcactccagcgcgtcacgggggtcgtcgaccatgggccggcctgccgtgttgaggctggtgttcaccacgacgggcagaccggtgcgccgttcgaaggctgcgagcatgcgggccacgaggggctccgcctcggcgttcacggtctgggcgcgggcggtgccgtcgacatggacgaccgcggggatgcgctcccgccactcctcggcgaccctgtggacgaagagcatgtacgggctcggcaccggcccgtcgaagagctcggccgcccgctcctccaacaccatgggggccaccggccggaactcctcacgccccttgaccgcgttcagccgctccaggttcccggcccggcccgggtgggcgagcagggagcggtgaccgagcgcccggggcccgaactcggaacgcccctggaaccacgcgacgactccgtcccggctcagctcctccgccaccgtctcggcgatgtcgtcggattcctcgtacggtacggcggcccgctccagccagccgcgcagttcgtcgtcgctccagccgcgcccgagcgcggcggtcggcatcgcttcgaccggctccttctcgttcgccacgtggagtgcggccccgagagcggtcccggcgtcgcccgcggcgggctgcacccagatctcccggaaggggctttcgcggtgcaggcgcgtgttggccacgcagttcagcgcgaccccgccggcgagagcgagcacgtcctcgccggtgcggccgtgcagccaccacgccagctccaggaggacctcctccagccgtgcttgagcgctcgcggcgacgtcggcgtgctcctgcgtccagggagcgcccggggcccgccccggcaccagggaccgccacggaacggtgcgggcggtgaatccgcccgcaccgtcggtgtggacgaactcccgcagccggtcgacgaaccgcggtttcccgtaggaggcgagcgccatgaccttgaactcgtcgctgctccgcaggaagccgaggtgctgagtgagatcctcgtagaacaggccgacggagtccgggaggcgctgggaggccaggacggtcagttgacggttgacgtagcggccggagagatgggagccgcactccccccgcccgtcgagcacgagcaccgcgcagtcggggtgcggggacgcctgtccggcggacgcggcgtgggcgacgtggtgcgggacgaagcgaaccttcccggcgtcgagtcccggaagggcttcggcgaggaactccggggctcgccgtgcgtactcctgccgcaggtggtcccacgggtcgtcgaggcccagccggtcggcgggagcggcgaggccgggatcgtaggagtaggcgaccacatcgagatcggaggggcgcagacctgcctgttcgaggcaccacctggcgctcagctcgggcagctcccacgcggagaacgggacggggcgcttcccgtgcttgcgccggctgaagcgctcctcctccgctgcggcgacgatggcgccgtcgacgaccagggctgcggccgggtcgtggaagagtgcgttgacgccgaggacgcgcatggaaacctccgtcagtctcgcagggcgggggacgcggggccgggcgtggcggagaagtgggcgatggtccgcttgatgccttcttcccagctcaccctcggttcccagcccaggagttcgcgggccagcgtggtgtcgggccgacgccgctcggggtcgtcctcggggcgtgtgatgaaggtgagcggggaggaggaccctgtcagcgcgatcacccggcgggcgatgtccagaaccgtggcttcgtcgccgccgccgatgttcaccggtcggacggcctggctggccgccacgcgcagcacgccgtcgacggtgtcgtccacgtagcagagcgaacgggtctggctgccgtcacccgccacggtcacggggtcgcccgcgagcgcctggcagacgaaggtcgggacggcccggccgtcgtgggcgcgcatgcgtgggccgtaggtgttgaagatccgcacgatgccggcgttcgcccccttcgccccggcatgggcggtgaccagcgcttcggcgaacctcttggactcgtcgtacacgctccgcggtcccacggggttgacgttgccccagtagtcctcgcgctgcggatggacgagggggtccccgtagacctcggacgtggaggcgagcaggaatcgggcaccgtcgcggtgcgcgatcgtcaaggcgttacgggtgccgaggctccccgcgtccatggtttccagcgggtggcgcaggtagtcggcaggtgaggcgggacaagcgaagtgcaggacgaggtcgtaggggcctgccagttcgtccaccgtccggtcggaagagacgtcgcagcgagcgaaccggaacccctgacggccttccaggtgaacgatgttgtccatggatccggacaacaggttgtccacgcagtcgacttcgactcccgcgtcgagcagccgttcgcacagatgggagccgaggaatccggcgcctccggtgacgacggcgcgacgccagggggctggtgtcgtcatcaaggacatgggtccgcctttcgtccgtgcagggtgtctcacacgactcctgggcagggccggaccactggtgaccgacggcaagggtcgggccgggttgctccgccggacggcgcgacaccgtggcgggctgcgcccaggacgcccgccgtggtcccgacgggcacggcgggcagagttccctggcgactaggtttcacacacggaagttcgccggtttctgcgggatcccccgaacggacccgccggggtggacatgtgctcccacggcaggacgcgcagggcccgcctggtcccggtctgcggcggacgtcaggaacagacgggcccgtacaacttcgggcgcagcggcttcagtcggtggaaagcgcctcgatgaggtcgccgacctgggggtcgggcagggcgcgggcgacgtccgcggtggcgaccatgcccaccagggtgtggccgtcgatgaccggcagcctgcggaccttgtgcgaggtcatcgtgcgcaggatctcctcggcggggtcgtcggcgccgatggtcaccgcctccccctgggccagctcgccggccgtgcagtccgccgggtccttccccgcgccgagcaccttgaccacgatgtcgcggtcggtcagcacgcccttcagcttgttgtcggtgccgcagatcgggagagcgccgacaccgaggtccttcatcttctccgcggcgtccaggatgctctccttctcaccgacgcactccgtgccgctggtcatgatctcgcgtgcggtagtcatgggttccgttcccttcctgggatggtgcggatcgtccttggcgcggcgggttccccacgggagacgttcctaacgcccggttcctccgcccgggcgtatgggacacgaggagccgctatgggcgcgtgccgccgcgtagacagctcggtggttcggtggccctgtgaccctgtcgcccggaacgaagcatggttgccggaaaaggccgctgattccacgtgtgcctcgacgcgaaggggtactcggtcttcatgagcacaggaaatccggaccctgatccgcgcgatacgccaggcctggagcccggcggcggaatctcccccggtgacactcccccgggggagagcagcacgtccgaagcaggaccgcgccacgcaccgcccaagggctgggccaagggcccgctcatcgccatcatcacggtcaccgtgatggtggccgccttcttccttgtctatgccctgctcatatgagcatggcgcccgcctcgacgggaagctcccgctgccaacggattttcagccctcgacgccggtggcgtggtgcggcgcgccgaccggcttggattccggggaaccacgctggcgcaggtagaccgacaggatggccatggaagccaccgcgagaagttcggactgccagttctggaacgttcgactccagaagtcggccgacagaaggtaaccgctccagtcgacgggtggctgaaggttccggagccgcaattcgttgtaggccgccgtgccggcgacggactgtgccagccacgacaggaggaacagcgccgccatgaccaggcccagcgagcgggagaacagcttctggcggatccccccggccgccgcccagcggggggagtcgtcacgggcgtgggctccgacccgctgcgtctcgtcgtcctccggccccgccctgtccatctccttcgactcgggggagccgcgctggagcagccagacggtgccgaagatgtagaggaagaactgcaggtattccgactgccagttctcggtcacatcgacggcgaagtccgacgacatgaggtaggcggtcagggacaccggtgccaaggagtcgacgatcagcccgttgttgaactcggcgtggcccacgagcgcctgtcccgcgagcgtcaacaggaagcctgttgcgaaggccagggtgagcgagttgtcccgcaggaatctacgcaccggaggcgcccttccccgtcgtacgtcctggccggccgggcggcagtcccctcacctgtgcatcagccccagcgcggtgaagtaggcgagcccgcagacgacggctgtgagacagaggacgaacagcgttttcgtcacggtcacccaccttcgacgacacagctgtagggccgacccgggtccggagtacagccggcggccacgaccttccagccgtcggggaagcgtgacaggaacagcgtgtcaccgtcgaaaacggcgcggccctggttcccgtacacatcaacgccgcggatcgagccggccaccggcagttcctcgcccccgatgaccgtgacgcacggtttcccttcggcggattccagcgtttcgcgggtcgcgggggccagcaacgtgcacgtcgccgccgcgtcctcggtgcgcagcccttctcggaaggccacggcagcgtcccgcacctcggccgtccggccgcccgccgcgccgcaccccgtcagcaggagcgtcgctgcgagcagcggagccagtagcgggaccggaaatactcccggggggcattgatacgccatcgtgtctccgtccaccgaccggccctccgggggacatcatgggcgcgtgaggccgcccgccgcccttccgacacgctcggcgcgggatccggggccgcctccgggcagcggcgctgtcggctccgagcggggggcgtcggcagacactgcggtgggcgcgtcaccagcaggccggcggcaactcctcgggggacacgtgacggcgctgctcgggcagcgccgtcaggcagtgcgtgcgggcgtcgctcacgggtgctccggccgctcctcgggcgggaccccgccaccggggcctccgcccttgccgcccttgtccgttccgtgcgcgtgcgccccgccaccgcgggacgttccaggctctctcgccttcctttcggcgctgtcctgcggggttgccccacccttgtcactgcgtcgctgttccggctgttgcgggttggacatcgcgatcgctccctccgcgtagatcggtgcgccatccgagtccccgagtggcttcctgtcaaacatgtctctgcccgcccggccggcgagatcgatccggacggcctcgacccacgccgcgtgggcgcggatgtgcatgagcgaaaccgataccggtcgaagcacctgtgacacgggccggaggcttcatctggtccatcgcgatcgtgcacccacccatccaggacaaacacggctcccaccggactgtgtccggccccctacagcgtttgaccgctgaccacggtggtacccggcgacagcagggccacgcgacgcgcaccatgcggcgcgccgctcgtggtgagctaccgcgcagacgcttccgtcacgccgcgaccgatctggggagaagacgtcatgaccgacccccgcccgttctccgggcaggacgagtcctactggatggatacgacggatgcttcgccgtacccgcggctgaccgacgacatcgccgtcgacgtcgccgtggtgggcggcggcatcgccggcctgagcacggcgtgggagctggcccggacaggtcggcgtgtcgcggtgctggaggcggaccgcatcgcgtccggcgtcacgggctacaccacggccaaggtgtcggcgctgcactcgctcgtgtacgaccggctgcggcgggcccatggcgccgaggccgcacggctgtacgccgcctcgcagctggacgcggtggagcggctggcggcgatcgtcgacgaggtgggcatcgagtgtgatctggagcgggtgagcgcctactcgtacgcggccgggcccgcttcccgtgcggccgtcgaggctgaagcccgtgccgctgccgacgcgggtctggaggtctcgtacatcaccgagacggagctccccttcccggtcggcggcgcggtacgtctcgacgggcaggcgcagttccatccacgcgcctacctcctggcactggccgaagacttggtgggcctcgggggcctcgtcttcgaacggacccgggtcaccggcctttcggaaggacagccgtgccgtctgaccactgaggaccagcggatggtgacggccggggacgtggtcgtcgcgacccactacccggtcttcgaccgtgcgatgctcttcgcgcggctttcgccccggcgggagttggtggtcgccgcgccggtggccgccgaccgggccccgaaggggatgcacatcaccgaggacgagggaaagcggtcggtgcgtacagcgccgctcgacgagaaccgccgtctgctgatcgtcaccggggagagcttcacgccgggaacgggtgacccccgggagggcttccgccgtctcgactcctggatgcacgaacgctttccggtgggtgacaccacctatcggtgggcggcgcaggacaacgaccccagcgatacggtgccgctcatcggccccctccatatcggcgctcgtcatacctacgtggcgaccggcttcggtggctggggaatgacaggcggcgtcctggcgggccgactgctgacctctctgatcaccgagtccgaagctcggccgacctgggcggagttgtacgatccgcgacgtatcgcgggtgtactgcgcgagggcgcggcgctgttgaagcaacaggccgatgtggcgaagcacttcgccggcgaccggatgcgggtgacccacgtcgactcggtcggtgacatcgcgccgggcacgggcgctgtcgtacgggtgaaggggcggcgctgcgccgtccaccgtcatcaggacggcacgctgcgggccgtctccgcccggtgcacccacctcggctgcctggtgtccttcaacgacgcggaagccacctgggagtgtccgtgtcatggatcccggttcggaaccgacggcaccgtgctccaagggccggcgacacgccccctggaaaggctggaggtccccgacgaggcggagtgagcccggtcggaggcgccggctcccaccagaccgtgacccgtcggaaaggcggacccatgcgatttcggaatcgggaccaggccggccgtgaactcgccgaacggcttctgacgtggtcggccgaccacgagatgaccgaccctgtcgtcatcgcgcttccccgcggcggcgtccccgtggcggcacccatcgcatcggcacttccggccgcgctggacgtcctggtcgtccgcaagatcgggctgcccggccggccggagagcggtatcggtgcgatcgtcggcgacgacccgccgctgttcgaccacgagactctggggatgttcggcctctcggaggaccgtctcggcccccaactggcccgggaacgcgcggagctgcgccgtcgcgaggaactctatcgggccggccgacccgaaccccgggtcgtcggcaggaccgtggtcctggtcgacgacggcctcgccaccgggctcaccgcgcatgtcgccctacgtcacctgcgccgccggtccccgggccgactgattctcgccgtgcccgtcggcgctcccggcagccgggaccgactgagcggtgaagcggacgacgtcctctgcctccatcagccgacgggccttcgatccgtgggtgagtggtacgacgacttcgaccaggtgacggacggcgaagtcctcgccctcctgcgcggccgcggagagcctcggcgctcctcggcgccttcggacggaaaaacgtgagcgcggaggagcgttttcgcgtgggtcccgccgcaccgtcgatatcaccacccgcatcgccgatgtcacccccatcgtccagcaggatttccggttgtccgatcgcgccgacgggacagccggcccgtagacgcgccgaagcgcagcaggaatcgcattgcggtggtttcgtcggtcccggagtgtcggtgagccgggcccgtccctgcgtgcggcgacgtcaccgcgcgtagcgtgccatgccggaagtgaggctccagccaggaaggagcgaccatgaccgacgccctgacacccgggacgcccgacctcatctcgctgctcctggacaccggcacgctggaggatttccttcaggcgctggcggtgggagcgttggccagcgctcccaccgccgatggctgcggcatcacgctggagcgcgagagccgccctttgaccatggcgagcgcggggaccagcgcgcggacgctggacgaggcgcagtacgggcaggacgacggcccctgcctgcgagccctgcgcgagggacatgaggtcagtgtggtcggcatgcgggacgagagccgctggaacggctatccggcgttcgccgtcgccgccgcgaccatgtcgtcgctctccctgccgatcgccgcgcactccggcaccgcaggcgcgctgaacctctactcacccgaggtgaagggcttcgaggacgtcggcctcgacggtctgcgtgacctggccgcccaggcgaccggtgccatcgcgctggcgcagcggctctccgacgcccagacgttcgcctccgacctgcaggcggctctccagtcgcgcacggtcatcgaccaggcgatcggcgtcgtcatgagtcagcgccgctgttcggccgaagatgctttccgtactctgcgcaccgcgtcgcagcaccgcaacgtcaaacttcgcgacccctgggggcagctggtcggcggtgtctccggcaacccgccgacgagcacaccccggttccgcccgcgcccctgaaacctcaccgtcgaggccgacccgtgaggccagggaccgagggacacggagcacatcgatgcgggcactccctgacctccgcgtgctcagcatcaagctcttcatgcacgagtggtttgccggcggatctcagccctgcctcgcgggtacgtttgcatccctgtccaggggtacccctggagcaggtatccggcgtacgcggagctcaggcgccgacgggttgggaacacagccctcggcgccgcccacgcccgaacgccgcccccggactcggccggtaccttccggatcggcgggtgtgaaacctgacggtcccggtgcgctgtcccgtcaccgggaaccgaaatcaggcccggtgcccatgagttgtgttgtgaaatgatccgggccacgttcgcacgcctcgacaggcgcgggccgtcgtcgagcagaggtttggagtgtcatgatccgctgcaccgcatccaccgaagcgctcgcgggatgacggggagggcagacccggccggtggcataccgccggagatcggtccgtaccggctggaggggttgctgggtgagggcggcatgggccgcgtgtacctggggcgtacgcccgccggaagtgccgtggccgtcaaggtcgttcaccgtgcgtacgccgcggatccggacttccgcaagcggttcgcgctggaggtcgcggcggcccggcgcgtacaggggctctacaccgtgcccgtcgtcgcggcggacctggaggccggggagccttggctcgccacggcctacgcccccggcccctccctccagcaggccgtcggtgagcgggggccactgcccgccgacgaggtcctcgcgctgacggccagggtcgccgaggcgctggagaccatccacgccgccggagtgatccaccgcgacctgaaaccctccaacatcgtcctcaccgccgacggacccaaggtcatcgacttcggcatcgcccgtgcc

SEQ ID NO: 2853 - DNA, 26538 bp, Unknown
  Kingdom: Bacteria, Phylum: Actinobacteria, Class: Actinobacteria, Order: Streptomycetales, Family: Streptomycetaceae, Genus: Streptomyces
  misc_feature (1162)..(1163): n is a, c, g, or t
gagaagcagacgtcggccgccgccatcgcttccgcgatggccgtgctcctcctgccctactccctgatcgggcccttcgcgggagttctgctggaccgctggccccgacgccaggtcttcctctacgggaacctcctgcgggccgctctggcctgttccacggccctgctgattctcgcctcggtgcccgactggctcttctacgcctcggccctctgcgtcaccgccgtcaaccgtttcgtgctggccggtctctccgcagccctgccccgggtggtcgacaccgatcgcctcgtcgtcgccaactccctctcccccaccgccggcaccctggcggccaccgcgggaggcggcctcgcattcgtcgtacggctggtggccgacgagtccgacgcggcggtcgtgctgttggggtcgatgctctacctgctctccgcgctggcgtcgctgagcctgccccgcgctctgctggggccggacaccgacgagagccccttgcggctgcgggccgctctggccgtcaccgcgcgcggactcgtcgccgggctgcgccatctggcgcagcggcgtcacgccgccggggcgctggccgcgatgaccgtgatccgcttctgttacggcgcgctcaccgtgatggtgctcatgctgtgccgctacgcgtggtcggacaccgagtccgacgggctggcgctgctcggcctggcggtcgggatgtccggtgcgggattcttcgtcgccgccgtcgtcaccccgtgggcggtggggaggctcggccggtacggatggatcgtgggctgcgccggcgcggcggcggtcctggtgcccgccctgggcctctccttcgctcccgtcccgatgctgatcgccgcgttcgtgctcggcatcgtgacccaggggtcgaagatcgcgaccgacacggtcgtgcagacctcggtcgacgactccttccgcggccgggtcttctcgctctacgacgtgctcttcaatgtcgcgttcgtgagcgccgcgggggtggcagctctgatgctcccgccggacggtaggtccgtcgccgtcgtggcggtcgtgtcggtgctgtacgcggtggtcgcggtcacgatgtcccgtcggcgacgcaccgatgcccaccggtagccggtcatggatgtgccgaggggcgttnnaacgcccctcggcacatccagcggctgatgtttcacgtgaaacatcagccgctgggttcagtcctgccgcgcccaccactccttgagcgccgccaccgcggcatccctctccatcggcccgtgctccaggcgcagttccagcaggaacccgtacgccttgccgatcaccgggccggggccgacgtcgaggatctgcatgatctcgttgccgtccaggtcggggcggatcgagtcgagctcctcctgctcctgcagcagagcgatgcgctcctccagcccgtcataggtgcgggagagtgcgttcgccttgcgcttgttccgggtcgtgcagtccgaccgggtcagcttgtggaggcgttcgagcagcggcccggcgtcgcgcacatatcggcgcactgcggagtcggtccactcgccgtcgccgtacccgtggaagcgcaggtgcagctccaccagtttcgatacgtccttgaccaactcgttggagtacttgagttcggtcatgcgcttcttcgtcatcttcgcgcccaccacctcgtggtggtggaaggagaccctgccgtccttctcgaagcggcgggtccgcggcttgccgatgtcatggagcagcgcggccagacgcagtacgaggtcgggtccgtcctcctccaggccgatggcctgctccaggacggtcagcgagtgctcgtagacgtccttgtgacggtgatgctcgtcactctccaggcgcagcgcgggaagctcgggcagcacctgttcggcgagtcctgtgtcgaccaggaggcccagccccttgcgcgggtgctgggagagcagcagcttgttgagttcgtcgcggacccgctcggcggagacgatgccgatgcgcgcggccatctccgtcatggcggtcacgacgtcgggggcgacctcgaagtcgagctgcgcggcgaagcgggccgcgcgcagcatgcgcagcgggtcgtcggagaaggacgcctccggtgtgcccggagtgcgcagcacccgctcggcgaggtccttcagacctccgtacggatcgacgaactccttctgcggcagagccacggccatcgcgttgaccgtgaagtcgcggcgcacgaggtcgtcctcgatggagtcgccgtaggagacctccggcttgcgcgaggtccggtcgtaggcctcggaccggtaggtcgtgacctcgatctgatagccgtccttctgggaaccgacggtgccgaaggcgatcccgacctcccacaccgagtcggcccaggggcggacgatcttgagcacgtcctcggggcgggcatcggtggtgaagtccaagtcgttcccgagcctgcccagcagtgcgtcgcggaccgagccgccgaccagcgcgaggccgaatccggcctcctggaatcggtgggcgaggtcgtcggcgaccggggacacccgcagcagctcactcaccgcgcggtgctgcacctggctcagtgcactggcgttctcttcgttggcgttcggcacaacagaaaagggtacgtgcacggaccggtctcgacgtcatcgtttacggggcccctgcgggatccccgcgatcatgtgcgatggaccccagcacttcggtccgccgcacctcgttaccatgcggggacgcaggaccgaacgatcgacagcatctgacgacgacgagggacgggtaggcgcgtggccgaggcggcagacttccaggggactcgtccctctcctgcccgccggtggctccggcgcacggcctcagcggcgctcggagcaccgctgctggccggtctcctggccgttccggccgccggtgccgccccggccgtcgagcccgccaaggcccccagaggctcccgtacggtcgatgtgtccctgaacacgctctccccgagcgttccctcggaggacgacaccctgaccgtctccggaacgctcaccaacaagggcaaggagacgatccgcggtgccgaggtcgatctgcgggtcggtccccggctctccggccgcggagaggtcgacgacgccgcgaagcgctccgcgtacgtgcccggcgtcgacccggtcgccgtcggggacaagtacacggtgaagttccccaaactcgccaaggggatcagccaggacttcacgctcaccgtgcccgtcgacaagctcggcctggacgactcgggcgtctaccagctcggcgtatcggtctccggccgtacgaccaccgccccctacgagcaggtgctgggcatcgagcgctcgttcctgccctggcagcccgaggcgagcgacagcaggacgaagctcaccttcctctggccactgatcgcgtccccccatgtcacggcggagacccgctcggacgaacagcagacccccgtgttcaccgacgacgctctggccaaggagctggcgcccggcggccggctggagcagatggtgtccctgggcagccggctccccgtgacctgggtcgtcgacccggacctcctggcgagcgtcgcggcgatggccgggaagtacgaggtcgagtcgggtgacacgaccgtcccgggcaagaaccaggccgtcgccaagcagtggctcaccgctctggagaaggtggtggaggacggcaaggtggtcgcgctgccgttcgccgaccccgatctggcctccatcgcgcaccgcggcaagaacgtctccggaacgctcagccatctgcagaacgcctccgcggtggccgcgaccacggtggagaccatcctccatgtgaagccgtccaccgacttcgcctggcccgtgaacggcgccgtggactcctccatcgtcgatgtggcgacctcggcgggggcccacaacgtgatcgcccggagcgacagcttccgggagaccacggaacttccgtacacgccgaccgcggcgcggccgatcggcgggggcaccaccgcggtcgtcgcggacgcccggctgtcgaccttgttcgacggcgacatgtcgagggcgggctcctcgacccgtgcggtccagaagttcctcgcccagaccctcgcgctgaccgagcaggcgccggacaacgagcgcagcatcgtggtggccccgccgcggatgcccaccgccgcacaggcccagacgatggcccgcgctctggagggcctggcgggcaaccgctggacgcagcccctggacctcgtcgccgccgccgaggtgaagcccgacccgagggccaccgccaaggtcccccgggcctccgcgtacccgaagaagctccgagcccaggaactgcccacgcaggcgttccaggacatccgcaccacccagggctcgctcgacagcttcgagacgatcctgacgcagcccgagcgcgtggtgacccccttcggcaacgccgtcaaccgctcgatgtcgacgtcctggcgcggacggtccctggaggcgcagcagtaccgggacgcggtccgcgactacctgcggagcctcacctccgaggtgcagctcatcgagaagtccgacgtcaccctctccgggcgcagcgcgacgatcccggtcaccgtgcagaacaaactggtgcagggcgtggaccggctggtcctccggctcacctcggacaacatccggctcaagttcaacgacgacgggaacatggccgaactgccggtcagcatcgcgggcggacacagccagtcggtgaagttcgacacggcgaccagcgccaacggccgcgcccaggtgaccgcccggctgtacacggaggacggcacccagtacggcgaggaaatgaccttcaccgtgaaggtctccgaggtgacgcccaccgtgctgctcgtcatcgccggcggcctgctgctcctggtgctggcaggtatcaggatgtacagccaccgcaagcgcgccgtggcaagcgacacggcggacggcaacggcgccggacccgagcagccgagtgacccgaccccggacaccggtccggaaagcggggccccgtcgggaacgggtgagaaagtggaccgttgagcgatgtctgtcgtggccggccggccggggacgatgaggtaggggtttcgatgaacgcgccgtacgacggtgaccgcgggcagggcgcgggcggagcagcgtctccgggcgggcctccggttcctccgggcgcgggccaggacggctccgtgccgcccgacccgtacctccagcacgcctacgatgacgacccctaccgggcgcaggacctggcggcacaggacccggtgggcgaggcgctctacgaccgcgccgcgcacccgccgccgcctcccggcacgtaccaggagccggggccgctctaccagcagccgcccgccgctccgtacgcccccgacccgcgcatctgggcccagaccccgccccccgagccggcggggccctcccggcacctgccgtacggggaccgcccggcgaccacgcagttcgtcggcgtcgacgccctcgtcacccaggcgtcggacgaccggcaggagccggacgccttcgcccatctcttccgggaccaggagggatcggggaagcccccggtgccgccccagcccgaaccggctcccgcacccgcaccggccaagggcggcggcggcaaggtctccgggctcctcaagtccagcgcgctcatggccgccggcacgctcgtctcccggctcaccggcttcgtgcggtccctggtgatcaccgccgcactcggcgccgcgctgctcggcgacagcttcaccatcgcgtacaccctgccgacgatgatctacatcctcaccgtcggcggcggcctgaactcggtcttcgtcccccagctcgtccgcgccatgaaggacgacgaggacggtggcgaggccttcgccaaccggcttctgaccctggtgatggtcgcgctcggtctgatcgtcgccgcagcggtcctcgtcgcaccggtgctgatcaagctgatgtccagcacgatcgccgacgacgtggccgccaacagcgtcgccgtcaccttcgcccgctactgcctgcccaccatcttcttcatgggcgtgcacgtggtgatgggccagatcctcaacgcccgtggcaagttcggcgccatgatgtggaccccggtcctcaacaacatcgtcatgatcatcacgttcgggctgttcatctgggtctacggcacctccgccgagtcgcggatgggtgtcgacaccatcccgccggagggcgtccggctgctgggcatcggcaccctgctcggcctcgtcgtccagtccctggcgatgatcccctacctgcgcgagacgggcttccgcttccgcccccggttcgactggaagggccacgggctcgggaagaccgtcaagctcgccaagtggaccgtgctgttcgtcctggccaaccaggcgggcgtcctggtcgtcacccagctcgccaccgcggccggcacggcatcgggccacgacggcaccgggttcctggcctactccaacgcccagctgatctggggcatgccgcaggccatcatcaccgtctcggtcatggccgcgctgctgccgcgcatctcccgagccgcccatgacaacgaccccggtgcggtccgcgacgacatctcgcagggactgcgcaactcggccgtcgccatcgtgccggtcgccttcgccttcctcgcgctcggcctgccgatggccaccctgctgtacgcctccagcggcaccgaggccgcccgctccatgggcttcatcctcatggccttcgcgctcggcctgatcccgtactccgtgcagtacgtcgtcctgcgcgggttctacgcctacgaggacacccgcacccccttctacaacacggtcatcgtggccgccgtcaacgccgccgcctccgcgctctgttacgtcgtcctgccggcccgctgggccgtcgtcggcatggccttctcctacggtctggcctacgccgtcggggtcggcatcgcctggcgccgcctgcgcaaccggctgggcggcgatctggacggcgcacatatcgtgcggacctacgcccgcctctgcatggccgcggtgcccgccgccctggtcggcggcgccgtcgggttcgggatcctggaacttgtcggcaccggtgctctcggctcgctggccgcgctgatctgcggcggcgccctcctcctgggcatcttcttcgtcgcggcgaagaagatgcgcatcgaagaggtcaacggcctggtcggtatggtccgtggacggctcggacgctgaatgagcacccgcccgcacaaccatcgccgcactccgcgtgtcgtgcatagcgccggagtgtgggcacaattggcgtgactgtgcagagctggctggcatcgcgcaacggatggggaggcaggaacgacggtggcggaacgtagcacggctgccgtcgacgtggccgacaacagcggcgacgagccgctgaccgccaaggcggacgaggccacgaccgacgggacggcgcaagccgaggacaccaagggcgcgagccccaaggacaccgagaacacggacggtgggcgggagcgttccgaggccgtcccggcatcaccggatctgcacagcggtcacaaactcgccggtcgctaccgcctggaggagtgcgtcacccgtctggacggcttcagcagctggcgtgctgtcgacgagaagctccgccgggcggtgggtgtgcacctcctgcccgcggaccacccgcgcgcccgctcggtgctcgccgccgcccgctcctcggccctgctcggcgacccccgcttcgtccaggtcctggacgccgtcgaggagaacgacctcgtctacgtggtccatgaatggctgccggacgccaccgagctcaccgctctgctggccaccgggccgatggaggcccacgacgcctaccagctcgtcagccagctctcccaggcgatggccgccgcccaccgcgagggcctgtcccacctgcgcctcacccccggcgcggtcctgcgcagctccaccgggcagtaccgcatccgcggcctcgctgtgaacgccgctctgcgcggcatcaccgccgagcgccccctccggacggacaccgaggccatcggcgccctcctgtacgccgcgctgacccaccgttggccgtacgggaacgacgcccacgggctcgccgggcttcccaaaggcatggggctcatcgccccggaccaggtccgggccggcgtccaccgcgggctctccgagctcgccatgcgggcgctcgccaacgacggcgccaccgcctcccggcaggaaccgccctgcaccaccccggacgagctggccaaggccgtcgcggccatgccgcgcatccttcctccggaacccacgttcaccgcgccaccggcgtaccagcgcacgacctatcagcagggcacgtacgggcgtccgtcgtcccacccgtccgccgtcacccagcccgtgatgccgacccctccggctcctctgcagagccgtgccggccgcgcgctcaagtggaccgtctcggcgctcctcatcgccgcgttgggcctcggcagctggcagctcgcggaggcgctgctcgaccgcaccaagggctccgacgacaccggcgtcaccgaaccgaacgaggacgacaagaacaagggtgagaagcccgcaccgtccgccgaacccctggacatcgcgggggccacggagttcatgcccgacggctccgggataaagcagcgggacgtggcgaacgctgtcgacggcagcccgggcacgtcctgggtcaccccgcggtacgagggcttcgccaacttcgggaacctcccccagcgcaagcagggcagcgggatcatcgtcgacctcgggaaggtgcgggacgtctccggcgtcgatgtgtccatgtaccggagcggacagacgacgaccgtcctcgccgcgtccccggacgcctcgtccccgtccacaacaggcgacttcgaccagtcgatcgtcaagcggacggtcgcggggtcgacgctcaaggaaaagctcgacgagcccgtccgtacgcgttacgtcctgatccacatcacggaactcccctcggacggcacgggcggctaccggggcggcatcaccgacatctccgtcctcggctgacgcacgtgccggtgcggcccacccgcaccggcccgtgatcaccggccccacccgcccgttactgtggggccgaccgcccgcaccaccgagcgcctgcggcgacaagggttgcgcccgtcacacccgtgacggcaggcttctccccgtcgcaccgcttcgccgggcgcggccatatatgacatcggatccggttcggagggggagcacggtggattccgttccaccagaggcaccgagcgactcggacctgctcgcccagcatgtggcgggcgaccccgacgccttcggcgaactcgtacgccgccaccgtgaccggctctgggcggtggcgctgcgaacgctgggggacagggaggaagcggccgacgccgtccaggacgccctcgtcaacgccttccgctccgcccacaccttccgcggccagtccgcggtcaccacctggctgcaccggatcaccgtcaacgcctgcctcgaccgggtccgcaaggccgcctcccgcaagacgtcccccgtggacgacgccgaacggctcgatcagctcctggaaccccacgaatcggccgaggcccccgccgtgcggcaggacctccaccgccagctccaggaagccctggccacgctgcccgccgagcagcgggcggccctcgtcctcgtcgacatgcagggttaccccgtcgcggaggcagccaggatccttgaggtgccgaccggcaccgtgaaaagccgatgcgcccggggccgggcgagactggcccccctggtccgccatctgcgcgcggaaaccggggggcaggccccctacggggagaacggcgcggccggaaggaaccggacgcccggagcatccgtcccacctgcgtcaggacccaaagacgcaggagcaagcgatcctgccgctacgaagggaggaggtgggcgcccgtgacatccacggccgacacggctcagcacccggaggtctccgagatctccgatctcaccgaggggctgctctcccctccccgggcggcggacatccggcagcacgtcgcaggatgcgacctctgctcggaggtacgggactccctggaagagatccgagatctgctcggaacgatgcccacccccgagccgatgccggaggacatcgccgcccgcatcgacgcggctctcgcggcggaagtccggcccaccgctcccgtcgtggacgagacggtcgttgtttcacgtgaaacaacgaccgccgaagacgccgccaccgaccgtgcgacgagcgagtccgcttccaggagcatcggcgcctccaccccgaatcgccctgcgggccggtcctccgccgccaccgggccgggccgccgtcccacccgtcggcgacgccgcgctgtggtcctcggcaccgcgttcggcgcggcggtcatcgggatgagcgtcttcttcctccagtccatcaccccgtccggcgaatcctccaagaccgcggccgacagcggagtcagcgccgcggaaagcggcgcgcacgcctacgccgacggcacgctcgaatcccaggtggaggacctcctcggcggcggagcgatccaggagagccccggtgccaagaaggtgccgccgggcgcggacaccaagtcgacgagcgaggccgtcacccccgacaccgaagcgtccaggagccccttgaaggctcctgtcgtcaccgttcccccgtgcgtccagcaggccaccggccgcaccacgccggccctcgccctcgacgaggggacgtaccgcggaacggacgcctatctcgtcgtccttccgcacgcgagcgacccctcacgggtacaggcctatgtggtggccgcctcctgcgtggacaccgacccggagtccaccggccagctgctgctcacccgcgcctacgaccgcccctgaaaaccgtccgcgaccggtgcggcacgttcgggaatgcatcagccgtaggatccgttgggtggggtgtgagtcgttgaaccgaccccgtaggcagttaggcagtctgtagaaacgaggaagaaacccgtgagcgacgtccgcaatgtgatcatcatcggctccggaccggccgggtacaccgccgcgctgtacaccgcccgcgcctcgctgaacccgttggtcttcgagggcgccgtcacggccggcggtgcgctgatgaacaccaccgacgtggagaacttccccggcttccaggacggcatcatgggccccgagctcatggacaacatgcgggcccaggccgagcgcttcggcgccgagctgatccccgacgacgtggtcgcggtcgacctcaccggtgacgtcaagaccgtcaccgacaccgcgggcaccgtccaccgcgccaaggccgtcatcgtcacgaccggctcccagcaccgcaagctcggactgcccaacgaggacgccctctccggacgcggcgtctcctggtgcgccacctgcgacggcttcttcttcaaggaccacgacatcgccgtgatcggcggcggcgacaccgcgatggaggaggcgaccttcctctcccgcttcgccaagtccgtcacgatcgtccaccgccgcgacaccctgcgtgcctccaaggccatgcaggaccgggccttcgccgacccgaagatcaagttcgcctgggacagcgaggtcgccgaggtcaagggcgaccagaagctctccggtctgaccctgcgcaacaccaagaccggcgagacgtccgagctccccgtgaccggactgttcatcgccgtcggccacgacccgcgcaccgagctcttcaagggccagttggagctcgacgacgagggttacctgaaggtcgaggcaccctccacccgcaccaacctgaccggcgtcttcggcgccggagacgtggtcgaccacacctaccgtcaggccatcacggcagcgggcaccggctgttccgccgccctggacgccgagcgcttcctcgcggccctggccgacgcggagcccgccgagccggagaagaccccggccgtctgaacgtccgcaccgcaccccaccaccccgagactaaggaggccgccgtggccggcgacctgaagcacgttacggatgacaccttcgacgaggtcgtcctcaagagcgacaagcccgttctggtggacttctgggccgcctggtgcggcccgtgccgccagatcgccccgtcgctggaggcgatcgcagcagagcacggcgaccagatcgagatcgtcaagctcaacatcgacgagaacccggccaccgccgccaagtacggcgtgatgtccatcccgaccctgaacgtgtaccagggcggcgaggtcgccaagaccatcgtcggcgccaagccgaaggccgcgatcctccgcgacctcgaaggcttcatcagcgcgtagccacgcagcagcgcctcggcgcgatgtttcacgtgaaacgggcccatcccctgaggggagtgggcccgttccgcatggcggccggaagcggcccggtctcacaacggcctcaacaccggttccttctggaccgctcccagaagccggtcgagcgccatctccacgtcttccttccaggagagtgtcgtccgcagatccagcctcagccgtgggtacacgggatgcggccgcaccgtcttgaagccgacagccagaagatgatccgcggggagcacgcaggtggcctgctcggaccgcgcgtctccgaacgcctcgatcgccttgaagccccggcgcagaacgtccttggccaccgtctgcaccatgacacggcccagtccctgaccctggtactcgggaacgatcagcccagtgatgagctggacggcatcgggggagaccgggctggtcgggaaagccgtcgagcgggggacgtacgcgggcggggcgtagagcacgaaacccgccggcacgtcgtccacatagaccacccggccgcaggacccccactccaggaggaccgcggagatccaggcttccttctccagctccggcttgcccgcccttactgcggcttccccactgaccgggtcaagctcccagaagacgcacgagcggcaacgctcggggaggtccggaaggttgtccagggtgagtggcacgagccgacgccccatgacggcgatccctcactttcttcgcccgccgcaccacgtacggctgccagtgtgctccgttcatggaacagactgccgacgaaccccccgacggcgcccaggcccagcccgactgtgacgagccgactgcggctcactcttcgcaaggcctccgccctcctctgaggtcgatcaccgtggatgcgccgtcccagaacgcatcgtatccacccagaggtgatgcggataccgagagagggcaaagggcgggccgtgttccggtatgcaccggcgcacggcccgcccttcctacgggccccgctgctcagccctcgtcgtcctcttcggacgtctcggccagtcggcgctccagcacacggccctcgcccggggcgagactgccgaggatccggtccaggtcctccatcgaggcgaactcgacgacgatcttgcccttcttctgccccaggtcgaccttcacccgggtctcgaagcggtcggacagacgcgtcgccaggtcggtcagagcgggggacagacggccgccggccctcggacccttgggcttcgcggagctcgtggggcgcgagcccatgagcgtcacgatctcctcgaccgcacgcaccgacagcccttcggccacgatgcggtgggccagccggtcctgctcctcggaatcgtccaccgacagcagggcacgggcatggccggccgaaagaacgcccgcggcgacccggcgctgcaccggcggcgaaagccgcaggagccgcagcgtgttcgtcacctgcggccgtgagcggccgatccggtcggccagctggtcatgggtgcacttgaagtccttgagcagctggtcgtacgcagcggcctcttccaacgggttcagctgagcccggtggaggttttccagcaaggcgtccagcagcagcttctcgtcgtccgtggcacggacgatggtggggatccgctccaggcccgcttcacggcaggccctccaccgacgctcacccatgatgagctcgtagctgtccgggcccgccttccggacgacgaccggctggagaaggccgacttccttgatggagacgaccagctcggccagcgcgtcctcgtcgaacacctcacggggctggcgagggttcggggtgatcgtcccgatcggcagctcggcgaagtacgcaccggatgtaccggcatcctgctcggaccggccctccggcgtggccgccggctccggcaccgccgggacggacggcagtgcggtcaccttcgcggcggccaccccacgctccgccgtcagaacctgacccgcgccggacgacgccgcaccgcctccgggcgccgaaacctgcttctcctgaggagcggcggggatcagcgcaccgagcccacgccccagtcctctacgacgctcactcactgaatgccctccgaaacgttctgctggctgttctgactgctcgtgtgggcgtgctgagcctcgtagtgcaccccggcgccccgcagggcgatctcccgcgctgcttcgagatacgagagcgaaccgctggatcccgggtcgtaggtcagcacggtctgcccgtaactcggcgcctccgagatgcgtaccgagcgcgggatactcgtccgcagcacctccttgccgaagtgggtacggacctcctcggcgacctgggaggcgagcctcgtccggccgtcgtacatcgtcaacagaatcgtcgagacgtgcagatccggattcagatgaccccgcaccaggtcgacgttccgcaggagctgccccagaccttccaacgcgtagtactcgcactggataggaatcagcacctcggccccggccaccagcgcgttcaccgtcaacaagcccaaggagggcgggcagtcgatgaggatgtagtccagcggctgctcgtacgcctggatggcacgctggagccggctctcccgtgccaccagcgagaccagctcgatctccgcaccggcgagatcgatggtggcgggggcacagaagagaccttcgacatccggtacgggctggaccacctcggagagcgggcggctctccaccaggacgtcgtagatcgaggggacatcggcgtggtgatcgatgcccagagctgtggaggcgttgccctgcgggtcgaggtcgaccaccagaacgcgcgcaccgtgcaaggccagggaagcggcaaggttgaccgtcgaggtcgtcttcccgaccccgcccttctggttggccaccaccatgacgcgggtgcggtcaggacggggcagcccttcgccggcgcggccgagggcctcgaccgccagctgagcggctcggccgatgggtgtgtcgtccatcggcggcggtgtttcacgtgaaacaccctcacccacggactcggttcggggaccggggaccgggtcggtcatcggtcccgcgatgttggcgtcggaccgcaaggattcactctcctcgacttcaggctcgcaatgaacagagcctgccatgctttcggggtcgtgaaccagcgaggcccgctgttctgtggatgaatccgtgcgtgtggacaactcggcaacccgtccgggcttgcggtcgcgcggcgtggcagccgcacgaccgcggccgatgattccctgcagcagagagcgacgtttcacgtgaaacacgatgcccccgcggggcaactaccaggccacgacactccgcacggagtacgtatcgctactttccggtagaaccactgctaagcggctcaagaaccaacagactccgcataccgtccgaccgcacaggacttccggccggacggcgatgcggtcccgcagtgcccctcagcgacgcctgcgcgtccgtcccgtccgagcggccttggccctctttgcggcgaacctcacaccgcccgggctctctcccaccacgacacggaccacagtggagagcggatcgaccacgccttcgccgacgtggagcacctcggtctccaggacaccgagcttgctcagcgcggccctggcgccgttgagctcctcctcggcagtgtcgcccttgagcgcgagcatctccccgtaaggcttcagcaggggcacgccccagcccgccagccggtccagcggtgccaccgcacgggcggtcaccacgtgaacgggctgaagcgtcccgaggacctcctcggcccggccgcgcacgaccgtcacatggtccaggccgagcagttcgacgacttcctggaggaagttcgtccgccggagcagcggctccagcagggtgatcttgagatcggggcgcaccagagccagcgggatgccgggcagacccgcgccggatcccacatcgcagacggtgacgccttcgggtacgacctcggagagcaccgcacagttcaacaggtgccgctcccacaaccggggaacctcacgcggcccgatcaggcctcgcttgaccccggcatccgcaagaagctccgcgtaccggacagcctccgggaagagctctccgaacaccgcctgcgcctccgcaggtgcctgagggagctctgctgcctccgtcacggggaccgtccttccgtaccgcactagcgcactgtgggtggctgactatcaggctgacaaagatcggccccgcctgcgaacagacggggccgacagtacaaggatccggtcaggccgggagtacgacgacgaagcgctgcggctcctcgccctccgactcgctccggagaccggccgcggcgatcgcgtcgtgcacgaccttgcgctcgaacggcgtcatcgggtccagcttcaccggctcgcccgagctcttgacctcgtccgcggccttggcgcccagcgccgcgaggatctcgcgcttctgggcccggaagccaccgatgtccagcatcaggcggctgcggtcgcccgtctcccggtggacggccagccgcgtcagctcctggagcgcctccaggacctcaccgtcgcggcccacgagcttctggaggtcgcgtgccgattcgctgatgatcgacaccgcggcccggtccgcctcgacgtccatgtcgatgtcgccgtcgaggtcggcgatgtcgagcagtccctcgaggtagtcggccgcgatctcgccctcctgctccaggcgggtcagggtgtcgctaccggcctcagcggcggccgtggaagtggtgccttccgtcacggatggactccttcttacttcttggacgggtgcttgggccgctgcgggcccttgcgctgtccggacttggcttggcgtgaggagccggaggcgggcttgcccgccgacttcggcttgtcgtcctgcggtgcgtcctgcttctcgagcgaggtcttggagccggcgcccgaggactccgagtccttggctccaccggccgtggcaccggccgtctggcgcttcgccttggtctggcgcttgggctgctggcgcttgtgcgcctggctgccctcggcgtcggcggcggcggtctcgctcttctgcaccgtgccgtcctcctgggccgcgaggcccagcttgccgaggccggtgatgaacttgcgctcgatgtcgttgcggtcgggacccttggcgacgatggccttgacggtgttgcgccgggtgcggccgcgcacctgctcgtgggcggtcacgctcttgagaacccgctggaggtaggcatcctgcgccttgctgcccggcgtcgggttctggttgatcacgtacatctgctgacccatggtccagacgttcgtggtcagccagtagacgaggacaccgacggggaagttgatgcccatcacggcgaagatgaccgggaagatgtacatcagcatcttctgctgctgcatgtacggggtcttcaccgtcaggtcgacgttcttcgtcatcagctggcgctgggtgaagaactgcgacgccgacatcagcacgatcatgatcgccgtgacgatccggacgtccagcagatcggcgttgagcgaggtgaccttctcgacgctgtccgtgaacttcgcggcgagcggggcgccgaagatgtgggcctcacgggcgctgtccagcaggtcctggttgatcgccccgatcttcttgcccgaggcgatggacgacagcacgtgatacagggcgaagaagaacggggactgcgccaggatgggaaggcacgaggagagcgggttggtgcccgtctccttgtacagcttcatcatctcttcggactgacgctgcttgtcgttcttgtagcgctcctggatcgccttcatcttcggctggagcacctgcatattgcgggtcgacttgatctgcttcacgaagagcgggatcaggcagatccggatcagcaccaccagggacacgatcgacaggccccaggcccagccggagtcgtcgccgaagagcgccccgtagaccttgtggaactgaacgatgacccatgagacgggcgtggtgataaagctgaacagactggcaatcgtgtccactaatcaggctccttgagcattgggcgaggtctctgcggccgggctcggaggttcggagaccgaccccccggaccgcacatcagcggcggactccccgcccttttcgccgcgcagggcgttacgcagcagctcgtgccaccgcggacgcttgcgtggcgggacatgatccacaccgccgggtgaccacggattgcaccgcaggatgcgccaggctgtcagcgctgttcccttgatggcaccgtgcctgtcgatcgacgtatatccatagtgggaacacgacgggtagtaccggcagacaggcccgaggagtggactgatcgtccactggtacagcttgatgagagcaagcagcgggtacttcatcgcgcgccccctcccagcagccgctgaagggcggcgtccaggtctcgggccagctgtgcatggtcggcgtcgcccgcaccgggcagcgcccgtacgacaacaaggctaccggggggcagctgagccagccggtcgcggaccaggtggcgaagcttccgcttcaccgcggtacggacgactgcgccccccacggccttgctgacaacgaaacccgcacgcggcgggggaacagtctcccccgtcacgtgcgggtccgtatcaccgctgcgtagatggacgacgagcagtggacgtccggctcgacgtcctcgtcgtaccgcggtcgcgaagtcctcgcgccgcctcagccgattctcggtaggcagcacgtcatggacctgttagcgatcaggcggacaggctgctgcggcccttgccacggcggttcgcgagaatcgcacggccggcacgggtacgcatgcgcagccggaagccatgggtcttggcgcgacgacggttgttcggctggaaggtgcgcttgctcactcgggggctccagaaatgattcgtgtgttggcgggacatcgcctggctgtcaccgtgcgcccacgaggaactcgcgtaaacgccttagtgcaccgcttcacaatcacagatcgtgatctttgcccatcggaggcaggcggcagcagccatcgacaactcgacctggtcacggtacgcgcggctacgccatccggtcaaaccggcttcgcgtgacccctcattgtgcacagcctgtggacaacaacttgaaccacgcgggtcggcctgactaccgtggctgaactccggttcttttccttcccgactgccgggcctcacccgacccgacccatcccgtcccgagaaccacacattcgtgggacatgcgagagagcgtgccttgtggctgacgtacctgccgatcttgccgcagtgtggccgcgagtgctggaacaactcctcggggagggtcagcagggcatcgagccgaaggacaagcagtggatcgagcgctgccagcccctggcactcgtcgccgacaccgcactgctggccgtccccaatgaatggggcaagcgcgtcctggagggccgactcgcgccgctcatcagcgagacgctgacccgcgagtgcggccgacccatccggatcgcgatcaccgtcgacgactccgcgggcgaaccgccctccccgccggcgcccccgatgcaccagtcgcaccagagccagcagggccaccgctacccggcgcagccgcgtgacgacgctccgcggggcgacgcgtacgacggctacggtcaccggccctccgacgacgggatgccgacggcccggcctgcctaccccgactaccagcagcagcgcccggagcccggcgcctggccgcgtacccaggaggacctctcctggcagcagccgaggcacggcggttaccaggaccgcgagcagccctccggcgagccgtaccgcgagagcgagtcgtaccgggagcgtgagaacgagcagtaccgggagcagcccccggagcagtggcgcgagccgtacggcaccgggcgcccccagcagccgcagcacgactaccggtcgcagcctcccgagcaccaggggtacgagcagcagcgtcccgaccgccaggaccagcagcaggggccccgccagggcggccacggtcccggacggaccggcggttcggtccccggcccgatgggcgcccagccggcccccgcgccgggccccggggagccgcacgcccggctgaacccgaagtacctcttcgacaccttcgtcatcggggcctccaaccggttcgcgcacgccgcggccgtcgccgtcgccgaggcgcccgcgaaggcgtacaaccccctcttcatctacggggagtcggggctcggcaagacccacctgctgcatgccatcgggcactacgcgcggagcctctacccggggacccgggtgcggtacgtgagttcggaggagttcaccaacgagttcatcaactcgatccgcgacggcaagggcgacaccttccgcaagcgctaccgcgacgtggacatcctgctggtcgacgacatccagttcctggcgagcaaggagtcgacgcaggaggagttcttccacaccttcaatacgctgcacaacgcgaacaagcagatcgtgctctcctcggaccggccgcccaagcagctggtgacgctggaggaccggctgcgcaaccgcttcgagtggggtctgacgaccgacgtccagccgcccgagctggagacccggatcgcgatcctcaggaagaaggcggtgcaggagcagctcaacgccccgccggaggtcctggagttcatcgcctcgcggatctcgcgcaacatccgtgagctggagggcgccctgatccgggtgaccgccttcgcctcgctgaaccggcagccggtggacctcgggctgaccgagatcgtcctgaaggacctgatcccgggcggcgaggagtcggcgccggagatcaccgcgccggccatcatggcggcgaccgcggactacttcggcctcaccgtggacgacctctgcggatcctcgcgcagccgggttctggtgacggcgcgccagatcgccatgtatctgtgccgcgagctgaccgacctctcgctgccgaagatcggtgcgcagttcggcggccgtgaccatacgacggtgatgcacgcggaccggaagatccgggcgctgatggcggagcgccgctccatctacaaccaggtcaccgagctgaccaaccgcatcaagaacggctgacgccggcttccagggcttctccctgagcgcctgtcacggacctccgcggtccgtggcaggcgctttttcgcgttcccggggcgccgcaacggtctgtccagagcctccatcgggctgtccgaggcccgcggcgagcgccgcgccggacccgcgctgttcgaataggggctgctcagaggcccttctccacagatgggggagaaatcttccgtccacagcctggggactgggaagttgtccatattgcgtccacagggcgcgctgccgatactccatcaggccaggtcacgtggctggggatttgtggtcaaccttcatccacagcctgtggacagagttttcgtccacagggggttgtcggcgttgtccactggcggcccacaggctgagccgtgttgtccccagcttctccacacccctgtccactgttcggcaacgcaacacacgctctcaccgcccggagtgaaaggcgtcacaccaaggtggtcggttgggctgtggggaacgtgggtaaagctggggacaggcctggggagaagtggccccctcctgtgcatcgggtgtgcagaactttcgcccgtccacagaaagccccggttgtccacgggcgccacccacaggaccggtggacaaaaaacagtcgctgacctgcgcaaacgacgttatccacggtatccacaaggcctactactactaccacccagagttagccaggaatcagcttcgaagtggggcctgtgtacaactcgaccgtcgaccgccgcgaagctcttggcccgacttgaccccgagcagcaacggctgtcggtgccgtaggtcagactggaccccggagcctccccagccctcggcagggagctccggtccagacgacgaaggccagcagggcgagcgagcaacagcaggaggcggttccggtgaagatccgggtggagcgcgatgtactcgcggaggcggtggcctgggtggcccgcagcctcccggcccgtccgccggcgcccgttctcgcgggccttctgctgaaggccgaggacggagctctcagcttctccagcttcgactacgaggtctccgccagggtctccgtggacgcggagatcgacgaggacggcacggtgctcgtctcgggccggctgctcgccgacatctgccgcgccctgcccaaccgcccggtggagatctccaccgacggtgtgcgggccacggtcgtctgcggctcctcccgcttcaccctccacacactgcctgtggaggagtaccccgcgctgccgcagatgccgaccgccacgggcaccgtccccggtgaggtcttcgcctcggccgccgcccaggtcgccatcgccgccggccgcgacgacacgctgccggtgctcaccggtgtgcggatcgagatcgagggcgacacggtcaccctcgcctccaccgaccgctaccgcttcgcggtccgcgagttcctgtggaagccggagaacgccgacgcttcggcggtcgccctggtgcccgccaagaccctcctggacaccgccaaggcgctcaccagtggcgacacggtgaccctggcgctctccggctccggcgcgggcgagggcctgatcggcttcgagggcgccggacgccgcacgaccacccggctgctcgagggtgacctgccgaagtaccgcacgctcttcccgaccgagttcaactccgtcgcggtgatcgagacggcccccttcgtcgaggccgtcaagcgtgtggccctggtcgccgagcgcaacacccccgtacggctcagcttcgagcagggcgtcctcatcctggaagccggttccagtgacgacgcacaggctgtggagcgcgtcgacgcggtgctggagggcgacgacatctcgatcgccttcaacccgacgttcctgctggacggtctgagcgcgatcgactccccggtcgcccagctctcgttcaccacgtccaccaagcccgccctgctcagcggccgcccggccctcgacgccgaggcggacgacgcgtacaagtacctgatcatgccggtccgcctctccggctgatcccggcgtcccccggccgggggacgtatccgcggcagtttccggcgggcccgctcggcgcggagcgggcccgccgtgctgtcccccgccgggcgtaggctcggtcctgggcgcaaacgccccgacgcttatcgccacgacgcttaaggaatctctgatggagctcggtctcgtcggcctcggcaagatgggcggcaacatgcgcgagcgcatccgccgcgcaggccacaccgtcatcggttacgaccgcaacccggatgtcgccgatgtccacagtctcgaagagcttgtgggcaagctgaagggcccgcgggtcgtctgggtcatggtcccggccggtgccgcgacccagtccacgatcgacgagctcgccgatctgctctcgcccggcgacgtcgtcgtcgacggcgggaactcgcggtggaccgacgacgagaagcacgccgtcgagctgggcatcaaggacatcggcttcgtcgactgcggcgtctccggcggcgtctggggcctggagaacggctacgccctgatgtacggcggcaccgaggagaacgtggcgaaggtccagccgatcttcgacgcgctgaagcccgagggtgacttcggctccgtgcacgcgggcaaggtcggtgccggccacttcgcgaagatggtccacaacggcatcgagtacgccatgatgcaggcctacgccgagggctgggaactgctggagaaggtcgactccgtcaccgacgtgcgcgaggtcttccgctcctggcaggagggcacggtcatccgttcctggctgctcgacctcgcggtcaacgcgctcgacgacgacgagcacctggacaagctccggggcttcgccgccgactcgggcgagggccgctggacggtggaggccgcgatcgacaacgcggtgccgctgcccgcgatcacggcgtcgctgttcgcacggttcgcctcgcgccaggacgactcgccgcagatgaagatgatcgccgcgctgcgcaaccagttcggcggacacgcggtcgagaacaagaagtagccccgcagggggaaacgcggcaccccacgcaccacggcaccacacagcggaacagaaaggcccgggaggtcggcgcacatgcatgtcacccatctctcgctggccgacttccgctcgtacgcccgggtcgaggtccctctcgacccgggcgtcaccgccttcgtggggcccaacgggcagggcaagaccaacctcgtcgaggccgtcggctatctcgccaccctcggcagccatcgggtctcctcggacgccccgctggtgcggatgggcgcggagcgggcggtgatccgcgcggcggtcacccagggcgagcgttcgcagctgatcgagctggagctgaacccgggccgcgccaaccgggcccgtgtcaacaggtcctcgcaggtcagaccgcgtgacgtgctcggcatcgtacggaccgtgctgttcgcgccggaggatctggccctgatcaagggcgaccccggtgagcggcggcggttcctggacgagctgatcacggcgcgttcgccgcggatggccggggtccgctccgactacgagcgggtgctcaagcagcgcaacaccctgctgaagtccgcggcgatggcacggcggcacggcggccgctcgatggatctgtccacgctcgacgtctgggaccagcacctgggccgggtgggcgccgaactgctcgcgcagcgcctcgacctgatcgccacgctccagccgctggccgacaaggcgtacggggacgtcgcgccgggcggcggtccggtggcgctggagtatcgcagctcggtcggcgaggacgtgggccccgagcgcacccgcgacgagctgtacgggcagctgatcgcggcgctggagggggtccgcaagcaggagatcgagcggggcgtgaccctcgtcggcccgcaccgcgacgatctgttgctcggtctgcggtccatgccggcgaaggggtacgcgagtcacggcgagtcctggagttacgcgttggcgttgcggctggcctcgtacgagttgttgcgctccgagggcaacgaaccggtgctggtgctggacgacgtcttcgccgagctggacgcccgtcgccgtgagcggctggcggagctggtggctccgggcgagcaggtgctggtgacggccgcggtggcggaggacgttccgggtgtgctggcgggggcgcggtacgcggtgaccgcgggcgaggtggagcgcgtatgaccggccggggcgagagcgcggcgggccgacgcgggtcggcttctcgcgcgggcggtacgggagcggctcgcgcgaagggtacgggcgcgggccggggcggtgggccgggagaggcgttgtcggatccggccgcttccggggcttcctccgggacgtcttcaggggcgccttcaggggcgtcgaagccgcccgaggtgaccggcgtcgatctcgcgcgggtcgcgctgcgggcggcgaaggagcaggccagggcgaggggtgcggcggcgcagcagaagaagcaggcgcgtcggggcggcgggctgcgctcgggcgcccggtcggacggccgggatccgcagccgctgggctcagcgatcaaccggctgatcaccgagcggggctggga

SEQ ID NO: 2854 - DNA, 11595 bp, Unknown
  Kingdom: Bacteria, Phylum: Actinobacteria, Class: Actinobacteria, Order: Streptomycetales, Family: Streptomycetaceae, Genus: Streptomyces
gccctcgccggagcggccgggcgcaccgggaacccggaggccacggtgctgctggcggcctggtgcgcactggtggcccaccgggcgggccaggactcctgcgtcaccgccgtgccgacctccaaccggttccacgccaggagcgcccgctcggtgaacaccctgtcccaggacgcgctgctctgcctggacgtccgggtcccgtccttcgacaccctggtccgcaagacctggggagcggcgctcaacgcctacaagcacagccagttcgactccgtacgtctgtgggagatgatcgacggggtcaccggggaacgcggcagccacttcgcgcgggacgtggtcttcaacgacgtcagcgtgctgcccgcgaccctgctctccaccgtgccgcaggagcacgagagcgccgaaccggacctggcctggggcccgttccaggcgctgccgacgcggatgctggcgttcacgtacgagacgaccccccagctccacatctccctgtgggccgaccccgccctgttcaccccggacgaggcggagggcttcctctccggcctcgtcctgctgttggaggccgccgcggaccatgacgtaccgctggcttcgctcaccggcgtgacgggtgtccggccggccgagcgcggacccgactggctgcgcgtggacggctgttgggtatcgccgtcggccgtacgggaggcgctgtccggggtgttgggcggtcggcccgtgcacatcgaggcggactccggcgcgggatcgcccccgggcctcaccgcgtacatcgcgcgtggcggcgacacgtcactgaccccgaacggggtccacgacgcgctgatggccgaggtccccgcccacggcggcaccggtgtcatcgccccccggcgctacgtgctcgtcgagagcccgccggccgaggcggacctgagtgccgcatggcgtcgactgcagatcatcgaggaagggaccggcagaagccggcaggtacgacatgagcgttgacgacacgaccctcccgcagaagcgggaagcactgcccagcccctggcggtcgggccggttccggctgttcttcacggcccgcagcgcgtcgctgctggccgacggcatgctgatggtctccctcaccacggccgtactgggagcgggccacggggcgaccggcgtcggctacgcgctggccgcgtggatgaccccgatcgtcctgctggtgctgttcggcggggtgctggccgaccggttcaccccgcagctgatgatgatctgcgccgacctggtgcgcatgctggccatgatcacactggccgcgctgctgttctcctccgaccgcgtcccgctgtggcagatcatggcgctgatggcgctgagcggcgcggcgaccgcgatgttccagcccggtatggcgagcatggtcccccgggtcgccgaggacatccagaaggccaacgcgctgctgcgcatatccgaggccctgagcaccctgctgggccccggtctggccggcatcctcgtcgcgtactggcaggtctcgggctcgtacctggtcatcgcggcggcgtacgcgctcagcgcgctggtcctgctgcccctgcggacgctgcacacggtccgcgacgagggcgacgacccgatgtggcgcaggctcgcgacgggctggcaggagttccggtcccgccagtggctgtggggcgtcatcgcggtctggtccgtctacggcctgttcgtgttcggccccgcgctgccactcggcgcggcgctgatgatcgagcagcacggggcgagcggctacggctggatcgcctcggcggacggcgcgggcacgatcatcggcggcctgatcggcatgcgggtccgcccccgccgccccctcgtagcgggggccctggccatgctctgcttcgcgctgaatcctctggccccggcgctcgaatggtccttcgcggccacggccgtcgcgcacgtcatcgcgggttacggtttcgcgttctggggggtgatgtgggcgaccagcgtccagtcgcacatcccgctgacagtcctgagccgcgtctccgcgtacgacgtcgccggctccatcatggtcatcccgctcggccgcgccctggcgggcccggcggcggacgcgttcggcgcgaacgaggtgctgatcttctcgtcggtcatgtccttcgcgctgctggccgtgatgctcagcgttccggcgatccgcgcactgcgcagggcgccggagggcatggcgaggacggtggagggcgaaccggcggtccgacccggaccaccggggtagcgacgtaccggtcggcctcgcgggcgggcacgacgtaccggtcggacctgcgtgaccggtacgtcgtacagcgggacacctggcggccctttcagcgagctggcgtgggcccggccgggggcggacggcacagcgaccggcccctcctcgccgaagcccgcctggccgcttttcgacgttgctcccgggaagagcgccgtgacagcatcccgtgggtgactgaccacggggacgacatacctgaacccggccgccgccggtccaggctcgccgatctggccgactggaccgtgtccgaggcccctgcgaatgccgcgcttccggcgcctgaaccggaagcggggccggtggacgctctggcgtccgcccggcgcgagttcgcgattctgctcggtgagttccggcgtacggcggtgctcgttccgttcgacgcgtacgggagtctgtggacggcggaccagaacggcgtccgctggatctgtgcgttctcgaacgaggacgcgctcgcccggttcgcgcgagcacagggcgacggcgagcgggagtggacgtaccgcacgattctcggtgcgcgcctgctggatgcgatggtgccgctgctgccgggcccggcaggagtcgcgctcgatgccggaagtacggacggcgtgctgtttccgccggtcgcgggcatcgtgcccgaccacgtggcggtcgatctgggggagacgggatgagcggggagaacgcggatctgaacgtgccgccggcgacgttggcgcagatcgcgaagggcatcgacctggcgcacaccgagttgaaggcactcggcatgaccgggcaggcgacggcgggccgcggcttctcggatctcgccctctccggcctggagttggggcacggcgggctgacatcgaagttcgagacgttctgcaaccggtgggagtggggcgtgcgggcgctgtcccagcggggcaacggtctcgctgccgggttgggcctgtcggtggggtcgttcgccgagcaggagcagtacgtcaaggactcgctcaagatcgtggtcaactccaccaacgggaacccctacctgtccgaggacgaggtcaagggcatgagctgggactcgatcagcaagcagcacgcctgggacgacccggactggagcgtggactcgttcaccgaggcccacggcgaggtgaagcagcagtggaaggacaccggatacgacgtcggggacgcgctgctggacgcttcgggggccgacgccgcgcagcgtgaggaaatcgacgcatgggctgaggagcatctcgatccgtcacaggagaccgtggctcaggccgaggaaccgcgctgggggcaagaccgctgatggtggactggcgaggagggttcgacaacgtcgtggacggcaccgtccggggcctcgacaagggcaaggagctcctgggcaagggcgtcgacgcggcgacggacaaggtcggtgcgggtctggacaaggtcggcgcacacgactgggccgacaaggtcgaagactggggtgacgaaaccgcgtcctcgctgggcgcggaggtcggggagaagcagctggggcagagcgaggaagccgacgagctgattcacggcaagccggagaagatcaccgcgacggtgaagaacctccgtgacttccagaaggccttcgatctcgtcggcggcgggatgaagaagctcgatgccggtcagtggcgcggggaggcggcggacgccttccggtcgaagttctcgacgcttcccaccgactggctgcacgcggcggacgcgttcgaggacgcggcgaaggcactggagacgtacgggtcggcggtcacgagcgcccagggcaaggcacgtgcggcgatagcgctctacagggagggcacgcaggactccgagaaggcggtctcggcgttcaacaagaaggtcgacgtctacaacgcggcccgcaacggcgacgaaccacttccccacccgggcgccttctccgacccgggtgtgtccaagcggaagcaggctcaggaagacctggaggacgcccgacgcatacggaacgaggcggcgggccgggccgagagcgcggtcgccgcggcgatggcgcacgccccggaggagccgacgggagcggacctgctcaagaacgagctgtacgaccacggcctcgcccagggcgtggagctggcccacttcggcggtggcgtgctcaagggcgtcggcggcctggtcggcttcctccgccagacgaacccgatcgacccgtacaaccttacccacccggcggagatgtacaagggcgtcaacatgacgctctccggcctgaccaggacggtcgccaaccccgaccgggccctggagaacgcctgggacgcggccaagggcgacccgtccgaattcgtcggccgcctgctcccggaagccttggggacgaagggagccggagcgctgaagggcggcctgcgggcggggctgcggaaggggggtgggcccgaggagccaccaaaaccgccggggccggcacgcgaagggcatgagaaggcgcccgactccactagcacgcagtgcggcgaagtcaagtgcgtcaacgatccgatcgatgtagcgaccgggcgcatgctcctcccccagacggacatcgcactccctggatctctccctctcgtgttctcgcgcgtgttcgactcctcgtaccgaagtggccgctggttcggcaccgggtggtcgagcacggtcgaccagcgcctggagatagacgcgcagggcgtcgtgttcacttgtgaccagggcagtctgctgtcctacccgcaccccgcgcctggtgttcccgtcctgcccacacacggtcggcagtggcctctcgatcgggtggccaacggctacaccatcacagacccgcaaaccggccaggttctgcacttcgcacgccagaactccgacctggctctgctggcccagatcgacgaccgcaacggccgctggatcactttcgagtacgacgaggcgggagctccgacgtccatcgtccaccacggcggctaccacctgaaactcacgacggccgaagggcgggtcaccgccctgcacttgacgggtgccgcaccggacggaagcgaccaggaaatcttgcggtacggctacacggacggccacctcacggcagtcaccaactcctccggccggcctctacgcttcgactgcgacgacctgggccgcatcaccgcgtggacggacaccaacatcagccgctacgagtacgtctacgacgatctcgaccgctgcgtctatcagtccggcacggacggccacctggaagcacacttcacctgggatggtgtggaccccgagtcgggcctgctcatgacgtccacgaccgacggcttgggtcacaccacgcagtacgtcgtcgacgaacgggcccaggtggtcgccgagatcgacgcaaagggcgcagtcactcgcttcgagtatgaccgctataaccgacagctctccgccaccgacgccatgggcaacgtcagccgttctgcctatgacgatcaaggaagattgacccgagtggtccgccccgacggccgcgaggtgacagctgagtacaacgccctgggccgtgccgtccgcatcaagaacgcggacggaacagtaactcatcagagcttcgacgaccgaggcaaccgaacctcggtcacagacgcttcgggcgcaaggacgaccttctcctatgacggcgcgggaaacattgtggcctcctccaacgctctcggggagcgctgttggatacggcgcgactcggccggacttcccatggaggtgatcgacccattggggcgcactgtccgatacgagcgcgacgccttcggccgaccggccacccttaccgatgctgctggaggaatcaccacctttgactggaccgtagagggccgactcgctcgccgcaccgaccctgacggcaccccccggtcctggacgtacgacggcgagggaaactgcctcacacacactgatgccatgggagccgtctcccgttatcagtacacacacttcgacctggtgaaggcacgaaccggaccggacggcgtgcgttatgagttcgaccacaacactcggctgcagctggtccaagtaagaaacccactaggtttgacgtggagttatgagtacgacgcgacagggcgccttgttgcggagaccgattttgacaatcgaacactcacctacgcttttgattccgctggacgcttgacggagcgcgcgaacggcctcgacgaaaccattcactacacatacaacgagctcggccaaataatcaggaagaatgttgcaggagatgtcactacctacgagtacgacatcttcgatcagctggctcgggcagacggcccgggcgtgacactgaatcgcctacgggaccggcatggtcgtctgaagtcagaatcggtcaacggtcggacgctcatgtaccagcacgacacacttgggcgtcgcatttcccgcacaactcctaccggagcggtgagcacatggtcgtacgatgctgtcgggcagcctgcgacactcgacgcatccggtcgaaccttgaccttcatccgcgatgttgcgggccgtgaagtgggtcgcaacattggagacgcgacgaaactggcgcacgagttcgacgcagcaggccgtctcaccagccaacaggtatccgtccacaaccgtgcacttcgtagccgaacctacgcctaccgtgccgacggaaacctcgtcggcacgactgactcattcgagggcaaccgcacattcgatgtagatgccgcaggccgtgtcacagccgtcagcgccgcgaattggaccgagacttacgcgtacgatcagacgggaagtcagacccgggcggattggcccgcgtcgcacgccgaccaagattcgacaggatcacgtgcctacgcgggaacacgaatcatccgcgccggccacacacggtacgagcacgacgcacaagggcgggttgtacaacgtcagaaagtccgactttcccggaagccggacacatggcgctatacctgggatgccgaggaccggctcacttcagtggtcatgcctgacgccacccggtggcgctacctgtacgatccgcttggccggcgcgtggcgaaacaacgcctggccgtggagggtgactccgtagtcgagcaagtctggttcacctgggacggaaccatgctgtgcgaacaagtggcgctcactccgtctcgcgaaaattccatcgccctgacctgggattacgacggatttcgcccactcagccaaaccgagcgcattctcgcctcggacgcctccgagtcctcgatcgacgaccgatttttcgccatggtcactgacttgaccggaaaaccgactgaactcattgacgagtcgggtgaactggcttggcattctcgcaacacactatggggcacaacaagctggtccacaaagagcaccacgtacaccccactccgctttccgggacaatatttcgacccggaaagcggtctccattacaacttccaccgttactacgatccagaagtatcacgatacctttcggtggatccgctgggcttggcgccggcactcaatccggtttcctatgtggataatccgcacacatgggcagacccgctcggattggggccgtgcccgcccccatcactcgcagacgcgaaaagtagggcactcaaggaagccggcgtacccgagggtgcagagccgctggaggtcgaccactacgtcccggccacgacacccccctggcagggcagtaaacaaattatggacgagaatcatcaacccatctattacactgaggaatggtacgaaacgtcaaccggggatatcatcgtattccaggatcatcattttggtcaccagaagcccggagagcccgggcatcaacctgcgcatattcacgtgagacccttcgacaatacaagaaatggccaaatcccaggaactgaggagcactattattatgacaaatcactgggctgatctactcaacaccaagagaggcctggaaaccttgtacgacgccatcccccctctggattccgtacgtctgagatcttttcacctaaactggcgggggcccaccatcaccacccgggtcgaccttccgacctatccggacaacccgccacacgaatggtccgagcgcgaccacaacacactacagattcatctacaattcctcgctatggacgagttggttgtacgcggctggattccgtccggccccgtgagtttcagcttttccatcctggaccgccgcaggctcctcactcgaatcaccggaaccgggttggaagtttcttttacgtgcagtgattcgcttggtgtaggtcacatcagctcattccgatccaccacctccgggtccgaagagggtgcgcacagcttccttcagcccctcgatgcacgcaggttttcctccctccccgaaacatatgagagcacctactatgaacgcatctgactgggcccagttcctggacgatccgcagccacttgatcagctgtacgatgaggcaccaaacctcgatcggtgcgatcttttccacttcctggcggatgagcgagaagaaagcatcaccctcgggttccgaaccgaccagttgccaacacgcccgagacctgaatgggagggaacggaatacaattccctcaccttctacctcgttttttccggtgtccaagaattgaccgtgcaaggttgggccgctccggcgcagaagagaatttctgtcggccgccactcgaatgatgggttggcaatgacgatcacttcggacggcacgtcggcggtctttcgttcccgcaccgtatcctttacaggggcccgcgtgggattggtgtcgcgattcgagtagtcgccgtctcctcgggaggcgcgtttccagatcgccggaagaacacggtggttggcagccgagtggtactggccgccctcactcctccggcggaaagaccacctcccccgaccccgccagcgtcagcgtgatcgcctccaccgggcagccctccgccgccgcgaggagttgttcgttcgcgtcgtggtcctcgtccgtcgggtgggactgacgggccgagtccaggtggaagccgtccggggcgtggttgacgcacatgccggagccgatgcagaccgagcggtcgacctccacgtgccagcggtcacccatcacgcctcccggtagccggcgggcaggtggatcatcttgtgctcgaagaactcgccgtagccctcggggccgaactcacggcccaggccggagttcttgtagccgccgaaggggccgaacatgtcgaggctgaaggtgttcacgctgtaggtgcccgtgcggacccggcgggccacgtcgatgccgcgttccgtgtccgccgtccagacgctgccgctgaggccgtacggggagtcgtcggcgatccggacggcttcgttctcgtcctcgtacgggatcaggcagatcaccgggccgaagatctcctcgcgggcgatgcgcatggagttgtccaccgagccgaagagggtgggttcgacgtaccagccgtgttcctgggaagggggacggttgccgccggtgaggatcttggcgccctcctcctggcccaaccggatgtagtcgagcgaacgttgttgctggcggcgggccaccagcgggcccagttcggtcgtcgggtcgagggggtctcccacgcgcagggctccggccgctgccgcgaaggcttccgcgatctcgtcgtagcgggagttcggggccaggatgcgcgtctgggccacgcacgcctggccgttgatcatccaggcgaaggggacgatgcccgccaccgccgcctccaggtcggcgtcggggagaatgacggccgccgactttccgcccaactccagtgtgacgcgggtcaggttgcgggaggccacctccatcacgcggcggccggccgccaccgagccggtgaaggagaccttgtcgacgtcccggtggcccaccaggtattcgctgacctcccggtcggccgggaggatggagaggaccccgggcggcaggcccgcctccgccgtgatctccgccaagaggtaggcgtccaggggggtttccggtgagactttcaggaccgccgtgcagcccgcgagcagcgccggggccagcttggcggcggccgtgaactgcgggacgttccacgggacgaccgcggcgaccacgccgaccggttcgcggcggaccaggaggggaccgaggacgccgtcccgtcgttcctcgtacgggaagtcgcgcgccaccgtgatcgccgagtcccagaccatcatcgcggccagcgcctgcaccatgacgctcgaactgtacggagtgccgttctgggcgctgatcaggcgcgcgaactcctcgtgccgtacggcgaaggcgtccttgatccgggtgatcaccgcgatccgctcgtccaggcccatcctcggccaggggccctcatcgaaggcgcggcgggcggcggcgaccgcccggtccacatcaccctcggaggcgtgcggcacacggccgatgacctgttcggtgtgcggggagatcacctcgatgacctcggtgccgagcggttcggtgaactccccgccgatgaacagttgtccgtgttccacaagctccgtaagttccgtcatggccgttgcctcccgcgaaaccgtgcacccgaaactgactgttcgtcagaactgataccagttcctgttccaggagtccacggctcggaccgcacccggagcgcgaagagttggtagacctgggctaccactggaacgagttctcgttacagtgggctcggcgcacgccgccgagcggagagccgagcagagatgggaagcccatgacacaggtgaccgaccacggcggaggcgtccacagcatcaaggtccccatccccgacaatccgctgggccacaccctggtccacctcgtcgacaccgaccggggacccgtcctcatcgacaccggctgggacgacccggcctcctgggacaccctggtcgccgggctggccgccctcggcgccgccgtcaccgacatccacggcgtcgtcatcacccaccaccaccccgaccaccacgggctctccggccaggtccgcgaggcgtccggggcctggatcgcgatgcacgaggccgacaccgcgatcgtccggcgcacccgggaatccgagcccggcacctggctcgactacctcacccgcaagctcgccgccgtcggcgcgccggacgaccacctcgcgccgctgcgtgccgcacgcggcgaagggaggttgcggac

SEQ ID NO: 2855 - DNA, 20759 bp, Unknown
  Kingdom: Bacteria, Phylum: Actinobacteria, Class: Actinobacteria, Order: Streptomycetales, Family: Streptomycetaceae, Genus: Streptomyces
ggcggcggccgccgccgcggtggcggcgggcccgacggcccggggggcagggggcgcgaccacggcgaccccggcaagaagcgctttatcgactacccgcgccacggcaggtacgggttccgccggtgggtgccctcgtggaagctggtgtcggggctctgcctggggttcttcggcgtgctgatgggcatcgggggtatctcgtacgccctggtgtccaagccgaacatcaacgaagcggccgaggcgcagaacaacgtctactactgggcagacaacacccagatggtggcgacgggtggcgtggtgaaccgccagatcctcaagtacgagcagatcccggtggagatgcggaacgccgtcatctcggccgagaacaagagcttcgaaacggacaggggcatcgacccggtgggcatcggccgtgcgctgttgaacatggccacgggtggtgagacccagggtggctcgaccatcacccagcagtacgtgaagaactccatgctcacccaggaccagacgctcaagcggaagttccaggaactcttcatcacgctcaaggtcgccggtgaggacagcaaggaagaggtgatggcgggctacctcaacgtctcctactacggacgtggggcctcggggctacaggcagcggcccgcacgtactacaacaaggacgccggcgaactgaacgcgagcgagtgcgccttcctggccaccctgctcaagggcgcgagctactacgaccccgccggcgcacccgacatcgacaagaacaacgcgaccgcggagaagaacaccaagcgggccaaagagcggtgggagtggatccttgacgagcaggtcaaggacaagcggatgacggcggaggagcgcgccaagtacacgaagttccccatgccgctgccgaagaagaaggacgccaagctgggcggtcagaccggctacctggtggagctcgccaagaagtacttcctcgccaacaacacgcagggcatcgacgccaagcagctcgaactgggcggctacgagatccacaccaccttccagaagaagagggtgcaggagctcgaagccgcggtgaacaaggtctacaaggccaagatccgccccaaggaccgtcccaagacggacacgcacgtcgagttcggcggtgcgtccgtggacgcgaagaccggcgccatcatcgccacgtacggcggccaggacgccaccacgcactacacgaacaacgccgacgccaccggcgcccaggtcggatcgacgttcaagccgttcgtgctggccgcggccatgcagtacggcgtgcgcgatccgtccggcggggaggaacagagcgagtccgagcgcacccaggtctcgccggagagcatctacaacggcgacgacggcctgcggatcagggactacacgggcaagatctggctgaacgaaaacgacgaggaatggcgtcagaccaacgacggcaactacgactacggcgagatcgacctgcggacggccatggagaagtccgccaactccccgttcgtgcagctcggtatggacgtcggtacggacaaggtcaaagatgtcgccgttgcctccggcctgaaggacgacaccttcatggcggacgcgaccgtcccctcgttctccatcggcacctcgtcgcccagcgccatccgcatggcgggctcctacgccaccttcgccacgagcggccagcagaacgacacgtactcggtgaccgaggtgaagcaggggggcgcggtcgtcttccagcacaagaagaatcccaagcgcgccttcagcccggccatcgccgacaacgtgaccgatgtgctgaagaacgtcgtggagaagggaacgggtgagcccgcgcggctggagggccgtgaggccgcgggcaagaccggtacgacggacggcaaccggtccgcctggttcgtcggatacaccccgcaggtctcgaccgccatcagcatgttccggctcgacgacgacgagacgaacaagaagcgcgagttcttgaagatgttcggcaccggtggcgaggagaagatccacggaaactcgttcccggcctccatctggcacgactacatgaccgcggcgatgaagggcaagaaggccctgtccttcccggaaccgaaggaccttggtgatgtcgtgtggggcggtggcgcggtcagccccagcccgacgcccagtcccacgccgtcgccgtcgcgctccgaggagccgccgccgcccccggatccgacccagaccaccccgagtccgtcgccgacgccgaccaacacgtgcggcatcttcgacccgaactgccaggaggccaacggcggggcgaactccggagcggacgccgggggtgacaacaccggagccgacgccgggggtgacaacaccggagccgacgccgggggcgacaacaccggaacgaccgacggtgccgacagcggcggagcccagggagcgaacggcaacccgggcgggaccggctccatctgggggaacaccggatagcgggaccgtcggccgggccctcacgggcctgcccggcacagcggcgagggccgccgtacccacccgggtacggcggccctcgccgtgttcccggcggctgcatgcggcatcccggctctgtgcccgtgtccccgggcggtccttgccccgggcacagccccgtacggcaggatgtgcggcatgccaagccccagcgcagaagacacgagcgtgcaccaggagcggccggtcgtgcggcccacggatcaggacgaggtcgcggcggccggcagcgagctgttcggtggccgggtgggacgctgggcgcggctcggcgacggcccgctcacgcccgtgcgcgtcgtcgcgctggtcatgatcgggatgttcgccctcggcatggtgcagaagatcccctgctacgaatgggcctggttccgcggggccacctcgcagtacacgcacgcctgttactccgacattccgcatctcttcatggggcgcggcttcgccgacggcctcgtgccgtacttcgaccggctgagcggcgatatgcagtacctggagtaccccgtgctgaccggggtgttcatgcaggtggcggcctggctgacgctgacgcccgacagcgaccccatccagcagcgcgagcagatgtactggatggtcaacgcgggcatgctgatgatctgcgcggtggtcatcgccgtgtgcaccgtccgcacacaccgccgccgcccctgggacggcctcctggtcgcgctggcacccgcgttcgtcctcaccgcgaccatcaactgggacctgctggccgtcgcgctgacggccggggcgatgctcatgtggtcccggggccgggtgctcgcgttcggcatcctcatcggcctggcgacggccgccaagctctatcccgttctgctgctcggcccgctcctggtgctctgctggcgggccggcaggcagcgcgagttcgggacagccctgctgggcgcgggggcggcttggctggtggtgaacctgccggtgatgatcttcgctcccgagggatggcggaagttctacaccttcagccaggaacggcccatcgacttcggctcgttctggctcatcatcacccagcgcaccggcaagcccatcgacgtggagacggtcaacaccgcgtcggtcgtcctgatggccgtgttctgcgcgggcatcgcgggcctggcgctctccgctgcccgccggccgcgcttcgcccagttggcgttcctggtggtggccgcgttcatcctgacgaacaaggtctactcaccgcagtacgtgctctggctgatcccgctggccgtcctggcccggccgcgctggcgcgactttgtcatctggcaggcctgcgaggtcatgtacttcctcgggatctggttctacctcgcctacaccagcaacggcgacaagcaccaggggctgccgcaggagggctaccaggtcgcgatcgccctgcacctgctgggcacgctgtacctgtgcgcgctgatcgtccgggacatcctgctgccggacaaggacccggtgcgcgaggacgggtcggacgacccgtcgggcggtgtcctcgacggggctccggacgcgttcgtgctggcgcccgaggcccgttcgtccggataccgggccccgacggtcacgggacctcaggtggagtggggcgcggcgcccacccgggacggctgatccgggtcccggcgcggccgttgagggccgcgccccgggcggctcagcggtcgacgagccggtcgtactgcgtggtggtgtggcgcaggtgggcgaccagctcgtcgccgacccgcggctcctgggcgtccgagggcacgaacaggatcgacacctgcatgtgcggcggctcggcgaaccaccgctgcttgcccgcccagacgaacggcgacaggttgcggttgaccgtggccaggcccgcgcgggcgacgcccttggcccgcggcatcacgccgtgcagcgccttgggcgcctccaggccgaccccgtgagacgtaccgccggccacgacgaccaaccagccgtcggacgcggccttctgctggcggtagccgaaccggtcgcccttgacgacgggggtgacgtccaggacggccccccggtactcggtggcctcgtggtcgccgagccagagccgggtgccgatgcgggcgcggaagcgggtctgggggaactgctgttggagccgggccagctcctcggcgcgcagatggctgacgaacatggtgtgcagcggcagccgggccgcgcgcagccggtccatccagccgatgacctcctcgacggcgtcggagccgtcggtacggtccagcggcaggtgcagggcgaagccctcgagccgtacgtcctcgatcgccgcgtgcagctgcccgagctcctcctccttgacgccgtggcgcttcatcgagctcatgcactcgatgacgacgcgggcgcccaccagggcgtgcaccccgtcgacggaggaaacggaccggatgacgcggtccggaagcggtacgggctcctcaccgcgccggaacggggtcaggacgagcaggtcgccgctgaaccagtccttgatccgggcagcctcgtaggtcgtcccgacggcgagggtgtcggatccgaagcggatcgtctcgtcggcgaggcgctcgtggccgaagccgtagccgttgcccttgcagacgggtacgagtcctgggaactggtcgatcacggacttctggtgcgcccgccagcgcgcggtgtcgacgtagagggagagcgccatggccggcccggaacctttctggtggctgcggtggatcaggaacgaacggtgtgtgcccagatgtgcggtgaagcggatcagcgacgcgacatatagatgtcgagagccttgtggagcagcttgttgagcgggaagtcccactcgccgacgtactcgacggcctcgccgccggtgccgaccttgaactggatcaggccgaagaggtggtcggtctcgtccagcgagtcgctgatcccgcgcaggtcgtagacggtcgcgcccatcgcgtagctgtcgcgcagcatgcgccactgcatcgcgttcgacggccggacctcgcgcccgatgttgtcggaggcgccgtaggagtaccagacgtgtccgccgacgacgagcatcgtggccgcggagaggttcacgccgttgtgccgggcgaagtagagccgcatccggttggggtcctcggagttgaggacggtccacatgcgctggaagtacgagagcgggcgcgggcggaagcggtcgcgcacggcggtgatctcgtagagccgctgccactcggccaggtcctcgtagccgccctggacgacctcgacgccggccttgtcggccttcttgatgttgcggcgccacagctggttgaagcccttgaggacgtcctcgagcgagcggttggccagcggcacctggaagacgtagcggggctgtacgtcaccgaagccggcgccgccgtcctcgccctgctgccagcccatcttccgcagccggtccgcgacctcgaaggcgcgcggctcgatgtgcgtggcctcgacgtcgcgcaggcgcttcacgtccgggtcctggatgccggacttgatggcagccgagtcccagcggcggatgaccaccggcggacccatcttcacggagaaggccccctgctgcttgaggtgcgcgagcatcggctggagccagtcgtccaggttcggcgcgtaccagttgatcaccgggccctcggggaggtacgccaggtagcgcttgatcttgggcagctggcggtacaggaccaggccggcgccgacgatctcgccgttcttgtcgaaccagcccaggttctccgagcgccattcggtcttcacatcagcccacgccgggacctggcagtgactggccgagggcaggctctggatgtacgccagatgctgctctcggctgatggtcctcagggtcaggctcatgcggggcgctcctcggcaggtgtgtccccatcggtcaggggctccggctctcgcgccgaagcctactgtgaccgaggggcgcccggcctggccccgggggcccggaacgcacggcggaccggcgcgggcgcccgggcacccgcgccggccggtgttccggccggtgctccggtcaggtgatcacgccgccgaagagaccgccgtgggccatgccgagaaagaagccgacggcggacgcgccgagtccgatgatcaggccgaaccgttcgccggtggtcctggagacgtacatcccgtacccaccggtcaggatgccgacgagcccggcccatgagctgatcaggtgcaggtggtggaacatcgccgtaacgaaggcgagcgcgcccagcacgagggtcacggcgagcagggtgtcctggagcgggtgcggcctgccgtccgacgcgaagagcgagccggtggcgggtcggatggtctgtgccatggagtacctcctggccggacgacgggcggtggttccagcgccgttcgcaccgcggcgggtgtagcgcctctcacaccgcttctgtctcgattgtgccctctgagctcctgatttcaaccggaagccggtctacgggtagtctgtacggtctgcaccggtgtctgcccaggccagcacggcgagcctctccccgaaccccgtatccgggatcgttcgggagtggattgtcagtgctgggtgttctcctcgggaacaccgttgcaacacgcatcacgaccctcctgccacggaacgaccgtggccgctgagtccaaaggaggtgggttccacatgcgtcactacgaggtgatggtcatcctcgaccccgatctcgaggagcgagcagtctccccgctgatcgagaacttcctctccgtcgtccgtgagggcgacggaaaggtggagaaggtcgacacctggggccgtcgtcggctcgcctacgagatcaagaagaagcccgagggcatctactcggtcatcgacctgcaggccgagcctgcggtcgtcaaggagctcgaccgccagatgaacctgaacgagtcggtcctccggaccaaggtcctccgtcccgagatccactgagcatctagctcagcggttttcgggtccgagtagcagcaagcagccagaagcaatccccgccgagaggttcacccatggcaggcgagaccgtcatcacggtcgtcggcaatctcgtcgacgaccccgagctgcgcttcaccccgtccggtgcggcggtcgcgaagttccgtgtcgcgtccactccccgcatcttcgaccggcagaccaatgagtggaaggacggcgaaggcctgttcctcacctgctcggtctggcgtcaggcggcggagaacgtcgcggagtcgcttcagcgaggcatgcgcgtcgtcgtgcagggccggttgaagcagcggtcctacgaggaccgtgagggcgtcaagcgcacggtctacgagctggacgtcgaggaagtcggccccagcctcaagaacgccacggccaaggtcaccaagaccaccggtcgcggtggtcagggcggccagggtggatacggcggcggccagcagggcggcggcaactggggcggcggtcccggtggcggtggccagcagggcggcggcggtgcacccgccgcccacccgtgggcgaccggcgcgccggcaggcggccagggcggcgggggacagcagggcggcggaggcggctggggcggaagctccggcggttccggcggttccggcggtgcctctggcggcggctactcggacgagcctcccttctagggctgctcgtacccccacttcttgatcacacaggagaaacaccatggcgaagccgcctgtgcgcaagcctaagaagaaggtctgcgcgttctgcaaggacaagacccagtacgtggactacaaggacacgaacatgctgcggaagttcatttccgaccgcggcaagatccgtgcccgccgcgttaccggcaactgcacgcagcaccagcgtgacgtcgccacggctgtcaagaacagccgtgagatggcgctgctgccctacacgtccaccgcgcgataagggaagggtgacaagagcatgaagatcatcctcacccacgaggtctccggcctcggcaccgccggcgacgtcgtcgacgtcaaggacgggtacgcccgtaactacctggttccgcgtggcttcgccattcgctggaccaagggcggcgagaaggacgtggcgcagatccgccgcgcccgcaagatccacgagatcgcgacgatcgagcaggccaacgagatcaaggccaagctcgagggcgtgaaggtccgtctggctgttcgctccggcgacgccggccgtctcttcggctcggtcaccccggccgacgtcgctgcggcgatcaaggctgccggtggtcccgacgtcgacaagcgtcgcgtcgagctcggctcgccgatcaagacgctcggcggacaccaggtgtccgtccgtctgcaccccgaggtcgcagcgaagctcggcgtcgaggtcgttgctgcctaagggcagagctcagctgagtcagtgaagggccgcacccattgggtgcggcccttcctgtttcatgaccctgttttcaggattttgtctctcaggaccctgctcgggacgcgcggtgtttcacgtgaaacaggcggcgtgtttcacgtgaaacacgccgtgcagtgtgcggatcagcgcgtggctccggtgacgatccaccggcccgaccgggtacgcagccagagcgtgatgaggcggacggccatcatcagcgtcatcgcccaccagagtgcggtgagcccgccgccgagggagggcacaaggagggcgacgggcgcgaagacggcgagcgtcaccagcatcgcccaggcgagatagcgcccgtcaccggctcccatcaggacgccgtccaggacgaagaccacgccggcgatcggctgggagaccgccacgaccaggagcgcgggcagcagggtgtccttcaccgaagggtcgctggtgaagagcgggatgaacaggggccgggcgagcacgatcaggacgccgaggacgatgccgcaaccgaggccccactcgaccatgcggcggcaggcctcgcgcgcgcccctctcgtcgttcgcccccagatagcggccgatgatcgcctgcccggcgatggcgatggcgtcgagcgcgaaggcggtcaggctccagagggagaggatgatctggtgcgcggcgatgtcgacgtccccgagccgtgcggccacggcggtggcgatcatcaggacggcgcgcagggacagggtccggatcagcagaggtacacctgcccgtgcactggccctgatgccggccgcgtccgggcggagggaggcgccatgccttcgggccccgcggatcaccacgacgagataggcggcggccatgccggcctgggcgatcaccgttccccacgcggatccggcgatgccgagcccgacaccgtagacgagggtcacattgagggcggcgttcaccgtgaaaccgccgatggcgacgtacagcggggtgcgggtgtcttggaggccgcgcagtacgccggtggcggcgagtacgacgagcatggccgggatgccgaggatggagatcctcagataggtgatggcgtacggagccgcggtgtcggacgcgccgaagacatcgacgagccagggggccgtcgggaccgtgagagcgacgacggctgctccgagcagaagggcgagccagatgccgtccatgccctggcggatggcggcgggcagatcgcccgccccgacgcggcgggcgactgccgccgtggtcgcgtaggcgaggaagacgaagatgctcacggccgtcatcaggagggttgcggcgatgccgaggccggccagttgcggggtgccgaggtggccgacgacggcgctgtcgaccatcacgaacagaggctcggcgacgagcgcgccgaacgccgggacggcaagggcgatgatctcgcggtcgtgccgtcggcggccgttcttcgaggtcgcgggggccttggtcatgggggtcaatctaatcttccacaggtaagagatgcaatgggtctagggcccttacttgtgcccctgtcgcgccttcctccccgcgccgtatgcggtgatcttgaaatgagtgcgaaagtttttctcccccacagtcagtggatggagaatgcgcaggtcagagtagtcacgctgtcgtcgctatgagtttgtccacagtcctgtcccccgctccgtgcacaggttcggcagggttctccacagcatctggtccgtcgtccacatgccctgtggataaccagattggctgacggtgcggaggggcctaccgtggggcggcgcccgcactccgttccggcaccggaatccaccgaaccagatgcgccggaagtggagtcgggcgacctgtttgtcggtgccgtgccgtaagaaagagtggcacggctaggtccgcgatgcggacgggaggaggcggcccggtgagcattcccgagcctttggacgacccctggaccgagaccggtcccggggaccgtctgcctgtctcccgacagcgtcgcggggaccgcaaggggcgtgaggaccgccatgaccgcggctcggaccaggcctgggagggcggctcccccgggttcgagcgggtgccgccccaggatctcgacgccgagcagtcggtcctcggcggcatgctgctgtccaaggacgccatcgcggacgtcgtggagatcatcaaggggcacgacttctaccgccccgcccacgagaccgtctacacggcgatcctcgacctctacgccaagggcgagccggccgacccgatcacggtcgccgccgagctggtcaaacgcggagagatcaccaaggtcggcggagcaccgtatctgcacaccctggtgcagtccgtgcccaccgcggccaacgcctcgtactacgcggagatcgtccacgagcgggcggtgctccgtcggctggtcgaggcgggcacgaagatcacgcagatgggatacgcggccgacggggacgtcgacgagatcgtcaactccgcgcaggccgagatctacgcggtcaccgagcagcgcaccagtgaggactatctccccctcggcgacatcatggagggcgcgctcgacgagatcgaggccatcggttcgcgcagcggcgagatgaccggtgtgccgacgggcttcacggacctcgacgccctgacgaacggcatgcaccccggccagatgatcgtcatcgcggcccgtccggccatgggtaagtccacgctggcactggacttcgcgcgcgccgcgtcgatcaagaacaacctgcccagcgtcatcttctccctcgaaatggggcgcaacgagatcgcgatgcgtctgctgtcggccgaggcgcgggtggctctgcaccacatgcggtccggcacgatgacggacgaggactggacgcggctcgcgcgccggatgcccgaggtctcggccgccccgctctacatcgacgactcccccaacctgtcgatgatggagatccgcgcgaagtgccgtcggctcaagcagcgcaacgacatcaagctcgtgatcatcgactatctgcagctgatgcaggccggtgggtcgaagcggtccgagagccgtcagcaggaggtctcggacatgtcgcgaaacctgaagctgctggccaaggagctggaagtcccggtgatcgcgctatcgcagctgaaccgtggccccgagcagcgcacggacaagaagccgatggtgtccgacctgcgtgagtccggctccattgagcaggacgccgacatggtcatcctgctccaccgcgaggacgcgtacgagaaggagtcaccgcgcgcgggcgaggccgacatcatcgtcggcaagcaccgtaacgggccgacggccaccatcaccgtggcattccagggccactactcccgcttcgtggacatggcgcagacctgacggatgcccgtgccggttcgcccttcgagggccctttcgcatggagggcggccggccgggcacggcgatggatccgggccggatcagcgggcggcgtcgaacgcgcgcgccacctccggcacggctctgaggaccgtcgtgtagtggtcggcctgtcccatatcggtgagccgttggtcggcgccgttggccctcaactggcttcggcagtgctgggcgttcgtgaagaggacgtccttgtcgcccttggcgtggaagaggtgcaccgggacttcgggacgccagttgcaggtgttgtccatcgccttcagcttccgtcgcagatcccctgtggggttacgcatcttctggaggaatctcccggtgaagagttccttcgaggtcctcggcaacgcggccgcgatctcctcccctgtgtggtcgccgtcgaggagcgactccgccgtcttgtcgaagggggcgcggaacgcgtcggccggcgagtcgtacaagccgtacatccgctgccatgcggttgagaagtatgcaaggtagagcgaggaccgttcgaccttgtcgtccgcggcggcggcctcgaaaccggtcaggtcgaacgggccggcgataggggcgagggcgcccaggcggaagtacgggtcgctgcgctgctgcacggcccggccgaccatcatcgtggctgggccgccctgggagaacccgctgatcagcacgcgcgggtcgaagtcgcggccgtccctgcgggcgaacgcacgagctgcccgcaatgcgtccaccgacgcgctgacggtcgccccggggtgtccgtacggatggaatccgggccccttgcccaggcccaggtagtccggggcggacaccgcgcggccggtcgaggcgaacagtaacgccgtggcccggtcggcggactcgtcgttcaccgaggcgacctctcctcggtacacctcggtgccgtgcagccaggacaccacccggaggtcgtgttcgccgttcttcggcaacgcgaccaactcgcttgccgtggtgggctttccgtcgatgtcgatggtgcgatagacgatccggtgagcccgtacgccgtagcggacctgctccgcatcgatacctgtcttcaccaggcgggccctgacgtcctcggcgtccaggttcgccacgggggtcacggagatcaccgaaccgcgtgctgcgggggactgctggtgagtaccgggagcggcgggcgagggaccgtcccggggggagctctgctcgccgcacccgctcgccgccagtgcggtcaccgcacacaccagggcgagcgcaccgggcccggcccttcttccaagtagacgagaaatgttcatggttggactctgccgcgtccggcgcacccggcacattgggacggacaccccgctcggccgggggctatccccctcttgaccggggcgcctcgtgggttcttgtcctcactcgtacgagttggctaattcgttcgacaggccgggtcggagtcgtcatgatccgcacttgtgacgactccccagcagctcctggtcctggccgccgcccgcaacaacgcggagtggtgcacggcgatgagccgaacgcacggctcgacaggtgagttcggagcacatgcctgggccgctccgtcccgcacgccgctgtactaccccgacgcggtgacgctggtgccgggcgccgaccgggtcgcgctggtgtcccggatcgacaccgtcgcacccggcgcctccgtcaaggacagcttcgccgacctcgacctgacggaagccggtttcgaggtgctgttcgaggcgcagtggatccaccgcccggcaggtgcgcccgcccaggcgccggatctttcctgggacgtggcgggtgatccggacgcgctgcgcgcctgggcgctcgcctgggacggcggagacggcaacgcggatctcttccggcccggacttctcgacgacccggccaccttcgtgctcgctggacggtccgccgacgggcgggtggtcgccggaggggtggcgagccgcagtgacgaggtagtcgggatctccaacgtcttcgcgctggacggcggtgccgacagggcgtggccggtcgtcctggacgccgtgaacaggttgttccccaccctgccggtggtcggctacgagcagggcggggacctggctgccgccatccgccatggcttcgagccggtcggtcccctgagggtgtggctgcacggccagtagccacaccggaacggaactctccgactgcggacctgcggcccggtcgacgggcatccgtcggacgcgatccggactctcagccgttcgccagggtgccggcgaggagagggagcaggcggtcccagtggagccgcagtccggccgggtcgaaggcgtcggtgtcggacatggtgaagccgtggaccgtgccggggtagatctcggaggtgtagccgacccctgcggcgtccagcgaccggttgagtccgccgagtgcctcgggcgtgatgtccgtcgccgcgtgaccgaagtggatctcggcggtgagacggcgcaggctgtcgggcccgtcggccgctacgggggcgtggaacgcggcgagggcggccacctgcccggggtgggccgcggcggtgcgtgtcgcaaggaggccgccgatgcagtagccggtcaccgcgaccggtccggtgctcacctcgggctgggccgtgaggaagccgaggtaggagtcggcgtcacgcaggacgcgttcggctgtgtgtgccgcgatcaagggcatcagccggccgacgagcgcgggccggtcctcttctccgatgtgctcgggaaggtcgatgagcggtgtcggcccgttcctgtagaagaagttggggacgagtacgtagtacccgtgaccggcgaggtcgcgggccatctcccgcagtacgggccggatgccgaaggcgtccgcgtacatcagcacccctggatgccgctcgccgtcttcggggaaggcggcgaaagcatccgccgaaccgtccgtcgtggggatctgcacggtcttgatgggaatggcggatcttccttcctgggggatttcaccgagccgacgtttgcggagcccacgctttcagcgcgatcggccgcacgaaagtggccttgtgccgtagcggcactctgacatgccgacctcgctggaggagtacgggcgcggccctacgtcgtgtccgcgaagtctcgtctggccccagggcggacgacgatactttgcggacagtccctagtcggcgggaatgatccgggtgacgacggcctcgaccaggtggtcgaggccgtcggcaccgagcatgtcagggagcgtgaagtgctccaggagtaccccggtcatcgccaggtagaggaccagaaaggcgtcggggtcgcccggtaggccgcggtcgcggtggaaggagaggctctcctcgaagccggcgcgcacggttcgggtcagctgggtgcgcaggtcgggccggcgggttgcctccaggcggagttccagcatggccagatagccggtccggtcgtcggtcatccgccggatcagccagtgcatcagctcggcgaccagctcccgggagggagcggggagcatgatctgttcgacctgggccggatccggtgtcatccggctgctgatgcgggcgccggtctgcatcaggaggtcgtcgcggctgctgaagtagttcgacgcggtgcccaccggtacgccggcccgggcgtccacggcgcggaaggtgagcccgcgggccccttcgtgtgcgaggacgtcgaccgccgcgtccgtgagcatgaccctgcgttcggggttcttcgccatcagcgttcttcctgctcgtccggcgtcggaaagcgccttgcgcaaccactacatctgaagcactatacgtgacgtggttgaggtgcggcgccgagcagtcgtggtggtcgcgccgcccgggccgtccggcccgtacccatcgacggaacggggaactcatgcgcaagctcacctacttcatcgcctgctcgatcgacggcttcatcggggattcccgtggcgacgcctcggcgatgatggccttcgtcagcgaggagttcctcggtttcctgaggtcggagtacccggagaccgtctcggtcgagggccgcaacatgctcgggttccacgacgccgagaaccagcacttcgacaccgtggtccaggggcgtcggagctatcagctggcgttggacgcggacatcaccagcccgtacggccaccttcgggagatcgttgcctcccggacgctcacggagtccccgcacccgaacgtcgaactgatcggtgaggatccggtcgcccgggtcagggagctcaaggccgaggacagtgagctggacatctggctctgcggcggatcccagctggcgggggagctgctcgacgagatcgacgagctcgtgatcaagacctacccggtggtgtacggcgtcggcatgccgatgttcgggtccggttcgggagtcaccgagttcacccttgagggagtgcggaccttcgagaacggcgcactggtccggacgtaccgccgcaagcgctgagccgcgggaaaagggttcgtcatgcggtggcccatcgggtaggggttggaccatgacttccatcgacgaagacctgcttcccggtacccggcgggccctgttgcaccgcatcgctgtcgcgcaacgggacggccgcgcaccgtccctggtggccgcggtgcggcgacagggtcgtacggcctggagcggggcgcgtacgtgcgtcgaggggcatgctcccgacgccgatacgcagtaccggatcggttcgatcaccaagacgttcacggccgttctggttctgcggctgcgggacgagggcctgatcgacctggacgatcccctggagaagcatctccccggcacgggagcgggcggggtgaccgtctttcagctgcttggccacagcgcgggtctgggtgccgaagcgcctgccccctggtgggagcggacgcccggcagtctgcggcccgagatcgccgacgtcctgggcgaccggccgcagccgcacccggccgggcatcgccatcactactccaaccccggttacaccctgctcggttcgctggtggaagtggtgcgcggcgtctcctgggaggaggcgctgcgccgcgagatcctggagccgctgggcatgcaccggacgaccagcggtcccgtggcgccgcacgcgggcggctgggccgtccacccgtgggccgacgtcatgctgagcgaacccgccgaggacctcgggatcatggcgcccgccggtcagctctggtcgaccgcggcggacctgctgcggttcgccgccttcctgaccgagggtgacgaccgggtcctgtcggcctcctccgtgcgggagatgcggacgcccgccgcaccggccgagacgggcggcagcggttacggtctcggactccagatcgtcgggggcgaagagcgcgtgctcttcgggcattcgggatcgcttcccgggttcgtcgccggcctctgggtcagcgaggaggacgacgtggccgcggtcgttctcgccaatgtcacctcggggctgcccgccgcgatggtggccgccgaactcctgggaatcgtggccgaagccgagccgcggatcccgccgccctggcgtccgctgcccgaggtggacgacgaactgctcgcgctgaccgggatctggtactgggggacccacccggtcacgttgaggctgacggaggaccggggcctgcagctcacgccgctgggaggcaagggacgcggcgcggccttcacgtaccgtccggacggcagctggacgggtcggaacgactactacgcgggggagaccctgcgcgtcgtacgcaaggacgacggctcggtggaccacctcgacctcggctcgttcgtcttcaccagggagccgtacgaggcgggagcggccgtgcccggtggcgtggacgcggagggttggcgggggctcggcggctgagcctctgtccgatgacgggtgggtgtttcacgtgaaacacccacccaccgcgttcgtcagagcgccagcttgaagcccacatggctggccgtgaagccgagccgctcgtagaagcggtgtgcgtcctcgcgggtgacatccgaggtcagctgcaccaactggcagttctggcggcgggattcgtccaccgcccactggatgagctgggtgccgaggccactgccgcgttcgtcgccatggatgcggacgccctcgatgatcgagcgggtcgctccgcggcgggacagccccgggacgatggtcagctgcagtgtgccgacgactcggtcctcgcgaacggcgacgaccacgtactggttcgggtcgtcggtcagccgctggaacgcctcctggtagggggtgaggtcgtccggtgactcgcgctgtgcgcccagtggatcgtcggcgagcatcgcgaccaccgcggccaggtcctccgggacggcgggtcgtatggcgagatcactcatgatcagcatcctaggccgtgtccgcaaagtctcgtccggcccgagggcggacggcgatactttgcggacactcccccaagacggctccaggagacgtctcgtcggtcaggggtgggtcagaccgggaccttcagctcttcgacggccctgaccagaggagcgagctccgggttctccgcagcctcgtccagggccgcccgcagtgcgctgtcgttcgtcggccgggcggcctccagcaacgtgagtccggcctcggtgacatcggtgtagatgccccggcggtcggtgtcgcacaggtagcgggtcaggagcccacggtcttcgagccgggtgacaagccgggtggtggcgctctggctgaggacgacggcgtcggcgacctgcttcatctggagatgtccgccggtgccgttgtgctgccggctcaacacgtcgagcagggagtactcgcgtgcgctgagtccgtggccggcctggagagcccgttcgacgcgggcctcgatcttcccgtggagcagggagagcgcgcaccagctctgggcgatggcggtcagggcggggtcagtcgctgtcatgtctctctcctccgtacgggagctgtgtgactccaggataggggacgtctgcaatagcccgcgcttgcaattaatcggcgtctgcaattattgtggacgctcgtaaggcgcagacgcaatctttaggaaggtggaacccatgccgctcgcgctcctcgccctcgccatcggggcattcgggatcgggacgaccgagttcgtgatcatggggttgctccccgaggtcgccggtgacttccaggtctcgatcccgaccgcgggcttcctggtcaccggctacgcgctcggtgtggtcctcggcgccccgctgatgacgctgctcggcacccgtgtcacccgcaagcgcatgctgatgctcctcatggggttgttcatcgtgggcaacgtggtgtccgcgctcgcccccgtcttcggcgtcatgctcgccggacgggtgatcgcctccctcgcgcacggcgccttcttcggcatcggctcggtggtcgcggccgatctggtcgccccgcagaagaaggccggggccatcgccatgatgttcaccgggctcaccgtcgccaatgtcgtcggcgtgccgctcggcacgttcatcggacagaccgcgggctggcggaccacgttcctcctcgtcgccgttctgggcgtcgtgggactgctcggcgtcgcgaagctcgtaccggaccagcccaggccggaaggcgtgcgcatccgccacgagctggccgcgttccggaacgtccaggtcctgctggcgatggccatgaccgtcctgggcttcggcggagtcttcgccgcgatcacctacatcaccccgatgatgaccgagatcgcaggctactcggcctcgtcggtcacctggctgctcgtcctcttcggcctcggcatggtggcgggcaacctgatcggcggcaggttcgccgaccgccacctgatgcccatgctgtatgtctcgctcggcgcgctcgccgtggtcctcggcctgttcaccgtgaccgcccacaacaagatcgccgcagccgtcaccatcgttctgatcggcgccctgggcttcgcgaccgtccctccgctgcagaagcgggtcctcgaccaggcggcgggtgcgccgacgctggcctccgcggtcaacatcggggccttcaacctcggcaacgccctctccgcctggctcggcggactcgtgatcgcggccgggctcggctacaccgcccccaactgggtcggcgccgcgctcgccg

SEQ ID NO: 2856 - DNA, 1624 bp, Unknown
  Kingdom: Bacteria, Phylum: Actinobacteria, Class: Actinobacteria, Order: Streptomycetales, Family: Streptomycetaceae, Genus: Streptomyces
caccgccctgcgcgccgccggccgggcgcactggttcgagccgacggggcagtggctgatcccgcaccactccgacgtgtcggccctgctgcgcgaccggcgcctgggccggacgtatctgcaccgcttcagccacgaggagttcggccgcaccccgccgcccgccgcgcacgagccgttcaccacgctcaacgggcagggcatcctcgatctggaggcccccgaccatccccggatccggcggctgatctccaaggcgttcaccccgcgtacggtcgagaacctcgccccgaccgtacggcggctggcggccgaactggtcgacgccttcgtgtcgaagggcggcggcgaccttctcgcggagatcgcggagccgctgccggtcgccgtgatcgcggagatgctgggcgttccggaggcggaccggggcctgctgcggccctggtcggcggcgatctgcgggatgttcgagctgaacccctcggaggagacggccgaagccgccgtccgggcctccgtcgacttctccgcgtatctgcgcgggctcatcgccgagcggcgcgccaaccccggcgaggacctgatctcggcgctcatcgccgcccacgacgagggcgagcggctgaccgagcaggagatgatctcgacctgtgtgctcctgctgaacgcgggccacgaggcgacggtgaacaccaccgtcaacggctggcgcacgctcttccaccacccggaacagctggccgcgctgcgcgccgaccccgcgctgctgccccgcgcgatcgaggaactcctgcgctacgacaccccgttgcagatgttcgagcgctgggtgctcgacgacatcgagatcgacggccaggtgatcggacgcggggcggaggtggcgctgctgttcggctcggccaaccgggacccggagcggttcgcgcggccggacgcgctggacctgtcccgggaggacaacccgcacatcaccttcggcgcgggcatccacttctgcctgggtgccccgctggcccggctggagctggccgcctccttcggggagctgctgcgcaaggcgcccgcgctgcggatgacggccgagccggagtggcagccggggtatgtgatccgggggctgaaggagctgcgggcggaggtgtagtgcgttcctgcggctccgggctcagcaggggtcgtagcactccggcctcggcgctccggccagcgcgtccacgccgacgccgatggcgaagagcgcggcgatggccgtgacgaggccgagcgcccgcttccagtcgccccggaccaggaagaacacggccagggccgccgcgatcccgccgaggatcatgaggggcaggccgacccagaggacgttccagttggaggcgccttcgaagccgtcgaggagaccgcccttgccgtgcggggcccagagcacgatgcccacgagcgctccggcgaaggcggtcaggcagccggcggtgccgacgacggcttcacgccgcgagttctggatctccatgcccggggggacgcggcggggcgcgggcccggttccgggggcgccgcccccggtgtcacgtcagcgggtacgacgaccggcccgacgcctcgtcgatctcgtcgtgcgccttgg

SEQ ID NO: 2857 - DNA, 2900 bp, Unknown
  Kingdom: Bacteria, Phylum: Actinobacteria, Class: Actinobacteria, Order: Streptomycetales, Family: Streptomycetaceae, Genus: Streptomyces
gtacgtgccggcgaagaaggcgggggcaccggggcgggtggagaagaggtccatcaggtcggcgcggccgccgatcgcgcccacgggggcgccgttggcgatggccttgccgagggtggtgaggtcgggggtgacgccggagatctgctgccagcctccgatgtcgtggcggaagccggtgatgacctcgtcgaagatcaggatgctgccggccttcgtggtctcctcacgcagcgtggtgaggaattcctggtacggcaggagggtgccgacgttgtgcgggacgggctcgacgatgacggcggcgatgtcggagccgcgctcggcgaaggtgcggcggacggcctcgctgtcgttgaaaggcaggacgagggtggcttcgaggacctcgggcaggatgccggtggagatcgggtcgtggccgccgaccttcccgggcgcggagatgacgttgaggctgaccgcgtcgtgccagccgtggtagcagccctggaacttgacgaccaggcggcggccggtggcggcgcgggagacgcgcagcgcgtggaacgtggcctcgctgccggtgctggtgagcagcaccttgtcgatggaggggatcagctcggtgagctgttcggcgaggaggacctcgccctcggtgacaccgacgcccatgtggccgagggtggcgccggcctccgcggtcgcacgggccacgtcggggtcgttgtggccgagcaggggcgggccgaacgccgagtggaagtcggtgtactcgcgtccgtcggcggtacggaaccgtgcgccgtccgtccccgtgacgaccaggtcggtcagtccgggaacgctgcgctgaccgctgttcacgccgccgggtacgaccttgcgggcgcgctcggcgagtcgggctccggattcgttgcccaccgggcctgaactcatcatcgcttgctccttgcgtcgagagtcgtcggtcttcgcaggccctgcccggcccgtgagtccctggcgccatccgcccggcagtcgccgcaggaatgtggatcatccgtggtgcttgaggtggtgcgtttcgttctccgaacgctgttctgtagagcagaacagtgcctggatattacgtgcggctccgggaccggtcaagacctttcagccccaggaaggctggattccgcgccccctgcaccgagaaaccgcgttcgagcctcccccaaggcactacactgttctgctatgacgaacagtgctgccccagaagaaccgaagtactgggtcaagagcgtggccagggcagcggacatccttgaggcgctcgccgcccccgcacaggggaacggcctgagtgtcacggaggtcggccaggtctgctccatctccaagagcgccgccttcggcatgctccagaccctgcgtgcctacggcctcgtctccgacgacggcgagggcatgaaccgccgctaccggctcggcatgagcctggcgaggctcggcgaccgggcccgctcccaggtgtccctgcgcggggtcgcccacccggtcctgcgcgagctgacccggctcaccggaatggcgtccaggctcgccgtacccgaggacggccacgcggtcgtcctggaccaggtcgaactcgaccagcgcgtccggctcgatctgcggatggggcagcgcgagctgccgcactgcacgggcctgggcaaggcgctgctctccgccgtgccgccgagcgaggcggccgcggtcgtcgagcggttcgggctgccccggcgcacctcccgcacgatcaccgacccggcgaccttcctgtcgcatctgcgcgacatcgtccgggtcggctacgccctggacgacgaggaggacgccgagggcatcatctgcatcggcgcgccggtcttcgacgaccgatcggtgtgcgccggagccgtctccatcaccggtctcaagctcggcctgccggcctggcgctaccaggaactgggcggccaggtacgggacgcggcccgccggatcagcgtctcgctcggctgggtcgacgacgcggacggcaccacttccgacaccgacacgtcgcattccgacggattcgggtcttgaccaaacggcgtaacccgccgtaggttccctgccaaccgcgctgacactccatggtcaccggcattttcccctttccggcctggttccggtgcctgcccatcgcactgtgaatatccgacggccagacccttttcagccatccgcctcatggcagtcccccgcgggaacgctccctcatctgtcgcacttctcggaaggcgaagtccgcatgagcgttccgcaccaccacaccgcttcgtcccgccggaatctgttgcgggcttcggggctggccggtctggtcatggccggttcggccgtgaccgccggttccgcccgggccgcaccgtcgcacaccggcgacgtgctccgggtcgacaccgtcgcggcgctccgcgcgctgaataccaagccgctcgacgacggcacccaggctctgatcgccggctaccgcaccccgggcgacggcggaaccatgctcgtgcgctgggacagcaactccaccgccccacacaacggcggcaccgtcctcaccccgcagaacacgaagaccggccgctggcaccagatccacaccggcaccctcgacttccgcaccttcggccacttcgacgccaggacccccgccgacgccgccctcgacgcgatgatcaccgacaagagcgtccaccgcatcgaagcccacaccgacctcctgttcacccaacgccacctcttcgaccgctccaacatcgaactcgacttcggcggccaccgcgtacacaccgaaggcatcgagaagaacacccacgacaaccccttcggcgccgtcctctccttccgcggcaccctcaccgacaccaccgtca

SEQ ID NO: 2858 - DNA, 9680 bp, Unknown
  Kingdom: Bacteria, Phylum: Actinobacteria, Class: Actinobacteria, Order: Streptomycetales, Family: Streptomycetaceae, Genus: Streptomyces
ccgtgcccctgcggtgcgcgcggttgcgtagaaggcatcgccagcggtcccaacatcgcccgccgcgcgctggagaacggctggcggccgggtccggacggcgacgcgacggccgccgcggtggccgtcgccgcccgcgccggggacccggtcgccatcgcctcctacgagcgcgccgcccaggcgctggcagcgggtatcgccgccaccgccaccctggcggacctcgacatcgcggtggtgggcgtgggagtggccggggccggcgacgtgctcttcgtgccgctgcgccgcagcctgcgcgactacgccacgctctcctacctccggcggctgaccgtggcacccgccgtgatgggcaccgacgcgggtctggtcggggccgcggcggcggccatcgcgctccgctagattctgtcgtcgacagcttccagggagcgcccggttcgtcaggccgggcgttccctgggccacgcttcgcgcgccggacggccgtatccggtcaacgccgtcccgcctcgggttccccgggtgatgagcactgctcgcagccgctgatcatgagcggaacgtcccgttgcgatgtcctgggtgctccctgtgaggagcagccgttccacactctgccctgaccggtcgtgggactcgacgacgccgtcggcgtactggcgcagcgtgccaccggcctcgaagcggaacgtctccgccgcgtgttcggcgaccaccggccgggccggaccgagcggccgggccgaagcccgcatgccgagcgcgtcacttcacccgcgggcaggagatagcggtgacggacggcctcggcgcctcgcgctgcgcgacccggccgagcccgcacctcgcgcgcgctcgccgtcgtggccgccgggccccgggccctggctggcggagtcaccccgcaggccgaggcagccccacccggcaccggctggacgctcgccttcggcgacgagttcgacgaacgcaccggaagctcccgtgcatggcaccgagggccggaccctgccgctgcgctacgacttccggatcgccgcgactcatccatcccatgacgggcggggtcgggtgcacctgacagcacccggccccgcctctccatgccgtaccgccgcacggcacactgtcttcgaatcccaccgtgaggagaccagttcgatggccctgttcgacatgccgctggccgaactccgcgcctaccggccgcagatcgacgaaccggatgacttcgatgccttctgggcggaaaccctcgccgagacccgctcccacgactccgcggtctccttcgaacccgtcgagaccggactgagcggcctgcgcacctgggacgtcacgttcgccggattcggcggccacccgatcaagggctggttcagcgcccccgcgaacaccgatgggccgctcccgctcgtcgtccagttccacggctacaacggtggccgcagcctgccgcactgctggggcatgtggccgctggccggcttcgcgcacttcatcatggacgtgcgtggccagggcagcggcggaaatgtcggagacacccccgacccggtcggctcgggcccctccctcgcgggcttcatgacccggggtatcgaggacccggagagctactactaccgccgggtctatgccgacgcggtacgtgccgtcgaggcggcccggtcccatccgctcgccgaccccgcccgcaccgtcgcgctcggcggcagccagggcggcggcatcaccctcgcggtcggcgcactcgtccccgacctggcggccgtcgccgccgacgtcccgttcctctgccacttcggacgggccgtcacgctcaccgactccaacccgtacgcggagatagcccactacctcaagatgcaccgcggcaaggaggagaccgtcctgcgcaccctgtcgtacttcgacggggtgtccttcgcggcccggggcagcgcccccgcgctcttctccgtcgcgctgatggaccaggtctgcccgccgtccacggtcttcgccgcccacaacgcgtactcgggcgagaaggagatcgaggtctacccgttcaacgggcacgagggcggcgccatgttccaggaggccgcccagctccgttgggtgccgaaggcgctgaacagggcggtctgaacctgtcgcgccctctcgtgctctgttcgacggtcgcgatcacggaccgggtgcgtacagcaggtacaggtgtgtacggggcagtccctgtccccgtacacctcacacgccgttgttcggtgtgagcctgagcgtcacgatcacagccgcctacgtcacgaccatgaccgtgtagctgtcgccgacggtcagggtggcggggcaggcgccggtccgggtgtctgcctctccctccggaatacccttccgggcaagccggcaggccgcgggagcccggtgcggcgccagccgcccccgcagcctgccggcacgtccgtggtccggacggctcaccggcggcacttggcggtcgtacgacgacggccgagaggtcaccaacgccggtgtcctggacatcgaccacttggtttcccttgctgaggcctgggattccggagcctccgcctggaccccgacgcggcggcaggcgtacgcgaaagaccaggccggacgtcccgctcgtcgcgatgacggcccgcagctaccggcagaagtcggatcaggaactggtcggctggatgccatcgtccccggacgcccagtgccggtacgtcaccgagtgggtggcggccaggcgccgccggcagctcaccgcggacgaccgcgagctcgaagctgaaggtctgcgccgacggcacatcgtccgctaccccccggccgcctgctccgcccgcaggcctgagagccaggcctgccgcaccgttccgcagaccgccgctcccgtgggcccgaacctcgggcacccggctggattgtcagtccccgcccgtaccgtcgaagacaggtgccggaggggccggggccggtgagtgaacggagtggcacatgggcgagataagcgtgagcagcacggctctgggtcggcttcttaccgacagcgccggcgcccgggcttgccgtccgtatcaggaggcgttcgccgagttggccgacacctgccggggaaagccgatcccggaggtcctgccgctgctgcgccgggccgcggatgaggcgctgctggggttcaccgacgaggatctgcgggagcaggcggaggcgatccggtccggtgcacggtacgtgctgcgggtccgcgtcgcgtagtggcacgggcggtgccgcaggagagcagtcggcccggtccggtcgatgtgcggagtgtgtccggacgggctccgccttccaccgtgcaccctgccgcccacgcagcgccggcggcggcgggcaccccccgatctggacgctccggccggggcactcgtggtcgggtgtgggtgcggtggatgtctgcgggccgtgggccgtgctccatcgcgctgtgcactcgggctggcgggcggggcaggccctgcggagtctggtccgaccgaagtcaggtcaccgttcgaccggggacgggtcagtcgccggagcgcggtgtcaaggtctgagctgtggcagcccacgaggcaaggaggcgaaggccctcttcggaggccgatccgggttcagcggtgtagatggtgagggtgaggccgggttcggcggccatctccagtccctcgtaggcgagggtgaggtcgccgacggcgtggtggtgaaagcgtttggtgccggtgccgtggtggcggacgtcgtgggcgccccagcgggtgcggaagtcgtcgctgcgggtggacagctcgcccacgaggtcgtgcaggcccttgtcatgggggttgcggccggcttcggtgcgcaggatggacacggcgacatcggcggcctggtcccagtcggggtagaagcgccgggaagcggggtcgaggaagttgaagcgggccaggttggcctggttgccggccgcagcgtagacgtcgtcgtagaaggcacgggcgagctggttggtggcgagcaggtccatgcggccgttgcggacgaaggccgggccggcggtgacggcgtccaggacccattgcaggctgtggcgcgccttccactgcgcggagcggcgccgagggcgggtgagggcgtcggagccgtcggctgcgtgggcgaggttgagcaggtgggcgcgttcggcgtcgtccagctggagagcgcgggcaagagcttcgaggacggccggggaggccccggcgaggttgccgcgctccagcttggagtagtactccacgctcatgtccgccagcgcggcgacctcgctcctgcgcagcccgggtacccggcggcgactgccggcgggcaggcccgcctgcccggggctgatcttggctcgccgcgaggtgaggaactcgcggacctctgcttggttgtccacgccttcgacggtacgtctcgcgtccggccgcagcgatgtaccgccagtacacccttcgtcagtgactcgctgcccgcgcggacccggggttacctggatgacgtggcgctcccatgagccgcctggccgggcagccggggcgccacggcgtttccgcaccccgggagcgccggcacgggggccgcccccgcccccacgtacgtaaggaaatcctgatgcgcggagcgatgatccatgcgcccggcgacgtgcgcttcgagaccgtggacgacgcgaagatcctcaagcccaccgacgccgtcatccgtacggccgctacctgcgtctgcggctcggacctgtggccctaccggggcgcggagccgatcggcgacccgcacccgatgggccacgaatacgtcggcttcgtggaggaggtcggctccgccgtcaccgcggtccgaccggggcagttcgtcgtcgggtctttcgccacctccgacaacacctgcgcgaactgcgccaacggcttccagtcgagctgcctgcaccgcgagttcatgtcgacctgccaggccgagtacgtgcgcatccccaacgcccagggcaccctggtcgccaccgacgaggtgccggacgaggagttttggccggggctgctggccgtgtccgacgtgatgggcaccggctggtgggccgcggacgccgccgaggtcaggcccggcgcgaccgccgtggtcgtcggcgacggggcggtcggcctgtgtgccgtgatcgcggcgaaggagatgggcgcggagcggatcatcgccatgtcccggcacgagagccggcagaggctggcccgggagttcggcgccaccgacatcgtcaccgagcgcggtgacaagggtgtcgagaagatcaaggagctgaccggcgggatcggcgccgacagcgtcctggagtgcgtcggcaccgctcaggccatgagccaagccctgcactcagcccgccccggcggcaacgtcggcttcgtcggcgttccccacgacgtcgccgtcgacggccaggagctgttcttctcccacgtcggcctgcgcggcggccccgctcccgtacgccgctacctgcccgacctcatcgccggcgtccttgaccgacggatcgaccccggcaaggtcttcgacctcaccctccccctggaccgggtcgccgagggctaccaggcgatggacgagcgccgcgccatcaaaacccttctcaccccttgacccctcacgccgtgcaaggagcactccgcgcagatcacccgcggctcgatcgacaccgccgagggcccggccgactggttcaccggcgacgtctgcatcgacccggtcgtctccgccccggtcaccgcctgaacacggaaaggaccaccatgaccaccttcgccctcatcggcgtcggccccggcgtggggctggccgccgcccgccgcttcggcgccgccggccacgacgtcgcccttctctcccgcaaagccgaccacctcgacgccctcaccggcgaactcgacggtgacggcatccgggcccgcgggtacaccgccgacgtcctggtcccgacctctctgacggcggcgtcgcacgcggcgggggaggagctggggacggtcgagaccctccagttcagtccggtgccccggcccgacttcatgaagccggtcctcgcgccggagaacatccacgccgcccagttgaccgtgcccggcgcgatcagcccggacgccgagcactccagccctcgcgcgccggccgagcgctggtacgccgtccacaccgagcgctgcggcttccggcactatgccgagcccatgcccacctgaccacccccgggacaccgtcatgcactccgcggcctgcttggtccgtgctgtcccggccgtggccctgctgcttgccatgagcgcctgctccagcaatgcgcaggagaaccctccggccgccgagtcctccgcgaccgcggctccggaacagccgcagacgacgccggccactccgtcatccccctccgagaggagcactcccatgggcatcgaggtcactctcgacggccgtcccgtcgaggccgccctgaacgacagcccggccgcccgcgacttcgccgagctgctgccgctcaccctggacctcaccgattttcacgccacggagcgggttgccgacctgcgccgcgagctgaccaccgagggagccccggaaccggtcgccgccaaagtcggcgacatcgcctactacgcgccctggggcaacctggccctcttctaccaggacgggcccgccccctcggccgacctgctcatcctgggccacctcgacgtgagcgccgaccagctcggccaggcgacccgcatcagcatcgaatccgcctcctgacccctgccgccctgaaccgggcgatcggagagagaagttccgtatggcctccgccgccggcacccgccggagcaagctgcccttcgtcgtgtgggtgctcgccgccggcacgttcctgatgggcaccaccgagttcgtcatcgccggactgctcccgcagatcgccgaagatttcggcaccagcgtctcccatgccggcttgctgatcaccgccttcgcgatcggcatgatcgtcggcgggccgaccatggccctggccaccctgcgcctgccccgccgcctgaccctcgtctcagctctggcggtcttcaccctcgggcacgtcgtcgccgcgctcagctcctccttcaccgtcgtcctgaccgcccgggtggtgaccgcgctggccaccggcgcgttctgggccgtcggcttcgtcatcgtcaccgccgccgccggccccgcccgcgccacccgggcggtgggcgtcatgatgggcggcctgaccctggccaacgtcgtaggcgtgccgatcggctccttcgtcggccagtacaccggctggcgcggtcccttctgggcgctggcggtcctcgccgcgctcgcggccgtgtgcgtcggccggttcgtccccgccactcagcagcaggtggcgacggtgtcggtacgggccgagttccgtgccctgcggcagggccggctgtggcttgcgctggccgccgcggtcctgatcatgggcggggtcctggccacctacacctacatcaccccgctgctgactgatcgggccggcgtccccgcgggggccgtcccgctggtcctgatcgtcttcggactcggcgccctgggcggcaccgccatcggcggcaggctcggcgaccaccgccccatggccgtcaccgtcaccgccgccaccgtgaccgccctggccctgctcgcgctgatcccgctgtcgaccggcccggtcaccgcggtcgccctggtcttcctcatcgcgctggcggggttcaccgtcaacccggtggtcaccgcgctcgccgtccgcttcgccggcgactcccccaccctgacctcggcgctgaccacctccgcctacaacaccggcatcgccgccggctccgcactcgcgggccgcgccctgggcacctccctcggtgtgaccggtcccgccctcgtcggcacggtcctcgccaccctcaccctcctgccgctcaccgtcctcgccctcatcaacacccggcggcagaaccggatcacggcccagcgcgccgccccggcccccggtgctggggcggcgctcgccgacatcgaccagagcgccgtcactcaggatgcgaaggaactcaccgacaaggaccaggtcgccaccgtcgtcgaccgtactgtcgaagagcatcaggtgcgcgggcacccgagcggccatgcgcgccgctccggcggggagccggggagccctgtgggctgctgaagcagctcgaagttgctgtggtcccggtcgtcgagcgcgacggtctcggtgtccagcacagctgggcggccggtcctcctcgacgggcgacctcccgcgtgtcgcggtcgaggagcggacggggcatgagctgtcgggcgtggagggcacctacagcgaggtgactcttgcgatggaggagcggatcggtgggtatctccagagggtctgggagaaggaggtggtgggggccgggctttgtacgcctgcatgtcccatccgtctcccggacggcctcgcgaaatccgctccgccgctgttcagcggccttcccaccttggagtacgagtgatcgtctggatcaacggtgcgttcagtgcgggcaagaccagcgccgcgggcgaactgatcgatctgatcccgcacagcacgctgtacgacccggagatcaccggagcggggctgcgcagtctgctgccgcagaagaggctcgccgaggtcaccgacttccaggacctgccgatctggcggcggctcgtggtggacacggcggcggcgctgctcgccgagacgcccggggtgctggtggtgccgatgactctgctgcggcaggagtaccgcgacgagatcttcggagggctcgcctcccggcgcattcccgtccggcatgtggcgctctcacctgaggaaacgatcctgcgtagccggatcgcgggccgcgaggagtttcccggcgacgaggagcagagcgagcgggtgcgccggtgggcgtacgagcacatcggcccgtaccgcgacgccctcggctggatcaccgaggacgctcatgtggtcgacaacagcgccctcacaccccgtgagaccgcagagcggatcgcggacgccgtgcgcaccgggaacgccgcgccgtgcccgatcgtccagagccccgagccgaccgccgagacggtggccgccggggtgctgctcttcgacgagcaggaccgggtgctgctcgtcgaccccacgtacaaaccggggtgggagttccccggcggggtcgtggaggcgggcgaggctcccgcgcaggccgggatccgtgaggtcgccgaggagataggcctccgcctcgaccgggttcccaccttgctgctcgtcgactgggagtcgccccgcccaccaggctacggcgggctgcgcttcctcttcgacggcggcctggtgcgcaccgaggacgccggccggctgctgctgcccggctccgagctgcgcggctggcgcttcgtcaccgaggaggaggccgcggggatgctgccgcccacccggtacgagcggctgcgctgggccctgcgggcgcgcgagcggtcgacggtgctcaacctggaggcgggggtgccggtgggccgagcggcgccctcacgccccgttcgccgccgcctccatctccgccgcc

SEQ ID NO: 2859 - DNA, 2447 bp, Unknown
  Kingdom: Bacteria, Phylum: Actinobacteria, Class: Actinobacteria, Order: Streptomycetales, Family: Streptomycetaceae, Genus: Streptomyces
gggtcagcaggtcgacgacctcctcggcggtgacggccggggtgtggccgatgcgcaggtgccccgccaggccgcgcccgatgcggcgggcgcggtccagggcggcgagcgcctgggcgccgagtgcgcgggcgtcgtcgatgagggcctgcccggcgggggtcggggtgacgtgctggtgaccccggtccaggagctggacgccgacgtacctctccagggtgcggatggaggtgctcagcgcctgttggctcaggtgcagccgctcggccgcccgggtgaacccgccctcctccgcgacggcgacgagatgctccagcttgcgcaggtccagactcacacggtcctcccggacgccccggccgacgacggacggggtcagcggacggtgtaaccgccgttggcgaagatcgtctggccggtgatccagccgccctcggtgacgaggaacttcaccagcggcgcgatgtcctcgatctccgtcagccggccgcccatggcctgggacttgtggaactccacccgctcaggcgtctcctgcgggtagaagaacggcgtgtccatcggccccggggccacattgttcacggcgatgccgcgcggagcgaactccttggccgccgcccgggtgaagtgctccagcggagccttcgcgcccgcataggtggcgtacccgtcggtgaaggcggcgagcagggaggtgaccaggctgacgatgcgaccgccgtcgttgaggcgcgcacctgcctcctggaggaagaagaacgccgccttggagttgatcgcgaacatgcggtcgtactcctcctcggtcgtctcgccgatcggcttccgcaccaccatgccggtggtgttcacggcgacgtccaccccgccgaaggcgtccagcgcctggtcgaagaggctccgcacaccctcgacacgggtcaggtcctcgcgtacgacgacggcctgcgcacccgtaccccgtacggcctccgccgtcttctcggcatcgtcggcggtgttctcgccgtggtagtggacgacgacgttcgcgccggcctcgccgagcgtgcgactgatcagaccaccgaggttcttcgcacctccggcgaccaccgcggtcctgccggccagcgactgcggccgctcctgctgctgctcactcatgacggatccctctctcccggccgcattccgatatgcggcgttcgtcgtagtttccgctgaccacgctaggagcgcgccctgtccgggggaaacacaaagatcgggtcggcccaccaggaagatgggtcaccgcaggtcagcgcaggcgcaagggcgtcgtccgcgtgtccggaaaggccattgacgtacgcgtacgggtcacgaaggatcaccgcgtgacgacctccgaacagccttcgcccacccccggaccggtccgccccatcgccctgatcacgggcgtcggacgcagcatcggcatcggcgcgggcatcgcgcgccggctggcggcctccggctgggacgtcgccttcacctactggacgccgtacgaccgccgcatggactggggtgccgagcccggggccgccgcgtccatcgcggaggagctggcggaggcaggcgcccgtacggcggcgatcgaggcggacctgtccggccccgacgcgccgacgcgcatcttcgacgaggcggaacagcgtctcggcgggccggtgaccgcgctcgtcctctcccacgcggagtcggtggactcggggttgctggacaccaccgtggaggcgttcgaccggcacttcgcggtgaactcccgggccagttggctgctcatccgcgagtacgggctgcgcttccgcagcgcgcccggcaccgcgacgggccggatcgtcgcgctcaccagcgaccacaccgtgggcaacgttccctacggggcgagcaagggggccctggaccgcatcacgctggccgccgcgcacgagctggcccacctcggagtgacggcgaacgtcgtcaaccccggcccggtggacaccggctggatgaacgacgagctccgcgagaccctggtccggggcactccgctcggccgtctcggcaccccgcaggacaccgcccacctggtggagttcctgtgttcccccgaaggtcagtgggtcaacggccagttgctgaagagcaacggcggcgcggcttcctaggccccggtccgcaccgccgaacgccggggcgtgaaccggcacgtcacgtcagtgcgtccgagcaggacggagcgtctaatctggcgtggtccatgtagtgcacagggggtcgtatgcacaacgaagacaggaccggcagagcgggcgacggggcgcggggtcccgagaaccgccggtcgggcgacgaccctcggcggccggacgccatggcgccgcaggaatggccgagcacgccgccgcacggcgcgccgccctccccccgcaccgtgatcgacggcc

SEQ ID NO: 2860 - DNA, 4583 bp, Unknown
  Kingdom: Bacteria, Phylum: Actinobacteria, Class: Actinobacteria, Order: Streptomycetales, Family: Streptomycetaceae, Genus: Streptomyces
  misc_feature (4273)..(4335): n is a, c, g, or t
gtgcccgtgccgacgccgacgaactgctggtcggcgcccggcgcgacgcgacggcgatccgggagcgggccgaggagctgcgggcccggctggagagcgagatcgaggagttgcacgagcgggcccgccgggagacgtccgagcagatgaagacggccggcgagcgtgtcgacaacctgatgaaggcggcgaccgaacagcgcgacgaggccgaggcgaaggccaaggagctgatggcggaggccaattcggaggcgagcaaggtccgcatcgccgcggtgaaacgggccgagtcgctgctgaaggaggccgaggccaagaaggccgggctgatccgcgaggcggagaagctgcgcgccgacgccgaggccgaggccaagcagacggtcgacgagggcaagcgcgagctggacgtcctggtgcgcaggcgcgaggacatcaatgcggagatctcccgtgtccaggacgtgctcgaagcgttggagtctttcgaggctccgaccgggggcgggaaaccggccggcgggtccgcgggaggcgtcaaggctccggcggcggcgggcactcgatcggggggcaagtcgtccgagcggtagccgatccgcggtgcgccgtgcttcgtcatggacattcaacccttcgagtggcaagcactccgggggtcagccactcaaaaggggtgtcattctccagatcaaaccggcatctgcacgctgacacgccgccatggcccctaggattccccctatcacctcaccggtctcattcgacaggaacctcatgagtgacccttcctcccccttcggcttcgagctcgtgcgacgtggctacgaccgcggtcaggtggacgaccgcatcaccaagctcgtcgccgaccgtgatagtgccctggcccgaatcacctctctggaaaagcgcatcgaggagctgcacctcgaaacgcagaacgcccaggcccaggtaaacgacgccgagccgtcgtacgccggtctcggcgcccgtgtcgagaagattctccgcctcgccgaggaggaggccaaggacctgcgcgaggaggcccgtcgagcggccgagcagcaccgggagctcgccgagtcggcggcccagcaggtgcgcaacgacgccgagtcgttcgccgccgagcgcaaggcgaaggccgaggacgagggcgtccggatcgtcgagaaggcccagggcgaggcgaacacgctgcgcaccgacgcccagaaggacgcccagcagaagcgcgaggaggccgacgccctcttcgaggagacccgcgccaaggccgcccaggccgcggccgacttcgagaccaacctcgccaagcgccgcgagcagtcggagcgcgacctcgcctcccgccaggccaaggcggagaagcgtctcgccgagatcgagcaccgcgccgagcagctccgcctggaggccgagaagctccgcacggacgccgagcgccgggcccgccagacggtggagaccgcccagcgccaggccgaggacatcgtcgccgacgccaacgccaaggccgaccggatccgcagcgaatcggagcgcgagctggcggcgctcaccaaccgccgcgactccatcaacgcgcagctgaccaacgtccgcgagatgctggcgacgctgaccggcgccgccgtggccgccgccggctccccggtggaggacgagcccgccacccgcggcgtcccggcccagcagacccgctgacccccggcaggcgccgcacccccgtgtgcgcccggttccgcccttgtggtggcgccgggcgctcgggcgttctagcgtgaacgcatgatcgagctcgagggactcaccaaacggttcggcagcaagatcgccgtcgatcatttgtcgtgtcaggtcaggccgggcatcgtgacgggcttcctcggcccgaacggggcgggcaagtccaccacgatgcggatgatgctcgatctcgacaacccgaccagcggtacggtgcgcatcgacggcaagcactaccgcgaactccaggaaccgctgaagtacatcggggcgctcctggacgccaaggcgatgcacggcggccgcagcgcgtacaacaacctgctgtgcctggcgcagagcaaccgcatcccgcgcagcagggtcgacgaggtgctcgacatggtcggtctgagcgcggtggcgaagaagaagtccaaggggttctccctcggcatgggccagcggctcggcatcgcgtccgcgctgctgggcgatcccgagatcctgatgttcgacgagccggtcaacggactggaccccgagggcatccactggatccgcaatctgatgaaggcgctcgcctcggagggccggaccatcttcgtctcgtcccacctgatgagcgaaatggcgctgaccgccgaccatttgatcgtgatcggccagggcagactgctcgccgacacctcgatggcggacttcatccacgagaactcccgcagctacgcgcggctgcgctccccgcagcaggagcagctgcgcgacgtgctgcaccaggagggcttcaccgtcgtcgagacggcgggcggcgtcctggagatcgacggcgccaccaccgaggagctgggtgagctggcggcccggcaccagctcgtgctgcacgagctgagttcccagcgggcctccctggaggaggccttcatgcagatgaccgccggttcggtggagtaccacgcccattcggaacgggacccggaatccgaaccacctgtggtgggagccggctggggcgagagctggaacaaacccgagggcaccgaccgcaccgacggcaagggggcgtgacgaccatggcatcggtacccgcggttctcacctcggaatggaccaagatccggtcggtctcctcgaccacctggaccctcatctccgcgttcgccgtcacggtcgtgatgggcgctgcgctcgccgccctgctcaacgcgcagttcgacgacctctccgaggccgagcaggccacgttcgacccgaccttcgtcagcttctccgggaccgttctcggccagctggcgatggtcgtgttcggcgtgctcgtcgtcggcacggagtacagctccggcatgatccgcacttcgctggcggcggtgccccagcgtgcgacgttcctcttcagcaagatcaccgtggccggtgcgctggccctcttcgtggggctgctcaccagcttcgtctcgttcttcctcggccaggccatgctcggcgaccgggggaccgacctcgctgcggagaacgtgctgcgcgcggtcgtcggcggcgggctctacatgggactgatcgcgatcttctccatgggggtggcggcgatgctgcgcagctccatgctgtcgctcggcatcctgatgccgttcttcttcctggtctcgcagatcctcgcggcggtgccgggcgccaagagcgtcgcccggtacttccccgaccaggccggctcgaagatcatgcaggtggtcccggacgcgatgaacagcgatcccgccccgtacggaccctggaccgggctcgggatcatggtgctctgggtgctggcggcggtgctcggcggcttcctggtcctgaagaaccgggacgcgtagaaggcgctccggtacgtgtcctgatccgcgtgacggcccggtagcgggctgtgcgcaacttggccggaaccgtcagtgcctggttatcctcctaactcttacgggggtgtgcggccgggtggcccgagccccgaacgacagagtgagtcgatggggctggagaatgatcgaggcagtcggcctgaccaagcgctacggcgccaagaccgccgtggacgacctttccttccaggttcggccgggggccgtcaccggcttcctcggtcccaacgggtcgggcaagtccacgaccatgcgcatgatcctcggtctggaccgccccacctcaggtcacgtcacgatcggcggccacccctaccgcgacctgccgaacgcgccgcgccaggtgggcgcgctgctggacgccaagggcgtgcacggcggacgcaccgcccgcaaccacctgctgtccctggcccagctggccgggatcccggcggcccgggtcgatgaggtgctgggagtcgtcggcctccaggacgtcgccaagcagcgctccaggggcttctcgctcggcatggggcagcggctcgggatcgcggcggcgctgctcggcgatccgcaggtgctcctgttcgacgagccggtcaacggtctcgatccggagggcatccactgggtccgcaatctgatgaaggcgnnnnnnnnnnnnnnnnnnnnnnnnnnnnnnnnnnnnnnnnnnnnnnnnnnnnnnnnnnnnnnnctcgctcatcgaggcgggcggccgggtcatgacggagccgggcgggaccctgcgggtcaccgggctgccgctgccgcggatcagcgagctggcgcacgggtgcgacgtacggctctgggagctgtcgccgcaccaggcctccctggaggaggcgtacatgcggctgacgcagggcctggtggactaccgctcgacggaggacgccaaggcgggcctcgtggagccgtcgccgcaggacgcgtacggga

SEQ ID NO: 2861 - DNA, 742 bp, Unknown
  Kingdom: Bacteria, Phylum: Actinobacteria, Class: Actinobacteria, Order: Streptomycetales, Family: Streptomycetaceae, Genus: Streptomyces
acggcctccagcaggacggccagcccggccacgttctcccggtagtacagcagcggcttctccacggactcgccgacctgcttcttcgccgcgagatgcaccacaccgctcaccgcgtggtcggccagcacccggtccagcaggccccggtcggaggccgagccctccaccagcgtgaccgtgtccggcaaccgctccacgatgccgctggagcggtcgtcgagcaccacgacccgctcgcccgccgccaccatggcccgcgccacatgtgccccgatgtatcccgccccgcctgtgatcagccatgtcatgcccgtcagcctaagccgcccgcccaccgcgaccgaccggcggtttgtgggccgggcccccgatcgatgatgatgatcgccaacgccgcccgggcttgcaggtccacccgtacagcgcacaaacgggcggtgaaatcggccttccgttcatccgatagcctcagccgacacgccgccggcccgcctcgtggccgtgccgccgcgtgccgtccacgtcagtgccaaggagtgagttcgtctgtcgaccgccatcctcaccggtacgccggtacccgggtcgtcgctcgcggacgatctgcggtccctgggcttcgacgtgcaggccgccgccgacgccggtgacgccgcaacgctcctcgccgccgtcccggcaggccgccgggtcgctctcgtcgacccgcgtttcgtgggccacgtccacgcgctgcggc

SEQ ID NO: 2862 - DNA, 2299 bp, Unknown
  Kingdom: Bacteria, Phylum: Actinobacteria, Class: Actinobacteria, Order: Streptomycetales, Family: Streptomycetaceae, Genus: Streptomyces
ccggcccgggccggttcgggtgggtcagacggtctcggggagttcttccaggccctcggcgaccagcttcgcgagccggtccagagccgcctcggcgtcgtccgcgtcggacgcgagcacgatctcctcgccgccctgcgcgcccagaccgagcacagcgagcatggaggcggcgttcaccgggttgccgtcggccttggcgatcgtcacggggacgccggaagccgtggcggcacggacgaagatggaagcggggcgggcgtgcaggccctcggcccaaccgacgtttacgcggcgctcagccatggttctgcccttcacatatcaacggttgtctagaccagtctctcatgcagtgcgtggtgctgtgcccggcctcctgtccggtcctgtgctccggcggccccggtacgggcctcctcagactgcccgggcaccgatctctccgcgaccgggatcgccgccgtaggctttgcccatggagcccacgccggagcagagtccgcatcacgcgtaccccgaccactgggaagcggacgtggtgctccgcgacggtggcaccgcgcgcatcaggccgatcaccacggacgacgccgagcgactggtcagcttctacgagcaggtgtccgacgagtcgaagtactaccggttcttcgccccgtatccgcggctatccgaccgggacgtgcaccgcttcacccatcacgactacgtcgaccgggtgggactggccgtcacgatcggcggcgagttcatcggaaccgtccgctacgaccgcatcaacgaccagggccgccccgcctcggcccccgccgacgaggccgaggtcgccttcctcgtccaggacgcccaccagggccggggcgtcgcctcggccctgctcgaacacatcgccgcggtcgcccgtgagcgcggcatccggcgtttcgccgccgaggtgctccccgccaacaacaaaatgatcaaggtgttccgggacggcggctacacccagcgccgcagcttcgaggacggctccgtccacctcaccctcgacctggaacccaccgagaagtccctcgccgtccagcgcggtcgcgaacagcgcgccgaggcccgttcggtgcagcgtctgctcgcccccggctccgtcgcggtcatcggcaccggccgcacccccggcggagtgggccgcaccgtcctgcgcaacctcctggcctccggctacaccggtcgcacgtacgcggtgaaccgcgccttcgacgagggcctggccaccctcgacggcgtcccggcccaccgctcgctcggcgagatcgacgagcaggtcgacctcgcggtcatcgccgtccccgcccaccgggtccccgaggccgtcgccgactgcggggagcacggagtccaggggctcgtcgtcctctccgccggatacgccgagcggggtgccgagggccgcgaactccagcgcgagctggtccgccaggcccgctcgtacggcatgcggatcatcggcccgaatgccttcggcatcatcaacaccgccgagtccgtccgactgaacgcctcgctcgcccccgagtcgcccgcccgcggccggatcggcctgttcacccagtccggcgcgatcggcatcgccctcctctccggccttcaccggcgcggcgcgggcctgtcctcgttcatctcggccgggaaccgggccgacgtctccggcaacgacttcctccagtactccttcgaggacccggagaccgacgtcgccctgctctacctcgaatcgctcggcaacccccgcaagttcacccgcctcgcccgccgcaccgccgccgtgaagcccgtcgtcgtggtgaagggcgcccggcacagcggctccaccccgcccggccacgcggtcccggtcagccgcatccccgacgccacggtctccgcgctgatgcgccaggccggcgtcatccgggtcgacaccgtgaccgagatggtcgacgccggactcctgctggcgggccagccgctcccggccggcccccgggtcgccatcctcggcaactccgaatccctcggcctcctgacgtacgacgcctgcctggccgaggggctgcgcccacgcccgccgatcgacctcaccaccgccgcctcaccgcaggacttccgggacgcgctggccgaggcgctggcggacgggacctgcgacgccgtgatcgtcaccgccatcccgtgggtgggggagaacggcgaggccgagaccggtgacggccaggtgctggccgccgccctgcacaaggccgtggccgggggttcggccaagccggtggccgtcgtc

SEQ ID NO: 2863 - DNA, 2401 bp, Unknown
  Kingdom: Bacteria, Phylum: Actinobacteria, Class: Actinobacteria, Order: Streptomycetales, Family: Streptomycetaceae, Genus: Streptomyces
cacccacaccaccaccgggctcggaacccagagcgacgacgtcgcgtccggcgtcctcgaccgcggcctccgcgagggcctcgacggtcttgaggcggaacacgtcccgggtggtcagcacgagaccctcggtgcgggcacggctgacgagttggatggacatgatgctgtcgccgccgaggtcgaagaagctcgcgtcggccgccacctcgtccagacccagcacctgcgcgaacagaccgcacagcactacctcacgcggcgtccgcgccgcccggccacgcgccgaacccgcgaaatccggtgccggcagagcacgccggtccagcttcccgttcggactcaacggcaacgcgtccagcaccacgaacgccgacggcaccatgtactccggcaacacccccgccacagccacccgcagcgccgcgacatccacaccacccgcggcaccgttctccggcaccacatacgcgacgacggccggtgatccgggacggtcctcccgtacgacgacggcggcctgctccacctcggggtggtccaggaccgcggcctcgatctcacccagctcgatgcggaagccccgcagcttcacctggtcgtccgaccggcccagatactccaggtcaccgccggccgaccaccgcaccacatcacccgtgcgatacatccgcgcaccgtcggcgccgaatggatccgccacgaaccgcgaagccgtcaggcccgaacggcgcaggtatccccgggccagctgcaccccggccagatagagctctcccggggctccggcgggcaccggtcgcagccgcgcgtccaggacgtacagccgggtgttccacaccgggcggccgatcggcacggacggggtcttgtcatcgggtccgcactgccaccaggtcacgtcgacggacgcctccgtcggcccgtacaggttgtgcagttcggcgcccggcgctccggtcaggacggtgtggaagcggtcgcgcagcgcggccggcagcgcttcaccgctgcagatcacccggcgcaggctcgcgcagtcggcggcggccggttcggccaggaacgcctggagcatcgacggcacgaagtgggtggtggtgacggaccgcgcccggatcagctcggcgaggtacagcgggtccttgtgtccctcggggcgggcgacgacgagagcggccccggtgatcagcggccagaagaactcccagacggagacgtcgaatccggacggcgtcttctggagcacccggtcctcgggcgtgaggcggtagtggtcctgcatccacaggagccggttgacgatgcccgcgtgcggaacgaccgcgcccttggggcggccggtggagccggaggtgtagatgacgtacgccgggttcgcggggacgggtacgggcaggggtgtcccctgctccggtccgtgcccgctcaggagcgcgacggtggcgggggtgtcgatgaccagaggcggcgtgccggtgtccgggagacctgcggccacctcggaggtggtcagcgtcagcaccgggtccgcgtcctggagcaggaacgcgatccggtccgccgggtaccccgggtccaccggcagatacgcggcccccgccttcagcaccgccaggagggccacgacgagttcgacggaacggggcacggcgaccgcgacgaagcgttccggtccgacgccccggacgacgagcagccgggccagccgcgacgcccggtcgtccagttcggcgtaggacacagcggtgtcctcgaagaggagagcggtgctgtcgggggtgcggtgcgcctgcgcggccagcagctcggtcagggtgacggccgggacggggcgggccgtgtcgttccaggtgtccagcagctgggcgcgctcggcctcgtcgaccagcccgagcgtgccgagcacccggtccgggccggacgcggccagctcgcggaggtagcgcaggaagcggtggaggtgggcgtcgatcgcgtcgggcgtgtacagctcggggttggcgtcgaggtcgatctgcagaccgttgccgtcggtccggtcgtacacgacgacggacatgtcgtcggcggggccgacggacaggttgtggacgatgccgcggtgcccggcgaacgtcaggtcgtagtcgaacatcatgatgttgacctgcgggccgaccagccgctggtcgtcggcgagcaggttcaggtcccggcgcagatcctcgtaccggtagcgctggtggcggaggtcgccgcgcatggcggcggaggtgtggcgcagcagggcgccgacggtcatgtcgtcgtggggtgccagacgcagcggcaggacattggagaccatgccgggcacggagcgggcggtgcggcccagccgggtggtgaccggcatcccgagcacgatctcctcgccgcc

SEQ ID NO: 2864 - DNA, 7031 bp, Unknown
  Kingdom: Bacteria, Phylum: Actinobacteria, Class: Actinobacteria, Order: Streptomycetales, Family: Streptomycetaceae, Genus: Streptomyces
  misc_feature (315)..(327): n is a, c, g, or t
cgcggccgtcgcccgtggagcgcgggccgcgctccatcggcggcccggtcttcctgaccgcgctggtggccggcggtctgggcaccgggctgagctgggagcagcagccgctgggcatcgccctccagatcggtctggtcgccgccctcgcggtgttcgggttcggcctgctgatcgcctcggtgctggggcggaccggtttcggcacggtcctgatggcgatgatcacggcgggtctgctggcgggtgcggcggtgctgccgaaggacatcgacacgtcgtgggcccgccaggagtggcggcccgcctcggtgnnnnnnnnnnnnnggcgggcggccgtcgtcgtcccgaagaacgtgacggtgaaggtgcgcgccgaggcgggtctcggggagatccggctggaggagggacagcgggtccaggtccggatcaacagtgacgaggcgaagcagcggacgctgccgccacccgcgggcacgaagcccgccggaacgatcgaactggtgctggaagtcggcatcggacaggtggaggtcactcgtgctgcgtcatgaattccggcccggccgcgcggtggcgggcctgacgatgctgggcctggccggcgggtacgcggccgacgccgccggggcctgggaggtcccgtggacgttcttcctgccgctgttcctcggcgggttgtggctggccgcgacggtgacgtgggccgcctacatgctgcggcggcggcgcgaggcgaggaaggcgtcggcggagaacacggcggcgcccgcgagcaccagcggcagccacgccatcagatagggcaggtcgttgccgtagtagtacggggtggcctgccagctcacggtcagccagaggctcagcgagatcagcgcgccgccgagtgccgcgagccgggcccagaggccgacgagggtgccgagtccgacgaggagttcaccgatcgcgatggcgtagccgaagccctcggggcttttcagcgccaggtcgacgagggcggggatcgcggaggagtcgcgcaccccgcgcatcatctcgccgatggacccggtgccggtcgcggacaggaacgcgctgtccgtgagcttgtcgaggcccgcgtagacgaaggtgacgccgaggaagatccgcagcggcagcagggcgtacgtgcccgcctgctccctcagtgtcctgcgctcgcccagaccgtacgatccgccgccgtaaccgttcatcatcgctgccctgcttcccgaagtcccgtcacctcgaccatacgtacgccctgggcgcgctgctcaccagggctgggacgccatcggcggcggaaattcgcccggggttccggtgacggtcagtccgtgacgtcgatcgggcagcggttggtctccaccccggcggcggtgacgacctggacgtccacggtccccggctcgacctcgaccgggacgggcacggtcaggacggtgtcggtggggttggcgaagcccccggcgacggggatcagcggtacgtggacatggaccgtgccgatccgtacgacgagcctggccagccggtcggggctgcccgcgccgggcggtacgaagcccgcgccccggatctcgatgtcgtcgccggtccggatcggcgcgtccaggtccccggcctcccgggcccgcacgacggacagcacgacgggccggccgccctccgtgtacttcccggcgaaataggtcgccgccgaaacagccaccaggagcgcgagcccccacggcaggtcgggcagctgctcggggcgacgggccaggcggaccgcggcgaacagcacggcgacggcgctgaccagcacgtactgcacatcggtgaaggagccgcgccccgagtcgtcggtgagcaggtcggcggcgcgcggccggtcggcgcgcagcttctggagccgctggcccagcacccgtacggtcaccacgcgccgcacgacgacggcgaccgcgcacacgagcgccagcacggtcacgactccggcggaacgcacgaggtccagcccctcgatcagcgcgtcccgctcgtccgggtcggatgcgcccgccagttgcagggcgagaacggatacggcgaagacagccagcagcacccaggccccggcgaccgtacgggaggtggagagccggttgtcctcgccgatcagcggagcgaggaggccaccccgggcacggtggaaccgggcggcggcggtgagcagcccggccgtgagaagggcggcgatcagagcggcggtacgggcggtggaccagccggcaccgatcgcggtgaggctcgcaccgacgaggagcgcgccggccgcaccccagacggtgaacaacgtcccgcgccagacctggtggagccaggcgtcaccggcttcccgggcccgttcggcgacggtgcgggcggacccggtcagctcgtcggacacccactgccgggaggcggacgcggactgggcgaccccggcggggagccccttgcccgcagccagttcgtcccgtttggccaggaacgcggcgacagcgcgccggtgtccgtgacgggctccgtgcgggcagtcgccacacgtacagccgccgccgtgcgtgccgctcgtcctggattcgtccaacgccacggaggattacgccctttcccgccccggtacagccaactcacttgcgatatcagcgaattgtgccgtaccgggcggacgccgcccgcatcggggcggccggcgggcggggaccgtcagaatgttcgagagatccgctgccacaggggctggtagttgatccaggccaccaggtcgccgccgaggtgatcgcgggtggtgacggcgtcccggtgcgagatgagcacgggcttcccggcggcccgcgccagcagttgcacctggcaggcgcgctccatggtgaggaaccaccaggccgccgcgtccaccgagtcgccgacggtcagcagtccgtggttgcgcaggatcaccgccttgtgcggcccgagcgcggcggcgatccgccggccctcgtcctcgtccacgacgaccccggagtaggcgtcgtacagcgcgtggtcctcgtagaaggcacaggattcctgggtgatcggctcgatcggctccccgagcgcggcgagcgcccgcccgtgcgtggagtgggtgtgggcgacggccacggtgtccgggcgggcccggtgcaccgcggcgtgcacggcgaacgcggcctggttgacgtggaagcggccccggagcacctggccgtcgccgttgacgaggatcaggtcctgcggggcgatgtcggcgaagggtgcgccgaacgggttgacccagaaacagtcggccagttcggggtcacgggcgctgatgtgcccggagaccccgtcctcgtacccgagctccccgaacagccgcagcgcgcccgccagccgctccctgcggtacgcgcgctcctcgtccggcgaggcgtgcacgggcggcatcgcgaactggagctgttcgacggggatcggggcgggggcgggcacggcgaccggctcggacatggcggctcctcgggttccctgggcgtacgggaccggaagctaccgccgggtgggtcaggtgaccagaggtgtgacaccccgcggccgggtcaggtgctgagcaccaggtaggcgagcgtgaggtacgagcggtagccgccgtagtagccggtgcggcgggcgtcgacctcggccgtcacctcggcgtgcagcggatggtccgggtgctccagtgcccagcgctgtccgcggccgatcggcccctcggactcgaagaggtcccattcgcgctcgtcggcgacggtgacctggagcgcgcgcagcccggcggactccgccagccggatcagctccagcagcgatccgaagtccccgggctcggccccgacgccctccagcgcggcgggggtcggctccttcagccagatcccctcgccgaacaggacccgtccgccgggtcgcacggtggcggcgagggcggtgagagcttcccgggtggtgccgggccaggcgtgcgaggagccgatggagacggcgaggtcgtatccgccctcggtccattcggcggcgggcacctcgtggaaccgcacccggtcaccgaggttccgctgctcggcgagcttccgcccgcgcgccacggcgtcggggtcggtctcgacgccgtccccggtggctccgggcgcggcgtcgacgagccgcatcagcaactcgccccagccggagccgaggtcgacgatccgcgatccgggagcgggggcgcaggcggcgatcagccgatccgcgtgctcctcggagagcggggtgttccaggtgaggcggtcgttaccggcggcggacacgatggcgcggacttcttcggcggacatggtgcaggagccttccacggacgggaggacggtgccaccggatatggaccccggcccggacacaccgatgccgccgcccaggcaggtgagcgacggcatcggcgtcgatccgggagggccctacgggctcgccgggagcggggaggtcactcccactcgatggtccccggcggcttgctcgtcacgtcgaggacgacgcggttgacgtcggcgacctcgttggtgatgcgggtggagatcttcgccagcgtctcgtacggcaggcgcgaccagtcggccgtcatggcgtcctcggaggagaccgggcgcagcacgatcggatggccgtaggtgcggccgtcaccctggacgccgaccgagcggacgtcggcgaggaggaccaccgggcactgccagatgtcgcggtccaggccggccgccgtcagctcctcccgggcgatggcgtcggcgtcgcggagcaggtccaggcgcgccttggtgacctcgccgacgatgcggataccgaggccggggccggggaacggctggcgctggacgatctcctcggggaggcccagctcctggccgaccatgcggacctcgtccttgaacagctggcgcagcggctcgacgagctggaactcgatgtcgtcggggagaccgccgacgttgtggtgggacttgatgttggcggtgccggtgccgccgccggactcgacgacgtccgggtagagcgtgccctggacgaggaaggcgacctcgggtccttcctcctggaggatctccagctgggcctgctcgaagacgcggatgaactcgcggccgatgatcttccgcttggtctccgggtcggacacaccggccagggcgtcgaggaagcgcttctccgcgtcgaccaccttcagcttcgcgccggtggccgcgacgaagtccttctcgacctgctcggtctcgcccttgcgcatcagcccgtggtcgacgtacacgcaggtcagctgggagccgatggccttctggacgagggccgcggcgaccgcggagtccacgccgccggagaggccgcagatggcgcgcttgtcgccgacctgctcgcggatgagagcgatctgctcctcgaccacgttggtcgtggtccagttcggctcgatgcccgcgccgcggtagaggaagtgctccaggacctgctggccgtgggtcgagtgcatgacctccgggtggtactggacgccgtagagcttcttctcgtcgttctcgaaggcggcgaccggcacgacgtcggtggacgcggtgacggtgaagccctcgggggccgccgagcaggcgtcgccgtgcgacatccacaccggctgctcggtgggcgtgccctcgaagagcgtcgacccggccttggagacgtgcagcggagtacggccgtactcgcgggcgccgttgtcgtcgaccgtgccgccgagcgtggtggccatcagctggaagccgtagcacatgccgaagacggggaccccggcctcgaagagcgagcggtccagggtgggggcgccctccgcgtacaccgacgagggaccgccggagaggatgatcgcgcgcgggttcttcgccagcatctcggccaccggcatggtggacgggacgatctcgctgtagacccgggcctcacggacacggcgggcgatgagctgggcgtactgcgcgccgaagtcgacgacgaggaccacgtcggccgtggcgtcgggggcggcggggggtgctgctggcacgggagcggccttccggcggtggtgaagggggtcggttcttccgattctaccggccgggcgcgagccctccgccggaccgggggccggggccgacgacccatgaccggtgcgcgtcgcgtctcaggatccgggccccgttttgtgggggccgccggaccggggccatactgtcccccatgcgtcagcacacgaccttcgtctttacctatggcatccggcccgccggctgccgtggtcgtgctgcttgagctactgacaagcaacgttccaggcgccccgggccgacaggcccggggcgtctcgcgtgtccgggtccgtagctccggggggccgcaccccaccgggagtcaccaccatgagcagcaccacggacaccaccgccgtcagccccgccgagcggaccggcgcccgcaccgacgaggccgccgccctgatcggcggcgcccgggagcgcatcgacaccctcgacgaccggatcatcggcctcgtccaggaacggatggccgtctcggcggtgatccaggaggcccggatcacctccggcggccgtcgggtcaacctctcccgggagacggccgtgctcggccactacagggacgcgctgggcaagccgggcaccgcgctggccatgacgctcctggagctgtgccgcggccgggtgtgagacctggtgagcggcccgcggacggaacggttctccgcttgccggacacgggccgtatctgcgttcgggccccgtctcacccgtacggcgcgtgaccgggagcgcggtgccttcgttgatcctgatgtccgtgccaaccaggggcggcatcggcaggaaaccacgcgtggctccgccgggacgtgtgacgtacctcaggtacgtcgtgggaccacgacccggcgtatgtgaccggtccgcaggggacagcagcccggtcaccccatatgcggccga

SEQ ID NO: 2865 - DNA, 9807 bp, Unknown
  Kingdom: Bacteria, Phylum: Actinobacteria, Class: Actinobacteria, Order: Streptomycetales, Family: Streptomycetaceae, Genus: Streptomyces
ccggggtgccggtcctggtgctggccgggacgatcgggccgggcgcgcaggacgtgcgggcggtgggggtggacgcgtacagcgcgatcctgcccgcgccgatgacgctggtggaggcgatcggcaggagcggcgagttcctggccgacgccacggagcgcgcgatgcggatcatggccctgggcacccggctcgcaccgctggccgccgcctgacgcgcacgcctccgtcccgggccccccggggtccgggactcggcggcaggcgctccggttaggctcggagccatggagagcctgcgcatcatcgacacctggccggtcacgacggcggcggccgccgtcgtacggtcggacggcacggtcctcggtacgcacgggccggccgaccaccgcttccccctcgcctcggtcaccaagccgctcgcggcctacgcggcgctggtggcgtacgaggagggggcggtcgagctggacgagccggccgggcccgagggctccacggtgcgccacctcctcgcccacaccagcggcctcgccttcgacgagcaccgggtgacggccccgcccggcaaccgccgcctgtactccaacgcaggcttcgaggtgctgggcgaccacatcgccaaggcatccggcatcccgttcgcggagtatctgcgccaggcggttctggagcccctggagatgaactcgaccactctggacggctcccccgcccgcgacggcgtctccaccgtggccgacctggtccgcttcgccgccgaggtgcaggccccccgcctcctcgacccgcgtacggtcctggaggcccagacggtcgtccacccgggcctcaagggcgtcctgccgggctacggccaccagagcccgaacgactggggcctcggtttcgagatccgcgactccaagtccccgcactggacggggaactcgtcctccccggcgaccttcgggcacttcggccagtcgggcacgttcctgtggatcgacccggtggcgggcgcggcctgcgtcgcgctgacggaccgggcgttcgggccgtgggcggcggaggcgtggacgccgttcacggacgcggttctggccgagctgtcctgaaccggctgccgcccttctccggcggtgtcaggcactcgaaccagacggtcttcccgctgccgtcccaccgcttctcgatgccccagttgtcggtgacggcgtcgaccaggacgagccctcggcccccgtcgtccagcggatcgcccgtgatggcgaggggcacggcgggactgctgtccgccacttcgacgcgtaccccctcgccgtgcggcaaccggaagatgaaggtcctgccgcgccggtcgggcacgtgccgcacgacgttggcgatcagctcggtgagcgccagttccgccgcgtcggcgaggaacagcagctcccaggccttgaggtagagccgcaggacgcggcgcagatgccgggcggagtgctcgcccagggcgaagtcggcgcggtagacgggctccccgggatccctccgggggacaagtacgtgattcatgtcaccaggctgcgacgggatggctacgctcggctacgtaccgaaacgaacgccgcgaggcgttgcacccggaggtccatccgtggccaacatccagacgctcgatcccgacgcctctccgctcgcctactacggcggggagttgcgccgccagcgtgaggcccagggcctgacgcagccgcagttgggcaacatcatcttctgtacgggctcgctggtcggccagatcgagacgacgaagaagatccccacccgggacttctcggagcgcgtggacgcggcgctggggacggacgggacgttctcgcggctggtgggactggtgctgcggagccagttgcccacgtggttccagccgtacgcggacatggaggcgaaggccgcgtacatctccacgtaccaggcgcaggtggtctacgggctgttgcagacggaggagtacgcgcgggcggtcctggccaccggcatgccggacgacctggagggtctgctcgccgcccggatggagcgccagcgaatcctggagcgcgacaagcctccgctggcctgggcgatcctggacgaggcggtgctgtaccggccgatcggcggccacgaggtgatgcgggcccaactccagaggctgttggactgcgcggcgcaccgttggatgcgaatccaggtgctgccgttcgaggcaggtgaacacgctagcttggatggctcgttcaaccagctgcgcttcgacgacgacccggacatcatctacaccgaggaccgcatctccggccatatgacggccaacccggaaaccatcagggaggcttcgctccgatacgctcacctccaggccaccgcactctccgtcgaggaatcggtggcgcggatcagccgcgtgatggaggagcgttatggagaccggccctgacctgacgaacgcggactggcgcaagtccagctacagcggaagcaccggcggcgactgcgtcgagtgcaccgtgaccggcggcgcggcctggcggacctcctcgtacagcgggaacaccggcggctgctgcgtcgagaccgtcgtcggctccccctgcgggtccgtccccgtccgcgacagcaagaacccgaccggccccgccatcgtcctcggggcccacgcctggcaggcgttcgtggacgggctgcgctgacccggcacctccaacggggcggcggcggccggggcctgcgggctcgggccgccgctttccctctggcggggatccttgacgggaacgttcaccgggggaacgctgaggggcttccgggccgccggcggacgtgaggcccgtagggggcgaggtagctcgtggtacgagagtgctggttctgcggggacgccacaccggtggcgtggcacgaccgcgtcctggggctgcaccggggcgccgacaccaccatgaccccgtggatcatcgtcctgcgcaccacgtggcaccaggaagtcgtccaggtgccgcgctgcccgcgctgtcacaccgggcatcagatcgagcagacgacggcggggctctccgtggccgcgctgatcgcctatgcggcgagtggccggctggaccaactcctcggcatcctgccggcgtcggccggggaccgggtggtcgcggcgatctgggcggccgtcgcctgcctgccgggcctcgtctggatcgtcatgcggcgaggccggctgccgtggcggcggctggcgccccgacgcctgggccatgcccgtcaccacccggagttcctccggctccaggacgagggctggaaacccagaccgggacccttcccgcactggaggaacccgccgagccctcacccctctcctccgttgggcagattccggcggtgggcgggacgcgtcatcgacctgctcggagcggcctgcgtcatcgccatccccatcgcctatctccagggctacgaggaactggccggaggtctcatcatggcgacggcaggggtgttcttcctgtcgtcgaagatcagactcgacaagtgatcccggcccggccacgccggccgtgggccgccgcagcccatgagggagagtggggcagagtgggcccatggctacctacgcgaccatgcccttccacctggagaccgagcggctgatcctgcggccgtgggccgagtccgacgccgccgagttcagcgagctgctcggcgaacgcggcaaggggacgcccccggtcgagcgcatccggacgtccataggggagctcctcaccgcgacggagaccacggggatcgccctgctgcccatccagcgccgcgaggagggcgacttcatcggctactgcgggctgatcatcggccgcaccaccctggaggagcccgagatcgcgtacgagctgttccagcgcgcccacgggcacggctatgccaccgaggcggccgccgctgtgctcgaagccgccgccgcgaccggacggaagaggctctggtcgaccgtggccacgtggaacaccgcgtcgttgcgcgtcctggagaagctcgcgttcgagcgggaccacgtttccatggaggagaacggcgaagtggtgtggctcacccgcacgttgccgtggggcggaacggccccggcgcacgctgctattcatgcgccatgcgatcacgggaatacgacctcgaattccggcagcagtccacccgtatacgcgcctggggggccggtctgctgctcctgtcggcgctgttgtggggctggtgcgcgattctgctgctgacggattacacggtcgagacgcgcagcggccacacggccgagtgcgaggcgcgcctgaccacggagggcggcacggccaacgagggtctgtggaagggcgattactgccaggacgagcgcgactggcccgaggcgctgctcgtcctggggctgtcccttcccgtatcgctcgtggggaccgcgctgttcacgaccggccaggtgagccggcggatgagcggacacgcccaggcgatgcgtgagctggaccggatcgcggacgagcgggagaagcgggagaagcgcgccgcggcctgaccgtgtttccggccggtcgcgccggcgctggaattcggtcgcgtcccaggaggcgagccgttaacttccctccgtgcgccgtggatcgcgtggcgcgacgacgagggagccacgtatgagcagccaggacccgcggaccgaccggctgagcattctgatcgagcagttcgaccaggcgcgggaaatggcccaggtccggctgaagggcctcggggacgaggagtacctgtgggagccggcccccggcagctggtcgatccggcgccgggacgaggcggtgacgccgcgggcgtacgggcccggcgcgtgggtcatcgacaagggggcgcctcagatcccggcgagcgagtacgcggaggtcgcgcggcaggcggcgggcgggatgtccgtggcgaagatcgccgaggactggagcgtgagcgccgaacgggtcgcggaggtcctcgcgttcaccggtgagccggagcccgacgtcgtgccgatcaccaccatcgcctggcggctgggccatctgcactccgacttcgcgggccggtgggagtggaccttcggcgaacggcggcaggacccgcatctcctggtcgacttcacgccgtccgcctcgacggcgctggaccgcttctggaagacgctcgaccgtcatcgcgcgagcatcgccacgctcaccgacgagcagctcgacacggtcggcctctcgcagtacccgtacggctccgaccccgacgacgcgtacatcggcgtgctggccaacgccaatctggaactcatccaccacatggccgagatcgcactgctccgcgacctctggcgagcccgcctctccgcatagccgggcggaatccggtcaggtccccatggttgtagtgacataaaccacagaaccccgtcgccgagtttgcgcattgtgcccgatctcgtcgaggcgtatgtgatcaagtcgtgtttgaatccccacacttgtgaactttcgcctcgcggggcggggttcggaaggcggaaagtttcgctctttccgtacggctcattaccgacgcataccagtgggggaaatcgtcgtgtcgcatatgcacagtcgcagattctggacaggcggcgtcgccgtcgccgcaaccctggcggggagcttcgtcgccgctcccgccatggccctgcagggggccccggccgatgcggcgtccttcggccacaccgcgaggatcgtcgtcggcgcctccgaccgctcctgcacgggaacgctcgtgaacccgcggtgggttctctccgccgccagctgtttcgccgacgccacggggcccgtccagcccggcaagcccaaggtcacgaccaccgtcacggtcggccgcgtcgatctgacccagaccacgggcggggccgtccggacggccgtggaactcgttccgcaccccgaccgggacctggtcatggtgaagctcggtgtcggcatcgcgaacgtgaagccggtcgccctggccaccgctccggccgcggccgacgagaacgtgaccgccgccgggttcggccggacgaagacggcctgggtgcccgaccggctgcacaccgcgtcgttcaccgccaccggcgacgcctcggcgaacgtctcgctgacggccgtcggcgacgcggtgatctgccacggggacgccggcggcccgatcctgcgggagaccggcgggaatcaggaactgctcgccgtcaccagcaggtcgtggatgggcggctgcgtcggcacgccggccaccgagacccgtacgggagccgtcgcgacgcgcgtggacgacgtacgcacctggatcacgaacaccgcgaccccggtgccgggcgacctgaccggcgacaacaagcccgacctggtcgcggtcgacgacaccggcaagctttacgtctacccgggcaccggcaccggcgccctcggctcgcggaccctcatcggcaccggcggctggggcggcgcgtcggtgacgcaccgcggcgactggaccggggacgccatggaggacgtcgtcgccatcgtcgcgggcgagctgcgcgtctaccccaacctcggcaccggcacgctgggctccgcgatcaagatcctcaccgggctgcccaccgactcgaagctggtgaacgccggggacgtcaaccgggacggccaccccgacctcctcgtccagcacagcaacaagctgtacatgtacgcgggcaagtccgcgcccaccccgaccgtcgccgccccggtggtcgtcggcaccagcggctgggacgtcatgagcctgtcggctcccggcgacgccgacaaggacggccgggtcgacctgctggcccgggacacccgcgacggcatcctgtacatctacctcggcctggcgaacaacctgttcggcgaccggaccgagtacggccacgggtacaccgtcaccaaccgccccctgatcgcgggcgcggccgacgccgaccgcaacggcgtcgccgacatgtggaccaccgtgggcgacggcaccctgaagttctacaagggcgccagctcgatccacggcccggtcgacggcacgagcgtggaggtcggcacgggcggctggggatccatcaagtccatcagctgacccgcccggactccatgaggccccgcgcccccggcgcggggcctcaacccgccagctcccacaccagcagctccgccggccccgccaccgcgaccgcctccagaccctccgcgccggtgatccgggcggcgtcgccgggacccagctcctcgtcgtccagggcgatccgtccccgcaccacatggacgtaggcgcgcgccgcgtccgggaccgccgtgcgctcgcccccgcccagacggcgggcatgaagcatcgcacccgcgccgggcagggcgtacggggtggagtcggcgatgccggggacgaccgtgtacgacggttcgccgcccggctccaggggtgccagccacatctggaggaaggtcaacggatccgtgccgtcgttgcgttcgacgtggcggaccccggaggcggcgctcaggtgggccacgtccccggcgcggacgacggtggagtgtccggccgagtcgcgatgggtcagctcgccctcgacgacccaggtgacgatctccgtatgactgtgcgggtgctcctcgaaacccgcacccggggcgaggcgttcctcgttgcaggccaggaccgggccgaagcggaggttgtccgggtcgtagaaggagccgaaggagagggcgtgccgggtgacgatcccggcggcctcgtccccgccccggtagcggtcgtcggaccggtgcacggaaatcacccggccacggtagcccggaggcgcccgccgtacggtcgcgggagcggaacgcgggcgcgtcaggtgttcgcctacccgccggtacggggcgccgtcgccccggcccaccgatccaccggcccgataaggcagtcttgtcctcgtgccccgacccgatcctgagcagccccccgcccacgacgcccacctgcacgccgcgaccctgaaacggctggagcagtcctccggccgactggccgcgaacgcgattgcccgcatggacgaatcgctgccgtggtaccgggcgatgcctccggagaaccggtcctggatcggcctggtcgcccaggccggtatcgccgcgttcaccgagtggttccggcatcccgagaccccgcaggccatctcgaccgatgtgttcggcaccgcgccgcgcgaactgacccgggccatcactctgcggcagaccgtggagatggtgcgcaccacgatcgaggtcatggaggccgcgatcgaggaggttgccgccccgggcgacgagtcgctgctgcgggaggcgctcctcgtctacgcgcgcgagatcgccttcgccacggcccaggtgtacgcccaggccgccgaggcccggggtgcctgggacgcccggctggaatccctcgtggtgaacgcggtgctctccggcgaggccgacgagggggccgtgtcccgggccgccgcgctcggctggaactcgcccgagcatgtgtgcgtcatcctcggcaccgcgcccgacggggacagcgaactgaccgtggaggcgatccggcgcgccgcccggcacgccaagctccaggtcctcaccggcgtcctgggcaaccgcctcgtcgtcatcgcgggcggcagcgacaacccgctccaggtcgcgaaggggctgatcgggccgtacgccgccgggccggtcgtggcggggccggtggtgccggacctgctggcggcgacccggtccgcgcaggcggcggcggccgggctgaaggcgtgcctggcatggcaggacgcgccgcgcccggtcctggcggacgatctcctcccggagcgggcgatggccggagacccggccgcgcgggaccagttggtggaggagatctacagaccgctggaagaggccggctcggcgctgctggaaacgctgagcgtctatctggagcaggcgagcagcctggaaggcgccgcccggatgcttttcgtgcaccccaacaccgtgcgctaccggctgcgacgtgtgaccgacgtcaccgggtggtcaccctccgatgtgcgctccgcgttcacgctgaggatcgccctgatcctggggcgcttggccgcagcggatcctcagtcctagacttttgttggacttcaacaattcccccgacggttcttcgtccctgtccccacgggcgtgcgaagccgtccacaagagagagtgtgagggtgctcgtactcgtcgctcccggccaaggcgctcagacgcccggcttcctgactccctggctcgacctccccggtgccgccgaccgcatcgcggcctggtccgatgccatcgggctcgaccttgcccactacggcacgcgcgccgacgcggacgagatccgcgacaccgccgtggcccagccgctcctggtcgccgccgggctgctctcggcagccgccctcggcgcctcgccgtccgtcgtcgcgggccacagcgtcggtgagatcaccgccgccgcgctcgcgggcgtcatcgacgacgaggccgcgctgcgcttcgtccgcacccgggggctcggcatggccgaggccgccgcggtcaccgagaccggcatggcggccctcctcggcggcgaccccgccgtaacgatcccgcacctggagaagctcggtctgaccgcggccaacgtcaacggcggcggccagatcgtcgccgcgggcaccgccgcccagatcgccgctctggaggccgacaagcccgaggg

SEQ ID NO: 2866 - DNA, 2064 bp, Unknown
  Kingdom: Bacteria, Phylum: Actinobacteria, Class: Actinobacteria, Order: Streptomycetales, Family: Streptomycetaceae, Genus: Streptomyces
cgctgctggcccgcgccctggacgacgggacggtcagggcgggcaccaccttccacgacctgctcaccctcgccgtcggaatcgccctggccaccgagcaccacgccgaaccgtcggtccaggccgaccgcctcttcacgctcgccgtcgaagggctgagtccgagcccgtgagggggcgtggttcccccgtcagcccgccgcgcccctggtggagaccctgacccggtcgacccgcatcgggtgacccggctcggtcgcggggcccaccgtcgccccgtcggcctccggcagcttgccgccgaccgccacgttcaggatcaggaacaccccgtggtccacggcccgcttccaggtcccggcgtccatcgcgtcggctcgcacccggtggtacacccggtcgtccagataccagcgcacctcccgcgcaccgggggagaggtcgacctcgacggcgtacgtacggaactccttacggcagtccgcgcactcccgaggccctgacgtcagccccacgggctcctcgcacgggccgccgtccaggaccccgcagtgcatcgaaccgaagacggtgtcccggccgttgaccgactccatcacgtccagctcgccgaccccgggccagccggtgtacccgtcgcgcagggccgatcccagggtccagaacgccggccagtagcccgccgccttcggccccgtcacgtccggcagcgcgatcgaggcctcgatccgcaggaccccgccgcgcggcggcgcgaagtcggaccgcacggtggtgatccggcccgaactccaccgcccgcccttcctggtggggacgatctccagtgcgcccttcccgtccaggcgcacgttgtcggtcgagtcggtcatggtctcgatctcgccggtgccccaccgcggcgccgggcagccggggtagcacgtcccgaggtcgtaactccagttcgccggggaggggcggctgttcgcggggccgtcgaagtcgtcccgcagcagctcggtccagccgtccgccccaggtgcggcggaaggccccggagcgggggcgccggccggggtcagtgcgcccgactccgtcagcagtcgctccagccggggggccagcacgatcgccgccacgttcgtcagatgggcgtcgtcccggtagagcaggatccggtcccgtaccgcagggcacgtcgggccgctccccgggcacagcaccgggttcacgctgacggaccgcacccccggcaccgcacccgccgcgatccgccgcgccagcgggtcggccggaaccgccttcgccctgctgaacgcgcaggccgccgcctcgtccggagcgccggacacgcacgccgggatgtccgtacccggtacgggggtgtcctcgatgtacacgatcggcgcgccggtcgcccgcagcggtttcagcgtcttctcccaggcggcggagaggagttcacggtcggcggtgtaccggttgagcgaggcgatcacgatgagccggggtgcgggtcccgtacgcaggcggtccagggcgtctgcgcgccaggtgtcgcactctcggtactcgcgccccaactgggggttcttcacggtcagttccggcagcgggcagccctgcttcaccagctcctggagcgcccagccgcgctgggaggccagtgcgagcagcggggagaaccactgcccggcgtgcgagtcgccgagcagcacgacacggtccgggctgtccaccgccccgaacaggcactccgggctgcgggtcaccgccggggcgacctggcaggacccgtccggcgggaagtccttgcgcgcctgagcaggtcccggcaccagcgggccgtccgcgagcggggaaccgccggtccgggcgagcagcgaaggaccggaagccgcacccggcgggagacccttcgcgtcgaccggggtggccgggcccatgaactggagggtcgtggtgccgatgaccagcgcgagcacgaccggcaggacgatggcggagatccccaccgccagcccccggcgcgggagttcggagaccgtgcggctgcggcgcagcggctgctcgacccagcgc

SEQ ID NO: 2867 - DNA, 21313 bp, Unknown
  Kingdom: Bacteria, Phylum: Actinobacteria, Class: Actinobacteria, Order: Streptomycetales, Family: Streptomycetaceae, Genus: Streptomyces
gccgcggatcttgacctggtcgtcgttgcgcccgaggtattcgatggttccgccggccaggtagcgggcccggtcaccggtgcggtagagacgtgctccgggttcggtgcggaacgggtgaggaacgaagcgttcggctgtgagggcgggccggtcgagatagccgcgcgccaggcccgttccgccgatgtagatctcgccgaggaccccgatcgggcagatgttgagcaggtcgtccagtacgtagacctccgcgttggcgatggcccggccgatggggacgccgctcgggtgcgaggggtgggcggtggcctcgtgtacgcagcagccgacggtggcctcggtggggccgtactcgttgtagatccgcgtgccgggtgactgcttccgccagtaggccaggctcacggcggggaacgcctcccctccgacgaccagtgcgccgacgttcagcggtcccgcgtcggcgggcagcaccgcgcggagcaggtccagttgcgagggggtggccttgaccaggctctgccgctcctcgctgagcagcaggtcccgcagttcggtgatctcggcgtgttcgctcagcagggtgacggtcctgcccgcgaccagggggccgagcagactggtgagggtggcgtcgaaggtgaccgaggagctcaccggggcgccggtgccctccgtcatgcggtactcgccggtggcccaggccaggtagttcacgatcgcccggtgggagaccatgactcctttcggctctccggtggaacccgaggtgtagagcacgtaggcgagcgcgtcgggctccacgtcgacgtccgcggcatgcggtggccgggtgccgtccgagggttcgtccacacagatcgccacgtggtgcccggggatgcggtggcgtgtctcgcgatgggtcaggaccgcggctgcgcccgtgtcgtcgaggatgtgagtgatccgccggtcggggtgtgcgggatccgtcgggacgaacgccgcgccgcgccgcagtaccgcgagaagggcgacgaccaggtccgtcgagcgcctcaggcagacggcgacccgggcgcccggcccgatggcgtgtccggcgagccgtgcggccagctgctgtgcgtgttcgtcgagttcgcggtaggtcagctcggtgtcgccgcagcggacggccacggcgtcgggggtaccggccgcgtgtgcggtgatgagccggtgcagcccggtgtccgccaggggcgcggccgtgccgttccagtcgacaagcacattgcgctgttccgtgcggctgaggatgcgcagtgagccgatggactgctcggggtcgcgcagggcctcggtgagcagggtgtggaagtggcggccgatgcgctcgatcgtgtcgcggtcgaacaggtcgctgctgtactcccagcgggtggacagccggccgtcctgttcgacgcagaccagggtgaggtcgaatcgcgccgcggtggacggcatgacgatggggtcgagcggtaggtgctccgtgctcgccgagggcatcttctcgtaggcgaacatcacttggaagagcggcgtgtggctggggtcgcggatgggcttgaggagttccaccagccgcgggaaggggaagtcctggtgggccagggcggcgagcacgctctcgcgggtgcgggcgaggtgcgtggcgaagctcgggttgtcggggatgcgggtgcgcagtacgagctggttggccaggtatccgacgagggaggccagttcgggacgggtgcgtgcggccgccggggtgccgatcaggaagtcggtgttggcggtgtagcggtgaagcagtgcctggtaggcggcgaggaacagcgtgtagggggtgacgccggactgtttggcgaaggtcttcagttcggtgaccagttcgtcgctcagcggctgggtgaggctggctccgtggtcacggcggacggccggcctgggccggtcgtaggggagcgggaacactgtgggtgcgtcggcgagctgctccgaccagtagcgtccttggcgttccggcgcggtggtcgaggtggggtcggcagcccagcgcgtgtagtcgcccagctcccacggacctgcctggggggtctgtccggcgtagccgcgctgcaggtcctccaccacgatccgcagcgaccacaggtcgacgacgatgtggtgtgcggcgagtacgaggattcgtccaccggggccgtggtcgatgatcagcgcgcggatgagaggtccgtgctccaggtcgaacggctggtcccggaactcggcgatccgtccgagggggtctgcggcgctttccggtgcgccgtgctcgtgggtgagcggcagcggcagcgcgtcgtggacgacggctcgcggccggccgtcggtggccgggaaggtggtacgcagcgcggcgtgccgctcgctcagggatcccagtgccgcgcgcagcgcgacgaggtcgacgtcgtgcgggagccgcgcggcgtagcaggtgttgtaggcgacgctgtgcggttccgaggtgtgcaggaaccacagtgcctgctcccctgcggacaccggccggtccggacggtgcttccgctcccccgtcggcacctccggcccgtcggcaggagcggcgacgagcttctcggttccggcgttctcggtcccggcggcgtcgagcaggtcgaggaggtgctgggcgacctcctcgacggtggagttctccaggaacagggtgagcgggaccggcacgccgagctccgcgctcatccggtgggcgagttgcgccgcggcgagcgagtcgatgccctggtcgatgagggtgctccgcgcaccggagtccgcggtcggctgatcgtcggcagcgaccaggtgctcggcgaggtaggcggtcagccatgcggggcggtcctgcgcggggaccgtgagcagggtggcgcgtggcgggtcggccggtgcggtcgtcgcctcgcgtggggcgaagacgctctggtggagttcgccgagcgtgccctggaggtacctggtgcggctctcgcgtcgtcggatcttgccgctggaggtcttggggatgtggccggtgggcagcagcgccacggcggcgacctgtaggccgtggtgctcgcggatgacgcgccggatcgtccggaccagcacttcggcatcgtggtcggcggatgcctggggggtgagctcacacacgaccaccaggtgttcggagtcgtggccgggtacggcgaaggcggcggcgcagccggtcctgatggccgggtcgctgccgtcgacggtgcgctccaggtcctgcgggtagtagttccgtccgcggatgatgatgaggtccttgagcctgccggtgacgaacagttccccggcgtcgtcgaggaaccccaggtcgccggtgcgcaggtaggggccgtcctcggagtcgccgaggtacgcgccgaacgtctcctggctccggtccggcaggttccagtagccggccgcgacactcgggccgccgacccagatctcaccgacgcgacccggtgggcaggcgcggcgcgagtcggggtccacgatgcgcagccgtacgtcgccgtgggtgcggccgctgctgaccagatcggccgtgggctcgccgggggcggcgtcgcgtgcggtggcggtcgtggacagctcctcgccggccagcgagcggacggtctccccggttcccagctcggtgccggtgaccatgagggtggcctcggccagcccgtagcaggggtagaaggcccgggagcggaagccgtgcggtgagaaggcttcggcgaagtcagcgagggtgccggcgcggatcggctcggcgccgttgtaggcgctgagccagcaactgaggtccagctcctggcggtcggcggccgtggtccgctcggtgcacaaggcgtaggcgaagtccggtcccccggagtgggtggcgcggtagcgggagacggcctggagccagcggacaggtgccttgagaaaggcggtgggcggcatcaagtaggcggggtagccggtgtagaggggttgcaggatgccgtcgatgaggcccatgtcgtggtaggcggggagccagctgaccgagacgctgctcggggagaggccgaacgcgctgcgaatgacggcggagttggccaggaggttgtgatgggtgaccatcacgcctttgggtgcggacgttgatccggaggtgtactggagcagggcgtagtgctcggcgggcggggtgccggctccggcgaagcatgtgggtatgcaggtgatgtcgccgtgcccgcgcggctgtgcgccgtccgtgccgagggcctggcgtacgccgtccgggagggccgcggcgatggtgtcggtggtcaggaccgcggccggtcgggcgtcccggaagatggcttcgagctgcaggtccccgcgcctgcccggcggataggcggggacgggggtgaggtccgccacgaagcaggcgaagagcgcggccacgaagtccagcccgggcgggtggagcagcagcacgcggtcaccgggccgggcgctcgtgcgcagtgatgccgcgatggcacgtgcgcggcgggccagttctccgtaggtcagctggtcggacggtgtgatgccgtcctggaggaaggtgtaggcgacctggtcgggcgctgtggtcgcgcggaagtcgaggagctcggccagggttgagaattcctggttcaccatggaggtccgcctaggtcgatgacgccgtcgatgggggctgagccgcgtaccggcaaggtcatgattttcgagtgggtgaagtcggtccgcgcgccgaactgggtcaccagcagccgtccggtgtactgcctccagccgagtgcggcgtagtagtccagcagcggtgggtcgcagacgaggaggccgaagtcgacgtcgccccgggtgtggaagaagtcctccgcgcagcgcatggcgctcgcggcatagccctggcgccggtaccgggggtgggtcttcacgcctccgatgccggcgatggtgacgcgggcgccgttgtgggtgccggcgcgcagcaggaccccgacgtgggaggcgagggtgccgtcgggggtcctggccgccgcgcgccagtgcgccggtgcccattccatgtcggcgccgtcccagtcggcttcccgttccggcgggtacacggcgtcccggagttctcccagttcggcctgctgctggtcggtgagttcggccatggcgtcgatcgccgtcaccatgtcgggtgtgctcatgcggggaggctccggtatctgtgctcagaagttgaggaagctgaggctggagaagatgcgtcggccggagtcctcgtaggggttgcgtccgtggaggaaccgggtgttgtcgatgaaggcgaggtcaccggggacccaggggatctcctcggtcacccccatgatcacatccatgatccgtttgacgtcggattcggagacaggggtgccgtcctccagggccatcgcgtcgccgagggtgttctcccgctcggtcatcaggctgttggcgaaggccttgtggtttccgtacttcgtggtgaccacggcggagaccacgtactccaggtagaccgagcggtcgtcggtcacgtggtaggagacgccgtccaggccgtccagggtgtgcttgagctcgtccagggtggcgtttccgccgaggaacagctgccacttgtcctcttcgtacttctggaagaaccggatcctcttggcctcgaagagttccttgaggtcgtcgggcaggcgctcccacacccggatgccgtcccacagcagcgtctcgccgccgtcctgggacggggtcttgcagcagaaccacagcgcgtccggccggaagggtgagttcgcctgctcggcgtgcggctcgacgaaaccctggccttcgaggaccgcctggacgtagccgtcactgccggggacggtgggacggatgcggtcgcggttgaagcgggtgctgaactgtgtggcgaaggagtgcatcttcgtggggtcggagacgtcgtagccgcggaagatcagcgccccggactgcttgaagatctcgcggatctcgtcggtcggcaggtcgaacaggtcgatgttctggctgcctgagcgttcgatgacacgggttgacccgtcaccgagcggtgcgtggtggatcgtcattttcgcctcgcaggtcgtgtttggaggttcaccgtgcgtcgaggtaggagatcagccggccgatggtcggatacttgatcatgtcggtgatcgtgaggtcctgaccggcgaggggcttgaaccggttgtacaccttgacgatcgacagcgagtcgccgccgatggcgaagaagttgtcgtcggggccgacggcgttccggcccagtacctcgcgccatattccggcgagcacggccgcggggtccggagcgctgtcgtcgacgagtgcggccatctggcggatcgtcgggttcttgatcatgtcggtgatggtgaaggcgttgtccgagtggcgcttgaaccggttgtagaccttgacgatggtcagcgagtcgccgccgacctcgaagaagttgtcgtctgcgccgacggtctccagtccgagcgtgtcctgccagataccggccagcaccgcggccgctccggtgaggtcggcggcgacgccggggtccgccggcgcgggaacggtgagcgccgcacggtcgagcttgccgttgggcagccgcggcagctcgtccacgatctcgatcagcgaggggacggcgaaccgcgggatgcgggtctggaggaactcgtgcagctcggccgtcgtcacgttcggatcccggagcaccacgtcggccacgagcctgcgatgaccgtcggcggagtacggcgcacccaccagtgcggactccaccgccgggtgctcgcgcagcgcggcctcggtctctccgggctcgatgcggtagccgcgcaccttcacctggtcgtcgatgcgcccgaggagctggatcgtgccgtcgggaaggtagcgggcgaggtctcccgacctgtagagcctgccgtcgccgaaggggtcacggatgaaacgctcggcggtcagctccggcttgcccaggtatccctgggacacgccggtgccaccgatgcacagttcacccggtactccggcggggaccagccgtgccgcccggtccaggagatggacccgggctccggcaatcggccttccgaccgggacctggccgggtgcggccgagggtgtgcaccgctggacggtggtccagacggtggcctcggtgggaccgtactcgttgaagagttccgcctgcggcagacgctcggcgtgccggtccaccaggtcctggtacagcggctccccggccaggatcacgcagttgagcgacgcgatctgtgcgggccgggcctcctggagtatcaggtcgtacagcgagggcacgcacagcaggtgggtgggagcggtgccggccatggaccgcagcagcgccggtatctccacgctctgcgcgatggggggaacgaggagcgcgccgccggtggtcagtgtccagtagatgcctgccaccgagctgtcgaaggacagcgacgacagcagcaggtatcgctgcggcggtgtgtcgtactggctccagcgtgctgtggtcgaggcgacgaggttggcgtggctgaccatcactccgttcggcctgccggtcgacccggaggtgaacatgacgtacgcgaggtcgtccgccgaaccgacggaacgcgggttgtccgtgtccagttcgtcgagttcgacgccgatgcggtccagcaggacctccttggcggggaggtccgggagcatgtcggcgacctcggtgtcggtgaggacggccaccggttccgcgtcgtcggccatggcttggaggcggcggtgtccataggcggggtccatcggcagatacgctgcgcctgccttgagcacggccagcagggcgacgagcatctcggccgagggccgcagggccactcccaccagcgtcctgggggcgatgccggactgccgcagccaccgggccagctggttcgcccggctgttcacctcggcgtaggacatctcccggtgttcctcgatcactgccgcggcccggggggtgcgcgccgcctggtcctcgaagagctgatggatggtgccgtcggtcaccggcggggcctggagggagctcccgtcccgggtgagcgcgcgcagctcctcctcgggcagcagtgccagctcggcgaccggccggcgcggatgggcgacggcgtcctggagcagggtgaggaagtgggtgcccagggcgcggatcgcgtcgggccggtacaggtcggtgctgtactcccagacaccgccgaacccctccccctcggtgcgcagttgcaggaccaggtcgtacttggcgacgccgatgtccacctcgtcgggggtgatgcgcagaccaccgtggtcatcgtgctgccccgcgggggcgttctccagcaccagcatggtctggaacagggggttgaaggcgggtgagcgctgtggccgcagcgcgtccacgacactgtcgaacgggacgtcctggttgtcctgggcggcgatgaccgcttccttggcctgggcgagcacatcgaggaaggaggcgtcggcgccgagctttccgcgcaggacgacggtgttcgcgaagaacccgatgaccttctccagctcggggtgctcgcggcccgccagggcggtgccgatgaggatgtcgtgttcaccggtgtagcggtggacgagggtctggagtgcgctgagcaggaccatgaacggagtggcgccgtgctgccgcgccagaccggtgaccgcccgtcccagctccgcggggacggcgaacggcagtcgtgcgccgtcgtgggtggtgacctcgggccgcggtgcggcgatgggcagttcgagcagtgagggggcctgcgcgagctgacctcgccagtacgcgagctgcgcctccaggtccggtccgccggtgcggcgccgctgccagtcggcgaagtcgccgtactggagggtgggttcggcgagcggggacggctgtgcccggctgaaggcggcgtagagttcggcgagctcgtggcggaacaggtcggtggaccagccgtcggtgatgatgtgatgcgcgatcagcaccaggacgtggtcgcggtcggagagcctcagcagtgacacccgcagcagcggaccgcgggccaggtcgaacggtttccgcgcctgttcgacggtgagccggtgtgcttcctcctcccgctgctcctcgggcagccgggtcaggtcggtgacgtccagcgggagtggctgcggtttcccgacgacctgaagggggccgtcggtcgcgtcggtgaaggtggtccgaagggcttcgtggcggcggacgatctcgctcaggcaggcttcgagcacggagacgtcgaggtcgccctccaggcgccatccggcggtctcgttgtaggtcggcaggcccgggcggatctggtccaggagccagaggcgctgctgggtgagcgaggcaggcaccggtacgccggggggtcgcgccggtatgtcgtcgcgtggtcctgcggcggcctgctgccggagcctggcgagcaggcgttcgcgttcggcgggtgagaggtcatgggcggaaacgtgcgcgtccgtcatcgtgtggggtcctcgtcctcaagtcgggattcctgtggtcagcgccctctcctgacctctctgatggcctcggcgacggcttccggatccgcgtcgctgatcagcgcgtcgtccacgacccgcgccatgccttcgacggtcgggtgctcgtacagggtccgcgagggcaggcggacgccgaaggcgttgcgcacccgggtgacgaactggctgccgagcagggagtcgccgccgagccggaagaagtcgtcgctcataccgatgtgttcgatccccagcagggtctgccagatctctgcgagcatccgctcggtggcggtgcgcggctggacgtactcggtgctcagctcgggacgggcctgctgtccctgggtgttctcctgctcgatcgccgtcaggtacacctgcgacaggtcctggcgccggtcgtccagcacgtccaggtagtcggagctggtgacgtagacctgcggcagtccgctgtccagtacccggcacagcgcgtcgattccctgcgccgccaggatgccccgctcggcgaagtcggccagcttcatctgctggagcaccctggggccggcggcgtcgtacgccatgccgccgttctgccacacgtcccagttgacgcaggtcacgaagcggtgggcggcggccttctcgctgtgcgcgaaggagtccaggaagcagttggcggcggcgtacgcggcctgtccgaaccccggtttgcgcgccgacagggaggagaaaagggccaggaagtcgaggtccttgtgctcgaacagttcgtgcaggaccaaggttccggtgaccttcggcgccaggacctcctcgaattcctcgacggtcttgtgcgcgagcgctccgtcgccgaggagaccggcggagtggatgactccgttgatcggtcccaggcgcgcctccgcggtccgtaccgctgcgcgcatctgcgccgcgtcggcgacgtcggcgcggagcaccaggacgtcggggtttccctcgtaccagggcacggtgccgtccgcttcgcgtccctggcccgaccgtcccaccaggacggctctggctcccaccttctccaccaagtgctgggcgaagctggagccgatggtccccagaccgccggtgatcaggtagacgccgccggtccgcagcatccgtccgccgtccgtgcggtcgagggtgaccggctcgacggtctccacccagcggtgagcgccgcggtaggcgacgacctcgtcgtcgtgcgcggcgaggacctcgtccgcgagccgggcggcgacggtctcgggtgccgcggtgaccgcgaagtccacgctcctgctggtgaggcccgggaactccagcgggatcacccggttggtgccgagcagcagtgcctgttcgggcctggtgtactcccccaccacgtcgtgcatgcctctggaggccacggtcagctccagtggatggtccgggccggcctggtcgactgcggtgaccagcgcggcgagttctcgccactgctgtgcggaggcttctccctgctcctggcccagcgcccacagatgcaccaggcgcgtcggactcgtcccctgggcgccgagctcggacaggacgcgcaggtagtcgtcgccggtgtgggggtggacctcgaagagggagtcgtcgtgcctgcggtactccgtcccccggcgcacgcagatcacccggtggccgcgttcgcgcagcaggcgctggaacgcggtgccggccgcggagtccgagcccaggacgagccaggtctccgcgtcccgcgcaccgccgcgcacgggggccgtcctcttccaggacggcacgcggaaccatttgctcacgtcggcctgtttgcgcaggccccggtcgcacggcggccgcactccctcgttgcgtgcgatgaggacgtggtgtcccagcgcttcgtcctccggcacggccgcgaccgatgcgaactgggcgctcagcctgcgctcccagccttccctggacaggaagggcgcgctgcgggtccggtcggaatcggtgacgctccccatcagcaggccgtaagtcagggcgaagtccgggccgggggtggtgatctcggccagcagcaggagtccgccgggggccaggagcgaccgtacgtgctccagggtccgtcccaggtcgctggtggcgtgcagcacgttggcggcgatgacgacgtcgaaggcgccggtctcgatgccctgctcagcgggtggcttctcgatgtccagctgtgcggtgccgaaccaggagtgctgggcgtaccggcgggcggcgtgtgcggtgaacgcgtcgctgatgtcggtgaagacgtagcggtggtcgcgtccgtcggcggcaagctccgggacgacctggccggtggtgaggccggtcccgccgccgatctccagtacgcgcagtccgtcggcggcgcggtccgccgccagcaggccggcgacggcactccggatgaccggcgcgtactcggtaccgaagatctcggccgacccggcgaacgcgcgatccagcaggggggtgaacaggtccacggggtcggctgtgccgtccaggatgtccggcagcgcggttccgcagcggtgcaccagttcgacctccggccggccggaccacgcctgccgggtgcgctccagcaggtcgtgcagctcctcccccgtgcgggtggtcggcgacggatggcccagccattcggtgatcagcggccggtaggcaggcacaacccggtccgccgggctgtcgccgagtgcctggagggtgttggccatgtaggcggagctgagctgctccagcaggtccaccttggtgcgcctgcgggtgaggtcttccgcctcgatctgctcggcggcctccctgcgggcctcgcggagcgccacgtcgaacggctcctcgccatgtcggccggtgcgcggcgggtcgatccagtggcggcggcgttcgaagggataggtgggcagggggaggcgtcggcgctccgcgccgtggtgcagcttctcccagtcgatgttcaccccggcgcaccacagcgatccgacggaccgtaggaagacgagatggtccggttcctcggccgagcgccgtggcagggcggccgaggcgatgcggccgcggtcggcgtcggggtggcgtctggccaggctcgtgatgacctcacccggtccaagctcgaccaggacgtgatcggtgtcctggaagactcgtcgcagcccgtcggcgaagcggacgcgtcggcgcaggtgccccacccagtatccggggtcggtcgcctgctcgtcggtgatccaggtaccggtgacgctggagaggaacggtacccgcggcgggttcagcgcgatcccggcgaagtgttcggcgaagggcgccagcgccggttccaccatggaggtgtgcgaagcgtaggagatgcgcagcacggaggcgtcgacgtcccggtcggccaggtgcctgtgcaggtcgaggatcgcctcacggggtcccgcgaccacgcaggaggcggggtggttgaccgcggcgatggacaggtcggcgccgagcaggtgctcgacgtcgtcggcgctgagcggaacggccatcatcgacccggcggggaggtcctccagcacctttccgcgggcgaccaccagggtcagggcgtcctccagtgtgaagacccccgcgatggtcgcggcggcgtactcgccgaagctgtggccgaccccggctgccatccgtacgccgtagtgctccagtgtcctcgccagggagtactgcagaacgaacagcgcgggctgtgcgttgcgggtgtcggtgagcagcgcgtcgtactcctcggtgcggccggcgtcctgcgggtggatcagctcgcgcaggtcgaggccgtgccgggtgcgcagcaggtcgaagcagcggtcggcctcgacccggaagcgggggtctgtctcgtagagccgccgtgccatcccgacgtgctggggtccctgtccgctgaacatgaaggccgcctgccggccttccttgaacaccggtggcgcgtcggccgcgggcagggcctccagctcgtgtaccaggtcggccgcggtggtggcgacgacggcccgacggtgcgcgaaggcccggcggccgcgttgcagtgtgtgggcgatgtccgccgtcacggcggacgggtccgccgtgacgtgtgcgcgcagttgctcggcccggcggtccagggccgactccgtgcgcgccgagagggggaggagttgtgcgccgtcctgcccggcgggccggggggtgggaggagcctcctccagtacgacgtgggcgttggtcccgccgatgccgaacgagctcaccgcggcgcgtcgcggtccttcctccacttcccagtcggtgctccgggcgttgacatagaagggactggcgcggaagtcgatggccggattcggccgttcgaagttgaggctggcggggatcttcctgtgccgcagagcgaggacggttttgatcagtccggcgacgccggccgcggcgtccaggtgacccacgttcgttttcacggaaccgatcgcgcagaagccggtcttgtccgtcgccgagcggaacacctcggtgagcgcggcgatttcgatggggtcgccgatgatggtgccggtgccgtgggtctcgacgtagctgatggtctccggggagactccggccagggcctgggcctcccggatcacggccgactggccttcgacgctgggcgcggcatagccggccttggccgatccgtcgttgttgaccgcggccgccttgatcacaccgtggatgtgatcgccgtcggccactgcgtcctccagccgcttcagcagaacggcacccgctccgctgccgatgacggtgccgtccgcgttcgcatcgaacgcacggcacgctcccccgcgggagaagatgctgccttcctggtggagatagccggcctgcggggtcctgacggagacgccgccggcgagagccatgtcggattcgtgcgacaggagcgactggcaggcctgagcgaccgcgaccagcgaggtcgagcaagccgtttgcaccgtcatgctggggccgcgcaggccgagcttgtaggagacacgcgtggccagcgtgtcgctctcgttgccgagcagggtccgctgcagggagccgggtcccaggtgctcggggtgcgcggccacgttgcgcaggaagtagctgttccagcctgatccggcgtagaccccgaccggcccggcgcagtccctcgggtcgtagcccgcgtcctcgaaggccgaccacgcgcattccaggaacagccggtgctgcggatccatcagcgcggcctcgctgggactcactccgaagaactgcgcgtcgaagagatccgcgcccgcgagacgaccatggacccggacatagtccggatggtcgagaacatggggatcctcgcccgattccagcaggtcgcggtccgtgagagcgacgactgctccggttccggattccagcaatctccagtacgcgtcaggaccatcggactgagggaatcggcaggaaatgccgacgactgcgattccgtcgatctcgccatcgagagcgtccacagcaaacctcatcgcctagtagtcgtcacccggacatacccgagaaggatcaagaatcgacttttacacagcgacgtaaacaactaccacacgcgttcggccactcactactcccactctccggttacccaggctttcggccagaccggaaacaggcaccacaaccggaagcgaagtaggcatatcgagaccgatgtcccattaagtctgcttccgaatggggcatttacttacatcgcctgccggtcatctacagatttccgtcatcgagatgggtcggcgatcggcaataaacagcgtattgacacgcggtatcccacagtgcaatggtcgggacgcggaggccaaaaaaggcttcaccagcacgtatgggcaacagatgctcaaccctcccggccgccacgcggaatgcaagatcaattaatagtcttccaaaaagagacatgccgtcaaattttcggggtacggcggagaacgttcggcactccgacctgtcatccgcaccacgtgaacgaggtatccgcacctattggaggacgccaggcgtggcgaacacgaaccgtgtgagcaccggtcaatgcgcagcggtcgcggtacctggtcccggacgcatcggccggcacgggcctcacctcggcacgcaacagcctcgacagcgacctcgtggctcggacggggacgagctcgctcggcgggcgacctccaccacggcgcaccccacgacgtcggcgtcctgaacgtcaacccctgtgatcccggtggcaacaccgaggtcacgcaggggtcgagcttcatccaggtcgtgggagttcggcaggagcaccggtccccgtacacactcagaaccatccacctgccgccaccggcgcaccgatgactctcagagacccggcgaacccgcgcaaagaaggggtagcacccgtgagtgacagcacaccgcagggcactgcggccaccgtccggccgaccgcactgcaagaggcgatgtggcgggtgtgccagcgcgtcggggacccgtcggtctaccacatctcctggcgtctggcctgcgaggcgccactggaccttgcggcgctccgcgtctcctggcaggcagtggtggaccggcacgaggccgtgcgcctgtccatcggctccgatgagctgggcctgtcggccgccatccacaccggaatcaccgcggacgtacagctcatcgagctggccgacaccggttccactgcggtggacaccctgctgcgggccgtcgccgaggagtcgcaccggcagccgttcgacctcgcctctccgcccctggccaggctcaccgcggtgagcgcgggcgagcaccacgagctgattctcacggtgcaccatatcgccgtcgacggactggggatgcagctgctgttccaggacctcaccgaggcctacgacgccgcgctgcgccatgagcaacccgggttcgccgcggcggcctcgtcctggcgtgagttcgcccaggaagaccgggccacgcgcgacggtgacggatggcacgccggcatcgagcactggcgagcggtcctggagggcgcgcacgcgacgaccgtagctcccgaccggagcgtgtacgcgggcaccggcggcgccggaaccaccctggcgtacaccttcagcgaagaggcggcccggggactgacggttctggcgaaggagtcctcggtgacgtccttcgccgtggtcctggccgcgctgcaggtcctgctctcacggtccggcgccggtgaggacgtggtgatcggcaccgtcgccgccaaccggctcagcgaacgcgaccagcacctggtcggctatctggtcaacctctgtctgatccgggcacgggtgtcggagcaggacaccctctcacaggtggtgaaccgggccagcgaggcgtcatgggagatgttcgccaaccaggccgtgccctttcccgtcgtcttctcccgactcgacgaaccgacacgatcctcgctgggcgacatcgcgccgatcatgctcaaccacctcggcgccatcggcagcggcctgcggctcggcgatgtcacgctgaaccagcggcccagtctcaatgtcgcggcgcgcaccgacatggcggtcgcctactggcacaccgacaccggcctcatggccgaggtcgagtacagcaccctgcggtacgcggagagcaccgtcctgcggctgctccaagacctggacaccgtcctctcccacggaaccactcctcacctgcgtgtgagcgaggtgcgggtgcggacgcgatcggtggcggttcaacccgaacaccgcggcgccggagacacagcgcgcgtgccggcacaccccgtgcccgtcaccgcggacaccgcggagcacgacgtcgccgacacctggtccgatgtcctcggatatcgcttctcctccctcgacgaggacttcttcgaggcgggaggccattcgctgaacgcggtcgacttcgtggcgacgctcgccgaacgcaccggcgccgccctcgatctggcgacctggctgggccacccgacgccgcggtccatactccggcagatcagtgcggcggacggcgcctccccgtccggcaccggggggatccggcctgacccgccgtccaccctggtgtggctccgcaccggaaccggaccgcatgtgcacctgttcgccggcgccgggggatccgcccaggactaccacgccctgctccccctcctgccgcccgacgggacggtcacgttctcccaggagcgggaacctttgacgaccatccctgagatggccaagcggttcatggacgacttggccgaggaggacctgcggccggacgtcctcgtcggctggtcgatgggcggacagttggccttcgcagccgccaccggctacggcgagtccgccgctccgaccctggtcctgatcgacgcgcctccgcccgtcggcacggccctgcggttggaggcggcgcaccggcgtctggcggacttcgccgcgacggtctgcctggcactcggagtggacggctccccggtggcgccgcccgccggcgcgggccctctcacgcgggaagggctgcacagcacgctcctggtgctgtccgcacagcttcgggcaggaggccatgacgtatcgagcgccgcactggccgaccgctggatgacctacgaacagcacgtgcaggcggtcgccacctacgcatcgagccacgtgatcgcctcgcacgccactctcctcgcagctgacctcccggacgagggaatcgcggcctggaaggagcgcttcacgcacaccccggaggtcgtgcgcctggatgccggtcaccacacagcgctccgtgcgccggctgtcgacgccgtcgcagaggcgatcaggcaggtcctgcccgggccgatcacttctggctgaccccgctccctgtctgcctgccaggtcgccggtggcgaagttccagtaccactcctcgcccggttcgaagtctgcgccatgggagccgacccgtccggcaggaactctgcgggtggcgccgactgccaaggcaccgccgtacggtgagagctgcggccaggatcgcgggtgggcagccgcatcacacctgcccgtcgcagcgtcgtcccccggccgggcctcccgctccggagggaagcgcgcccgcgggcttcagcagtggtgaatgcgggcgatcctcctgcgcgggccgcgagcaatccgggtcatgggacggggtgttcctcgctgtcgaggagctcggtcacgagccgacgggtgtacgtggcgtcgagtccggccggacggaagaggatgcggtacatgatgggcgcgaccacgcggtccatcaccgtctcagcaccgggggggttctcctcgcggccgatcgcgcgggcgagcatgacgtcgatctgttcggccgcgtaggccgagcactgaccggcgttgctgccgtccgggtcgccgagcagagcgtcacggatgtaggcgcggccggagggggacgacatctcgtcgaggaactgttcggcccaggccgtcaggtcggacagcaggtcaccgtggctctccggctcggtgtcgggccgcaggcgctccaccgcgacgtccgacagcagctcctgaaggtcgccccagcggcggtagatcgtcgagggggtgaccccggcgcgctgggcgaccagcgggacggtcaccgcgtcgcggccccgctccgacaggatgtcccggacagcagtgtgcaccgaagcctggacccgtgcactgcgcccgccggggcgcaccatcggcttacgactcatacctccaccttaaagcatgattattgcgtttaggggagcgccgcccccggctcgacggggggccagagccacctcgccggtctcctcgctgcgggccaccggtcctgatcttgaccggagccgaacggcgcatggaccctgccggaaccgtccggcccgcacgccgtcctcaggccgtcggcgcgagcgagggggcggactgcgtccgttcgtaggcgtgacccacccgcagcagctggcgctcaccgaagggccgcccgagcagctgcatcccgatcggcatgcccgccgcgtcgtggcccaccgggacggacagagcaggcactccggtgatgttggccggggaggacagacgcacgtaggcgtcggagacggcctcggtccagccgtcggaccaggtgacgctcacctgaccggccttcaccgctgtcatcgggaccgccggggcggcgatcacgtcgaccttctccagaatgcgggcccattcctcccgcatgagcgttcgggagcgctgggcacgcagatagtcgcccgcgcccatcagctcaccggcctccagaaggacgcggacgtccgcctggtacagctcggggaccgtacgcagcgtgtcctcgtggtaggcggtggcctccggcaccatcaggccccactgggtggcctggatgtaccgggtcatcgggatgtcgatctcgacgaggcgggcgccgagcgcctccagtcgcgcgatgccccggcggacggcggtctccacctccgcgtcgacgtggtcgaagtagtagttgcgcggcaccccgacgcgcacgcctgccagatccggctcccgttccgaccggtggccgacggcgggggtgtccagcgaggcggggtcacgggggtcgtgcccggcgaggaccgtcaggaccagggccgcgtcctcgacggtgcgggtgaccgggccgacatggtccagcgaccaggacagcgacgtgacgccgtggcgcggcaccagcccgtaggtcggcttgaagccgacgaccccgttcagcgcggcgggaacccggatcgacccaccggtgtcggttcccagggcgaaggtcgccgccccggccgccaccgcgacggcggacccgccgctggagcctcccgcgacccggccgcgatcccaggcgttggcggtctgcggagtggtcaggccgtaggcgaactcgtgggtgtgggtcttgcccaccaggacggcgcccgcgccccgcaaccgggctgcgaccgcgctgtcggcggcggcgcggtggcctgcccggacccgggaactggcgctggtgggcgaaccggcgacatcgatcaggtccttgagtccggccgggacgccgtgcagcggcccccggaacacgccgcgggccgcttctcgctcggcctcccgcgccgcgcctcgggcctgctcagcggtgaccgcgacatatgcctcgacgtgcgggtccacctggtcgatgcggtcgaggaccgagtccaccaactcgacgggggacagccggcgggcgcgaatctgctgcgcggcggcggcgagggtcagctcatacggctgcatcgcgcttctcctttccggcgcggtaggcgccggcgggcggggtgtccccgaagtccagctcacgcaggaccgcgacgacggagtggatgtggttggcggtggcggcgaccgcggcatggcggtcatcgggcaggggaagcccggcgcgggcggcccagcgggcggcttcgggcggcgtgagttcaacggagggcacaggtttctcctgatcagggggcgtggcaacgcagtaccccacaccaaaagctatcggtttgctttaaggggaccgtagggcctacggtccccttaaagca

SEQ ID NO: 2868 - DNA, 12735 bp, Unknown
  Kingdom: Bacteria, Phylum: Actinobacteria, Class: Actinobacteria, Order: Streptomycetales, Family: Streptomycetaceae, Genus: Streptomyces
  misc_feature (225)..(226): n is a, c, g, or t
cccgcgtggtggccaccggcctgctgctgctcttcatcgacggtcccctctggctggtcgcggtgtgcgtgttcatcgtcggagcaggcgaggggaccctgcggccgacccagatggccatgctcggcgacctcgttccggaggaccgccggcagtccgcgatcgcactgaccacgatcaccttccggatctccctgatcctgtcaccgggcctggcgaccaccnncgcggcgtacgccgtgcgcgcactgcccggcgtcgacccggagcccgggaccgaccgccgagagagcgagtccgtacaggcgaaactcctcggagggatccatgccgcgcgcacccagccgtggttcctgtgcggactggccgtgctcgccctggtcctgggggtctccgacgccacccagatggttctcctcccggtgatcagccaggaccgtttcggcaccgagtccgtgtacgtggtctccctgagtacgtttgcgctgggtgcgctggccggcggtctgctcatgctgcgctggaggccaccgaggccgggtctgttcgccctgccggggatcggtctcatcggtgccattccctgcgtcctcgccttctcctcccacccgtggccggtgtatgccgcgcacttcgccgccggtgtggggatggaggtcttcaacgtggcctggttcgcggccatccagcgggagttcgctcccgaagtccgtgcgcgcgtctcgtcgctcgacttcttggtctccttcgcgatcagtccgctcagcctggccgtcgtaccgaccgcggtgtcgggcttcggtatgcgaccggtactgatcacgatgggagcgctcgtggtggcaggctgcctcggcgcgctggcggtaccgggaatgaccagatttcacagggttggccctgcaagctctcagtgaggtggcgaagccatgtttacccaggtggacacactcaatgacgtcatcgccgaggcggcggcggcactgcccgacaaagtcgcgctgtccgacgcgacccggaccctgacctacggacaactccatgcccgcgccgaggcggccgccggacgcctggtccacgatggagtgaccaagggaagtctggtcggcatcgtggtcgaacggtcggtggacacagtcgtcgggatgctcgccatcctccgctgcggcgccgcatacgttccgatcgaccccacctatccgccggaacgccgggagttcatcgtccgggactcaggcatcgaggtcatcgcaggttcgaaggaggcgctcaccaccatcgaggcaacccccaccgtgcgcacctgccccctggacacccccggcgacggtggcgagcccgtcagccggccggcgggagcccagccctccgatccggcctacgtgatctacacctccggatccaccggcctccccaaaggctgcctggtcacccatgggaacgtcgtcagcctgctgcgtcacgcgctcccgctcttcaccctggactccgacgactgctggtcggtcttccactcgttcagcttcgacttctccgtctgggaactgtggggagcgctcgcgaccggcgccacggcggtgatcgtgccgcacacggcgacccagctcccttcggaactggctcagctcctggtccaggagaaggtgacggtgctgagccaagtaccgtcggtcttccggtacttctccagcctgcagcgctatcccgccgatcagctgcgctacgtcgtcttcggcggcgagagcgtcgacctccccagcatcgccacgttctggtcccggtgcggagagacccggcccacggtcatcaacatgtacgggatcaccgagacgacggtccacgccaccttccgtcgcatcactgacgcggacctcgccgcaggcaacggatcacccatcggaacaccgctgccgcatctgaccatcgaactccgcggtgaacagccgccgcatgcacccgtagcggacggggagacgggtgagatgtggatcgccgggtccggcgtggccgatggatacctgaaccgaccggaactcaccggccgtcggttcgtcactgatgaccaggtggaagccggaaggcgctactaccggtcgggcgacctcgcacggtggctgccggacggcgaactcgaatacctcggacgcaacgaccagcaggtcaagctccgcggattccggatcgaactcggggagatcgaggccgccattcgccggcagtcctgcgcgacggacgcggcactgtgtgtcgccaggcgcagaccaggtgccgaactgctggtggcctgcatcgtgcccagcggtcctggagggaatttcgccgggacggtcgcgtcgatccgcaacagcctggcggagaagctcccgaagcacatgctccccgaccgctacctctacctgccggccctgccgctcaccctgtcgggcaaactcgaccgtcaggagctggaccacgtggtctcccgagcggtggaggacggagccgttctccccgcgccgcgctgacaccgctgccagcacctctgggtgacctcacggcagccctgtcacccgcgtcaccgatctgtccggacgacacacccggtgctccagcagcggttcttgtcccgagctgcgttttcggtagtggcagtgggcgagcgatggcccggcggcgtcttccccaggcggaccgttcagtgcgtgggtgacgggatcgtgatcggcccggggatgattcgttcttcgcggcccgtgagcgaggtagtaggtgatctcgccagtggcgggcagtttcgccgcggcccggtgacagacgcgcggacccttcaccccatcaccgcaggactgccgccgccaggctcccagacgctgctgttcagcagccgctggaagctgtccggcgtgcggtgacctagcgtgtcgcccgccccagcagaccacggacataacccgcatccgccaccgcagacccgcccgagcgaacctacccgccacccgcgcgaacaccgaccccaactaggcatccccacaactcatttcatcggcctcgtccataccgggacaacgacagacaccaactcagcacacgaaccgctgctggagtgctgagggagcccgcacacagaatcggcagacggacaccagtgtgggcggtcgacaacagagtgcgtcaggccgctccctgtcccagcactcgctgggttggcttgaaacctatgggtacgatcgtcgctacatacatccccacgtcgagagccgaggacttacatgtctggaaaccttcacgttccgagtgtcacggcagactacgcgcagcgggtggctgatgacctgtccgcgaaccgcagcgagcaggagcgcgtacgtaccgagctggcacggttgcaggacgagctggtccgcctggaggacagcgagcaggtcctgacgaagatgcaggaagtgctcggcggtacgcccaagcaggcagtgaagcagggtaagggccgtaagggggccgcagttcccgcggcgaggggttccaacagcaaggcagcagcagggaagccggctgcctccgccgggcgcaaggcgtccaagaaggctgtgtcgcccaggaaggcgggggagccgacgtggctggagctgaccactgcctatctgggagggcagagcgagcccaggtcagcggcagaagtggcggcctcgctcactgaggcgcaccctgagcgcacggtccaggtgacggtggtgcgcaactctctggagcagggcgttgcgcagggcctgctggagcgttccaagcagggacgttcggtcttctacagtcccaccgcccctgcctcggaaccgtccggttcctaggtcgtgtccgcaaagtctcgtctggcccgcgggccccgcccggagggcggacgacgattctttgcggacactccctagcggtggttgaggtgcttgcgcgcgatgtcggcgaacgtgctgatagctgacttcagggcatcgaagtgttctcgggggcgatccgtcggagtggagggatgcacgattccgtcgggatccgagagaccgtcctcgataccgttgagcgtggcggccagtcgctgggctgcggcctgaacgccccgagccgccgctgcgacgcgcgagggtccctccagctcgacctgtcgagctgcggccgccaccggctgaggctcggccgcggacgagatcgcccgtcgaaagtcagaccgttcagagttgctgtgccggggcggaagaccttccagctcgttgaacaggtcctcaagcaggaagcccgcgctctccagaactgccccggtccccgcctcgtaggcatgagcggctctcaggagctcggcgtacacctcccgttgcgccgtacggcgcgtgacgtcgagcgatccgagataagcgctgcgggccgccttggacgctccgaccacagcagcggcaccgccgatcagagcgccggtgagagcgctgcccgcgccgatcaacgcgatcatcagctcgttctccataggtggatcctgccgtgaacctgctgggtcgtctacggccgggtcgcgccgtggcagtcggcggtcggagtggcggtgtcgagcgctggactggacgtcgcccaccgaccgggacgtgcggcgctggatctccggtgccgcacggtggccgaccggccgccgtcttcgtcaccggccgcggtcagctggtgcggttgtagatcgccgtgccggggcaggcggtgacgcccgagcgggttgcgcacccggtgtactggctggagccgttccaccaggcccagccgccgatggtgcggccgttgagccaggtgtactggccgttgtagttggcgtcgtacgtgcgcaggctccagtgcacgtgggctccggtcgcggacccgccggcacaggtgtcggtgccgatggtgccgagcagggcgctgcgggcgaccgatgttccgttgtagtaggtggtgttccacatgtggtagtagtccgtcgagaagccgccggggtggatcactctggtccagccgcctccggcaccgcacatcgaggtcgccgttccctcccgggacgagcggacccgcccgctggcgttgcctcccgcgaagtcgaggctgctccagtagcccgtcgagccggtgtgggagtgtgccccgccggtgagagtcatgtagtagtcgggcatccagggaagcagcaacccgttggtgttggcagccgtggaacccaccgacggcgtctcctgctgcggagtcgccctgcgctgagcgtacgccgtcatggtccgccgttccgcctttccgaccagcggagactcggccacgtgatcggtgaactcgcggtcgccctcaaggcccgagatccattggccgtccttgcggtgagcgatgtagagccagccctccggctcaccgtggtgggcgcgggtcgcttcgacgtacgcgatgccacgagcccagtcggccgagacggtacggacatcgacgactaccttgcggccctcaccggcgagtttgctgacggcggctttcggagcgagaccctcggcgtcgtgggaccgggagaggacgtctgtggagacggcatctatcagtgcctgtcggccggtgccgaggcggtcggccaccgcggccggcatcttcacggtgacaccgggggaaggcgactgggcggaggtcgccggggacccggcagacgttgtgggcgagtcgcggaaggccgccgtcgccgagggtgcggtggcgagcagaccgagggcggcaagggcggcggcggtggttctcgcggacagcttgaagagcatgggtggtgtcccttctggaccagagaggcctgacaggccgacaggagcgagagctgggtggggcgcgcgcggccacgccgtacgagaggaggacagcggtgaaatgacatgtccgcaccaaatctatgcgcgtagcatacgggtctgttggccgccggaacagatcgagcagccatggattcagaggagataccgagcgccgagccggggagtcggtgacggccgtgggcgcggctgtctcagaagaagccgccacgagcgccgggaaacggcatgtgcgcggcagtaccgcgccgaggaagggctcggcgggcgcggccccggcggtggcgaccgggtcttgagtcgtgccccgaccgaaccccggaccgcatcaccccgtccggtctcggccgcctcctcgttgcccccgtcgaggccggcgcggaacacgccctgccgagcacgtgtggcacgtctcggtccgtaacgtccccaccgaccgcaccctctcggacgccgccagcgcctacctcaggaagaagcgcacgtcaccccgtccggtcgccgccggcaggccggcaccccgggtggcgacccgacgggttctcagccgtacggagaccctcaccgagctggaacagcctcggctcaaggtcgtgttggccgaggtggcgcccatcagtcatcggtgcaggggtgctgagatctaccgtcggcgcggtgacgtgaggaccggacgaagggcttcgcccaggacgaatgcgacacatcacacctggcaggcaccagaggtggggtgcaggagcgtgcgggtcacgcgtgtccactttcgctggaagttgccccggcacgggaaacgatgttcgtgtcgggtgccggcccagtgtcggcgagccgaggttcgcatggtgtggcgtacatcgtcaggcccttgggcgtcggtgtgagttccaggctcacgccgatcttgcggcccggccgcgccgggcgcagcgtgcgcgcgctggccagggtcgccagcgcgacgggcagcatggcatcggccgcggctgcgccggggcagtaccggggaccgaggccgtaagcgagcagtgcggagggggccggcgacggctcggcgtgggggagccagcgctgcgggtcgaacacgtccgggtcgcggtagcggttcctgtcgcggcgcagggcccccagaggcagggtgaccacggctccggccgggatccgtacaccgccctggcaggtctggtggcgggtgcggcggaccaggaacgggatgccgtggaggcgggtgacctcttggacgaacgcggtcgcgagcgggagctggtgtgcttggagacggctcgtatcgggcgcggcgtcggcttcgtcccggagcgcctgctggtagtgcgggtagcggcccagttcgtagcaggcccaggcgagggtggaggcgctggtctccatgccggcgatcagcagagcgcgaatgtcgcgctgcaccacatgggggtccccgggagcggcagcttcgagcacggacaccaggtcctggccgtcggggtcgggctggtggcgggctcgcacctggcggacggcctcgtccagttcggcgagtgcgcggcggcaggcgcggcgccggggcacgggcacccagggccagggtgctagggcgtagcgccagaacattccgccggacagggtggagcgggcggctgcgatgctggacagggtgccgggagtgagctcgctgttgaggacacagctgacgaggaggccgcaggcgagccggctcatctccacccgcatgtcgagcggtcggtccacgggcaggtcggcgagaagccgccgggtacgggtctggacgctgggcccgagagcggtgagccgggacgcggcgaacgcgggcctcatcacggcgcgccgctcccggtgggcggcgccctcgaggccgaccaccccgtcctcggtgaagtcgcgcaggctcgggtccgggccccagaatcggaaggtgtcctcatcactgccgaccttgcgcagcagtgccgggtcgttgacctgaaaggcggtcgccgggcctgtcctggtcgggacgaccgggcccgcctggtcgaggcgggccgcgaggttggccgggtccagccagaaccgcagggcgcgggagtgagcgagtactcccgcgccctgcggtacgaacggttgtccggggcaggctgtcctgtccacactcatcagcttcgctgtcctgtccacgttcgtcgtcctccgcggctccggccgcagtacatgtgggcaacgatcaactgcgggggcggtcacgggtgggccggtcccgtgtgaacccgcgagcgcccgactggacctgcccgacctgcctggtaccggacgcacaccgtcacctacccaggagcgcggttacaacgtggagatcctggaggcgtacccgtgccgcgagaccggggtcgttcccgtcccggccgtcgtcggagccgtcctcgaccgcgcacccgccgccaccgcaccggcatgggggcgaaagagctgaacgcgacgactggaaagggcacaacccgagagcggccaccgcggcggcgatggccctcggcgcgcgtcgggaagggtcggatgcctggaatcagcccgccgggcctcggcggtggggtaacaaacaatcccgcccggaaccgaggaaagccccttcgcgaagagcctctcgttcataggatcgattccagctccgggatggcccgggacgtcggcagagggaggggttcgtgtcggatatatcaagacgcaagttgctggggtactcagggacggccgcagcaggagccgtgttcgcgtccacctcggcggccgacgccgcggaagcggactcggccacaacaacggctcagttcatggagggcacggagtttcgggccgacgcgagcatggccgagagcgatctgatgatggacgtaaccttcaagctccgcgtcgacaagccgaacggctacccttcagcacaggacatcacgcccctcgaggtggccgaggcgttgtcagcactggctcagtcgaagggctggccgccgctcaccttctacggcacaccgcctcccgtcgcgctcaactgacaccgacgcggcagcgttcgcgctccccggaaccgtccatagccaaggaccaggtcgatcccgacgaatccaccggcggcgatagggaagccgacaccgcgccggtgcaggaggtccgtctcgacggcgatcaccaggccgaccacgggacctacctcagccggtctgctacgtcctgggcgccggcgactgggtccatgtacgcgatggaccgatccccgtgccggtgatccgtcgctccggccgccgtccccgtccggcggccgggggcctgtttcccccgtcgtgctggtcaggcgctgagcatcgggtgcgtctccagcagcgcctcgggtatggcgaaggcgcgggtgagggacagggcgtggggctccaggaagcagaggaccgcgtcgaccgcgtcgggcaggtgctcgacctgatcggccgtcacccgcccgcgtgccagcaggtctccgctgtgcgcggcgacccggcgcagggcgaacagggcgtgcagcccgcgcagcaggtccgccgggagtccggagggaacctgatcagcggcggtcagcagggactcggcggcgagccggtggacgtgggcgtcggccagcgcgacggcgggcgtcacggtcgcgttccagcgggcgagcggggatgcggcgcgctgccggagccgggctttcgcacgggtgtgggagatgcgctcgatgtcggccaggaggtcctggaggtgctgggggtcggtcagctcccggtccgcgggtgcgatctcgctctccggcttgaggtcgacgccaccgagcagcatctcgcccgcggccttctgcatgatgacctggttgtcgccctcggccgtgatcgtgccttcgatggaggcgagctgtaaagcgatgccgttggcctggatcaggccctgagctccgcaccgctcgcggcactcggtcatgaccgcgcgggcccgccaggtgatccaggccttgctgatcgccgtcagccgctcgtacgcctcacgttcctcaccggtggcccggtcccactgacgcacgaccgaccgctggagcagcgtggcggcgtaggtcgtcgcggcggcgtcgagcaggggggtgtggtggccgcgatgggcgatcagcggcacgcgctgtccgttggtcatgcccgaggtgacccgggtgtgggcgtaccgcatggcgacgtcgagagcgtgccgcatgacgccgaggctgtgggcggtcatacagagcttgcccatcgtgacccgtccgatggactggaggaaccgccggcgggggcttccgagcgagctggtgaactcgccgtccggggtgaggtggccgtggtcgctctggaggagagcgctgaacgggaggcgcacgttgtggaacgtcgtggcgcagtggtcgacggggctgctggccgtctggggcagcggccgcacctccacacccggcagcgggctgccgtcgctgtcgctgagcggtgtcaggaacaggaagacgccgtggtcggtgccgtcgacgatcagacgggcggcgacgacggcacccttcgcccctccggccgggctggtgttgggcatgaacttcgccgcggcgggcgttggggtgttgagcacgaacccgggcgccgcccggtcgaacgtcgctgtggtctccatatgcgcggcgtcattgccacgggcaacctcggtacagagaaacgtcccgatgcggtccgcgcggacgtactcgtccaggtcgcgcccggccggttcgtggtccaccaggcttccgaagaagaggttgtagtggatggcgacgatggtggccatgccggggtccaccgcaccggcccactcgtggacggcggtgagttcgaccggatcgttcgcgaggacctgcggagcctctacggtctcgttgaccagccggagccggtcgtagctcaggcctatgcgttcccggtgggtcagcccctcctggaagcggaacggggcggagctgaagaggtgtctccatcgagcgtgagtcgtgcccagctgaccagcgaacaggacgtcggcgagcgcggcggagacggaagcggaatccggaatctgagagtcagtcacaacccgaaaaactagcctgatcgatcatgcctgagggggtgatgatcaacacgattgagatgggtgaaaacacggtaggtgccagctccgtcactcgcttccccgtgccggtggccgggcgtgatcatggtcagggtgcgaaagggccgatccggctcggaacatggtcgcggccgctcgcagccgaacgggccgactggccgcgatcaccccagcggctacgacaaggtcgatgggtcgcacggcacgagaagagccgagaaggccgtcgggccagtcctctgatgacacgatgacttgctgggataaatgggggagtacgtgcgggccgacaagcggcggctgtactccttgcggctgtcctgctcggcagggccgtccaccgcgtcttcgcctcctgcggccaggaggtcctcttccagggccacgtcgacgcacgcgcggaccgtgggcgggggcccacgcgccaaggtccgttacgacaacctgacggcagccgtcgccggggtgctgggtcagtgccagggaaggttgaggccgccggtggatcgccttccgctcgcacttcgccctgccgtccgggaacgaccggtggagctgggaggacgacttctacgcgtgcgggcacctcgggttcacgttctggggttgggcggagctcacgtccgatttcatccgtgaggtcggcctcaggctgggcggccaccgcactgtgctgctcgccggaaggctgtagagcgcggaccggccgccgaccgggcattccgtcaaggacgagatgcccggcgcgcgggcacgggaaggggtggtcagctggtccagaggaccgggctgtcgcggtacgcgtcaccctcctcgaacgaggcagccgtgatgggctcggtcttcgtggcgctgagcgagcaggtctcgtaggacgcgcccttggtggtgaagtcgcggggtgccgattcgctgtcgcacttgcccgggaggtcgccgatcagaatgacacccgtggggccgccgccctccagcttgccgcgtagtttcagtgacgcgtacgacaggtcggtgccgccgacgttctccaccttcatccggatgtagtagggcgtcatgcccttggccttgtcgccgaaggaggccatgtcggcctcggcgcccttctcgattgccgtgacggtcacggcgatggtgcccttcttgtcggtcccgtacgtgaacggcaggaccgctcggtcaccgatcttgaccttcgtgcccggtgcggcggcatcaccggccggagcggcagcgtcgtcaccggtgtccgcggacgggctctcgctgctcgggtcgggcgacgccggggcggaggccgaaggcgattcctgtgtcgttgccgagtcctcgccgtcgttgcaggccgtgagcccgagtcccagggtggtgagggcaactgcgaagacgatgcgtcccttgtgtgtcattttttcctaaatagcaatgagggctgaccgtgtgacagccggaacgttcaacggggtgtcagtgaggcgcgctgagacgcccatatcaggctgaggtgggaatgacacaggctcgccacaggcacggcacaggtgcgcgacggcttcggcgcggctcggaggacgtgggaagtgccgcaccctccgggcccccggccccagttcccggcctccgcctacgccgccgcccgggcacgaaggtcaagatcggtgaccgagcggtcctgccgttcacgtacgggaccgacaagaagggcaccatcgccgtgaccgtcacggcaatcgagaaaggcgccgacgccgacatggcctcc

SEQ ID NO: 2869 - DNA, 6676 bp, Unknown
  Kingdom: Bacteria, Phylum: Actinobacteria, Class: Actinobacteria, Order: Streptomycetales, Family: Streptomycetaceae, Genus: Streptomyces
gtcctggacatcgtgcccaaccacatggcggccgccccccggtacaaccgccggctgtgggacgtgctgcgcgagggtccgtcctccccgtacgcacgctggttcgacatcgactgggcggcgggcgggaatcaggtactgctgccggtgctcgccgggccgctcggccaggagctggggcacctcaccgcggacgggtcggtgaacagtccgtcgatccggtgcagcgcgtcgtatccggtggtgcccgcgaccgcccagtccgccgggaggcgctcgtcgccggtgaggatcttctccaccaccgtccaacggccgccggtggcctcgctcagccgctccagataggcggcgggggcggcgaggccgtcgggatggtcgatgcgcagtccgtccagcaccccgtcgcggagcagttcgaggaccttggcgtgcgtggcgtcgaagacctccgggtgttcgacgcggaccccgatcagctccgacacggtgaagaaccgccggtagttcagctcggtgcgggccaggcgccaccagccgagccggtagtgctgggcgtccagcagctccggcagcgggagctgcgccgtgccggcgcgcagcgggaactccaggtcgtggtagcgcagcacctccccgtccgcggtgaggtgccccagctcctggccgagcggcccggcgagcaccggcagcagtacctgattcccgcccgccgcccagtcgatgtcgaaccagcgtgcgtacggggaggacggaccctcgcgcagcacgtcccacagccggcggttgtaccggggggcggccgccatgtggttgggcacgatgtccaggaccaggccgagcccgtgctcccgggcggccgaggcgagcgagcgcagcccctcctcgccgcccagctcggcccggacccggctgtggtcgaccacgtcgtagccgtgcggggagccggggaccgcctccaggacgggcgacaggtggaggtgcgagacgccgagcgcggcgaggtacggcaccgccttctcggcggcggcgaacgggaagtcgggctggagctgaagccggtacgtggcggtgggcgtcatggactcctacgtaccccgcccgggacgatccgtgtcaccccgggcggaacactcactccccgtacttctccccgcccacccttcaggcgggccgcttcagcacggtcaggctgcgcccgatcagcgtgatccgctcgccctcggcgaccttgggtcccgtccccggctccaccccgtccggccgcgcggtgtcgacgacgacctgccactgctccccgtggtccaccgggacggcgaactccagggtctcggcgctcgcgttgaacatcagcaggaacgagtcgtcggagatccgctcgccgcgcggccccggctccgagatcgcgtgcccgttcaggaacacggtcatcgccttggcatgggccgcctgccagtcctgctgggtcatctcctcgccctccggggtgaaccaggcgatgtcggagagctcgtcgtgggttccttccaccggccgtccgtggaagaagcggcgccgccggaagacggggtggtcgcggcgcagccacaccatggcccgggtgaactccagcagcgtcgaggcgggggtgtccgccttctcgtccgggtcgggccagtgcacccaggccagctcgttgtcctggcagtaggcgttgttgttgccgtgctgcgtacgggcgaactcgtcgccgtggctcagcatcggcacgccctgcgagagcatcagcgtggcgatgaagttccgcatctggcgggcccgcagctccaggacctccgggtcgtcggtctcgccctcggcgccgcagttccaggaccggttgtggctctcgccgtcccggttgtcctccccgttggcgtcgttgcgcttgtcgttgtacgagacgaggtcgtgcagggtgaagccgtcgtggcaggtggtgaagttgatcgaggcgagcgggcggcggccgtcgtcctgatagaggtcggaggagccggtgagccgtccggcgaactccgccagggtgcgcggctcaccccgccacagatcgcggaccgtgtcgcggtacttgccgttccactcggtccacagcggcgggaagttgcccacctggtaaccgccctcgccgacgtcccacggttcggcgatcagcttcacctggctgaccaccgggtcctgctgcaccaggtcgaagaacgaggagagccggtccacctcgtggaactgccgggcgagcgtcgccgcgaggtcgaagcggaagccgtccacatgcatctcggtcacccagtaccgcagcgagtccatgatcatctggaggacgtgcggggaccgcatgagcagggagttcccggtgcccgtggtgtccatgtagtagcgctggtcgtcggtgagccggtagtaagaggcgttgtcgagaccgcggaaggagagcgtcgggccgaggtggttgccctcggccgtgtggttgtagaccacgtcgaggatgacctcgatgcccgcctggtggagcgccttcaccgcctgcttgaactccagcacctgttcgccgcggtcgccccaggaggcgtaggtgttgtgcggggcgaagaagccgatggtgttgtaaccccagtagttggcgagccccatgtccgacagtcggtggtcctgcacgaactggtgaacgggcatcagctcgatcgcggtgacgcccagttcggtcagatgggcgatcacctccggatgcgcgaggcccgcgtacgtgccgcgcagctcgggcgggaggcccgggtgcagcatcgtcaggcccttcacatgggcctcgtagatcaccgtgcggtggtagtccgtccgggggcggcgatcgtcgccccagtcgaagtacgggttgaccaccaccgagctcatggtgtgcggggccgagtcgaggtcgttgcgggcgtccggcctgccgaacggatagccgtacacctcctcaccccactggatcttcccggccaccgcacgggcgtacgggtccagcagcagtttcgcggagttgcaccgctgcccgcgctggggctcgtaggggccgtgcacccggaagccgtaccgctgacccggcatcaccccgggcaggtaggcgtggcgtacgaaggcgtcggtctcgcggagctccaccgccgtctccgaaccgtcgtcgtgcaacaggcacagctcgatccggtgggcggcctcggagaagaccgcgaagttggtgccggcgccgtcgtacgtggcgccgagggggtaagcgtgtcccggccagacctgcatgatgaagactcttccacttctgatccgggttcggtggctttcctcggcccgatactcctcgaatacctcccgaatactccccgaagacagagctctcgcctaggacgtcgcgcggtgcggccgggtctcgtcgccccgcgccgggccgcaccggtcaacttcggacactcccgtgccgccccggacgtgcttccggaccccgtcacccggcgggcgtccggttcccgccccgggacagagggcctaatcactatgaatcagctcactccacccgatctcaccacaaggaacaagccttacgtgcaggggagttgagaaagtcgcctgcgcatcgggctgcgtcggatcgtgctcccggagtacccttccttgatcgttgggtgggggagtggaaggcggtacacgggtgagctcgggagggttcgagctgcccccaggtgacgcgggtcacgagggggaatcgaccgatgccccgcccggggcggtgtccctcgcgcagcccatggagatcggcgccgagctggactggggttccgaggcctggaacgaggtgcggacccgcgcccagcgggccggacgcgcctatatctggctgaatctggtcgaacagcgcctgcgggccgtcgtcgccgcggtactccgtccgatctacgagccggtgcacggcgaggagtgggtggtggccgcggccggaccggccgggcaggagtgggtgcagcgcgccgtcgccgtacgcgaggtctcgcgccgcaagggctatctgctggatcccgccgacgacaacgtcctcagcttcctgacgctgccgcagctccgtgagctgatggtccagcactggccctgtttcgagccgtacttcgacgaccggcgcgacgtcgagctggccctggacgagctggaggtcgcgcgcaacgtcgtctcccgcaaccgcgcgctgaacgaagcggtcctcgcccaggcggaacgcgcctccgcccggctcctggacatcctcggcagtggggcgggggtgccctcggcggaccggctgccggtggacgcggtggaggagctggtcggcgaccggtacgcggacgtggtctccgtccaccccgaccgggtccggctccagcgccaactgcccgccgaggacctgttcggcggggcgcggcggctggacgccatcggcatagggctcaacctgctcgtgcagaacttctccggccgccggctcgtccggctcgccgaatcgggctgccgggtccggctgctgttcatcaacccggccagcagcgcggtgcgccgccgggagcgggaactcggcctcaagaagggcgagctgagccgttcggtggagatgaacatcctgcacatgcgccgggtgcgctccaagctccgcgacccgggtgcgttcgagatccaggtcttcgacgagaccccgcgcttcaccgcctacctggtggacggcgacggaccggacgccgtgggcgtcgtccagccctatctgcggcgggcccgcggcatggaggcgcccgtgctggtgctgcgcggagggggccggcgcacggtggtgcgggcgggccaggacagcgagcacggcctcttcgagacgtaccgcgaggagttcgaatcggtctggacggactcccggccggtctcctgacggtccccgccgcagtccttccggcgggccgtgcgccgcaggcctcctggggctctgtcagtggcccgtgcgaaggtggtcatcactcggggggagcaccacgggggagcaccacgaaggaggaatcgggatgagctggcaccggggaacactggtcggcttcgacctggagacgacggggaccgacgtcgagaacgaccggatcgtcaccgccgcactggtccggctggacgcggaggggacggtcgccgaccagcggacctggctgctcgacccgggggtggcgataccggaacaggcctccgcgatccacggcatcggcaccgaccacgcccgcacgcacggggcacgggccgtcctggcggtcgaggagatcgcccacgcggtcgcggaggtgctccgctccggcgtcccgctggtggtgatgaacgcgcgctacgacctctcgctgctggaccgcgaatgccgcaggcacgggctgccgtcggtcgacgagcgggtcggcggtgcgccctcgcccgtcatcgacccgctggtgatcgacaagcacgtcgacaagtaccgcaagggcaagcgggccctccaggcactgtgcgaccactacggggtcaccctcgacggagcccacgaggcgagcgccgacgcggtggccgccgtgcgcgtggtgcgccggatgggagagcggcaccggcccgtcggcaccctgccgcccgccgaactgcacgcccttcagatccgggcggccgccgagcagtcggcgtccctccaggcctatctgcgccgctcggacccggcggccgtggtcgaggcgtcctggccggtgatcccgcgcagccgctgagccgggcgacggtcgccgacgtctggagccgcggaggattcccgacgcgggtgactccccagctctcctcgaccgcacctcggggacgtcctcggccagccgcctccggatccggatggcgtgcgtcaacgccgtcccgaccccggggcgctcggtaccggtcagcatgtcggggaatcgtatgaggtgaccctgcgcgggggtcgttcagaaggggtaccagcggacctcgggatccccctcgcgcagcgaggcgacccggcggcggaattcggcgagcgccttcgggttggccggggcgtgctgggagacccaggcacagctggccgtctcccgggcgccgcgcagcaccgcgcacccctcccactcccggacgtcccagccgtacgcggaggtgaaggcgtcgtaggccgcgaggtcgaggccgtagcggtcgcgggagagagcgagaacgaccaggtcgtgttcgcgcagatcggcggagaacgtctccaggtcgaccaggaccgggccgtcgggaccgacgtggacgttgcgcgggagcgcgtcgccgtggatcggaccaggcggcagatgcgggacgagcgcggcggcggcggcctcgaagccgtcgcggcgctcgcggaggtagtcggcgtccgccgggtcgatcgcggctcccgccagactcagccagcgctccacgccgcccagcagttcgcggcgcggcagggtgaagtccgccgggacgggcagcgcgtgcaccagggagagcagtggtgcgaggtcgcgcggctcggcggggcgtacggggtcgggaagccggtgccacagcgtcacggggtggccctcgaccaggcggggtccgcgctcggccgcgcggacggccgggaccccggacgcggcgagccagtcggcga

SEQ ID NO: 2870 - DNA, 5389 bp, Unknown
  Kingdom: Bacteria, Phylum: Actinobacteria, Class: Actinobacteria, Order: Streptomycetales, Family: Streptomycetaceae, Genus: Streptomyces
ggaccgagatcggcaggctgaccagcctgccgatctcggtccgttgcgcggcggtgatccggcggacctccgccggccagggacgcgtcgtcggcgcgacgacgccgatcagggccagcaactctcccggggtcgggcggtcctcctcgttcttggacagacacggggcgatgatctcgtgcagttccggcgggagggtgctcaggtcgggttcggagtgcgcgaccttgtagaggatcccgggcaccgagtcggcggggaacggcggcagtccggtgcaggccgtgaacagggtggcaccgagcgagaagacgtcactcgcgggcgtcggcgcgcgcccgtgcacctgttccggcgacatgaacggcggtgaacccagcaccgctccggcgtgggtgagcgcggtctgaccctcggtcgcccgtgcgatgccgaagtcgatgacccgtacgccgtcctcggcgagcagcacgttcgacggcttgaggtcgcggtggatcagcccggcgcggtggatgtcggccagtgcctgcgccagtcccgcggccaactgccgtacggacgggacgggcagggcccgcaccgcctccagcgcctggctcagcgagggacccggtacgaaggccgaggccagccaggggacggctgcatcggcatcggcgtcgaggaccggcgcggtgtaggcgccggacactcggcgggaggcggccacttcgcgccggaaccgggcgcggaacccgtcgtcctcggccaggtcggcgtgcacctgcttgacggcgaccagccgtccgtccggcgagacaccgagaaggacccggcccatcccgccctcgccgagcaccgcgaccgttctgaacggccccgtcctctgcggttccagcaactccgaaaaactcatggtcgaacagcccccgatcgcggtcaggatagtacgaccgcttgatcccgccccgcgtcgacggcgagctgcccacgaggccgcacacgacgtccaccactcccgtcacctgccggcaccgccggccacggaaaagcaccgatcgctctacagcccccgttccggccccccgagcgagctcgagaggtgaacacgcaggagttccgcgacttcgggagcggcctgctccggaatccagtgcccgattccggtcagggtgtggaaggtgtacgggccggtcacgtacctgtgtgcgtgttcggcgctcgtccggtccagggccgggtcgttgtcgctgttgacgaacagggtcgggacagtgacctcggccagctggccgggtgtgctgaagggcatcgcccggtaccagttgagggcaggggtgagagcgcccgaggacaccaggaactccaggtcccgggcgaggcgggccgccgtctgcccggcggccatgcgctcggtgacgcgcggtgccgcgacggagttgaggcggcgtatcagcttctccgggatccagggcagttggaagacgtacatgtaccaggacagcatgaactggcggctggtgaagagagcccgcatgaaggcggcggggtgcgggacggagagcgcggtcagggtggccaccgcgtccggccgggccgcggccagcgtccaggcgaccgcggcgccccagtcgtgcccgacgacatgcaccttgtggccgctgggcccggcggcctcgatgagggcgacgacatccttggtgagttgggacatgcggtacgagaacctgccgcgcggccgggcccggggtgagtaacctcgctggtcgggtgccagagtgcggtatcccgacgcgtgcagcagcggtgcgagcaggtcccagcagctcgccctctggggaaacccgtgcagaagcacgacgacctcgccgtcgagcggcccccggtccacgacgtcgaagaccagaccgtcgcgtccgaacgaggtgagtcgcccggcggcgttgcgccgggccgtcacgcgtggacccactggccgtggaaggtgaagccgaggctttcggggacggggagggtgcagacggggccgtcggcgacggattgtgcgtcgaagacgacgatgttcgtggtgcccgcggtgagttgggcctcgtaggcgatgagccagccctgttcgtcgagctgcttgaggtcgcgggggacgaagagcggctcgctgacgagatgaccggggccgtagtcgtggacgtcggcgtcgccgagttcggtgtcgtagcgtgcgaccgctgtgaacgcgacgcccgacgcgggggtgccgacggtcgcgccgtagacgttgcggtgggcggtgccggagcggcgtgggtcgatggtgggccactccatgggctgtgcgttgagctggtggtcctcgaccttgccggatgcggtgacgcggtagcgccagagccggccgaccgggaagcacgacggatcggtgaggtgactcatgctggagatggcctcgtgcatgacggtccaggaccggaagcggaccagatcgaagacgatgtcgtcgccgtcgtcgtacgcgccggcgaagtgccactggaaccacggatccgcctcgacgacacggaacgggccaccggcgcggggaacgagcaggatgcgggtggcctcctcaccgtgccagcgcatcgcctcgaaggcggggacccggccggacgcgacggcgggcaggtcgaggatgacggggccgaggcagaacaccagatgggtggcggtcatcgcgaagtcgtggaccatgtagcggcggggcagcgcgatggaacgctgcttctcggtcggtccgccctgctcggtccggtagatgtccagccggggtcgtgggccgtagacgcagccgaagttccatgtctcggcggtccgggggtcccggcacgggtgcgccgagtacgggctgccgagacggcggccgaggagacccgacggtgccagtgcgcggtcgaggtcgcagcggccgagggtctccagggtgccgggctccaactcccagggcatgtcgccctcccagagcgccaacagccggccgtcgatcatcgccaccgaggtactggcctgggaggcggccgggcgcagcaggaggttgcggagccgaccgcccgcggcgttggccccggccagccggaccggaggcgcgtctgccccgggtgctttcacggaagcccggtaggagggggtccggacatagcgggagcggacgcgcacgggactgcccggggtgaacgtcacggcactgaccaggccgtcgccgtcgatgacgtagtccgacagatggttgcccgccccgttccggtagagggtgccggccaggcctggagggacggccccctggctggggtgcagttcggcgtcggcctctcgggcccagccgccgcgacgcaagtccatgaacgctcccatgtaatcagcgaatacatgcatgtaatcgctgattacatgggcccttcggggtacgtgtcaaggtgtggtacgactggctgtatgagcacccgggtggccgaccggccctatcaccacggatccttgccggaggcgctggtcgcgtacgccgtccaactgctggacgaggcgggcgccgaggcggtgaccgtccgtgaggtggcccgcagggcaggtgtttcccccggggccccgttcaggcatttccccgaccgggcggccttgctggccgcggtcgccgaggcggtcgcggtggacttcggcgtggcccagacggaagcggtcgcctcggccgcgtccgtcccgttccgggctctgggcaccgcgttcgtgcggtacgcgttggctcacccgcaccggctcgcgctcctgcgcggcgctctcttcggcgcggagcgaacgcccgccctggaggagggacatcgcgccttcacccagagcgtcatcgatctgatcgtcgccgggcagcagcgtggcgaactgcggcaggccgatccggagttgatcagaatcgccgctcaagcgctggcctacgggctctcgcagatgttcgtcgacggctacctcgacgccgcacgggccgacacgctgatcaaccaggtcgttgacctgttcggcctgggagtcctcgcgcccgggagcgatcggcgcgaagcggactgaacgcggcacgggccagcacggtagcgaaccacgaaccgagagggcgtccctgtggataacgttatccacaggggtcgcgggacagggcgggctgcgggaccgtcaaggcatgaacaagcaccacgaatccaccggccaggccggggagcagcagatcaccttgcgcggtcccgccgagctggccgacgccctcccgtatctcatgggcttctatcccaacgacagtgtcgtgatggtcgccctgcacggcggccggggccggttcggcggccggctccgcctcggaattccgcaggcccccggcgaatgggggccggtcgccgatcagttggcggagtgcctggtatcggggagcgagcgccgtgagggacggcccgacgcgatcgtgatcttcctctgccaggactcttcggacgtgacgggtggccggctggccatggagcggctccggcctttcgcgcaacgcctgcgcacggcgtgcggagcactcgacgtccccgtcctcgaagcgctctgcatctccgacggccgttactggtcctactgttgccccgacacccgatgctgccccgaccagggaaatccgctggccatgcccggcaccacggtgatggccgcggccgccgcctacgcgggcgttcatgtgcgaggcacgctgcgcgacatggaagcgcggctccagccctggcggaccccggcggccgtgaccgcgcaggaggaggccctggacagggccggaccggctcttgtcccgaggctcctcgacgagcgggccaggagcgaggtcgcggcggagaccctccggttggcgcgcacgctcatggaccgcatcgaggggacgcagcccgctccgcccgcgctctcggacgccggggacgaccagttgatcagctccgacgaggccgcggccgtcatcctcggactccaggaccgggagacccgggacaaggccgccgcctggatggagggcgcggaagcacaagcggccctgcggttgtggcggacgctggcacggcgttgcgtcgggccgtacggggaacacgccgccgctccgctcaccctggcggggtgggtctcctggtccacgggcgacgagccgggcgcgcgggtcgccctggccctggcgctgcgtgccgatcccggctacacgttcgcccagctgctgcatcgggcctgcaacgaagggctcgatccggaggccctgcgccgttgcttgcgcgagtccgcggacgaggggacgagtcccggcacccgggccgtggaggcggtgatggacaccgccgccgaccggggcgccccctcgctgcgcgtccgcagggtc

SEQ ID NO: 2871 - DNA, 10976 bp, Unknown
  Kingdom: Bacteria, Phylum: Actinobacteria, Class: Actinobacteria, Order: Streptomycetales, Family: Streptomycetaceae, Genus: Streptomyces
gcccggacggggtggcggggaccaatttcgccctgtgggcgggcggggccgagtcggtcgagctctgcctgttcgacgagcggggcacggagacccgctgcccgctgaccgagctgacccatgagatctggcacggcttcgtgcccggggtgcggcccggtcagcgttacggctaccgggtgcacggccgctgggacccgtggacgggggcccgctggaacgcggcgaagctgctgctggacccgtacgcccgtgcggtcgacgggaccttcaccctgccgcccgaggtctacggacacgtacgggactggccggaccagcatgtggccgacaccgtgcgggacgaccgggactcggcgcccttcgtgcccaagggggtggtcgtccgcgacgacgacgactgggtcgaggaccgccgtcccaagaccccgtgggcggactccgtgatctacgagctgcacgtgcggggcttcaccaagctgcacccggacatcccgcccgagctgcgcggcacgtacgcggggctcgcgcacccggccgcgatcgagcacctgacgcggctcggggtgactgccgtcgaactgctcccggtgcaccagttcgcccacgaggaccatctgctgcgacgcggactgcgcaaccactggggatacaactccatcggctacttcgccccgcacgccggctactccgcctccgggacggcgggccagcaggtcggcgagttcaagcggatggtgcacgcgctgcacgaggccgggatcgaggtgatcctcgacgtcgtctacaaccacaccgcggaggcgggcgagctgggcccgatgctgtcgctgcgcggcatcgacaaccggggctactaccgcctgagggacgacccgcgccgctacgccgactacacgggctgcggcaacacgctgcacgtggtgcaaccccaggtgctgcggctcatcaccgactcgctgcgctactgggtcaccgagatgggggtggacggtttccgcttcgacctggcggcggcgctggcccgctcgatgcacgacgtcgacatgctctccccgttcctcgcggtgatcggacaggacccggtgctgcgccgggtcaagctcatcgccgagccgtgggacgtcggcaacggcggctaccaggtgggagccttccctcccctgtggaccgagtggaacgaccgctaccgcgacgcggtgcgcgacttctggcgcggcgcgctccccgacgtacgggatctcggctaccggctgaccggctccagcgacctgtacgcctggggcggccgccgtccgtacgcctcggtcaacttcgtcaccgcgcacgacggcttcaccctgcgcgacctggtcagctacgagcagaagcacaacgaggccaacggggagggcaaccgggacggaacgagcgacaaccgggcctggaactgcggggcggagggcgagagcgacgacccggagatcaacgcgctgcgccgccgccagctccgcaatctgctgaccaccctgctgctgtccaccggggtgccgatgctggtggcgggcgacgagatgggccggacgcagggcggcaacaacaacgcctactgccaggacaacgagaccggctggctggactggtcgctcctgcgggagcccgcatggcgggagctgaccgagctgacggcccgggtgctgacgctgcgccggacccatccggtgctgcggcgccgcgcgttcttctccggccgggcacaggccccggacggactgcgggacctggcgtggttcgcccgggacggccgggagatgacggagggcgactggtacgcccccgccgccacgctcggcctctacctctccgggcgggacatcccggggcgggacgcgcggggcgagccggtcaccgacgacagcttcctggcggtcctgcacgcgggcgcggagccgacgtccttcgccctgccgggagcaccgtgggcggcccgctacgaactggtcctggacacctcgcgggaggagcagaccgaggctcccggcaccgtcctggacggcggtacggagatgacggtgccggcccggtcggtgctgctgctgcgggtggcggactgaggaggggacgtacgggtcagccgaggatgccccggtcgtagccgacggcgacggccgcggcccggtccttggcgcccagcttggcgaagacgtgggtgaggtgggtcttcacggtcgcctcgctgatgaacagttcggcggcgatctcccggttggtggtaccccgcgccaccaggaccagcacctcgcgctcgcgggccgacagggaggtctcggcggggccggcggccggggtgcggacccgggtcatcagccgggaggcgacggcgggcgacaggacgccgcgcccgtcggcggcggcccggacggccgcgaacagctcctcgcgcggagcgtccttgaggaggtagccggtcgcgcccgcctcgatcgcgggcagggtgtcggagtcggtgtcgtacgtggtcagcaccaggaccttcgagcgcgcgccgccccgggtcagctccgcgatggcctccactcccccgccgccgggcatccgcaggtccatcaggacgacgtcggggtcgaggcgttcgacggccgagagggcgtccacgccgttcgacgcctcgccgaggacgtcgaatccgggggcggcggcgaacatgccccgcagtccgtcccggacgaccgggtggtcgtcgacgacgacgaggctgatggcgcgggcggcggtctcggtcatgacggcaccgtacggcggcccggggccgcctgaccaggggccaccgcggtgctgttcacggggcgcctgaccagggggaccctggccgataccgccgtgccgccgcccggttccgactccacctcgaccgcgcccgcgatgcgctccgcgcgggcccgcataccgccgaggccgaagcctccggtgcggccggccggggcggcggtcgcggggtcgaagccgcggccgtcgtcccgtacgtccagggtcagttcgtcgtccatgaaggacagcgtcaccccgacccgcgaggccccggagtggcgcccggcgttggcgagggcctcgcccgcgatgcgcagcagggtggcggcgatctcgtcgtggaccggttcgacggtgccggtgacggtgaagtcggcccggacgctgtgctgttcggcccagtcgctgaccgtcttcccgagcgccccggccagttcgtcgtgctccagggcgacgggggccaggttgtgcacggagcggcgggcctccccgaggctgtggcgggcgagcgcggcggcccgctccagatggaggcgggcggtctccggatcgcggtccgtgacggaggtgacgacctggagctgggcgatgatcccggtgaggccctgggcgagggtgtcgtggatctcggcggcgagccgccgccgctcgtcgtcgaccccggcctcgcgggcctggacgaggagttgggcgtgcagggccgcgttctccgccatggcctcctccaggcggaggttggtgcgctccagctcggcgatggtctcggcctggatccgggccttctcctcctcgcgggccccgatgttggcgaagaactcgaccagggaggcgttgaggacgaacagcgcgccgaaggcgaaccactgcatcggggaggcgggtggcagcccgccgctctgggaaccggcgagcgtgacggcgttggccagcagcccggtccggacgaggcgcttgggaagcagcgggtcggcgtcgaagtagccgaggctggcgtagatcgcgaagaacgggttgagcaggcagagggtgaaggtgagaacggtccgcagggcgtagtaggccatcccggccggggcccccggcacggtacgggggcgagcccggccccaccagagctggagcgcgtacgccgccgcgaccagggccccggccgcgtacatctcggtacgggtcatcagcaggtcggcggcgacgcccgcgacgagagcggccagggtgaggacggcgtagggcccgtaccggtggaactgctcccagcgctgctcgaccgagtgcggacccgccgcgccggacgggagcgaggagcgggatggctgcgtcattccggaagtttccgccactgccaccggaagagtcgagcggccgcgatgcccagagccgcggtccacagggcgaggaccacgaggtggatccagtccggccagctcccggacgctgcctgctccagcgcctgggaggcggccccgaacggggtgatctccacgatgcggcgcagggcgtcgggcatcgcctggacgggcagccagaccccggcgctgaacatcatcacgaggtaggcgcccgagccgaccgcggtggccgccttcgtcgtccgggacagggcgcagatcgtggcgcccagggtcagcgcggcggtgacggcgagcagcagcgccagcagatagccggggaagtgttcgggcagcgggacaccgtaggcgatccgcccgacggcggtgaccaggagcgcggagccgatcgcggccgcgccgtgcagcaggatctgggcggcgagcagggcggagggccgcaccggggtggcggacatccggcgcaggatgccgcgctcgcgataggcggtgaggaccggcggcatcgcctggatccctgccgtgatcatggcgagcaggatcgagatggggacgtacaggtcgatgacgcgccgtccgccgaggtcgtcccgcacctccttgaaggcggggacgaagccgaggatcaccagaaggacggaggggaagacgaagacccagaacaggctgcccggttcacggaggaagagccgggtctcggccgtcaggacggctgccgcgggaccgcgtcgccgggtggcgcggagcgccgggtcggtggcgggtgcggtggtggtctcggtccgcatctcaggcgtcctgtccggtgaggtcgaggaaggcttcgtcgaggctggtctcggtgatgcgcagccgccgggcggtgacgccgagttcggcgagcagggcgacgaacggggtgaccgtctcgtcggtgccgtgcagcgtgagcgttcccccgcggtccggcggggtcacggacgcgacaccgggtagcgcggtgagccgggtgaggtcggggccggtgagcggcctggagggcgcgaaggagacgacggtggagccggtcgcccgtcggatcagccccgccggggtgtccagggcgacgaccttgccccggtcgatgacggcgatccggtcgcagaggcgctgggcctcctccatgaagtgggtgacgagcaggacggtcaccccgccgtcgcggatctcctcgatgagcttccaggtgtcgcggcgggcgcgcgggtcgaggccggtggtcagttcgtcgaggacgacgaccttcgggtcgctgatcagcgcgagggcgatgaacaggcgctgcttctggccgccggagagcccgccgaagcgggtggtgagcttctcgtcgaggccgagccgggcggcgagcgggcgccactcgacgggagccgggtagaacgcgctgtacagctccagcgcctcccgtacggtcagtttggcctggagttcgctctcctggagctgggcgccgagcagccgcgtcacccgttcgtggtcggcgacggggtcgagcccggcgaccctgatggtccccgcgtcggggatgcgcaggccctccacgcattcgacggtggtggtcttgcccgccccgttgggtccgaggatgccgaagatctccccctcgtccacggagaaggagacgccgtcgaccacggcacggcccgcgtaggtcttgcgtacgccgttgacttcgatgatggccatgtccaccagggttccggcgggcgggcgcggccggtatccgccgtcacgctcgacagcgcatcggccgatcggttgacccggggtacgaccgccgccggtggagcgtccggcccggcggaaattggcaggaccgatgtcagtggtgaaacgtagggtcgcccctgatgcccaaaaagcctgcagagcgcacggaccggtccgccgtgcgctccctcctgcgcctgtggccctatgtccgacccgtgcgaatgcgcctgttcatggccgccttcgtggcgatcctggcgtcctgcctgggactggtgatccccctggtcctgaagtggatggtggacggtcccgtcgccggccgcgatccgggcggggtgtggctgggagcgctgtatctgctgctgctgggcatcgccgaggcgctgctgttcggcctccggcgctggctggtggcgcgtccgctggccggggtcgaggcctcgatgcgggcggatctctaccgccatctgcaacggctgccggtcgcgttccacgaccgctgggcctcgggtcagctgctgtcgcgcgggacgacggacctgatgctgctgcggatgttcctggcgttcccgctgaccttcctggtcgtcaacacggccacgatcctggtcgggttcatcatcctgttcgcccaggactggacgctcggtctggtgctgctggcgcccgcggtgccgctggtgatcctgtgctcgctcttcgagacgaagtactcggtggtcgcgcgccgggcccaggaccaggtcggcgacctcaccacggtcgtcgaggagagcgtgctcggcatccgcatcatcaagggcttcggccggcaccgcagccaggcgcaggcgttccgggcgctgtcgcaccggctgcgcaccacggagctgggcaaggcccggctgctcgccgggatctgggcgctgatcaccgcgatcccggagctggcgatcggcgcggcgctggtgctgggcacgatccaggtggcggacggcgcactgtccgcgggcacgctggtggcgttcctgtccacggcgctcgccctgcgctggccggtggagtcgatcggcttcctgctggcgatgagccaggagtcggcgaccgcgaccgaccggtatttcgaggtgatggacgtggcggaggagcccggcgccgcgccggtccgcgagggcgcgccggccaccggcccggggatggtgttcgaaggcgtcgagttccgctacccggacgcggatccgggctcgcctccggtcctcgccgggatcgatctgcacatccggcccggtgagacgctggccctggtcgggggtacggggtcgggcaagacgacgctcaccgctctggttccccggctgcacgaggtgaccggcgggcggatcacgctggacggcgaggacatcgccacgatggagcgctcgcggctgcgggagctggtctcggtggcgttcgaggagccgacgctgttctccgcgacggtcggcgagaacgtgacgatgggcgcggcggacgcggacgagaagcaggtgcgccgggcgttgtcggtggcccaggccgacttcgtgcacgagctcccccgggggctggacaccgaggtcggcgagcagggcctgagtctgtccggcggccagcgtcaacgcctcgcgctggcccgcgccgtggtcggggagccgcgcttcctggtgctggacgacccgctctccgcgctggacgtgcacacggagacgctggtggaggccgcgctgcggcaggtcctggagcggacgaccgcggtggtcgtggcgcaccgtccctctaccgtgatgctggccgaccgggtggcgctgctgtccggcggccggatcgccgcggtcggcacccatcaggagctgctgcgcgacaacgcggagtacgcctggctgatgtcgggcgccgggaacgatcccgccggaccggtggacgcgtttgccggaccccctccggccggaccggtggacgagccggccgcgccggtggacgagcccgccggaccgcaccccgccacttcggtgagcacccccgtagagcaggtccccgccgaggagggcagtgcccgatgaccacgaccaccgacgacgcgtcgctcccggccgccgacgacgacggcccggcgaagagccggaccgcgcctgcactcgggcgcgccgacgacccgttcgaccgggacgacctgcccgcgccgcccggagcgaccagggccctgctgttctcgctgctggccccgatgcgcggccgggtcgcggtgtctgccctgctgctgctggtccagcaggtcgcgatgcaggcgggcccgctgctggtggcgtacgcgatcgacagcggggttccggcgttccgtgaccacgactacgggccgctgttggcggtcgcgatcggttacgcggtgtgttccgtcggcgcgggcgtcctccagtacgccttcatccgggccgccgcgcggatcaaccaggacgtgctgctcgatctgcgcggccggatcttccggcacgcgcaggcgctcagcgtcgacttccacgagcgctacacctcgggccggctgatctcccgctccacgacggatgtggagtcgttgcgggagctgttgagcgaagggctccaggaactgatcggcgtggccctgtcgttcgtgtcgatcgcgttggtgctgctctggctggacctggggatcggcgcgatcgccacgctctccttcgtaccgctgtatctgatggtccggacgtaccggcggcgggcttccgtcgcgttcacggcgcggtcgacggcgatcgcggcggtgatcgtgaagttcgcggagacgatgaacggcatccgtccggtccaggcgttccgccgcgagcggagcaacgacaccgtcttcaccacgctgaacacccgccacgagcgggcgaacggcgacgcgatcctggagatggcccgctatgtcatcggctcgcggctgatcgcgaacacggcggtggccgggatggtgctgtggggcgcctaccgggtggcggacggaacgctggcgctcggcgtgctggcggcggccgtgctgtatctgcgccggctgtacgacccgatcgaccggctggggatgttcctcaactcctacgagtcggcggccgcttcgctgacgaagatcgccggactgctggcccagacgccgaacgtcccggagaccgaccggccgaaggaactgccgccgcgctcgggcgaactcccgggccgggaggtcacgttcgacggggtgcggttcgcctaccgtacgggcggcgaggtgctgccgacgttcgacctgcacatcccggcgggccggacggtggcggtcgtcggctcgacgggcgcgggcaagtcgacgctggccaagctgctggcccgcttctacgacccgaccgagggccgggtcctgctggacggcaccgacctgcgcgacctggacaccgcggagctgcgccggggcgtggtgatggtgacgcaggaggcgttcctgttctccgggacggtcgcggagaacatcgcgatcggccgcccggacgccacccgcgaggagatcgagcacgccgcgaaggcgatcggcgcgcacgacttcatcgcggccctgccggacggctacgacacggacgtacgcaagcggggcgggcgcatctcggcgggtcagcggcagttggtggcgttcgcccgggccctgctggcgaacccggcggtgctgatcctggacgaggcgaccagttccctggacgtccccggtgagcgggccgtgcagcgggccatggacacggtgctgcacggccgcacggcggtggtgatcgcccaccggctctccacggtggagatcgcggaccgggtgctggtgatggagcacggccgcatcgtggaggacggcgcgcccgccgaactgatcggcgggacggggcggttcgcggggctgcaccggacgtggaaggacagcctggcctgagcggatccggccggggatcacctccttggccctccgtacgacacctccgcccgggtgtggccgttgtgccgcgcgtaacgactcctacgcgaaggcaggacccactcggatgaccaccacccgtaccgtcacccggagcgcgatcacggccgccctggccaccgcgctctccatcggcatcacctccaccgccgtggcctcccccgccggaccggacagggccggcgcctcccggaccgctgccgcccagcagccgggggaggggtggaccggggagggcgggctctccctcgggccggccgacaacgagcgggtcgacgactacgtcgaggacgcccggcgggccgagcgggccatcagtcctcaggtgcgggccgcggccttgatcgccggcgccgaggtgatcggcttcgagaaccggctgaagtccccggactccctcaagcggaaggtcgccacctcgctcaaggaacaccccgaacagagcgccgaggccgccctcgccgctctcggtgacgcggtgcgctacacccttcagtggcccgacggccagtacacggacggcgtcacgaccgccgcgcggacgctctccgcctggggcaacgacagcacgaagtggtccaacacctggggtcgcgcccaggggtacaaggggctcaacaccggctggcgcgccccccgttcggggcagctcttcgaggttcagttccatacccccgccagcaagggtgcccaggaagccacccacaagctctatgaggagcagcgccttcccggcaccggccccgagcggaagaaggaactgcaggaacagcagaacgccctcttcgccgccgttcccgtgccgacgggagcggaccggctgaccgcgccgctcccggcccgggtccccgtacccctggggtagcggcgcccccgggcacgacccgggcgggtcggtctcggcacggcggcttcgccagggccgtgtcgaggccgaccccgtgcgtccgcaccaccaccgccgtcgaccggtggttgcgcagcccgaggcagggagcgggcatggcccgggccgtggcacgggccgggcctttctcggcgtcggtgtgcgggtcgatggacacgcacccggtcgcggcggagatccggctcgtcgccgacaggaccgacgaagccgtgagcaggtc

SEQ ID NO: 2872 - DNA, 2270 bp, Unknown
  Kingdom: Bacteria, Phylum: Actinobacteria, Class: Actinobacteria, Order: Streptomycetales, Family: Streptomycetaceae, Genus: Streptomyces
ccgtccgccgcccgggcggccaccagcagcccgcgccgcttcagccgggagacgcaggagcgtacggaaggggcgtcgacgccgacggcgtgcagcaggcgaatcagctccgagaccgcgaacggtgcgccgtccggcgggcggccgtaggcgccgtagagcgtgacgatcagggaacggggggtgcgcaactcggccacgtgatcactctaggggtgctggtcccgcagcaggaaccgctggagtttgccggtcgccgtccgtggcagggactcctggaagacgaagacccgcgggcacttgtgcggggccaggtcggccttcatatgggcgcgcagcgagtccgccgtctgctccgagccgttccgcagcaccacgtgcgccaccacgatctcgccgcgcagttcgtccgcccggcccaccacggcggcctccgcgacctccggatggcgcagcagggcgtcctccacctcgggacccgcgatgttgtagccggaggagatgatcatgtcgtcggcgcgggccacgtagcggaagtagccgtccggttcgcggacgaacgtgtcgccggtcatgttccagccgtgccggacgtactccgtctgcctcgggtcggcgagatagcggcagccgaccgggccgcgcacggccagcagtcccgcctcgccgtcgggcagttcgtccccccgctcgtccaccacccgggcctgccaccccggcacgggcacccccgtcgtgcccggccggatcgcgtcgtcggccgcggagatgaagatgtgcaggagttcggtggccccgatgccgttgatgatgcgcagccccgtcgcctcgtaccaggaccgccaggtcgcctcgggaaggttctccccggccgacacacagcggcgcagcgccgagaggtcgtggccgtccagctgcccgagcatcgtgcggtaggccgtcggcgcggtgaacagcaccgagacccggtgccggaccagggcgggcagcagctgccgcgggcccgcctgctccagcagcagcgtcgaggccccggcccgcagcgggaagaccagcagcccgcccaggccgaacgtgaagcccagcggcggactgcccgcgaacacgtcgtcggccgaggggcgcagcacgtgccgggagaaggtgtcggcgatggccaggaggtcccggtgcaggtgcatgcagcccttggggcgtccggtggtccccgaggtgaacgcgatgagcgcgacctcgtcggcggccgtgtccaccgcccggtacggcccggttctggaggcggccagccgggtcaggtccccgcgcgcgtccccgccgaactgagtgatccgcaggccgtccacgtccgcctcggccagatcccgtaccgaacgggcgtcgcatagggcgtggctgatccgcgccagagagcagatggtggccagttccgtcgcgcgcgcctgcgccagtacggtgacggcgaccgcacccgccttcatgacggcgagccagcaggcggccagccagggcgtcgtcggcccgcgcagcagcacccggttgcccggcacgacgcccagatcgcccgtcagcacatgggcgatgcggtccaccgtctcccgcagctcgccgtagctccagacgctcccgtcgccggaacgcagcgcgggacggtccgcgccccgttcctcgaccgtgcggtccagcagttcgtacccgcagttcagccggtcggggtaacgcgacgcgggatcgtccaggaggagcttcggccactgctccggtgacgggagatggtcgcgcgtgaaggtgtcggcgtgggcgcccgcggcgtggccggacggctcgggatgcgcgccggggacgcgtacggacgcgtcggcggcggctgtgggcgtgttcggcgaggaattcggctccatgaaggatcgcccccttgtcgcctttggagcgtatcgtttgggtgacggtagtcaacggtccgcgataagacatgacgtgcgatgcgatgcgacgagatgtcacgcgacgcgacagggcacgcgaaacgacgcgacaagagaggcgccgccatgacggcattctccctcgaaccggaacaaaccgcttggtgcgaagagctccgcaccctcgccgcagaggagctgcgcccgctggcggagaagggggagcccgggcgggtcaaccgcccgctgctggccgctctcggcgagcggggcctcctcggccggatgctgggctccggggcgctggacctgtgtctgctgcgcgagtccctggcccggggctgtacc

SEQ ID NO: 2873 - DNA, 506 bp, Unknown
  Kingdom: Bacteria, Phylum: Actinobacteria, Class: Actinobacteria, Order: Streptomycetales, Family: Streptomycetaceae, Genus: Streptomyces
gtcggcggacacggcgtcgaaggcctcggcgcagtcgccgccctgcagcaggaacgcctcgcccttggcgacggctcccaggcgggcgcgcagctggtcgcactcgccggcgaagacgagcggcggatacgacgcgaggtccgcgagtacatcgcgcagggcctcggagtcggggtactcgggctgctgcgccgcgggaaggtctcgccaggtgttgccaccggcgacggaggtattggcgttcacggtcacgagcacaacattacggggtcggaagggacgtccagccgtgcgctcaacagatgagacacgcgctccgatgccctgaccggtccgctagggtcggagcatgtcgacgcgactgatcgagatctcgatccagaactggtggtggaccgctcatccggcggcccgctgattcatcgcgctgacacgtcgcgaaggccgcccgaggggcggcctttctgcgttcgcggagccgttcctccccctgtgaacccgtacgg

SEQ ID NO: 2874 - DNA, 4802 bp, Unknown
  Kingdom: Bacteria, Phylum: Actinobacteria, Class: Actinobacteria, Order: Streptomycetales, Family: Streptomycetaceae, Genus: Streptomyces
tggcgcgtcgcgtccggcgccgcgccggacgcgacgcgccaccggaccgcgaacggtcgtcgtcgaacggaatgaccttggcgtccgccatcgtcggtgcgctcctctacctggcgccgtgagtcgtctgtaccgcaccggccccgcgctcccgcggcccggtgcctcccgggagcggcaacgccgccagccggtccaccgccctgcccaccgtctccggcggcagcagccccggaccccggctccgcgcgaactccgcgaacgtctccgccgtggtgaacttcggccggaaaccgagggtctcgcgcatctgcaccgtcgagaccaccctgccatgggtgagcagccggatctgttccggcgagaagtcggtcatgccgatcgtacggagcgccgagccgacccacgtgacggcgggcagcagcaccggcacggtcggcttccccagccgccgcgaacactgcgacagcagcagcaccccgtcaccggcgatgttgaacgtgccgctgttcagcgtcccgcgccggggctcgctcgccgcgatccccaggacgtcgatcacatcgtcctcgtgcacgaactgaagccgcgggtcgtagccgaagacggtcggcaggacgggcagcgacagatagtccgcgagcggcgagtccggccggggacccaggatgttggcgaaccgcagcacacacaccgccacgtcgggccggcggcgggcgaagccccgtacgtacccctcgacctccaccgcgtccttcgcgaaaccgccgctgggcagcgacttgggcggagtggtctcggtgaacacggcgggatcgcggggcgccgacccgtacacgctcgtactggacttcaccacgagccggcgcaccgtcggggacttctggcaggcgccgagcagctgcatggtgccgatgacgttggtctccttgatcgccgtccggccgccggcgccgagcgccttgccggagacgtccaggtgcacgaccgtgtcgacggcgtgctcggccaggatccgcgccagggcggactgccggatgtccgcgcgcacgaactccgcgtcgcccagctcgtgcgcgggcgcgaccgcgtcgacggcgatcacccggtccaccccgggctcgcgctggacgcgccggacgaagcggccccccagctgccgggccgctcctgtgacgagcacgacctttcccaagacccggctcccctgcttcccgcggtaacttccctggccgtcaccgtagcgggtggacgccgtcctgtgacgaccccgtgctccgaaacgcaccgcagcccctccaccggaacggcggagaggctgcggatctcacgaactgcgttcgcttacttcttgttgcgacgctgaacgcgcgtgcgcttgagcagcttgcggtgcttcttcttggccatccgcttgcgccgcttcttgataacagagcccacgactaccctcgctcacttcattttcactggtgcggggcgtctgggcccacacgacctacgtcggcctagcctacccgccaccgtccgagggacgtaatccgcaggcaacctcaggctgattccacccccacaaaggactcgcggagatacgcgtgaaccgcttgctccggcacccggaaggacctgcccacccggatcgccggcagatgaccgctgtgcaccaagcggtacacggtcatcttcgacactcgcatgaccgaggcgacttccgccacggtcagaaacttgacctcgttgagaggcctctcgctgccagcagccatgacccacctgtaccttccgcaccggacgcgcaccggcttcccctccggtgactcttcgtcgctgtgcgctcactccacagattaggggcgcgtggtgcgagtggggaagaggagagacggtcggcggcctactgtgacagacgggcccgattgagcacatagcgcgtcaacggccggtaaaacggcgcccgtacgccgtcgtcgagcggaacgacgacggacacccgtccctcggcctctcccacgaacagcgccggatcatccgtgtccgccggcccgatcgcctcgatccccagctgacctgcaccgcagacccagccgtgatccccgatcaccaactccggcagcaccccgagccgctccgccgcgtcctggagcgcgagccgcaccggaagcggcgaatgcgtgtgcgcgccggtctcaccccccgtgggacggcgccccggttcgcgcaccagggcgacaccccgtacgtagtcgaggttgtacgtgcgtacgccaaaccgggtcgttatgtcgacacatctcccctgcgcgggggtgagaacaggacagccggccgccgacagagcgtctgccagaccggcgtagaaaccgagcaaccggtgcggatggccggtccccagcaacaccggagcccgccgctcggccaccaacgccaaccgctcggcgaacgcgtccagcgcggccaccgtccgctccggatcgatcgcgtcgggaccgctcacatgcgcgggatcggccgagaccccgcaccggtccgccatcagccgcaacagctcgccctcgccccaggcccgctcgggcgcgagccccagcatcacccgcggatcccgcgcggcgaacaaccggtagctgcgcagactggtctcgcgcggggtggccacggacccggccaaccgggccgccagcagatgggcgcgcagcgccccggtgctcaacacccctgggatgctgccgtaccgcggatccccggcgggcggaaatcccgttacgcaccaccgttggcgtaacgcacggcacaatgcccccctcgccacccggaactcaggtcagcagcccccgcagcgggaacgccgccttccgggacgccagcaccgcctggtccagccggtccgccgggtcgtacccgtcctcccaggccttccaggacggcgtacgcccgtccgtcatcctgcccggacccaactgccgcgtacgtgcgtagacgagatcccgccaggacggcggcaccaccgactccggatcaacgggagcgtgcgccgcgatcccgacgagatgcgtccacgaccggggcaccacatccaccaccgcgtacccgccgccgccgagcgccacccagcgcccgccgtccgcgtaccggtgggccagctcgtggcaggactccatgaccgaccgctgcgcgtccagggacaccgcgaggtgggcgagcgggtcctcgaagtgcgtgtccgccccgtgctgggtgacgagcacctggggccggaagtcggccagcagttcgggcaccaccgcgtggaacgcccgcagccatcccgcgtccccggtcccggccggcagcgccacgttgaccgcggagccttcccccgccccggccccggtctcctccggccacccggtctgcggaaagagagtcctcgggtgctcgtgcagcgagatcgtcagtacccgcgggtcctcccagaacgcggcctgcaccccgtccccgtggtggacgtccacatcgacgtacgcgacccgctccgcgcccagctccagcagccgggcgatggcgagagcggggtcgttgtagacgcagaacccggcggccgacccgggcatggcgtgatgcagccccccggtgaagttcaccgcgtgctcgcactcaccccgccacacggcctcggccgcacccaccgacagcccggcgatcagcgcggacgcctcgtgcatcccggcgaacgccggatcgtccacggtcccgagcccgtagtcctggtcggcctcccgcggatcggcggaagcggcccgcaccgccgccacgtagtcctcgcggtgcacgagccgcagggtggagtccccggcggacttcgccgaccgcagatccaccgccccgtcgagcccgaacgcccgcaccagccccatcgtcagggccagccggaccgggtccatggggtgcgtctccccgaagtcgtatcccgtaactgcgtcatcccacatcagctgtgtgcggccgctcatgcccgccaccgtatcgggcgggctccggcccgaacgcgcgggcatacacgagcgtcgccagcaccagaaccatcggtacgagcatcgcgccgcgataactccacgcatcccccagagcacccacgagcggcgaacccaccaggaacccgacatagttgaagatgttcagccgggccacggccgcgtcgctgttcccggggaacatccgcccggccgccgcgaaggtctgcggcacgatcacgcagagcccgaacccgagcatcgtgaacccgaacatccccacccaggccccgggcgccaccgccacgaccgcgaacccgccggccgccagcagactcccgccccgcacgacggcgaccgccccgaaccgccggaccccgaggtcccccagggcccggcccagcagggtcgtcaccatgtagacgttgtacggaacggtcgcgagctgctccgaaccgcccagcacgtcctggaggtacttggcactccagttggagacggtcgagtccccgatgtacgcgaagctcatcaccaggcacagcggcagcagcagcctgaacgacagcgccccgccagcacccccggggccggccccctgctcctccggtcccttcccgtccggccccttcccctccgtgtaccaccggctcccgagcagcgcggcgggcaacagcaccaccacgacgggcaggtaggacccgagcaacgacagatcccaccgcgccccggcccacgccagggacgcccccgcgatcccgccgaggctgtaggcggcgtggaagccgagcatgatgctgcgcccgtacgcccgctgga

SEQ ID NO: 2875 - DNA, 2177 bp, Unknown
  Kingdom: Bacteria, Phylum: Actinobacteria, Class: Actinobacteria, Order: Streptomycetales, Family: Streptomycetaceae, Genus: Streptomyces
cggctcttcaactacctggaggagtcgatcctcgccggtacgcagtgggtcgtcttcgagccgaacgacgacgccctgtgggcccgcgtccggcgcaccgtctcggcgttcctcgtcaacgagtggcgcaaggggtcgctgttcgggctgacccccgaggaggcgttctacgtgaagtgcgaccgcgagacgaacccgccggagagcatcgacgcggggcaggtcatctgcgagatcggggtcgctcccgtcaaaccggccgagttcgtggtgttccggctctcccagctgaccggcggcagcggtggtgtcgacgaatgaccggccgccgcccccgttggtcgctgacagaccgttcctgagtccggcgtaaggagtctgctgtgccacttcccgatctcgacagttccgtcgggcattccttcggcctcgaattcgacagcgtcatcatcaagcagatcaccgaggtcagcggtctgaagatggagcaggacgtcatcgagctgaagcagaacaccttcgacggcaagtacgccatcaagaagctgcccggccgtcccaaggcgggtgaggtcaccgtgacgcgcgggctcaccgaggacaacagcttcgagcggtggatcaaggactcgcggttcggccgcatgacgaacgcccgccgcaacggcgccgtcatcgtctacgactacgagggcttgccgatcaagcgctacaagctcatcaacgcctggccgaagtccctggagatcggcaccctcaaggccggcgacacctcggtgctgaccgagaagctggcgatcacctacgagagcatggaactcgactgatgcgccgctcggtccagttccagagcgcggagcaggtcgagaccgctgcggggaagcggagcgggtccgctcgccaaccagagcagctgcgcacggagttcgggttcgagctgcctcgtggctacgtcgacgagtcgggcgcggtccaccgcaccggcgtgatgcgcctcgccaccgcacgcgacgaactggtccccctgagggacgaccgggtcagggagaactcggcctatctgtcggtggtcctcatctcccgggtcgtgacgcgcatcggcacggtcgaggacatccaccccggcgtcatcgaggacctgttcgcctccgacctggccttcctccaggacttctaccgccggatcaacgccgagggccacacgcgcgccgccgtcacctgcccgtcctgcgacgaggagttcgcggtgaatctcgccggtggccgcctgggggaatcgtgacgtacgcggccgacctgctctacgaggaggtcgcgtacctcgcctaccacttccactggccgctggacgacctgctggacctggaacatccggaacgcctgaagttcgtcgcgcaggtcgcccgcctcaacgggcactagccgacggcggggcgggacacaccgtgcaggggagaacgaggagctcatggggttgatgtcctggctgcggggtggccgcggtggtgccgctcgctccggcgatgcccccgcgcccatgtccgcagccgatcgtggcgaacgggtggacgtgaaccggctggagccgatccagcgggtggtgtccggccagcaactgacggtggaaccgaccgagttcgaggcctcgctcaccacccgtcaggacaccgcgctcggaaccccgctcgggcacctggtgagccctgatgctccggccgggctcgttcgcgggctcggtgtcggtgtcggtgtcgcggattccgccgtgtcgcgatcgcgggcgcctggggaatcgccttcgtcgtcgccttcgtcgtcggtcgcggctcagcggtccgtggacatgccgccgcgcgggtcggtgaaccacttcggccggctgggtgggccgcaggccgtaccggggacggtgcccgcggcccccgtacccgtacagcgtctgtacggcggtgagacctcggcgatgacgtcctccgccgggacggagagcggtcgagggggcggcgaggagctgcccgtacggcggttggtgggggagcggcccgtcgtggcggagccggattctccggttccgtcgcccgaaccgccacccgccccggcctccggcagcgtcggcgttcagcggtctgcggtgcctccggcgggggagcggccccggcggaggcaccgcagaccgc

SEQ ID NO: 2876 - DNA, 1371 bp, Unknown
  Kingdom: Bacteria, Phylum: Actinobacteria, Class: Actinobacteria, Order: Streptomycetales, Family: Streptomycetaceae, Genus: Streptomyces
gcctaggacacacccccgggacccccggttccgccggacgggctggggccggccgaccccgcacggggacggccggggccgaccgggtccgcaccggtcagggaatccatcgcctccgacaaccgctcaagcacccgcacggcctcccccagctcctccacccccatctctcccaccagccgcgcagcgaactccgcgtgcggcgggccgatccgggagaccgcctcccgccccagctccgtcacccgcagcagcttcgcccggcggtgggccgggttctccacgtactccgcgagtccccgcccgaccagcagatccgcgatccgctgcacgctctgccgggtgatccccatcgcccgcgcgatccccgccaccggcaacggctcccgcagcaccgcccccagcacctgccaccacgccgccgtgagtccgcccggccgcgccaactcgtcggccaccccgaggaactgcccgttgagccggaacaccgtcagcgccgcccggctcaacaggtcctgctgggcgcggacttcctccccgcccgtgccctcactcaccttccagcacctcgtacgcgctcgcgtccgagtcgtggaacagccggtaccacgcgtccagcttctccggcccgtacaccccgagcagcgcgaagacctcccgcgcgaacgccaccggctccgtcggcccggccgtgatcagcccgccgtccgtcaccgcgtccgcgtccacgtaccgcgagccgcccgcgtaccccgtcgccgcgaggtagaaggagaccgcgctcgtgtgcgtgcggccgtccagcagcccctcccgggccagcccggccgtcgccccgcagatcgccgcgaccgggaccccggcgtccaggaagtcccgggcagctcgcgcgaacggggccagccggtcgcccgtgtcccactcgtccgcgccggtcaggatgagcaacgcgctgtcctgcgcccgcagttcgtccaggggcaggtcgggctggacgcgcaggccacccatggtcgtcaccggctcccgggaaggccccacggtccgcacggtgtagccgttccgtgcgagatgggcggtggtgtgcccggtctcccagtcggcgaacgtgtcgtagacggcgagatgcacggttctgctgctgctggtcatgatgacctcctcggttcgatgacagaagactgtcatatcgacagcatgctgtcaatggaactcgtccccggcccccgaccgcccccggcgacccgacaccctgccgatccatccgctccaggccgtacaaggtggccattggggccacccccaccagcgcctacgctcgccgcatgacccctcatgcccctcatgccccgtccgccgaccccgcggccg

SEQ ID NO: 2877 - DNA, 14756 bp, Unknown
  Kingdom: Bacteria, Phylum: Actinobacteria, Class: Actinobacteria, Order: Streptomycetales, Family: Streptomycetaceae, Genus: Streptomyces
gctccccgctgccggtgtcccgcaggcgcgggctcgcggccagcagcgcccgcgtgtacgggtgccgggcgcggcccgcccgcaggtcggccgcggacagttcctccacgacacgtcccgcgtacatcaccacgacccggtggcacaccgtgccgacgacaccgatgtcgtgggagatgaggagcacgctcgtgccacgccggtggttgatgtccttcaggacgtcgaggacttcggcctggacggtcacgtcgagggcggtggtcggttcgtcggcgacgatcagccgcggtcccggcagcagcgcggcggcgatcatcgcgcgctgccgcattccgccggacagctcgtgcggatactgcttcatgacccgggcgggctccttgatccgtacctgctccagggcttcgacggcccgccggtccgcctccaccccgctcacgccctggtgcacgcggagcgtctcggtgagctgaccgcgcatccgcagcgccgggttgaaggaggacgacgggtcctggaagacgatgccgatcccggtcgccagacgcccggcgtcggcttcgggggcggccaggtcgaggtcgtccagggtcagtcgcgccgcatgggcggacagtccctccggcaggagccgggccacgctcatcgccgtcaacgacttgccggagccggactcccccaccaggccgacgatctcgccgggcatgacgtggaaggagacgtcgtcgacgagacgggtgccgtcaggcaggaggacggccaggccgtccacggtcaccagggcgccggcgggagcccggtgcgagggcgtggccacggcggtgggacgtaccgctgcggccttcgccctcccaccgcggggatcgagcgctgcggcgaggccatcaccgacgaagcccacgaggacgccggtgaccgtgatggccaccgccgggccgatcgcctcggcggggttggtgtagagggactgcaggccggagttgagcagcgcgccccagtcgtaatccggtgcctgcacgccgactcccaggaaggagaggccggacagggcgacgagcacgttcgcgaaggccaccgacagcagtaccagcagcggcccggcgatgttcggcaggaggtgccggacgagcacgcggtacggcggtacgcccatcaggcgcgcctgcgtcacgaagtcgcgctgcgccacggaggccgccatgttcgccgtgaggcgggcgaaggcgggggcgccccccaggccgatcgcgaggacggaggcgacgggcccggtgccgaggaccgtggcgatcaccagcgcgaggatgagcgccgggtaggagatcatcacgtcgatcaggcgcaggcccagctcgcggacgcgccgtcccgacacccagacgccggtgccgagcaggatgccggcgaccgcggcgatcgcggtcgcggcgagggtcatctccagggtgagacgggtggcgaccagcgtccgcgccagtacgtcgcggccgagcacgtcggtgccgagccagtgtccggcgctcacatgcgcgcgggcggcaccgctcagcgcggtcgccttctcctccagcagaaggggagcgacgatgccgagggcgacgatcagtccgaggccgaccagggatatgaccaggggtgcgttccaccgaatgcggcgcatcagcggcctccctttccggccagggtgcgggggtcgagcagcgcgaggacgacgtcgacgagcaggttgagcagggcggcgagcaaccccaggatcaggacgcagccctggatgacggggtagtcgcggacgaggagcgcctccacgacgcgttgcccgatgccgggccaggcgaagacggactcgacgacgaccgtgccgccgagcagcccggcgaggatcagcccgccgagggtgagcgtggcggtcagcaggttgggcagggcgtgccgggcgtacaggcgcaggggcggcaggcggcggccccgagcggtccgcatgtagtcctgggcaaggacgtgggtggcctcgctgcgcacgatgcgggccatcacgcaggtggcaggcagcaccagggcggcgatggggagcaccatcgacacgagggtctcggcgcccgccgccgggagccagcccagcttgatggcgaagccgaggacgagaagggtgccgatgatgtactcgggtgtggcgccgagcgtcccggtgacgaaggtgaacgaagcgtcggtgcgccggctgccgcgtgcggcgacggtcagtccgatcggcacggcgagcaccagcaccacgaggacggagaggagcgcgatctcggcggtgaacggcaggcggccgccgatgatctcggccacgggctcctgcgtctggaaggaggtgcccatgtcgccgcggagcagaccgctcgtgtacgtgccgaaccgtacgagcagcggctggtccaggccgaggtcgtggcgggcccgctccacgtcggcgggggtcgcttcggagccggcgaccacgcgcgccgggtcgccggggatgagctgcaccatcaggaacgtgccgacgacgagcgtgaccgcgacggcggtgagcccgacgagacgccggaggagaaaggtgccccagggtccgagccgggccgagcgcccggcccccgcgaccgtcccgagggccgatgccgccgccatcagccgctgatccggatcgtggagacggagagggatccccccggcatcgcgaaggagacgcccttgcgggcgacgtagtgcacgtcgaccgtggccagcgggatcacgtcgtgcgccttgagcagcgcctcctgtgccttctgccaggcggcgcacttggcgttgcggtccgtggtggaggtggcggcgacgtagctctcggcgtaagccgcgttcttcaccgcgccgtagttgcggccgcccttggccggttcggggccgaggaagtaggtgccgccgcgcgcgagggtggcgctgatcagcgggaagacggtggcgtcccagtcgccctggttggcggtgacgtcggtggcccaggcggcgttgtcggcgttggtgagcttcacctcggcgccggcggcgcgcagggcctcggcgacgtaggagttgcctgcgccgccggcgaccgcgttggatccctccagcttgatgctgacgcccttcaggacccgcttcgccgcagccgtgtccgccctggtcagcagggagccgtcggtggagacgcacgccgccttctcgtccacgtacgaggtgaggggctgtccggtgccgccgaagacgttgttgaacgccttgacgctcaccgcctgcgcgatcgccttgcggaccttcgggtcggcgcccggacgcccggggcgttggttgaaggcgatgtagttgcggatgaacggcgcggactcgaccgtgaacgtctcgttgtccgtgaaccgcgtggcgtccgtgccggtgaggggggccaggtcgagggcgccggtctgcagctggttggcgagggtcgactcgttcttcgagatctggaagcgcaggcggccggccggctcccccgcgggcatcgaggcgaaccgcggatacgccttgaatcccttgcgcagccgcagttcgtacgaggcgccgcgccgtgccgtcaccatttcgtacgggccggtggccgcgccctcgacggcgccctgggcgagcgcggcggcgcccgcgtcgaggccggccttgcagacgatccccgcggcggcgccggacaggccggcgaggacctcgccccacggggtggcggtggtgatggtgacggtgccggccgcgtcgtcgccggtgatcgtggtcttctcccctgcgttcgcggcgccgaaggtgagcagggcgccggccgagttcgcccggtagcgctccagcgaggcgactacctgcgaggcggtgagcgccgatccgtcggagcaggtcaggcccttcttcagtgtcagcgaggtcttcgtcggcgtggacgtccaggtctcggcgagaccggcgacgaacgtaccgccgtcgtcctggccgaccagcggctggtacagcaacgacgtgagggcgtagtccgtcgcgcccgcgctcttcgccgggtcgaacgaggtgacgtcggaggtgaatccgaccgtgacggtggcccggcccttgtcgccgcccgatgaagggccgccggccgggccggtggtgcaggcggaggccaggagggagatggcggcgaccgtgatggcgccggagaggaaccgcgaacggggcatggaggactctccaggactgagaaccgagaagggaccgggggctgggacgggtgaagggccggtacgggggcttgcacggccgtgggccgggccgggccgaggtcagggagcgggaggtgctgcgtctgttgcggcatacagaacaggccacttccctcccgaccccgcaattgcaagaatccgcatcggaaaggtgatcgcatgcatgaattcgcaggacccgtcggcctcggggcctccaccaccccgtcccggggaacactcgatgaactcgatctcgccctcgtcaacgccctgcagatggcgccccgcgccccctgggcgcagctggcccgtccgctcggcgtggacgcggcaacgctctcccgacgctggtcccggctccgggactccggtgaggcgtggatcacctgctacgcgtctccttcccaagtcacctacggcgccctcgccctgatcgaggtgtcgtgcgtgccgcaggcccgggaagccctggccggccggctcgcccggcacccgcaggcgatgagcgtggaactggtggcgggatcctgcgacctgctcctgatggtggccacggcgaccatgtcgttgatgagcgggtacgttctcgccctcggccgtatcgaggcggtgacggccacgcgcacccacctggtgcagcacgtgcaccgggacgccagcgagtggcgcatggactccctctcccgcgaccagaggcgcgagctcgcggagaccgaggacagtggcacccccacggccgtcgcggccacgctcacgcccgaggaccgcgtcctgctgcgcgtcctcgccgaggacggccgccgctccgtcacttcgatcgccgccgaactgggccgtccggagtcaacggtgcgacggtcgctgaactctctgctccaaggcggcagaggagtactgcgctgcgacgccgcccacctgtacgcgggctggcgcagctcggtgacgctctggatgtccgtaccgcccgcccagctcatggcggcgggcgacgaactgagccgcctgcggcacacccgtatggctgcgtcggtgtcctccgaggcgaacctgctgagcgtggtgtggctgcatgccctggaagacctcggtcgctacgaggtccaggccaccgcccggatcgccgccgtgcgcgtacgcaatcgggccgtgaacctgcgctgggtcaagcgcatgggccgcctgctcggtgacgacggccgcagcgccggctgcgtcccggtcgatccgtggcacccggtcgcctgaatcactcccgtccgaaccgccccctccctccgggtcccgtccgagtcactccttcccaggcccgcagttgcgctttccggcacaccacccccggtcctggcggattcttgcaatccgcaggccgggcgggtccggtccccgaggctgacaccaccgccggacgacagccgaccgaccggcacagcgaccgaccggcgtgccggccggcccttcagcctccgtacgggaaggacgtcacgcccatgtccagccgcaccccggcccgcgatgacctcgtccacctcagcgccaccgatgccctccagctcttcgcccgccgtgcgctgtcgcccgtcgaactcatgcgagccgtcgtcgagcgtgcggagaaggtcgaaccgcgcatcaacgccttcaccgagcggctcttcgacgaggccctggaacaggcccggcacgccgaggcccgctacctcggcaaggacggcctggccccccggccgctggagggcatcccggtcgcagccaaggagaagcacgccatcctgggccgcaccctgaccgaaggctccctcgcccacaagggccgcgtcgccacggagaacgcccccgtgatcgaccgcatcctcggcgccggcggcatcatccacgcccgcacggcgaccccggagttctccctcagcacgtacacgcactcccgtatgtggggcatcacccgcaacccctggaaccccgacttcacccccggtggctcctcgggcggcgcgggcgcctccctcgccgcgggcacgaccctgctcgcctcggcctccgacatcgggggctccacccgcatcccggccgccttcaccggaaccgtcggcttcaaggccccttacggacgcaaccccggcctcggcgtgctcgccgccgaccactaccgcggcgacggtcccatggcccgcaccgtggacgacgtcatcgccttccagaacgtcctggccggccccgacccccgcgaccacgcctcgatccgccccaagttgaccgtgcccactgcgtacgaggacgtgaccggcacacgtatcgccctgtgcgtccgactcggcgagtacgacgtccatccggaaatcgaggcgcacacccgcgccgccgctcaggccctcggcgacgccggcgcacacgtggaggagatcacccttccctggacgcgccgcgacctgctcaccgcggtcgccggccatttctcgaccctcttcggcgccctcgtcgtcgaggccgccgaaacccaccgcgacctgctcagcccgtacacggtcgccttcgccgacaccatgacccacgcccgcgccaaggtgagttacctcgactccctgcgggccgaacaccggttgcaacgagcactcgccaccgccatggacggattcgacgcactgatctgccccaccaccgccgttcccggctggcacgcgggcgacgacctcgccggcgacaaggtcgtggtgcacggcgaggaagtggccgacaccctgtggagcgccatgaccacgcctttcaacatcaacaaccgctgcccggtgctcaacgttcctaccggcatgtcgagttggggtgtccccgtcggcctgcagatcgtcggccacccctacgacgaccccgccgtcttccgtatcggcaaggcgctggagaccctccgcccctggtcgtacgcccagatcgagaacggcctgtcgtagccctgagagcagcgccgacgcccccgtccgcgcaggaacgcgcggcaggcccccacccactcccaaccagcccatcgtcgaaaggcagctcctgtgaacgcccctgaacccgatccgctctggcccgcgtacgaccagccggacgccctggcgacgatcgagtccatcgcgctcggggaccgcggcttgcccggttccacgtacgaggtcctggcccgcgccgccgccatgtggcccgaccggccggctctcaccatgctgcccagcgcggagcagtggacgcgcggtgaaaccgtgtccttcgagcaactgcgcgaccaagtacaccgcatcgccaacctcttccaccggcacggcgtccgccgtaccaccgccgtcggcctgctgaccccgaacgccggcctgctgcccgccactctcctggccgcccagctcgcgggctgtgcggcaccggtcaacccggcgctcgccgccgagcacgccgaacggctgctgggtctgggcggggcaaaggtcctggtcgcggccggacccgaactcgacgccgacgcctggcggacggcccgcaccgccgcggcgtcactccgctgctcagcgctgttcgccctgcgtccggtcggcgcacccgagcccgcgcccgaactggaacggatcgagggggtccacgtcgcctatctgcacgtcgaggccgccgcccagccggcagagctccaccctggtgtggtgcctccgaaggccggcgacctggccgcgtacttccacaccggcggcaccaccggcgcccccaagctggccgcgcacacccacgccaacgaggtgaccgacgcgtggatgatcgcggccaacagcacgttggactccgattccgtgctcttcgccggactgcccctgttccacgtcaacgccttggtcgtcaccctgctggcaccgctgttccgcggtcagcacagcgtgtggtccggccccctcggctaccgcgaaccggcgcttttcgcactcttctggaagatcgtcgagcatttccgcatcgccaccatgtccgcggtcccgaccgtctacgccgccctcgcccgggtgccgctcgacgcggacatcacctcgctccgcttcgcgatagtcggcgcgtcccccctgccgccgacggtacgcgcggcgttcgagcaccacaccggcaccccgctctgccaggggtacggcctcaccgaagccacctgcggcagcgctcggagcttcttgcacgagcaccagcgcccggaggccgcgggccagcgcatgccctaccagcggatgaagacggtacggatcgacagcgacgacacctggcacgacctcccgcagggggaacccggcattctcgccatcagcggccccaccgtcttccccggctacgtcgtcggccacgacgacaccggaccgcgcctggacacgctcggcagtgtgcgcgacggctggctcaacaccggcgacctcgcgcgcgtggattccgacggattcatccacctgctcggccgcgcgaaggacctgatcatccgcggcggccacaacatagaccccgccgtcatcgaggacgccctcctcacccacccggccgtcaccggcgcaagcgccgtcggacgacccgaccctcacgccggcgaggtacccatcgcctacgtcactctcaggcccggcacgaccggcaccggacccgacgagttgatcgccttcgccgcgcagcacgtacccgagcgagccgccgcccccaaggacgtcatcgtcctgccggcgctgcctctgaccgacatcggcaaaccttccaaggtccctctgcgcctcgacgcgacgcggcgcgcgatctccacagccctggccggcctcggcactgctgtcgccgacgaacagatccgatgcgaactggcggacggccgcccgatggtttacctgcctcccgtcgccgaccccggccaacgccgccggatcaccgcccaactcgccccgtacgacgtgaactggacgttcaccggcctcggcagttcgtgagctgccctgccgtcaccacagcatcccggcggcctgccgccagcacggtggaccgccggggcgaaacaccttcgcccccacccaccccgcagccgcgccgtcgccgctcgtcagcccctcgcggcaacacgctcgtcagccccctcgcgacctcggctccgagccccggcgacccgagatcctgcggggcccaccgccgatgcggagcctggggtcacgaaccgagaaagaacccagaaagcactgccgaatcgaccgcgtccctcaagaagccgcaggtcgggcatctacaaggctcgatccagccactcgacccgccactgggagcgaacaggtcaatctgacacagggcaacagaaccgcaggtcaaacgcccttagcgaccggctccagaatcgccacgcactccacatgatgcgtcatcgggaagatgtcgacctgagcgcatcacagaaaggaccaggtcaggcaccttttcttagctcgccgtcctgcgcatggggacctggagcgtcaaacgagcgtcacaaccgagtcagtgaacacgccgccaaagtgcccgccggggccggctacaggtgcagtcccacatggttcacgatgaaccgcttctcctcggagtcgagggcgaagtagatgcgtcccacctcgttgggcgagacggcgtcccgcaccttgatgtgcggcagtccgtcccagcgcttcccgttgagcgtgaagtagctcttgtccttgtccttgctgagtttctcgtcgctgggcgcgaatttcagtccgtggttgtcgtagaaccactggacccccgacgcaggcggtgccggcacagaggccgagaagttcgcccaggcgtacaagaagatcggcaatcgctggctggaggtctggggccggtccgcgctcagcgtcggcggtgtggcagtcgggttcaccgagacagccacgcctacaccaaggccgacgtcgcggcccaccccaagcccggcaggacagccgagcagcgcccccggcccgcggtcatcgacaaagacccgaacctcggctccatccccgacatcaagtggggcgacgacgacggcggcgacgacatcctgcgaggcttgatggagggcatgcccgaaatcgtccgggatctcctccatccactgtgcaagaacgtgttccgggtcggcagggtggcagacgtttacccctatccggaacagcactacctcaactccatctgccacagctggatcagagtgtccgtcactgcatcgctgggggcggaccagctcacccaggctgtcggtgccatcaccaaccaccagcaggccgagtgggaggccgcgatgcggaccttctgcagcgccctctggggaggaacggcctgggggcagcgacagcacggctaccagtgggcgcagaccgcgaactccggtccgggcacaccccgcgtccccacgggcagtcagcccgtcctggccgtactgaaggacacggccgatgacatcgccaccatcctgcgcgagtacgcggaagccgccgtcgacctcaaccgcgacgtcaaggacgagctcgaccgcgccatgtggaaagccgccaaggacatcatcgaggacctggccaagcccaaagacctaaagagcgcgctcggcgccgccacatccctcctcggcagcggcgccggcctgctcctgtcgttcgacgtcaagacagtactgaacctcgacaccggcaagctgaacgggatcgtcgccaattacaccggcattctggacggcctgaccacccgcatgagggcgctggaagggtcgctggacgaggcgtaccgcagcgcccccaagttcgaggccggcgtcgcccgtgcgcacggcttcggtacccgggccttggaggaattcaaggactcgaaggtctggctgaaggttgattcgaacggcaactacgacctgaatctcgccgccaacgaatatatggcgaacggccatactttggacaagcacgtcggaaaaacggacgagcagttggcgcagcgcctgcgtgaccagcagtcgggcggcccgacagcgtcttggccccacggcaagccgatgcccagcggctcctccgccttcccgagctaccagcgcgccgaggaattgaccgagcgcaacctcaacacgaacaaggccgccatcgaggcatggatcaaggggcctccgccggcctccgacggcgatgtcaagtcgttctacgacacggtgcccagcggcgagaccagtggccgcagcgtgagcaagcagccggtggaccctaacgacccgctgtccgggtacaagcagggcggtctgaatgccagggcgtacgacgtgagcggcgtcgacacgcgcatccgctacgacagcagccgcaaccctccgttcagtgtcatgacgtcgatgccctccaagtcctagcgaaaaccgagaaaggccagcaccacatgcccgtcgaccagacgtcctgggaagccgcggtacgccacttgtacgaggacgcgtacccgtacgacgccacgggcccgcgtcgccacgagaactgggtccttgatgtcctcgctctgatggcacgggccccggacccccgcggctggaccggtctcgatgacgcggctcaggacccggagcgcgaggcgtcccccacctatcccttcgtcgcccacccgccggagtacattgcgagccgcctccaggagatcgatcgggacagtgccgagagcctgctcctcgcccttacggacgacggctgcaccctgtccaacctgagccgcttcgccgaaagcgaggcggagctgagggcgttggcgcgcacgatcctcacgcgctacggggactccgcccgtttccacaccaacgtcaacaagcccggtcacgtgaacggcacgctcgacttcacatcgtcgggctgggcatacagcccgctgagtgtgtactcggaggactacggcctgatcgtcatctcggacaccgaggtgggcatgttctggaacttcgccgactactgaaccgcctatcgcccgtgggagctcggctcctgacgaggcaatttgagaggatgccccgtgctgacccgttccgcctcctatcccgaccgggagaccgctcagtgggcgacccagcaggtggtgaccgccaacgaacaggccgtccaccgctggctagcccagaacatccgggtccgcctcaccctcgaggcagcctggccgtcccgcgaggagcccgtgggccgggtccagctggagggcgacctgatggccgggcgcggccccgtcgacgtgcgcgcggcgcgcgtggtgctgcgccgcgcggcgacgagtccgctcggcttcgtcgtccacacgaccatcccgttctacctgtaggggtcacacgcacatgtccatgaagcccctcgaacacgaccggcggtacggcgagctggaccaggtgatgcgcgcgtatctgggtcagccggccgacgacgccccggagcggcgcagtcgcgccttggacgcgtatctccgccatacctggcgtacccgtccctcggccatcgcagaggcggagcgacagctgcgcgagtacagccgcaatcctccaggccgcatccggcaggagctgggtgagttctactcgatcccggacaccggaaagccccagtcggacatcgctgactggctgacagtgctggccgaccacctgaagaggagcatcgaggagggcgacgcccccgagccatcgtccccgcggacgcactgggagtggcacgcccgttttccggagaccgcgcaactgctggggggctggttctcgcaggacatcgttgacgagttccccggccacgacgccgcagtcgccgactacgccggtaccacaaacccgcagttggtcgcccgcctcgtgggtgaactgcacgagttgctcgccctccccctggacgagggggactacgccctggctgccgccgaactcggcatggaggtcggcccgccggaaccgttctcccacggcgcctggttccagtcgctggcggcgacgctctccggtgtctgatccggctgcgcggtcgcgggacgggctctgatgacacgaacgtgcacagcacctcagggccgagccctcgcaagaccccacctgaaggtccgaccggccggtgaccgcagtactttgagaacatcgccagggcctcaacagcgcaacccggaggagacgcaggcgatccgcagtccgaaagcggatgtatctcagcaccctgaccgcaccgaccggggccaggtcggtgtagccgtcctggccccccgggcggccagatggctcgcggcgaccaagaaacctctcctccatgatgacgcgacgacccgtactgcgccgtgggttcgaagctcatctgacgcaccataagaacgagcgtcagatgagcgtcgagcccgtcgtgcgccatccccaacgaaggccgccgcagaccgcttgcccctgcactcttgggtgaaaccgcaggtcagagcagtgcgcctggacgggccgcgcgctccacgtcgtgtccggtgggaaacatgtcgagcgcatcccgccgtgcctgagaacctcgggaaaactacaggtcagagcccctttgcagcaggctccagaatcgctacgcactcaacatgcgaagtcatcgggaacaggtcgaacgcccgcagcgtccgcaccttgtaccccccgtcccggaagtacgccaggtcccgtgccagcgccgccgggtcgcaggccacgtaagcgatcttgcgggcgcccagccccgacaggtgcttgacgacctgcttgcccgcgcccgcgcgcggcgggtccaggacgatcaggtcgcactccgtgatgccggtgcgcggcaggacctggtcgaccttgccgtgttcgatgcggacccggtcgaggtcgcccaggttgtggcgggcgtcctcgacggcgcgcttgccggattcgatgccgaggaccgcgcccttctcgccgatgcgctggccgatggcgccggcgaacaggccgacgccgcagtagaggtcgagggccgtgtcgttcttgcggggcagcaggccctgcatgaccgcgcggaccagggtgttggccgcctgcgggtggacctgccagaagccgccggagccgacgcggtaggtgcggtcgtcggcgcgctcacggacgaaggcgcggccgtggacgcggtggacgccgccgtccttctcgtcgacgcggagtacggagacgggcttgtcgagttcgaccagggggagccggccgccgggcttcggggtgaggatgacctggcggtcgttggagccggtggcggtgatggcctccaccgcggcgatctgcggccactcgcgcttctcgacgccgagctccgagacacccggcgcggcgatcaggcagcggtcgatcggctggacgtcgtgcgagcggtgcttccgcaggcccgcgcgaccgtcggcgtcgacggcgtactggacgcgggtgcgccaggccggcacctcgcccgcggggagtttgtcgccctcggccggcatgaccgtgccgtcccagccggcctcctcgggggtgag

SEQ ID NO: 2878 - DNA, 17737 bp, Unknown
  Kingdom: Bacteria, Phylum: Actinobacteria, Class: Actinobacteria, Order: Streptomycetales, Family: Streptomycetaceae, Genus: Streptomyces
ggaccgtcaccgagctggacgtcacggcgggagcgacggtcgcgatggaccagatcctggcggtagtggcccccgtcgcagcccaggagggctcatgaccacgcgtgcgctccccatgaaggtcccggcctccggtctgccgccccgggtccgcatccatgaagtgggtgcgcgggacggcctccagaacgagaaggggatcgttcccacggaggtgaaggcggagttcatccgccgcctggcggtggccggcctgaccaccatcgaggcgacgagcttcgtccacccgaagtgggtgccccaactcgcggacgcggaagccttgttccctctcctcggggagatcgcggacgtgggtgacgtctccctgccggtcctcgtgccgaacgaacgcggactggaccgggcgctggcgctcggggcccggtcgatcgcggtgttcggctcggcgacggagacgttcgccgcgcgcaacctgaaccggaccgtggacgagtcgctggccatgttcgagccggtggtggcccgcgccaaggcggagaaggcgcaggtgcgcggctatctgtcgatgtgtttcggcgacccgtgggaaggcgcggtgccggtggcacaggtggtcggggtcgcgaaggcgctgatggacctgggctgcgacgagctgtcgctgggcgacacgatcggggtggcgacgccgggccacgtgagcgcactgctgacagcgctgaacgaggcggccgtcccgacggaatccatcggcgtccacttccacgacacgtacggccaggcgctgtccaacaccctggcggcgctccagcacggagtgagcacggtcgacgcctcggcgggcggcctgggcggctgcccgtacgcgaagagcgccacgggcaatctcgccaccgaggacctcgtgtggatgctcgacggcctcggcatcgaaaccggcgtcgacctcgacgagttgaccgccaccagtgtctggatggccggacacctgggccgaccgagcccatcccgcacggtccgcgccctgaccccttcctccccctcccacaaggagtgagccacaccatgtccctggaccaccggctgaccgccgaacacgaggaactgcgccgcacggtcgaggcgttcgcgcacgacgtggtcgcgccgaagatcggcgacttctacgagcgccacgagttcccgtacgagatcgtgcgcgagatgggccgcatgggcctgttcgggctgccgttcccggaggagtacggcggcatgggcggtgactacctggcgctcggcatcgccctggaggagctggcccgggtcgactcctcggtggcgatcaccctggaggccggggtctcgctgggcgcgatgccgctgcacctgttcggcacggaggagcagaagcggcagtggctgccgaagctctgcgcgggcgaggcgctgggcgcgtttggcctgaccgagccggacggcggctcggacgcgggcggcacgcgcacgacggcggtgctggacaaggccacgaacgagtgggtgatcaacggctcgaagtgcttcatcaccaactccggtacggacatcaccgagttggtcacggtgacggcggtgacgggccgcaaggaggacggccgcccccggatctccgcgatcatcgtgccctccggcacccccggcttcacggtcgccgccccctattccaaggtcggctggaacgcgtcggacactcgcgagctgtccttctccgacgtccgcgtcccggcggcgaacctgctgggcgaggagggcaggggttacgcccagttcctgcaaatcctggacgagggccgggtcgcgatctcggcgctggccacgggcctggcacagggctgcgtggacgagtcggtgaagtacgcggccgagcgccacgcgttcgggaagccgatcggcgcgaaccaggccatccagttcaagatcgccgacatggagatgcgcgcccacatggcccgggtgggctggcgcgacgcggcgtcgcggctggtggcgggcgaaccgttcaagaaggaggcggcgatcgcgaagctgtactcctcgacggtcgcggtggacaacgcccgggaggcgacgcagatccacggcggctacggcttcatgaacgagtacccggtggcgcggatgtggcgcgactcgaagatcctggagatcggcgaggggacgagcgaggtgcagcggatgctgatcgcacgggagctggggctgccgggctgaactgccgcccgatggtctgactgccgccccggctgccgtgaaggtgctcacggcagccggggcggaggtcagcggggggtcatccggtggacatacgacttcgccgtaccggactccgcgcgaaagaagggcaatgcgccatgatctccacccggtcctggtcggatgcccggcaggtgggggatcaccacctcatgcaccacactccccgcccctgctcggtcatcgtcgggctcggcagccatgacctcggggtggccgacggggatggtcgtcgacatgctcgtcggaaccctgcaacggctgctcgtctacccagcgcggggtttcatgatcgagcagcccctcccggacgaagtcgcgaaggcctacgaacggctggtcgcggccgggttcacgcgtcggctgatcctgtgaggagcgggccagggatgccgtcaccagggcccggacgacccgccgtcacagccgttcctccgtcatgacggtgaacggcccctcggcggctgccacacacgcgttggcgtccgtcacctcacccgccgccagacccgccacgcagagccggccgccgctctcccgcaggtcgaggtagaagcgtgtggccttgccgtcctgctggaggccgtggatgtgttcgtcgatgtatccgaggttgttcagggtcgcccggaccttggcgggggtcggttccgggaccgactgcagcacctcgatgacgcgctgttcatggtgagcgctcgtgcaccagtcacgtgcgttcaactccgccgcaggcccggtgagggggccgggctcgatcggctcggccgggggcgtctccccgggagcgaggctctgtaccgcctcgggaccggtccgcttcgcgccggcaggccccggtgcggccccgccgggcgacgggcatggctgcgcgaacctgccgagcatcgccgcgaacgccgcctgctcgggggtcgggcgggcagcgctcgtggtggagccggccctgacgtccggctccgtccgctgcccgccgctcctcacctcgcttccgcagccggtgagtgccagaacggcgagagcggcagccacaaggccgcgccgggggtgggcgaacgcactgacggaggcacgcatacgggtcatgcgccgagtctccgccgacaccgtgcggcccgcgtgagtacgcgtactcaccccacgcgcgtctccgatccctgtatccggccgcctcagcgccaggcgtggcggatcttcagccgtccgtatcccagcgcccccgagaggcggatgcgcggcgcgccggggcgggtcggctgccggggcctgtagcgcaggtccttccagccggtggtcaggccctcgacctcgacgatcgcgtcgcgcggcacggtgatgctcgcgttgccggtgccgaggttcagctcgatgtcgacgaccgggtggtcgatgaccgcccgggagaggtccaggcgcacccgcccgaaggcggactcgaccttgaggacgcggggtacccgccatgcgccgcgccgcttgatccgtccgcctgcggcggcgatcgtcgccgtggtgcccggatcctccgccgggagggagtcgagggccgccgcgagctcgccgtgcgtcgtggcggccagcacccggtcgaggcgctcgtccatctcctcgtgcgcgatgtgcccgtcggcgtaagcctcccgcacgcgtcgtacggcgctctcgcggtcgtcttcgcccacgcgcgacgcggcgtttccctggggtgaggtcaccgcttcactctaatgcggctccggacccccggacatgggtcaagacccgcggtctcaggaggccgacgcctcgacgtcctggcgggcgtcgtagtcggcacgcgctttcgcgatctcctgctggtggctctcggtccagtcgaccagggacctgatcgtcgtgtgcagggtcgcgcccagctccgtcaactcgtactccacacgcggcggaacgacggggtagaccgtgcgccgcaccaggccgtcgcgctccagctggcgcagggtcaccgtcagcatgcgctggctgatgccctcgatcagccggcgcagctcggagaagcgcagcgtgcggcgctccaggtgggcgatggcgaggagcgaccacttgtccgcgacgcggtcgaggatctgccgcacctcacatccctcgcggacgtcccactggctgatgtcgtagtcctggccgacgccggtatccacgcagttactcggtgacttcgaagtgccttcttccatacctccccacggtgccgcaagcttcgagtggttacaagagggaaccgaccggcacttcggtaactcgccgccacggtgcccgacttgaggtctccgctggccaatgtcctttcacccgaccgcctttgcggttcctcgtcatgcccatgcgtccgcgtacaaggagaagtcccgtgtcctcatcaccatccctttcggaaccgtccccgccgggttcgagcagcgaccgtatgagcggacgcgcctggggcgtgctgttcgtcctgtgcggcgcgatcttcctggagggcatcgatgtggccatgctcaacgtggccctgcccgcgatccgggacgatctggatctgtccaccggcacgctccagtgggtgatgagcgcgtacgtcctgggctacggcggcttcatgctgctgggcggacgggcggccgatctgttcggccgccgccggatgttcgtcctctggctcgtggtgttcctgctcttctccggtctgggcgggctggccaccgagggctggatgctgatcgtcgcccgcttcgtgacgggaatcgccgcggccttcatgaccccggccggcctgtcgatcatcaccaccggcttcccggagggtccgcagcgcgacaaggccctgctggtctacgccggcaccgccgccggaggcttctcgatcggcctggtcgtcggggggttgctctccgccatcgactggcgctgggtgttcttcgccccggtcctcctctcgttcggcatccttctcgccgcgctcgcgctcgtccccgcctcgccccggccggaccgcgccgggcagggcgtcgacctggccggagcggtcgccgtcaccgcggggatcctgctgctcgtcttcggcgtcgagcgggccacgcacgtcccggccgcctggaccgtcggcacgatcggcgcggccctgttcctcttcctcgcgttcgtcctcatcgagcgcgcctcgtcctcaccgctggtgcgcctgggcctcttccgcagcggggcgctggtccgcgccaatgtgtcggggctgctgttcgccgcggggttcttcggcttccagttcatcgtcgtgctctacctccaggagctgcgcggctggtcgtccctgcagaccagcttcgcgttgatcgtgatcggcgtggacgcggtcctctcgccgctcctcaccccgaggctggtggcccggttcggcaacgcccgggtcatcttcggcgggctgctcctcgcgtcgctgtcgtacgccctgttcctgccgatcgccgcggactggacgtacgcggcgatgttcccgggcctgctcctcctgggtgtgtccttctccctggcctacgggcccctcaccatcgtggccaccgacggcatcgccgaggaggagcagggtgtggcgggcgggctgctctacacgtccttccagttcggggccgcgctgggactgtcggcggtggccgccgtcaacatcgccgccacggaaggcacgtcgcccgccgccctcctcgacgggtaccgggcggccctggtcgtcccgctggccgccgccctgaccgccgccgccgtcagtgcgttcggcctccgctcccggcgggcggcggccggcggatcctcctccggcgacggcggtcggggcggcagcgcctcgccgggcgggaacgacgccgcgggccccgctcgcgcggcccgccgcgatcggcgcctgaacgcgtccgcgtcggcgagagagcgggggtggccgggtggatcctgccgccctcgcggccgtacgccgcccccccatattgcggtcgacacttctcgcccgcgtccggcagagtcccctcatggatctcatggacctccggtactggcccctctacgggcttcgcctccgtacgccgcgcctcgaactgcggctgcccggcctcggactcctggacgagctggcctcggcggcggcccacggggtacacgacccggagcgtatgccgttcaacgtgccgtggaccgacgggacccccgacgaggtgggacgggcggtgctccagcacgtgctggggaccgtggccgactggtccgcacaggactggacgctcagcctggccgtcctccacgaggggaaggtcatcgggcggcaggacctgatggggcggaggttcggggtgcgacggcaggcggagaccgggtcctggctcgggctcccgtaccagggtcagggcttcgggacggagatgcgcgccgccgccctccacctcgcgttcgccgggctcggcgcgcggtacgcggtctccgccgccatgaccgacaacccccgttcgctcagggtctcacggcggctcggatacctggacgacggcctggagacggatgtcgtgcgcggggttcccgtcaccctgcagcggctgcgcctggaccgggcccggtgggaggcgcaccggaacgtggacgtgaccgtggagggactcgacgcctgccgggcggagttcggggtctgaccacgaagactcagctcgtccggaacgaggggaccgtccgcggcgtggagaccgtgcgcgacgccgagttgcccgggggcacgccgtacgcgtgggtcgcgggcgaggcgtccggggtgcgggtgctgcgccatcacctcatccacgagcggggcttcgaccacgagcgggtgacgtccgccgcgtagacggcgcggacctcccgaggagcaggcccggagcgcggaagcggaaggggtggcttctgttgcccgcgacactcttgaactgccggaagagagggatcaggcagatcaagtggagggatagggggacaaccggcacatcggagggggcgagaggaacagccgattttgagttaggttaggctcgccttactttggcatcgcgccctcgtccccccttcctgcccggagggccgcgatgaagttcccctcacccgggaggaccccttacatgcgttcgcacctgctcaacaacacgaccgcggagcactaccggaacaccgtctccgcaggagtggaacgggtcgcggccacgctcgccgccaccgagcgccccttcagcgggatcggtgtcgacgagctctcccctctcgtcgacgcgatcgacctcgaccggccgctgggcgacgccgccgcggccctcgacgagctcggcgaggtctacctccgtgacgccgtctacttccaccacccgcgctacctgggccacctcaactgcccggtcgtcatacccgccgtgctcggcgaagccgtcctctccgcgatcaactcctccctggacacctgggaccagagcgcgggcggcaccctcatcgagcggcggctgatcgactggaccaccgagcggatcggtctcggcccggccgctgacgggatcttcaccagcggcggcacgcagtccaacctccaggccctgctgctggcgcgggaggaggcgaagatccggccgaagcacttcacccggctgcggatcctcacctccgagtgcagccacttcagcgtgcagaagtccgccaagctgctcggcctcggcccggacgccgtcatctccgtccccgtggaccgcgacaagcgcatgcggaccgtggctctcgcccgtgccctggggcgttgtgtcgccgagggctccgtcccgatggccgtcgtcgccaccgccggcaccacggacttcggctccatcgacccgctgcccgagatcgccgccctctgcgagcagttcgccgtctggatgcacgtggacgccgcgtacggctgcggactgctcgcctcccgtgagcggggcggcctgctgagaggcatcgcgcacgccgactcggtcaccgtggactaccacaagtccttcttccagcccgtgagttcatcggccctactggtccgcgaccgggccaccctgcgccacgcgacgtaccacgcggagtatctgaacccgcgccggatggccgaggagcggatccccaaccaggtcgacaagtccctccagacgacccgccggttcgacgcgctcaagctgtggatgacgctgcgcgtcatgggcgcggacggcatcggcgagctgttcgacgaggtctgcgacctggccgccgagggctggcagctgctcgccgccgacccgcgcttcgacgtggtcgtcgagccgcagctctccacgctcgtcttccgctacatcccttccggcgccacctccccggacgcgatcgaccgggcgaacctccacgcccgcaaggcgctgttcgcctccggcgaggcgatcgtcgcgggcaccaaggtcggcgaccgccagtacctgaagttcaccctgctcaaccccgaaacgaccgtgcgggacatcgccgcggtcctcgatctgatctccggccacgccgagaagtacctgggagactcccttgaccgcgcttcctgaaccccacgacttcatcgggatcgggctcggcccgttcaacctcggcctggcctgcctgaccgagccgatcgacgagctgaacggcgtcttcctggagtccaagccggacttcgagtggcacgccggaatgttcctcgaagggtcccatctccagacgccgttcatgtcggacctggtcaccatggccgacccgacctcgccgtactcgttcctgaactacctcaaggaacgcggccggctctactccttctacatccgggagaacttctacccgctgcggaccgagtacaacgactactgccgctgggccgccgcgcaactgagcagcatccggttcggcgagaccgtcgagacggtgacgtacgacgaggtctgcgagctctacaccgtgcgcaccgcctccggtgagctgttccggtcccggcgtctggtcctcggcaccggcaccccgccccacattccggacgcctgccagggactcggcggagacttcctgcacaactcccgttatctggaggggaaggccgagctccagaagaagaagtcgatcaccctggtcggcagcggccagagcgccgcggagatctactacgacctgctctccgagatcgacacgtacggctaccggctcaactgggtcacccgctccccgcggttcttcccgctggagtacaccaagctgacgctggagatgacctccccggagtacatcgactacttccacgcactgcccgaggagacccgctaccggctggagaccggtcagaagggactgttcaagggcatcgacggggagctgatcgacgcgatcttcgacctgctctaccagaagaacctctccggcccggcgccgaccagactgctgaccaactccgccctcgtcaccgcgcgttacgacgccgagggcggcgcgtacagcctggggctgcgccaggaggagcagggcaaggactactccctgaccaccgagggcctgatcctcgccaccggctaccggtacgaggcgcccgccttcctcgcgcccatcaccgggcggctgcgccacgacagccggggtcgcttcgacgtggcccgcaactacagcatcgacaccaccgggcgcggggtcttcctccagaacgcctcggtgcacacccactcgatcacctcgcccgacctcggcatgggcgcctaccgcaacgcgtacatcatcggcgagctgctcggccgcgaggtctacccggtcgagaagtccatcgccttccaggagttcgccgtatgatccgccccggcaaccgacgccccgacacactcggcgccttcgccgtccgcccgctggaccccgccgtcgacgccgaactggtgcacggctgggtgacccaccccaaggccgcgttctggctgatgggcgacgccggactcgcggacgtggaacgggagtaccgggacatcgccgcccacccccaccacgacgcgttcatcgggctgcacgacggcgaacccgccttcctgatcgagcgctacgaccccaccgaggtcgagctgaagggactgtacgaggcggaacccggcgacgtcgggatgcacttcctggtcgcccccaccgacaccccggtgcacggcttcacccgggcggtgatcaccaccgtgatggatttcctgttcgccgacccgtcggtgcgcagggtcgtcgtcgagccggacgtgaccaacagcgccgtgcaggccctcaacaaggcggtcggtttcgaggtgctccgggagatcgccaagccggagaaggacgctctgctcagcgcctgcacccgtgcgcagttcgaagcagcaaccggaggtaacgaccgatgaccgctctcaccgacagcgtcgcgcacctctccccggggcgctgggccaccgcaaaccgactgctggtgcgcaaagcactggcggaattcagccacgaacgactcctggctcccacgccgctcggcgacgaccactacaccgtccgtagcgacgacgcctccaccgagtaccgtttcaccgcacgcctcttcgcgctggaccactggcaggtcgacgcggagaccatcacccggcaccgacacggctgcgaactcccgctggacacgctggagttcttcatcgagctgcggcacacgctcgggatctccgcagaggtcctgccggtctatctggaggaggtctcctccaccctggccggaaccgcctacaaactcaccaaggaaccggcgacctccggccagctcgtcgccgccggattccaggccatcgagacggggatgaccgagggccacccgtgcttcgtcgccaacaacgggcggctcggcttcggcgtggacgagtaccgggcgtacgcccccgaggccgcctcggagatccggctcgtctggctggccgcccgccgggaccgggccaccttcaccgcgggcgccggtctcgactacgacgcgctggtcaagggtgagctgagcgagccgacccgggagcggttcgacggagcgctgcgcgggctcggcctcgacccggacgactacttcctgctgcccgtccacccctggcagtggtggaacaagctcgcggtcactttcgccggagagctggcggcacggcatctggtggtgctcggcgagggcgaggacggctatctcgcccagcagtcgatccgcaccttcttcaacaccgaccacccggagaagcactacgtcaagaccgcgctgtcggtcctgaacatgggcttcatgcgcggtctgtccgccgcgtacatggaggccacgcccgcgatcaacgactggctggccggcctgatcgagcgcgacgacctgctgcgcggggtcgggttctcgatcatccgggagcgggccgcgatcggctaccaccaccggtcctacgaggctgccaccgtcaagggctccccgtaccggaagatgctggccgccctgtggcgcgagagcccggtgccgggcctccagccgggcgagcgggtcgcgacgatggcctccctggtccacaccgaccacgagggcggttcggtggccggggcgctgatcgccgagtcgggcctggacccgcaggtgtggctgcggcactacctggacgcctatctggtgccggtgctgcacagcttctacgcctacgacctcgtctacatgccgcacggcgagaacgtgatcctggtcgtggagaacggcgtcgtcacccgcacgatcttcaaggacatcgccgaggagatcgcggtgatggacccggacgcggtgctgccgccgcaggtcgagcggatccgggtcgaggtccccgaggacatgaagctgctgtcggtcttcaccgacgtcttcgactgcttcttccgcttcctgggcgcaggcctggccaccgagggcatcctggacgaggacaccttctggcggacggtcgccgcctgtgtgcgcgactaccaggggtcggcgccgtatctcgcggacaagttccggcagtacgacctgttcgaggccgagttcgcgctctcctgcctcaaccgcctccagctgcgcgacaaccagcagatggtcgacctcaacgaccccgccggcgcgctccagttggtgggccgcctgaagaacccgatcgccgggttctgagctgagcccggccgccggaccacggcggcctcccgaccggtgagcgcccggggacggtcccccgggcgctcaccttcttccgctcggcgcggagacgggctggcagaatcgcggacatggcagaaatcatccagcgggacggaacgtggacgttcgacggggacaccgtgcgcatcgtgccggggggaaaggcgcacccggtccggcaggagctgggtgagatagccgtacccgtacaggcggtggcgggcgtctcgttcgaaccggaccgcaagggcggacggctgcggctgcgtctgcgcggcggcgcctgcccggtcctgcgggccgccgacggccggctcaaggacggcgtcgacccctatgcgctgaccgtggagaaggaccgcacgggggtcgcggagtacttcgtcgacgaggtccgcaacgcgctgctgatcgagcaggtgccggacggccccgtggaccgcttcctgctgcccggccccgcactgccggtctccggcgggggcggcgacgggacggcgtccttcgacggcgagagcgtccggctgacctggaactggaaggccgaggagtccaagaccgccggggggccgtccactttcccgctgtcgcggatcgcgggcgtgcggtggctgccctcgatcgggctggagaacggctacctgcgcttcgagccggtcgagggagccgtctccactccgccgaagtacgacccgtacgccctggacctgtgggggatctccaagaaggagcacaccgcggtcctggtcgcggcggcggtgctggtgcggctgcccggggtccgtgcggtgccggccgccccggaggcggccccggctctgccgaaggcggccgggccggcctctgccgtcccgtccgccggcgaccacgacacgctgctgcggcggctgcgggagctgggcgagctgcaccgggccggggtgctcaccgacgaggagttcagcaccgcgaagcaggccgttctgcgcagcatgtgacgcgatcggacggccctccccggccctcctgcccgattccgggcagatttcttgcataagtgtgccccggcaagcaatatcgacgggtgcttgaacgccgctcgtcgcacgacgacctcatcgatcacctcgtacgctccaccgcgctccagcgcggcgaggcggcccgggtgatcctcgacgtgctggcgtacttcgacgagagcaccgacgacttcgtccggcgccgccaccgcgaactgcagtccggcggcctggtcaacacggagatcttcgagcggatcgcggccgagctgccgcaccgcgccgtggcgccgccggagctctcgctccgccagctgcgccgcatcgtctacggctgagcgggccgggcgcccgtgcgcggggcgccgaacgcatgcgtgtacgtgtacgtcgatggaggggcagagaatcatgtgcgggatcgtcggatacatcggaaggcgtgacgtcgctccgctgctgctggaaggcctgcagcggctggagtaccgggggtacgactccgcgggcatcgtcatcaccggcaaggccgcggcgggcaggcccggcgcgctcaagatggtcaaggccaagggccgggtccgcgagctggaggccaaggtccccaagcgcttcgccggcaccaccggcatcgcccacacccgctgggccacccacggcgcgccgagcgacgagaacgcccacccgcacctggacgcggagaacaaggtcgccgtcgtccacaacgggatcatcgacaacgcctccgagctgcgcgccaagctcaccgccgacggcatcgtcttcctctccgagaccgacaccgaggtgctggtccacctgatcgcccgcgcccaggccgacaccctggaggagaaggtccgcgaggcgctgcgctcggtcgagggcacctacggcatcgccgtgctgcacgccgacttcaacgaccgcatcgtggtcgcccgcaacggctccccggtcgtcctcggcatcggcgagaaggagatgttcgtcgcctccgacgtcgccgccctggtcgcccacacccgccaggtcgtcacgctggacgacggcgagatggccaccctgaaggccgacgacttccgtacgtacaccacggagggttcgaccacgacggccacgccgaccaccgtggagtgggaggccgagtcgtacgacatgggcggccacgacacgtacatgcacaaggagatctccgagcaggccgacgccgtggaccgcgtcctgcgcggccggatcgacgaccggttctccaccgtgcacctgggcggactcaacctggacgcccgcgaggcgcgcggggtgcgccggatcaagatcctcggctgcggcacctcctaccacgcgggtcagatcggcgcccagctgatcgaggagctggcacgtatccccgccgacgccgagccggcctccgagttccgctaccgcaacccggtcgtggaccccgacaccctgtacatcgcggtctcccagtcgggcgagacctacgacgtgctggcggccgtccaggagctgaagcgcaagggcgcccgcgtcctcggcgtggtcaacgtggtcggctccgccatcgcccgcgaggccgacggcggtacatacgtccacgcgggcccggaggtctgcgtcgtctccaccaagtgcttcaccaacaccgtggtcgccttcgcgctgctcgccctgcacctgggccggatccgtgacctgtcggtcgcggacggcaagcggatcatcgacgggctgcgccggctgccggaccagatcagcgagatcctggcgaacgaggacgagatcaagcggctcgcggcggagtacgcggacgccaagtcgatgatgttcatcggccgggtgcgcggctatccggtggcccgcgaggcctccctgaagctgaaggaggtctcgtacatccacgccgaggcctacccggcctccgagctgaagcacggcccgctcgcgctgatcgagcccgcgatgccgaccgtggcgatcgtgccggacgacgatctgctggagaagaaccgcgccgcgatggaggagatcaaggcccgcagcggccgcatcctcgccgtcgcccaccaggtgcaggagaaggccgaccacaccatcgtcgtgccgaagaacgagaacgagctggacccgatcctcatgggcatcccgctccagctcttcgcgtaccacacggccctcgcgatgggccgcgacatcgacaagccgcgcaacctggcgaagtccgtgacggtcgagtagacggccgcgcacagacgttgggccccgtaccgtcacgaagacggtacggggcccaacgcatgccgctccagcgccttctggcggtccctcaggaagctcggctccgctcgggcgtcccgcccgcccgggccgttcagggaatgacgatgacggggcgttgcgcgcggcgggcgaggcggccggccacggacccgaagatccggccgacgatgccgtgcgtggagcccacgacgatggcgtcggcggcgtactcccggccgacctcctccagctcgtggcagatgtcgccaccgcgctcgacaagcacccagggcacctcggagaggtaatccgcgcaggccagctccaggccgaggacctcggtgcggtgatcggggacgtcgacgaagacggggggctcgcagcccgcccagaccgtggtcggcaatcggttggcgacgtggacgatgatcaggccggagcccgagcggccggccatgccgatggcataggcgagagcccgttcactcgacgtggagccgtcgaaaccgaccacgactccgtgccggaaggcgggatcgcacgcatggcgtgcttcttcgaccgtccgcggctccgaccctgggtcggctaccggcttgcggtctttgggttcagggatttcgtgaccggccatcggtgtctcggcgaagagagtcctcgtgaggagggaaacggtttcgagaggtgcatcagctggtggtgaagctctgtccgggaatcatcttcccaaccccatacccccaagggtacggcgtcactcctccaccgcccagacccccgcaaaagcgtgcgcgacgctggagggagcatgcccgagcctgtccgggatggcaatgccggttgtgtcgtacacgggcctcggagggggcgaacacggtcggccgtcctgtttttcgcgacggccgacggtcaccccgcgcacccggcggcgggggccgcgcccggtccccgttggccacgccgtcaccgggtcatcacccctggacatgacgccgcgacgagccggacgcgatcctcgttcgagccgagcccggcgacggcgcccggacggacggacggcgcgtccctccgggcagtccccgatcaccccgcgacgcccgcggttctcgtgccccacggcccatcggtcggtaatgcggccccctgggaccgcggcccggtccacaccgcggcggcctgccgcatccctcctcggcggtccgaacacgccatggttcacggggggcgagggagcgcaccggcgcggccgtcacgcggcggttgtgcgcccggcgtgaccagatacagcacacacaaccgatggatttaagccaacttcacctgggtgccgaacccttcgcgggatggccggacaccccaccgcccaccaggcaggaacggaccgcgcggtacgctttcacccgacgcggacgggccacgttgtcgaagggcacttccctgtgcgcttcgcgggtgaaacgcttcgtgatcgaacgcttcacgccacgtttccttatcgacattgagctggtgggggaaggtgtcacggcgggaccacgcgacgcagtagattcgatcttggaaatcggagactggggacacgtgcgacaccgaggggaaacgtgcaggagcgacaggcccgtaaggaccagggagacgcgaacaccgaggggggcttagcgtcatgagccaggactccgccgccgcgacggaggccgcacgcaagctgaccgggcggcgacgccgggaagtcgttgccgtgctgctgttcagcggcggccctatcttcgagagctccatcccgctctccgttttcggaatcgaccggcaggacgcgggagttccccgctaccgcctgctggtctgcggcggcgaggaaggaccgctgcgcaccaccggtgggctcgaactcaccgcgccgtacggcctggaggcgatcagcagggccggcaccgtggtggtgcccgcctggcggtcgatcacctcgccgccgcagaccagc

SEQ ID NO: 2879 - DNA, 6772 bp, Unknown
  Kingdom: Bacteria, Phylum: Actinobacteria, Class: Actinobacteria, Order: Streptomycetales, Family: Streptomycetaceae, Genus: Streptomyces
cggcggtccgcgctcgatcctcgcccggaccgccgaggtcgccgagtgactgaccgaggttttcggccccaacgccggggaccacggcgacgaagccggctgcgggcacgcgggtcacgaccaccgctgacgtgtcccggggcgtcggagcggcgggggttcagccgttccgacgcgccccggcggcgcgggcgtcgggcccggccgtacgcgacgcggcgcgggccgctcgcgcccggggcagatagcgcagcctctccgggaggacggggacgacgacgcgcagcaccgcacacatccggcgcagccgcttctcctggtccgggctccacggcaggccgatggccgtgcgggcgtcgggcggcatgaacccgatggtgacgaaccggcggaagcgggccagcggcggcagcagcaccggccacagcgcccgcagcagcagccggagcggccacggaccccggtccggcggcgggacggactggtcggtggcgacgagttcccgcacgacggcggtcgcctcgatccccccggcgagcatcttctcccagtacggccagaagtcctcgatggtctgcggcatgtcccggtcgtggatgcccaggatccggccgacccggagccattccgcgtacagggcacgctcctgggcggggctcatgggacggatcagatagcgggccgcgtgctggtacaccgggaagccggtggcgtgcacccaggcgtagttggcgggtgtcagggcgtggtagcggcggccacgggtgtcggtcccctggatggtgcgatgcagcacccgcagcctgcggccctcctcggcggcctccgcaccgccgtagacccagagctggagcgaacgcagcgaacgttcaccgcgcccccaggggtccgtacggaagacggagtgctcgtcgacaccggcgccgacggccgggtgggcgacctggagggtgagggccgcgggcagcatcagcagggcgcggatgtccccggacaggctccagagcaccccgccgggcggaggcggctcggggttcttcgcttcggtcgcgccgctcatccgtgctcccgcggtcccggcgggcctgccgtgtgctgcccgtccccttcctctccatgatccctcgctcgcgggagacccccggcggcgggtccgggaccgccggccgcggtcagtcgtggtcgtacaccgtcaccggaatgccggcggatatcaggcgtcgctcgatcagcggctcgatcctggcccacgtgccgcccgcgagcccgcagccgatccggggcatatggaccgaggcccccagctcgcccgccctgacggccaccgcgtcgagcgccgcgtcgatcgcctcgtaccgcacgggcacccccttgctgccggtgcgcataccccgctggccgaccatgttggccacccagaggtagggccccacctgcacgaactgcgccgaccccagggcgaagtcgttggccgcgcgctcccggtgccagcgccggtaggcggcctcgggctccggccagcggcgggagagggccaggacgaaaccctttccccagccgccgaggtcgttgcagacgtggacgatcagcttgacacccttgccctggggagcggtggcgtccccgcgcacatagttgatctccgacatgacctcaccgtacgggccgccactgacaacgggtccggggtggacggcggggcgatggtgccggagactttcacagtaatggtgagacagcggaactgtccgatacgagggttcgacggcggggagcagagatggcgacggggaccgacgagccgacgctcacggtggacgagctggcggcgcgtgccggggtcaccgtgcgtaccgtgcggttctacagcacccggggcctgttgccgcccccggtcatcgggccccgccgggtcggacgctacgggccggaccatctctcgcggctcgcgctgatcgaggagctccagcagcagggcatgacactggcggcgatcgaacggtatctggaacagctgccgcccgacctgagcgcgcaggatctggcgatccaccgcgccctcgtcgcctcctgggcgccggacaggaccgaggacctctcccgggcagagctggagcgacgggccggccgggtgctgtcggagccggacgtggaacggctggcggcgatgggggtgctggtgcgaccgcaggaggccggcgggacgtaccgggtggatctggggctgctgcggctcggggtggagctgctggacgtgccgatcgcgcacgagacgatcctggcggcgcggaccgttctgctggagcacacccgatcggccgcgcaggagatgacccggctgttccgggacgaggtgtgggacccctaccgggagcgcgagggggacccggagcatgtggcggcgatgaagtcgctgtccgccgacatgcaaccgatcgtggtgcaggcgctggtgacggcgtttcagcgctcgctgcgggaggaactgcgggccgcgttcaccgccgagtgacggtgaacgcggcgcgcgagcgcctcagtcgtggaaggtctcgcccttctcggccttctccacgagcagcgcgggcggcaggaagcggtcgccgtagcgctcggcgagttcccgggcgcgggccacgaagccgggcaggccgccctcgtacccgttgatgtactggaggacgccgccggtccacggcgggaagccgatgcccatgatggagccgatgttggcgtcggcgacggagatgaggacgttctcctccaggcagcggacgctgtccagggcctcggagaagagcatccgctccttcatgtcctcgaagggcacatcggcgtcgggcttcgcgaagtgctcgcgcaggccgggccagagaccggcgcgcttgccgtcctcgtcgtagtcgtagaagcccgctcccccgctgcgtcccgggcggccgaactcgtcgaccatgcggtcgatgacctcgtcggaggggtggtcgggccaggtgccgccggcctcctccaccgcgcgcttcgtctcgttgcggatcttgcgcggcagggtcagggtcagctcgtccatcagggagagcaccttggccgggtagccggactgggcggcggcctgctcgatcgacgcgggctcgacgccctcgccgaccatggcgacgccctcgttgatgaactggccgatgacgcgcgaggtgaagaaaccgcgcgagtcgttgacgacgatcggcgtcttcttgatccggcggaccaggtcgaaggcgcgggcgagcgcctcgtccccggtgcgctcccccttgatgatctcgacgagcggcatcttgtcgacgggcgagaagaagtgcagcccgatgaagtcgacggggcgcgatacgccttcggcgaggaccgtgatcgggagggtcgaggtgttggagcagagcagcgcgtccggctcgatgacgtcctggatctcctggaacaccttgtgcttgagggcggtgtcctcgaagacggcctcgatcaccgcgtcgcagcccgcgaggtcggccgcgtcgccggtgggggtgatccgggccagcagttcgtcgcgcttcgcctcggtcgtacggcctcgggagagcgccttggcgagcagtttcccgctgtacgccttgcccttggcagccgcttcggtggagacgtccttgaggaccacctcgatgccggccttggcgcaggagtaggcgatacccgcgcccatcatcccggcgccgaggacggcgaccttgcggacgggtcgctcggggatgtccttggggcggttggcaccggagttgacggcctggaggtcgaagaagaacgcctggatcatgttcttggagacctggccggtgaccagctcggtgaagtaccgggcctcgatggtcagggcggtatcgaagtcgacctgggatccctcaacggccgccgcgaggatgttgcgcggcgcgggcatcggcgcgcccgcgagctgcttcttcaggttggccgggaaggcgggcaggttggcggcgaagcgcgggttggacggggtgccgccggggatcttgtagcccttgacgtcccagggctgctgggactcggggtgggcgtcgatgaaggcgcgggccttctcggtcatctcctcgcgggtggcggcgacttcgtggacgagcccgttctccagggcgcgccggggcgtgtactgcgtgccctggagaagcaccttgagcagggcgtcggcgatgcccatgaggcgtacggtccgggtgacgccgccgcccgcagggagcaggccgagggtgacctcgggcaggccgatgcgggagccgggggcgtcgagggcgacgcggtggtggcaggcgagcgcgatctcgtaaccgccgccgagggccgccccgttgatggcggcgacgacgggcttgccgagggtctcgatgcggcggagcgaggccttgatcgcgttgccggcgtcgaaggcgtcctgggcgttctccgggccgaccttgatcatgtccttgaggtcgccgccggcgaagaaggtcttcttggcggaggtgtagatgatgccgcggatggagtccttctcggcctcggcgcggtccgcgacggccgcgatggagtccttgaaggcctggttcatcgtgttggccgactggttggggtcgtcgaggacgagggtgacgacgccggtctcgtcctgttcccagcggatggtcgtgctctcggtcatgtcggtgtcttctccgtaagcgggtagggccggggacaggtcggtcagacgcgttcgacgacggtggcgacgcccatgccgccgccgacgcagagcgtgaccaggccgaaccgctggtcgcggcgctccagttcgtcgatgacggtgccgaggatcatcgcgccggtcgcgccgagcgggtggccgagcgcgatcgcgccgccgttgacgttgaccttgtccagggagaggcccatgtccttgacgaagcgcaggacgaccccggcgaaggcttcgttgatctcgacgaggtcgatgtcgtcgatggtcagcccggccttggcgagcgccttgcgggtggcgggggcggggccggtgagcatgatggtgggctcggaaccggagacggcggcggagacgatgcgggcgcgcggggtcatgccgtagcgctcgccgacctcctgggagccgatggcgacgagcgacgcgccgtccacgatgccggaggagttgcccgcgtggtggacgtggtcgatcttctcgacccagtggtacttctggagcgccaccgcgtcgaagccgcccatctcgccgatgcccgcgaacgagggcttgagcgcggcgagggagtcggcggtggtgccggggcgcaggtgctcgtcgtggtcgaggacgaggaggccgttgcggtccttgaccgggacgacggaacgggcgaagcggccgtccttccaggccgcggcggcgcgttcctgggagagcgcggcgtactcgtcgacgtcgcggcggctgaagccctcgatggtggcgatgaggtcggcgccgatgccctggggggcgaagccggtctcgaagctggtcatcgggtccatggcccaggctccgccgtcggagcccatcggcacccgggacatcgactcgacgccaccggcgaggacgaggtcctcccagccggagcggaccttggcggcggccaggttgaccgcttccaggcccgaggcacagaagcggttctcctggaccccggcgacggagtcgggcaggccggccgcgatggcggcgatgcgggcgatgtcggatccctggtcgccgagcgggctgaccacgccgaggacgatgtcgtcgatggcggccgggtcgagatccgggaagcggccccggatctcgtggatgaggccgacgaccaggtcgatcggcttggtcccgtgcagggcgccgttggccttgccgcggccgcgcggggtgcggatcgcgtcgtagacgaatgcttcggtactcaagacagctgcctttcgagggtggttgtcggcccgggtgacgggcggctcaggcgagcagcgagcggccgatgatctccttcatgatctcggtcgtgccgccgtagatggtctggatacggccgtcggtgaaggccttggcgaccttgtactcgctcatgtagccgtagcctccgtggagttggaggcagcggtcggcgacgcgcttctgcagttcggtggcccaccacttggccatggaggcgtgcacggcgtccaggacgccgtcggagtggtcgacgatgcatcggtcgaggaaggtccgggtgacggcgcactcggtggccatctcggcgatctcgaagcggatgtgctggagcttggagagcgggcgtccgaacgcctcgcgctccttgacgtaccgggtggtgatctccagcaggtgttcggcggcggcgatcccggcgaccgctatgcccatgcgctcctgggccaggttggtcatcaggtggatgaacgcgccgtcgagctcgccgaggaggttctccttggggacgcggacgtcgtcgaagaacagttcggcggtgtcctgggacttctggccgatcttgtcgaggttgcggccgcgctcgaagccctccgccccgcgttcgacgacgatcaacgagagacccttggcgccgccgtcgggagtggtcttcgcgacgacgacgaccaggtcggcgaggatgccgttggagatgaaggtcttggagccgttgagcagccagtggtcgcccctgtcctcggcggtggtgcggatgccctggaggtcggagcccgcgcccgg

SEQ ID NO: 2880 - DNA, 5730 bp, Unknown
  Kingdom: Bacteria, Phylum: Actinobacteria, Class: Actinobacteria, Order: Streptomycetales, Family: Streptomycetaceae, Genus: Streptomyces
tgctgccgcaccggctgcccgcggcggcacggcggcagattcccgacgaccagctggccatggccgagtcgcagccttccggggtccgactggcgttccgcacccgggccaccgccgtggagctggacgtggtggccaccaagagggtctatcccggcgcgccgccgcgccccgacggcgtgtacgagctcctcgtggacggccgccccgcggcccgggccagtgcccccgacggtgacacgctcaccatcgatctggcctccatgacctcgcagacccggcccggccccgtggaaacactccggttcaccgacctgccggacgaggagaaggatgtcgagatctggctgccgcacgacgagaccgcacagctggtcgccctgcgcaccgacgcgccgctccggagcgccgggcagagtggccggccggtctggctgcaccacggcagttccatcagccacggatccaacgccaccaccccgaccggcacctggcccgccctggccgcgaacctcggcgaagccgagctgatcaacctggggttcagcggcagcgccctgctcgacccgttcaccgcacgcgccatgcgcgacacccccgccgacctgatcagcgtcaagatcggcatcaacctcgtcaacgccgacctgatgcggctgcgcgccttcggcccggccgtccacggcttcctcgacaccatccgcgaaggccaccccaccgcaccgctgctcgtggtctcgccgatctgctgccccatccacgagaccactccgggccccagcgccccggactacagcgcgatgagcgaggggcggctccggttcgtggccatcggcgaccccgaggagagcgccgccgggaagctgaccctcaccgtcatccgagacgagctggcccggatcgtcgcacaacgcacgcccgccgacccccatctgcactacctcgacggcctcgacctctacggcgagagcgaccacgccgaactcccgttgcccgacgacctgcacccggaccccgccgcccaccggcgcatcgccgaacgcttcgcccgcctcgccttcggtcacgacggaccgttcgcaccgggcagccggtgacgccggggcgggaccgacgcgggcacgggggcgcggaggagcggtgagccgtccgcgcccgtccgcacccccgtttcgggtggcacggaatcagggagcccggtcaccccgttcccgggttccggcggtgggccggccgggaacggcgtgaccgagcgccggttcaggacgaggccggcacctcgtgtgtcccgtacgaccggttacgaggcgtccaccaggacgcgcccgtcagccggcacgcgcggggcgaggccgcccgcgtaggcggactcgacccgggactgctcggccgcgttcggcagggcgttcttgcagctgattcccgcgctggatcccgacatcagctgggagcaggggccgggcttggtgtccggcagcccgaggctgtggccgatctcgtgagcggcgatacgggtcttgtcgtggccctgggcgaccgcctggctgcccagttccaccctgacctggccgccgggccggaccgggccgagtgtggcctgcggccagccgctggtggccacgatctgtatctcggcacgcgtgccgggtgcggcctcgaccagcttgacgttgtcgacgttggagttccacgaggcgaccccggccgcgatctccgcctcccagccgccggcccggctgtcgtcgtaccggagcgtcaccaccgccgacgcaccctccgccgccgggttcggcgcgggagcggcctgcgccgccgtagctgtggccagggtgatcgccgcggcgacaccgactgccttgagccatctggattccagcattgctgtcccttcactcatggggggctcggctccgcgcggagccgagggagtgggagggcggtcaccgcgaaccgtatggacgcaagggccggttgccgatcctcccgggccgcaggacctatgccgcgatcgcggcttgatcatgcccctgtcatgcaaatgaggccggaaatgcaccctggcgggatcttcggcccgggcctttcgccccatcgggtcgcccccgccaccctgccgccgggcatcgtcgccgtcgggggcatgttccgtaccctgagggcatgcgcatgcgacccaccctgagctggacctccgccgaggagccaccgccggccaccacggacctggagccggtcgtcgaggcgctgcgcggtggcggtgttctcgtcctgagcggtgcgggcatctccacggagtcgggcatccccgactaccggggcgagggcggcagcctgagccgccacaccccgatgacctaccaggacttcaccgccgacgccggagcccgtcgccggtactgggcgcgcagccatctcggctggcgcacgttcggccgcgcccggcccaacgccgggcaccgggccgtggccgctttcgggcggcggggtctgctctcgggtgtgatcacccagaacgtcgacggcctgcaccaggccgccggcagcgcggacgtcgtggacctccatggccggctggaccgggtggtctgcctgtcctgcggagccttcagcccgcggcccgagctggcgcagcggctggagcaggccaacgaggggttcgcgccggtggccgcctcgatgaacccggacggtgacgccgatctcaccgacgaacaggtcggggacttccgcgtggtgccctgctcggtctgcggcggcgtcctcaaaccggacgtggtgttcttcggcgaggccgtgcccccgcagcgggtcgagcactgccgtgagctggtccgcggagcgagcacgctgctggtcctgggctcctccttgacggtgatgtccgggctccggttcgtccgccaggccgaccgggccggagtgccggtgctgatcgtcaactgggacccgacccggggcgaccggcatgcagtgacccgcatcgccctcccgctgggtgacgccctcaccaccgcggccgcccggctcggcgttcccgtcgacgtcgacgggacgaccgggtccgggcgagccggcggggcgtcacccggctctaccgggcgaacttcctcaggtcctccgccagcgagctgatggccgcgggattgcgcgggctctcgaccagatccacgtagtcgagaacgacgatccggtcgttccgaatcgcggatacgccggcgagcggcttgtaggacttcaggaacctccgcttctcgtccgctccggtgtcgccgtagtcgttgatgacgatgacctcgggatcgcggtcgaccaccgtctcccagcccaccgtcgtccagctgtccttgaggtccttcatgatgtggtcgccgccggccttggtgatgatgtcgtgcggtcctgcgtacgcgcccgaggtcagcggcttgtccttcccgtcgtcgtacaggaagacacggaggcggtcgccgccctcggccgcctccgcccgtgcgtcggcgacctccttgcggaacgacgtgatgagggtgtccgcccggtcctcgacatcgaagatctttccgaggttccgcaggtcggtgtagagcgcttcgagcgggggcatgactccgcgggccttgccctgcccgttgcggcacgactcgctgagcagatacgagtcgatgcccacgcgctccagttccgcgggggtgaacccctccccctcgttgaatccgtagttccagccggcgaagaccaggtcggcgcgggcttcgaggaccagctccttgttgatccgctccttggagagccacttggtcttcctgtaaccgtccttccaggggacggacgtcatgtcgcccttgtcgtcgggcatgacgtacccggccatgtggtcctcgagtccgagggcgaacatgatctcggtgatgccggtgtcgttggtgacgacgcgctgcggggccttggcgtacgtcttcctctccccgcagttctcgacggtcacggggtagtggcggccggcctcggacgggcggtccttcccgtcggcctgtgaggtgacgtccgctccgcagccggtgagggacagggcggccgcgagcacgagcactgcgggacgcagggggttgagcatggtggtccaggctccttcaggaggtggtgcgggcaggggggaggtcgaagagcagttggagcgcgccggtctccgggtgcgcgacgcggtgcgcccgtacgccgaagacgtcggccagcaactcggtggtcaggacagcgtgcggggccccggaggcgacgatccggccgccgtcgatgacgtggagcaggtcgcagtgcagggccgccagattcaggtcgtgcagcgcggtcagcacggtcaggccgctgtcgcggaccagggcgaggacctccaactggtgggcgatgtccaggtggttggtgggctcgtcgagcaccaggatccggggctgctgagcgagggcgcgggcgatcaggacgcgctgccgctcgccgccggagagggtgaggaagccgcgttcggccaggtgtcccgcgccgacccccgccagcgcctcgccgcagaggcggcggtcctcgtcggatgtccgggccaccggtccctggtgcggcagacgtcccatggcgacgatctcggcgacggtgaagtcgaattcggcgaccgcgtcctgcggaagtgcggccagtcgccgggcaccctcccgggcgctcagggagtggaggtcctcaccgccgatcctgacgacgcctgacgacgggcgcagggcccggtagacgcagcgcaacagggtcgacttcccgctgccgttgggaccgaccaggccgacgagctgcccgtcggccgcgcccagggtgacctggtccaccagccgtgcaccggcgatctcgacggtgagcgcgtcgatgtcgatccgcatcagacgcctccgaaggagtaggcgcgccggcgcatgaggaggaggaagcagggaacgccgatgaccgcggtgagtacgcccaccggcagctcggccggcgccagcaccacgcgggagaggatgtcgacccagatcagcaggacggctcccgcgaggggtgcgacggccaggagccggcggtggtcggcgccgaccagcatccgtgcggcatgagggaccatcaggccgacgaaaccgatcgccccgctcaccgcgacgaccgctccggtgacggccgcggagacgaggaagagttccttgcgcagccttccgggatcgaccccgagcgcggcggcggtctcgtcccccatggcgagggcgttcagccgccgtgccgaccagccgaggtgtgcgaggccggcgagaacggctccggcggcgatcggcacggccgcccagttggctccgctcaggctgccgagcagccacatcatcgcggagcgggccgcttccccgcgctcggccgcgaacaccatgaacgtggtgacggccgagaagccgtagtacatcgcggtccccgagaggacgagccgcagcggggtcagtccgcgttcggtgcgggcgaccgcgtacacgagcagcatggcgaggagcgcggagaggaacgccgccgtggacagggcccagatgcccaacgctcccaaggccccgaagatgagcacggcgttggcgccgaccgccgcgcccgaggagatgccgagcacgaacgggtcggcgagcgcgttgcgcaccagggcctggacggcgacgccgatggcggacaggccggccccgacga

SEQ ID NO: 2881 - DNA, 3854 bp, Unknown
  Kingdom: Bacteria, Phylum: Actinobacteria, Class: Actinobacteria, Order: Streptomycetales, Family: Streptomycetaceae, Genus: Streptomyces
tgtgcacgtctccgtcggcctcgcggccgacggagacgtgcacaggagcgggtggtgcggggccgggacgccgtgggctccgggcatggtgacccgccggtcgcgaagtcccgaggattccgggcgcggggtgggtgcgtgaagtggtctcacggaatctccccaggtgacacgccgggcatgcctgcgtggcaggatgagcgtgtcgcgcagaccgctgcggaccgtacggcagagggaaggaacggacccggcgttgagcgagaatcagaacctgctcgcggagcagcgacgtgcgctgatcctcgacgaggtgcgcaggcgtggtggggtccgagtcaacgagctgacccggaagctgaacgtctccgacatgacgatccgccgggatctggacgcgctggcccgccagggcgtgatcgagaaggtccacggcggcgcggtcccggtcgtcgaggcgagtacgcacgagccggggttcgaggcgaagtcggcgctggagctgagcgccaaggaggacatcgcgcgggcggcggcggcgctggtgggctgaccgggggttgccggaagcgggtcagccacggtggtgcgcggtcacgacatgccggagcccgcggccggtcggcggccgcgggctccggtacgggtgggtggcgccggtcagtcggagggacgcttctccgtggccgtggagccaggaccggtgggatcgggcttgtggcgctcgtccgtgatggtcgtggccccggggccgatgcggatctcgaagtcgccgtcgtacttggcgtgcccctcgatcaccgcggactcaaccgcctccacgccgaactcctgccggacgatctgcgggtccttgcgcagatcccgcatcagggccacgcacatcccgatcatcacgatggtgaacggggcggcgaccagaatggtgaggttctggagccctgcgagtgcgttgtcctttccgtcgccgatgaggagcatgatcgcggccacggccccggtcacgacgccccagaagatgacgacccacttgctcggttcgaggacgcccttctgcgagagggtgcccatgacgatggaggcggcatcggctccggagacgaagaagatgccgaccaggaccatcaccagaatgctcgtgagcgtggcgatcgggaactcctggaggacgccgaacagctgcgcctccggggtgtcggcgccggtgagcttcccggcctcgtccagcttcatggccgagccgccgaagacggcgaaccagatcaggctgacggtgctcggcaccaggatgacgccgccgacgaactgacggatcgtgcgaccgcggctgatgcgggcgatgaacatgccgacgaagggcgtccaggagatccaccaggcccagtagaagaccgtccagctgccgagccagtcggcgacgtcaccgccgccggtcgcctcggtgcggccggcgagctgcccgaggtcggtgatgtacgcgccgagtgacgtgggcaccaggtcgagtacgaagatcgtgggaccggcgatgaagacgaacacgacgagaagcagggccagcaccatgttgatgttggacagccactggatgcccttctcgacgccggagaccgcggaggcgacgaaggcgacggtcagcacggcgatgacggtgacgagaagtccggtgccggccttctccagccagtccagctcctggatgccgctgccgatctggagagcgcccaggcccagggaggccgcggagccgaacagggtggcgaagatggccaggatgtcgatgacgcggccgacgccgccgtaggcatgacgcttgccgatcagcggttcgaagaccgcgctgatcgtctgccgcctgcgcatccggtaggcgctgtaggcgatggcgaggccgaccacggcgtagatggcccaggggtgcagcgtccagtggaagagcgtggtggccatcgccgtctgcatggcttcggccgagtcggcggggtcggtgcccggcggcggggtccggaagtgggcgaggggttcgctcacaccccagaacatcagcccgatgcccataccggcgctgaacatcatcgcgatccaggaaatggtccggaactccggagcctcgccttcctggcccaggcagatcttcccgtaccggctgacggccagccacagggcgaagatgacgaaggccgacgcggccagtatgaaggcccagccaccgttgtggatcagtcccttgagcagtttgccggagacgctctccagggagtcggtggcggtcgcaccccagacgacgaaggcaagcgtgaggaccgccgtgacgccgaacaccacccgatcggtggtcggggtcctggtactgagcggttcggggggaaggtccgccgtgaccgccagcacttcccgcccgtccgttgtctggtcgtcctgggacacaaatggcacctttcactgagtccgaaaaacgctctccgtaggcagtaccacacctgccccggatctcgaaggatcaacaagcagttctggcttgaccgtttatgaggtgatatgtcgcccgctgatcgagaagcagcggaattatgcgtcgagccgactggcgcaacggcacgaatgcgccaccttcctccggacgggccgtgacgccgtgcagggccagctcgtccttcaccgccgcgtactgggccgcgtccagccggtagccgcacggcgggtcggcgaggatctcggcaggctcggccgggtcgttgtcggcgccgccgaggtagacgggtccccgatccgcgaggccggtcagtcgcgagagcgcggtggccgtccagagccgggctcgctgctcgtcggtgaaggcgaagagaccgccgagcgcggtccgctgggagtggaccctgcgccggtggttgagcgcctgatccgccttctccgcgtcgctcagcgcgtcgacccgggattcgatgagcaggccgacggcgtgtttgaggccggaggtgttgcgcaggatgcgctcctggccgtcgccggcgacctgcttgacgggctccccggtggccgggtcggtccagatgccgtagtggccgctgctgtagccacccgccgtcgcggcgggacggacgtaccgctcggagagggtgcgcgagacgtcgtggacccggtcgtcgacgttcaggttccgcggccacagcgcgaacaggtccttgtcgtagtacggcggggtcgcgccgtactcgtgcaagtcgtagatcacctggggccgttcgtcgcgtacgacggcggcgacggtccgcgcctcggcggtctccagggcgatgtggtcgcggttgacgtcgaccccgtcggcgttgccgcgggtgtcggcggcgcgcccgtcggggttggccgtgggcagcaccagcagggtcgtacgggccaggaaggcgcgggtggcccggtcctcggcgaacgccaggtcgcggatggtggtcagacaggcctcgcgtccggcgggctcgtccccgtgctgactgcagatcaggagcaccgtggtggtgccgggtcgctcctggccgacgcgcacgagccgcagcggccggccctgaccggtcgtgccgacgcggtccacggagacccggtcgctcccccggtccaccgcggccaggaatgaacgctcctccgcctcgccggtccagcgggccccctcgctcgtctcgaacccggtgcggggcgggcggtgagcggcctcggccggtgcgatggcgaacgggagggccagtccggcgagcgtcgccgccacggccgtccggcgcgtcacccgcgctccgcggcgcgcggactgcgaccgggcggggccggcgaccggcgcgagccacgggtgcgggctgagcacgcgg

SEQ ID NO: 2882 - DNA, 1191 bp, Unknown
  Kingdom: Bacteria, Phylum: Actinobacteria, Class: Actinobacteria, Order: Streptomycetales, Family: Streptomycetaceae, Genus: Streptomyces
ctggccggcctgcgccttcgccgtctgcttgtccgggtcgaaggcgggtgcgccgcgcaggatcggctcgccccagcggatcacgacgttctgggcgtacccgtcggggatggtgaccttgtcgtccttgttgggcgcgaccggcgagaaccgcaggccacgcgcgccggacggggccggtttgtgggggtggcccggtcggtgaccgtgcccggcgagcgcggcggcctcggcctgcggggcgctcgggccggtcaatgccgcggtaccggcggcggtggcgacggtgaccacggcggcggcgcgcatcatcgagcggcgcgacacggcaccggcgatgatgtcgccggcgtactcgttgtcgctgttgttgggcgtctccttgaagcaggcgtccccgcagcggaagcggcaggtcagcgcggaacgcccaccgggatgcgagctgatgaacggcagcagattgcgcacgtggattccctccgtctggtgtcgtgcgtgacggtatgtgtgcctccacgcggtccgagggactcccggtgaacggcgggtgaagtccgggccaccgctgtttccttgagggctggtggtggacaccgccgcggactcggtccgggaacgttttcggctcggttgacgcagcggtgggccgcaccggcgaacggccggatccggccgctaaccttacgtatccgtcctggccagggatgaattcacccaggtcggacattcaccgcacccaactcatgcgaaaggcctcgcccatgggcattcggagcttgctgcgtaaggtgttcggccgcacggagcaggacgagccgaccacggccaccgtcccgccccaggccgagcgcaatcagcccaaggagccggagcaggagaccacttcggcggccgagcccgcggcggagccgaaggcgtcgatcccggccccggcctcgccctcgtcctccgcctcgtcaacctccgcttcctccacggagacgccgtcggccgcgtccacggcgtcccccgccgccggctccacggagcgtgacggctcgctggccgccgacctggtggcggaggccttcgacaaggcggccgccgcgccgacgtcgccgaccgtccccgcgcagaagtcggccccggaagacgctccgcaggcggagaagcccgaggcgccggtgaccgccgaggaagccgtcaagg

SEQ ID NO: 2883 - DNA, 4026 bp, Unknown
  Kingdom: Bacteria, Phylum: Actinobacteria, Class: Actinobacteria, Order: Streptomycetales, Family: Streptomycetaceae, Genus: Streptomyces
tggcgcgtggctgtccggaccgtccggacagccacgcgccactcagccagggagcccagggagctgtcaaccgcctggtcggtatccggactcttgacccccgggggcccggacacacaggatcacgccatgacaggtgtacgcagcagcacagtcgacggagtcctcacccgcagcgcccggcgcacccccggacggaccgccgtgcggtacgccgcccggagctggacctaccgctccctggacgccgccgtctccacggccgccgccgtcctcaccgaggagcacgggctcgcccccggtgaccgggtggccgcctacgcgcacaactccgacgcctatctgatcggcttcctcgcctgcgcacgggccgggttcgtccatgtgccggtcaaccagaacctcaccggcgacgacctggcctacctcctcgaccagtccggctcctccctcgttttgaccgatccggacctcgcagggcggctccccgccgggctcccggtgcgcgcgctgcgcgacgcgcccggctcgctgctcgacgccctggagacggaacgggcgttcaccccgcagcgcccgcccgcctccgacgacctggtgcaactgctgtacacctccgggaccaccgccctgcccaagggcgcgatgatgacgcacggcgccctggttcacgagtacgtcagcgcgatcaccgcactcggcctcgccgcgaccgaccggcccgtgcactccctgccgctctaccactcggcccagatgcacgtgttcctgctgccctatctggcggtcggtgcggagaacaccatcctggacgcaccggacgccgccacgatcttcgacctcgtcgaagcgggtctggccgacagcctgttcgccccgcccaccgtctggatcggcctcgccaaccatccggaattcgccacccgcgacctcgccggactgcgcaaggcgttctacggggcttcgatcatgcccgtgcccgtcctggagcgactgcaaggacgcctcccgcacctggccttcttcaactgcttcggccagagcgagatcggccccctggccaccgtgctgggccccgacgagcacgagggccggatggagtcctgcggccggccggttctcttcgtggaggcccgggtcgtcgacgagaagggcgaggacgtccccgacggcaccgccggcgaggtcgtctaccgctcaccccaactgtgctccggctactgggacaagcccgaagagacagccgccgccttccgcgacggctggttccactccggcgacctcgcggtccgcgacgccgaaggcttcctgaccgtcgtcgaccgggtcaaggacgtcatcaactccggcggcgtcctcgtcgcctcccgccaggtcgaggacgccctctacacccaccccgccgtcgccgagaccgccgtcatcggcctccccgacgaccgctggatcgaggccgtcaccgccgtcgtcgtcctgcgcggcgaggcggacgagagcgaactcatcgcccacgcccgcgagaagctcacctccttcaaggcgcccaagcgcgtcgtgttcgtggaggcgctcccgcgcaacgccagcgggaagatcctcaagcggcaactgcgggacgagctggcctgaacgagctacggacgcggcctcctgttcggtgcgctgggccgaggcggtggggcccgggcggcccagccggccggaaggaacgggtgtcgcggtggtgtgaacggagcgccccggcctgccggggttgtcccttcgcacggcggcggcggcgcggcgaggaaggcgcggcgacggcgctgtgtgggtgtcggcgtgaggacggcagcgtgacgacagccctcagtccgtgccggactcccgcagatccacgatccgccggatcttgcccaccgagcgttccaacgactccgggtccacgatctcgacgttcaccgacaccccgacgccgtccttcaccgccgccacgatggaccgcgccgccgtctcccgttcgtcggccgtcgcgtccgcccgcgcctccgcgaacaccgtcagcgcgtcgagccgccggtgccgggtgagccgcagctggaagtgcggggcgaccccaggcgtacgcagcacgatctcctcgatctgggtggggaagaggttcaccccgcgcaggatcaccatgtcgtcgctgcggccggtgaccttctccatccggcggaacgtccgcgccgtccccggcaacagccgcgtcaggtcccgggtgcggtaacggaccaccggcatcgcctccttggtcagcgaggtgaagaccagctccccctcctcgccgtcggcgagcacctcaccggtgaaggggtccacgacctccggatagaagtggtcctcccagatgtgcagcccgtccttcgtctccacgcactcctgcgcgacccccgggcccatcacctcggagagcccgtatatgtccaccgcgtcgatggcgaaccggtcctcgatctcccggcgcatcccctcggtccacggctccgcgccgaagatcccgaccttcagggacgtcgaccgcggatcgacgccctgccgctcgaactcgtccagcagcgtcagcatgtacgacggcgtgatcatgatgatctcgggccggaagtcctggatcagccggacctggcgcgcggtcatgcccccggacgccgggatcaccgtgcagccgagccgctccgctccgtagtgcgccccgagccctccggtgaacagcccgtaaccgtacgccacatggaccttgtggccgggccgcccgcccgccgcccggatcgaacgggccaccacgtccgcccaggtgtccaggtcccgttcggtgtacccgacgaccgtgggacgccccgtcgtgccgctggaggcgtggatcctgcgcacctcgtgctccggcacggcgaacatcccgaacgggtagttgtccctcagatccgccttcacggtgaacgggaaccgggccagatccgcgagcgtccggcagtcgtcgggccgcagccccgcgctgtcgaaggcgttccggtagaaggggacgttgtcgtacgcgtggcgcagcgtggaccggagccgctccagttgcagggtctccagtgcgccacggccgagccgttccgccgcgtccagcatggccgtcatcaggaccttccttccgaaaccggcgaccaacaggcaacccacaggcgacagaacggccgcaagggggcgaccgatcattcggtcgatcttcctgggagcagtaattcaggcggcccggggtgctggcaagaggtgcgtggcgttcgcggcggatcagcccgcggcgaagcccggtgcgcccgctcgcggcttcctgtttggatggggagcatgccgatcttctccgcgcacgacacgaccccgctcgcctatcacctggtgggggagggggagccgctgatctgtctgcccggcgggccgatgcgggcgagcgaatatctcggtgacctcggaggtctcgccgcccggcggcagctcgttctgctggatctccgcggcaccggcgactccggtgtgcccgaggacccctcgacgtaccgctgcgaccgccttgtcgacgacgtggaggcactgcgcgaacacctgggcctcgaccggatcgacgtactgacgcattccgccggagccgacctggccctgctgtacgcggcccgctacccggaccgcctgcgcaccctgaccctcgtcactcccagcacccgtgccgtgggcatcgagatcagcgaccaggaccttcgcgaggccgcggagctgcggcgggaggagccctggtaccccgaggccagggccgcccaggaggcactgctcgccgggggaccgttcgccgagctgtggcccgccgtccggcccctcacctacggccgctgggacgcggctgcccgtgcccacgccgaagcgtccgccgggcagaccaacgcggaggcccgcggccactacgctggggaaggagccttcgaccccgccgccaccgccgccgccctgcgcggaccggccgtgccggtc

SEQ ID NO: 2884 - DNA, 8925 bp, Unknown
  Kingdom: Bacteria, Phylum: Actinobacteria, Class: Actinobacteria, Order: Streptomycetales, Family: Streptomycetaceae, Genus: Streptomyces
tcgccgccaccctccaggcccgaggcgagctgggcgcggagtacgagaccgcgctcatcgactcgttcctggagaaggtcgagcagcggctcgacaccacgctcgaccgccgggtccgccgtcagctcgccgagcagcagatgtccgtcgcccggggggcgcgtccggcggagccgtggagtttcggggagcggcacggtctggggatcgtctcgctgattctggccgtcccgctgtccgcgatcggcgtcgtgaacgccgggatcgagggactggtcgtggcctggctcggcatcgtcggcgtcaacgcgttccaggcggcgcggggcggcggtctgttccgtcgccgggaggaacgcccgccgtccgactggcgggactgagccccgcccgaaggatcgggccgggccgcctaagtatgtcgcggggaccgccgcacccccggtcgcccggggggcgggacgacggcggtccccgcgagggacgcggtccgggtcagggccggatgcccgcgtccgggcgacggtggaggtccgggagccgctccgtagtccggtgtcgccgttctgggtgccggcgggtttccctgccgacacccaccaatgtgccggagccgtgttaagcgggtgctgcgcggacgtgacgcgctcgtaccgttttcgcgaaggcccgccgccgggccgtcggacctcggcccgaccctcgtcgccgggccgtcaggcctcggcccggacccggcgaccggcccgtcaggccttcgccgtgcccgcgtccttggcgaggaacgccagcaggtcctgcctgctcacgacgcccttgggcttgccctcgacgagcacgatcgccgcgtcggcgccgtccgtgccgctgagcacggccatcaggtcctcgaccggttcgccggagccgacctgcggcagcggagccgacatgtgcttctccagcgggtcggtcagcgaggcgcgctgggtgaacagcgcgtccagcagctgccgttccacgacggatccgatgacctcggcggccatcacgtccgggtgaccggcgcccggcttcacgatcggcatctgggagacgccgtactcgcggagcacctcgatggcctcaccgaccgtctcctccgggtgcatgtggacgagggagggcatcgggccctccttgaagtccaggaccgcgccgacgttggcggaggcgccggtgttctccaggaagccgtagtcggccatccactcgtcgttgaagatcttgctgaggtagccgcgcccgctgtcggggagcagcaccacgacgacgtcctcggggccgagccgcttggcgacctccagggccccgacgaccgccatgccgcaggagccgccgacgagcagtccctcctccttggcgagccggcgcgtcatctggaaggagtccttgtccgacaccgcgacgatctcgtcggtgacggtgcggtcgtacgcgctcggccagaagtcctcgccgacgccctcgaccagatacggccgcccggagccgccggagtagaccgagccctccgggtccgcgccgatgacctggaccgcgccctcgctgatctccttgaggtagcgcccggtgccgctgatcgtgccgccggtgccgacgcccgcgacgaagtgggtgatcttcccctccgtctgctcccacagctcgggaccggtggtctcgtagtgcgagcgcgggttgttcgggttcgagtactggtcgggcttccaggcgcccggcgtctcggtgaccagccggtcggagacgttgtagtacgagtccgggtgctcggggtcaacggcggtggggcagacgacgacctccgcgccgtacgcgcgcagcacgttgatcttgtccgtggacaccttgtccgggcagacgaagatgcacttgtagcccttctgctgggcgacgatggcgaggccgacgcccgtgttgccgctggtcggctcgacgatcgtgccgccgggcttcagctccccgctctgctccgccgcctcgatcatgcgcagcgcgatgcggtccttcaccgacccgccggggttgaagtactcgaccttggccaggaccgtcgcctggatacctgccgtgacgttgcgcagcctcaccagcggggtgttgccgacaagactgatcatcgaatcgtggaattgcaccgtgtactccgggatctccgagatggtccggcccagagtatgcgtacaggacgcactctgcgtacgggaaggagtacaccgagccccgagcggggcaagtaggtacgtgtacggctgtacggcgaggaggaggtggaccggactgtgtcaacagcaagggtggcacggcggatcgcggcgggcgcggcctacggcggtggcagcatcgggttgatcggcgcggcggccgtgggcgtgttcctggcggaggtccagctcgcgaagaggcaggtgggcggcgggacggctccggtcccgccgagcgcggacggccggtacggagtggcgttcgccgggccgaacgacgcgatgcggctcgggatgctcggggactcgacggctgcgggccagggggtgcggcgggccgggcagaccccgggtgcgctgctggcctcggggctcgcggcggtggccgagcggccggtggacctgcggaacgtggcgctgccgggggcccggtcggacgatctggagcggcaggtgtcgctgctgctggcggatccggcacgggttccggacgtctgcgtgatcatgatcggggcgaacgacgtcacgcaccggatgcccgcgacccagtcggtgcgctgtctgacgacggcggtgcgcaggctgcggacggcgggggcggaggtggtcgtcgggacctgcccggacctgggcacgatcgagccggtctaccagccgttgcgctggctggcccggcgggtgagccggcaactggcggccgcgcagaccatcggcgcggtggagcagggcggccgcacggtgtcgctgggcgatctcctgggacccgagttcgcggagaacccgcgcgagctgttcggcccggacaactaccacccctccgccgagggctatgccacggcggccatggccgtgctgcccaccctgtgcgcggtgctgggcctgtggccggagaccgaccggctggacggtacgcgccgcgaggacatcctcccggtggcgaaggccgcgtcccaggcggcccgggaggccggtacggaggtcacgggggcgcgcgctccctgggctctcctcaagcaccgtcggcggcggcgtctgcccgcctccacggaacccaccccgcacccgcatccggacgccgcccacaggcacgtctaggggccgccgggctccgcgcgaggttgccgccggggtccggccccggcggcaacctcgcgcaacctgagcaagcgcttagaaaagagttccgcatcacacggcctgccgggtgaccccggcgatacgtccgggtaacttccagaggagttccgccgtccacacagccttccagcccctatggagccgcgtgatgcccgaagccgtgatcgtctctgccgcccgttcaccgatcggtcgcgccttcaaggggtccctgaaggacctgcgcgcggacgacctgaccgccacgatcatccagaccgcactggccaaggtccccgagctggacccgaaggacatcgacgacctgatgctgggctgcggcctgcccggcggcgagcagggcaacaacctgggccgcatcatcgccgtacagatggggatggaccaccttcccggctgtacggtcacccgctactgctcctcgtcgctgcagaccagccggatggcgctgcacgcgatcaaggcgggcgagggcgacgtcttcatctcagccggcgtcgagatggtgtcccgcttcaccaagggcaactccgacagcctcccggacacgcacaacccgctgttcgccgaggccgaggcccgcaccgccgcccgcgccgaggagtccggcgcgagctggcacgacccgcgcgaggacggcctcgtgccggacgcgtacatctcgatggggcagacggcggagaacctggcccggaccaagggcgtcacccgccaggagatggacgagttcggcgtacggtcgcagaacctcgccgaggaagctctgaagaacggcttctgggagcgggagatcaccccggtcaccacccccgacggcaccgtggtctccaaggacgacggcccgcgcgcgggcgtcaccctggagggcgtgcagggcctgaagccggtcttccggcccgacggtctggtcaccgccggcaactgctgcccgctcaacgacggcgccgcggccctggtgatcatgtccgacaccaaggcgcgcgagctgggcctgaccccgctggcccggatcgtctccaccggtgtctccggcctctcccccgagatcatggggtacggaccggtcgaggccagcaagcaggcgctgaagcgggccgggctgaccatcgacgacatcgacctggccgagatcaacgaggcgttcgccgcccaggtcatcccctcctaccgggacctcggcctgccgctggacaaggtcaacgtcaacggcggcgcgatcgccgtcggccaccccttcggcatgaccggcgcccgcatcaccggcacgctgatcaacagcctccagttccacgacaagcagtggggcctggagacgatgtgcgtgggcggcgggcagggcatggcgatggtgatcgagcggctgagctgagccgcggcggagggtgggggcgcctgaggaacgaaggcggcacctgcccgcagcggaggcggaggtcagcgcgaccgcacgcacgagccgctgagccgagccgctcgggcctgcggcactcccgcgcggcgggggtttcgaaccccaccgagctccgaccgtgaccgaatctcccccaggatgtgatctgcgtcccgggggagagtcgtttctgcaggtcaccgccgatatggggctaaacatcggaccgaaagacctgtccatttcgtgacgtaatgcactgacagcacgtaccggtacaggccaagctgatgtaggaagtcgggggtatcgatagaaaccgggagtatgtcagtgagcgccatgtcatttgccctgttgctgaccaccgccgctgccacggccgtcggcgccgccgcactgcacgctgctcacgggctgcgcaagcaggtcgcggcgctgcgcacggagctggccgcaggccacgctctcggcgcttccgtgccaccacagagccgcagcgcggccacccccgccgaggagatacgcacggccgtcgccgaagcgctcgccgaggagcgcgagcgcgagctggccgaggcgcgcgccttctgggccgcccaggaagcacgtgacgccgccgacgccccgtccctgctgggcggtctgtccggcctcggcgacgacgcgccgtactacctgccccggcaggccgacttcgccggtctggagtcgatggacctcgaagcggccgaggcgatggaggagctcgcggagctgagcgagcggactctcgcggagcacgagatcggcgagctgaccgacctcccggagatcgcggagttccccgaggactcccccgagctggccgcagcccgccgccgccacccttcgcacccggacttcatccccgtgcagacaccggtggtcaccgaccacgagcgcaccgtgaaccggctcgaagagctggccgacaccgcgaccgagctgaccgacgtgcgccccggcccgctgggcacgctcgacgtgtacgtcttcgccgacggcaccacgctctgcatgacccccggtcaccgcgagaccgccgagcgcctcgccgacgccctgcgggccggccggcagccggtgctgctgggcggctcgggcgtctcgggcgcatacgcgctgaccttctcctgcggtgaggacaacgtgtacatcctcgccgaccgcgtcatcgcctcgttctgaccgggatccgccccgtaccgccccggtccgccgggcgcgggccgctcacgcgaaagcccgcgccgccgcttccccgacataccgcacggcctcgtccagctcctgggacggggccgtttccagtgccacggccaggtcccgcccggcgacggcgagttggtcgcccacggcgaacatcccggcgtccggcagctcacgcggctcggcggccgggttctccaggcgcggggcgcgggcggcgagttcacgggcagcggccagcgcctcggccgccgcaccgcgctggaggcggctctgcggggccgagcgcagccggtcggcgaaacggtccacggccaggatgaggggagtcgtatcgagcacccggccgaccctacgcggccctgccgcacggttgccaacgcccgggagacgcacgggcggcggaacggggggacggcaagcggaacggcccgcaggcgcgatgcctgcgggccgttccggtgttacgggtgttgcgtgtgcggcgggtgccgtgcggtcggtcagtcgtcgccgctgaggatcgcgaccaggcgcagcatctcgatgtagatccacaccagggtcacggtgaggccgaaggccgccagccaggactcctcgcgcggggcgccgtacgcgatgccgtcctcgacctgcttgaagttcagggcgaggatgcacgcgccgatgacgatggccacgatgccgaagatgatgccgagggcgccgctgcggaagccgaggccgtcaccgccgccgaacacggcgaacaggaggttgaccatcatcagcagcgtgaagccgatggcggccgccatcacgaagccgtagaagcggcgcgtgacccggatcagtccggtgcggtaggcgatcagcacaccggcgaagaccgccatggtgccgatcaccgcctgcatcgcggcgccgggagcccagtagacgctgacgatgttgctgatgacgccgaggaagacaccctcgaacgccgcgtacgtcaggatcagcggcggcgacggccggcgcttgaacgagttcacgagcgacagcacgaaaccgacgatcgcggcgccgatggccacgccgatcgccgtgccgacgttctccttgtcgaccggcagcgcccaccatgcggcggtcgcggcgacgatcacggtgccgagcgtcatcgccgtacgcgtcaccacgtcgtcgatggtcatcacgtcgggacgggcgggtgcctgcggggcaccctggatgtccgtctgcgcgtaggggttggtggcgtacgggttggcggcggtgccctgcgcgtacgggttgcccgtagcgggggccccggcctgcggcgtcgcgttgaagcccgcgtggccgttgtcgcggctgaacccccgtcgcgagaagaccgggttgctgctcctcatctcactcctccatggccacactgcgtggccttgccacaagagtaatgggtaggcaaaagaatcaccctagtgccaggggaggatctttccggcactccgcggcgggaccgccgcagggcccaggaggactgtcgcacgaggccgggatcacaggtgccgtacgaagccgggatcacaggacggagtgttggtcacggtctgggccgtccgggtcacgcagggtgcggcgcgtggtgcccggagccggactcgaaccggcacgcccccgaggggcagcgaggtttaagctcgccgtgtctacgttccaccatccgggcgtgccgcgcggctccgcgtttggctaccgaccctatccggggacgtccctcgatcagcggaacagtggcgcgatgttgtcttattttattgaccgcttgagggtccgtcaggacattcggccgggctgaccacacgcccgcggccgatcttgggcggtccgcgcgccgcacgggaatgacggaaagtcgccgcactcgtacggcccaacgcgccaggtccgcgccaggcttcgccagggcatccgccaccctcgggtccggcaccgctccgaccccgggtccggcaccgctccggcagtgcctccacccgccgtcggggccgctccccgcccgcgttcccgtgcggtcacggtgggtgatcacgaagcggtcgctacgacaccggtcagggtcggtgtcatacccgaggaggacggaatcacgccctcgatgcgactcaagacggccttgggaacgggtatcgggagtgacgaccgggcgcgatcaggacgtaaggatggagtaagtccccgaggcatggcgtcagcgcccgcctcagcacggtccccgcatccgcatcacccgaacaggagcgtccctgtgagcatcacccccaccgttcagcgcgccaccgcggtggccgcccgcgccacggagctgtcgaaggtctacggcgagggcgagacccaggtcgtcgccctgaaccaggtgaccgtggacttcccccagggcgagttcaccgcgatcatgggtccctcgggctccggcaagtcgacgctgatgcactgcgtcgccggactcgacagcttcagcagcggttcggtgcgcatcggcgagaccgagctgtccaccctcaaggacaagcagctcacgcagttgcgccgggacaagatcggcttcatcttccaggcgttcaacctgctgccgacgctcaccgcgctggagaacatcaccctgccgatggacatcgcgggccgtaagccggacgccgcgtggctccagcaggtgatcgacatggtcggcctgtcggagcggctcaagcaccgcccgaccgagctctccggcggtcagcagcagcgtgtcgccgtggcccgcgccctggcctcgcagcccgagatcatcttcggcgacgagccgaccgggaacctggactcccgctccggcgccgaggtcctcggcttcctgcgcaactcggtgcgcgagctgggccagaccgtggtgatggtgacgcacgacccggtggccgcctcctacgcggaccgggt

SEQ ID NO: 2885 - DNA, 7253 bp, Unknown
  Kingdom: Bacteria, Phylum: Actinobacteria, Class: Actinobacteria, Order: Streptomycetales, Family: Streptomycetaceae, Genus: Streptomyces
acctgggcgagcaccgcggccgcccggcgccggtcctggcgctttccgccgaggcgcaggggcagcaggacgttctgctccacggtcagtgagggcagcaggttgaaggcctggaagacgaagcccaggcggctgcggcgcagttcggtcagcgcggtctcgttcatcccggtgatctcggtgccgccgagccgcacggaccccgccgagggccggtcgagtccggcggcgcactggaggaaggtggacttgccggaaccggacggtcccatgatcgcggtgaacgtaccgcgcggaagggcgaggtcgacacccgcgagggcgtgcacggtacccgcgccgcgcccgtactgccgccgcaccccgcgcagttcgacggcgggaccgggcggggtggccgggctctcctgccgctcgtccgccgtgtgccgcttgccgctgcgtagcctcatgtcccgttccgccctctcgcgttccgctcgtagcgatgtaccgacgaggtgcagcgtgcggggacggccgtgcacgaggcgtcataccggggagccaagagggacgtgctaccgaggtaggggtggaggtggatacgggatgcggcacaccggtacgtcggggtgctcgtccgccggaccgagccccgggtcgatgacggcgaaccatccggtcactcacgctcggggcatcggcggaacgttggcccgacgacggggggatcatgcagacttgcactccccgggtcacatcatgtgactgttcccggggctgttctcgcctcgcagttgcggtcaacgatgcgcggcggtcgcccggacatgttgaaaggtcttcgtgtgacgcccaagcacactcacctcgacccggcgcacaaggccgacgagcaagcccggcagtcctcgcaccaagccgccgcgccaggccgggagtcgatgccaccggagcggctgatggcgttgcaggccggtgtgggcaacgccgcggtcgtccagatgctgcgacggggtggccactccgggacacaggaacagcaccggcactccgcgggatgtgatcacccgtcgaccgaacaggccgcgcccgcagtgcagcggtccgccgtccacgacgtcctgcgtgctcccgggcgtcccctggacgacgccacccgcaccgacatggagacgcgcctcggtgcggacttctccgacgtgcgcatccacaacgacgccgccgctagggcctcggccgccgaggtcggtgctcgcgcctacacctccggtcaccatgtcgtcatcggtgccggcggcaccgacaagcacaccctcgcccatgagctcacccacgtcatccagcaacgctccggccctgtcgccggcgccgacaacggcgcggggctgaaggtctcggacccttcggaccggttcgagcgcgaggccgaagcgcaggcccgccgggtcatgtcggccgccccccgggctgcctcggaagcctcctctctgcagcgtcgcaccgtgccttccccgacgtcggcggccctcccttccgtgcaacgcgtcggtgatgcccaggacgtcatgtcgacagcgcactgggaaggaaaggccgggataaatgagagcgccggccaggcaagcagcaagaagaagggcaacaagggggagaacaagaaggcgcaactcatgacggccggaaagaagaaggggaaggtgggtgagccgcagacactggacaccatcgtcaagaagatcggccccgaccttctggcggagctggccctcaaacccgccgacgccggacagctggatctctacaggtccatgtccctcgcggaggcgcagagcgtcctggcctactggggaaaggccgaagagcggagcgccctcacggactacatagcgacgggcacggggacgggagcgggtttcagggaaggcgggcacgcggccatggccatgggcgtccacctgggggaccaggaccaggcggacgtgtactacgagcaggagggggcgggctacgaggtccagctgaaattcacgctgaaacccggcgcgcacgagttgctgttcgatccgcgccacatggcgctcgggccggggtatgccagcgaattgattcgcgaggggaagaaggacgaaatgggcgagaggaaaaagaaggggtatgagaccgccagcgccggtgaggggacgctgagcggctatataggaacgaaggcggaagggcacggtcccttcagcctcggcctcgcacagaacaagaaggacaggacggctgccactccgagccacctgttgttccagctctttgtccaagaagtcaccgtggtgaagagcaagagcccactgatcgtccccgacgccgtgtgaggggacccgagggcgtccggccgagggccatcgcgttcctcggcccgtactccgagcggatggccgaggtgatggcaggccactcatcgcaggagatccagcacgccgaggggttcctcggcacgctgcgcaccaccagggacgccctgtcggcgcacgagtaagagggtggcgggccggcgcctcccacccctgacggcagtccggtccgcgaaccgcgctgtcagcaccacccggtagcgtcgggtcatgtccaacatggccgtcctcgaaggtgtcctggagcggatcacctacgccaacgaggagaacgggtacacggtggcccgcgtcgacaccggacggggagccggggaccttctcaccgtcgtcggcgcgctgctcggcgcgcaggtcggcgaatcgctgcggatggagggccgttggggatcgcactcccagtacggcaagcagttcaccgtggagaactacaccaccgtgctgcccgccaccatccagggcatccgccgctatctcggctccggactgatcaaggggatcgggccggtgatggccgaccggatcaccacccacttcggcgtggacaccctcgacatcatcgagcaggagccgaagcgcctcgtcgaggttcccggcctcggccccaaacgcacgaagatgatcgcggccgcctgggaggagcagaaggcgatcaaggaggtcatggtcttcctccagggcgtcggtgtctccacctccatcgccgtccgcatctacaagaagtacgaggacgcctcgatctccgtcgtgaagaaccagccctaccggctggccgccgacgtctggggcatcggcttcctcaccgccgaccggatcgcccaggccgtcggcattccgcacgacagccccgaacgggtcaaggcaggcctccagtacgccctgtcccagtcctccgaccaggggcactgctatctccccgaggaacggctcatcgcggacggcgtcaagctgctccaggtcgacaccgggctggtcatcgagtgcctggccgagctggccgccgatccggagggcgtcgtacgggaaaaggtgccgtcccccgagggcggcgaaccggtcacggccgtctacctggtccccttccaccgggccgagctgtccctcgccggacaggtgcgccgcctgctgaacaccggcgaggaccggatgccggccttcgggaacgtggactgggacaaggccctggcctggctcgccacccgtacgggagccgacctcgcgcccgagcaggaacaggccgtacggctcgcgctcagccggaaggtggccgtcctgaccggggggcccggctgcgggaaatcgttcaccgtacggtccatcgtcgagctggcccgggcgaagaaggccaaggtggtgctcgccgcccccaccgggcgcgccgccaaacgcctcgccgagctgaccggggccgaggcgtccaccgtgcaccggctcctggagctgagaccgggcggggacgcggcctacgaccgtgaccgcccgctggacgcggatctggtcgtcgtcgacgaggcgtcgatgctcgatctgctgctcgccaacaagctcgtgaaggcggtggcacccggtgcccacctcctcctcgtgggagacgtcgaccaactgccctcggtcggcgcgggggaggtgctgagcgatctgctcgccgagggcggcccggtccccgccgtccggctcacccggatcttccgccaggcccagcagtccggcgtcgtgacgaacgcccaccggatcaacgcagggcagccgccgctcacggaagggctgagcgacttcttcctcttcgtggaggacgagacggaggacgcgggcaagctcgccgtcgatgtggcggcccgccgcattccggccaagtttggcctcgatccacgccgtgacgtgcaggttctcgccccgatgcaccgcggcccggccggtgcgggccagctgaacggactgctccagcaggccatcaccccggcccggcccgaccttcccgagaagaggttcggcggccgggtcttccgcgtcggcgacaaggtcacccagatccgcaacaactacgacaagggcgagaacggcgtcttcaacggcacggtcggcgtcgtcaccggcctggacgcggacgagcagaagctcaccgtccgcaccgacgaggacgaggagatcggctacgacttcgacgagctggacgagctggcccacgcgtacgccatgaccatccaccgctcccagggcagcgagtatccggccgtcgtcatccccgtcaccaccagcgcctggatgatgctccagcgcaacctgctctacacggccgtgacgagggccaagcagctggtggtcctggtcgggtcccgtaaggcgatcggccaggcggtccgcacggtttccgcaggcagacgctgtacggcactggatttccggctccgaggcggctcgggcgaagacttcgcgtgacccctccgaaaaaatgatcgatcaaatcggtgggaaacatcacggaggtcttccggaaccgcagtcaagggggcaggatgagtaagttggcggcactcagtgccgtcagtaggtccaatggacaaccccgagtgcactctcctgagccgaatgggggagggtggaagacagtcagggcacctcgaagaagaggcactacgtcggtgagggatgacgtgagcgagcacaccaacaacgctgtagtactgcggtacggcgatgacgagtacacctacccggtgatcgacagcaccgtcggcgacaagggcttcgacatcgggaagctccgggccaataccggcctggtgacgctggacagcggatacggcaacaccgccgcctataaatccgccatcacgtacctcgacggtgagcagggcattctgcgctaccgcggatacccgatcgagcagctcgccgagcgctcgtcgttcctcgaggtcgcgtacacgctgatcaacggcgacctgccgaaggtcgacgagctggcgaccttcaagaacgagatcacccagcacacgctgctgcacgaggacgtcaagcggttcttcgacggcttcccgcgcgacgcccacccgatggccatgctgtcctcggtcgtcagcgcgctgtccacgttctaccaggacagccacaacccgttcgacgagcagcagcgtcacctctcgacgatccgcctcctggcgaagctcccgacgatcgcggcgtacgcctacaagaagtcgatcgggcaccccttcgtctacccgcgcaacgacctcgggtacgtcgagaacttcctgcgcatgaccttctcggtccccgcccaggagtacgagctggacccggtcgtcgtctcggcgctggacaagctgctcatcctgcacgcggaccacgagcagaactgttcgacctccaccgtgcgtctggtcggctcctcgcaggcgaacatgttcgcctcgatctccgccggcatctcggcgctgtggggccccctgcacggtggcgccaaccagtcggtgctggagatgctggaaggcatccaggccaacggcggcgacgtcgactccttcatccgcaaggtgaagaacaaggaggacggcgtccgcctgatgggcttcggtcaccgggtgtacaagtccttcgacccgcgcgccaagatcatcaaggccgccgcccacgacgtgctgtccgcgctcggcaagtccgacgagctgctcgacatcgcgctcaagctggaggagcacgcgctctccgacgactacttcgtctcgcgcaacctctaccccaacgtggacttctacaccggtctgatctaccgggccatgggcttcccgaccgagatgttcaccgtgctcttcgcgctcggccgccttcccggctggatcgcccagtggcacgagatgatcaaggagccgggttcccgcatcggccgcccgcgtcagatctacaccggcgaggtcctgcgcgacttcgtcccggtcgagggccgctgacccggacctcgtgtcgaggtcgccgacccggacctcgcaacccccccgtagtgcccggcctcttcggccgactgccttcgccccgcgtaccgcgcttcgcacagagcgcggtgtccggggcgattcggcgttccgggggccggcgcgggagggggcggaaagcgagaagcgccccgccgccgatccccccacgggtcgacggtcagggcgcttcccatatcccggagcggattccccccacgggatccggccgggcgtctgctgggagccggagctcccgctgttctgttgtgctgcggtccgccggggtacgtacgcacgggagggccgctcaaagctccccggtgcacgtgccccggccaacgcttgccacaggagcgtcccccaagacactccatcggacgtcccccaagacatccttggcatcgcactctaagactcgcgaacccaccggatggttaccctgaaatcggtgtgatctaaatctctttgtggaagttacgtgaaggcacgcaaccgtaggctgttcgtgacgacgaacacggacgaaaacgccatggcggctcccgcgatcatagggttgagcaggccacttgcagccaggggcaaggccgcgacgttgtacccgaaggcccagaagaggttgcccctgatggtggccagcgtacgcctggagaggcggattgcgtcagcggtcaccttgagatctccacgaaccagcgtgaggtcgctcgcctcgatcgccgcatccgtcccggtgcccatcgccagtcccagatccgccgtggcgagggcggccgcgtcgttgaccccgtcgccgaccatggcgacgacccggccttcggcctgaaggcgcttcacgacgttcaccttgtcctcgggaagtacctccgcgtggacctcgtcgatgccgacctcg

SEQ ID NO: 2886 - DNA, 2509 bp, Unknown
  Kingdom: Bacteria, Phylum: Actinobacteria, Class: Actinobacteria, Order: Streptomycetales, Family: Streptomycetaceae, Genus: Streptomyces
gctgggccgcgggcagggcgtccagggccaccgcgccctgcccgcggcccagcaccaccagcgggttgatgtccagctccgtcaggtcgtcgcccagctccagggccatgcgctgcacccgcagcacgacttcgacgagggcgtccacatcgacgggtggcccgccgcgcaccccctccagcagggcccggccgcgcagctcgccgagcatgtcccgggcctgctgctcgccgaacggcggcacccggaccgccgcgtcgtgcagcacctccaccaggaccccgccgagcgccaccgtgacggtcgggccgaagagcgcgtcgtgggtcaccccgaccatcatctcgacgccccggtcgatcatctggcagaccaggatgccgtccaggtccacggactcgtaccgggcgatgtcggtcagctcgcggtaggcgtcgcggacctggctggccgaggtgaggccgaccttcaccaggcccagctccgtcttgtgcgcgagccggggtccggaggccttcatcaccaccgggtagccgaccggaccggcggcccggaccgccgccgccgcgctggtcaccaactgctcgcgcggcacccggatcccgtacgcgcgcaggagctgcttcgccgcgtgctcgctgagctgctgtcccggccgcagcaggccctgcgccttgcggaaggagggggacggggtgcgcggggcgtcctcgaagggggagcggtagcggtcggtgaagcggtggtggtccaggtaggccttgacggcggtgacgcagttgccgaacgtccggaaggtggcgaggcgggaggagcccagcagggtggagcggtaggcgtcctcggtgccgacgggggagccccagacgacgcagaccagcttgtcggtggcctccgccgcgtccgccaggtcctgggcgagccggtcgctcatcggggggaaggggccggtgatcggacagatcagcaccccgaccgacgggtccgcgaggaccgcgtcgatgatcttccggccgcgccagtcgccgaccgggtggccgccgttgtcgatggggttggcgacgttgaggtagtcgggtatccaggtgtgcagttcgtcctgcttggcggcggagagggcgggcagcgagagccccgccgccgtcgccaggtccgcgaagtgcgcgccggtgccgccggagatcgagtacaccgcgaccccctcggccttcggcggccgggcgcgggccaacagggcggcggtgtcctggagttcgtccaggccgttcacccggatcaccccgaactggcgcatcgccgcgtccaccacccggtccgcgccggtcagtttgccggtgtgggaggcggcggtcctggccccggcctccgtgcggcccaccttcacggcgacgacggggaccttggcgcgggcggcccggtcggcggcgagcaggaaggaacggccgtccttgagcccctcgacgtaacaggcgatggcaccgacctcgggaagctgggcgaagtacgcgaggaagtcggcggtctccagatcggcctcgttgcccgtgggagcccagtgcgagagccggatgcccagctcctggagggcgtggagcgggcggccctgatgcccggactgggtgatcagggcgatggcgggaccctccaggtcctcccggaacctctcgaaggcgttcaggttggtgttcggtccgagcaggcgcagcccggaacgctccacggccgcagccagttgggcttgggcctccgcgcccgcctccccggtctcggcgaacccggaggcgaaggcgacggcgaagggcaccttggcctcgcccagctcctcgatcaccgggagcgggtccgcgaccagcaggaccgcgaggtcgaccggttcgggagcctcggcgaccgaggggaagcaggtccggccgaacacggtccgccgggtcgggtgcaccgggtgcagccgggctccgacccggtcggcccaggcgatgagctgccgggtgatgccggtgttggggcggccctcggcatccgaggcccccacgacggccacggaccggggccggaagaagcggtccaggtcgggcacggtcaggtgcagcggtcgcccgctgacgtcgaggccgccccggtccgaggcagccggcaggctgacgacggcggcgtgcggctcctcgccgcaggccaccacccgggcacggaagtcggtggtgagggtgccgtgagtcgatccaagcatcgttccgcccactcctgctcgatggtccgccggtgaacgggcggagccggccgattagctgacaccctgtcaggttactgaactgacgctgcgtcaggaatgggtgtgcaggcaaaggctcgtgtgagcgccgggccgctgtgcgggcagagcctcccgtggtcacggtgcggcattccgtggcgtagggtggtgtttaccgacgcggggtggagcagctcggtagctcgctgggctcataacccagaggtcgcaggttcaaatcctgtccccgctactgaa

SEQ ID NO: 2887 - DNA, 9839 bp, Unknown
  Kingdom: Bacteria, Phylum: Actinobacteria, Class: Actinobacteria, Order: Streptomycetales, Family: Streptomycetaceae, Genus: Streptomyces
ccccggcacggtggccgcgctcgccgcgctagcgccgaaggtcggcgccgtcgccgtgatcaccggccggccggccggtgtcgcggtgcgctacggaggcttcgcgggcgtccccggactggagcacctcgtcgtgctcggacactacggcgccgaacgctgggacgccgtgaccggcaccgtgaacgcccctgccccgcaccccggcgtcgccgccgttcgggccgaactgccgggcgtactgcacgagttcgactcctggcacggcacctggatcgaggagaaggggcaggccgtcgccgtccacacccggcgcgcccaggacccgcaggcggccttcgagacactgcgcggccccctcggcgagctggccgcgaagcacggactgatcgtcgaaccgggccgcctcgtcctggagttgcgcccgcccggcatggacaagggtgtcgcgctcgccacgttcgtcgcggaactggacgccgagtccgtgatctacgcgggcgacgacctcggggacctcgccgcgttcgccgcggtggagaagctgcggaccgagggcccggacggcatccccggcctcctggtgtgcagcggcagcaccgaggtgcccgaactggccgagcgcgcggacctgtcggtgccgggcccggccgccgtggtcgcgttcctggcggcgttggccgagcggctctgagccgtaccacgagtccggctcacccctgccgcagcgcctccagctggtccaggaaccactgctggggcggcagcgcggtcgccgcctcggccagccgcttcgtgcggccggaccgctcgtccccgctcatcgtcagcgcctcgtgcagggcctcggccgtgcccgtcacgtcgtacgggttcaccacgatcgcgtcctcgcccagctcctcgtacgctcccgcctcccgcgacagcaccagcgcgcagccgtggtcggagacgaccgggacctccttggcgaccaggttcatcccgtcgcggatcgggttgaccagggccacgtccgccagccggtacgcggccagcgagcgcgcgaagtcgtccttgacgtgcagcacgaccggcgtccagctctccgtgccgtacgccctgttgatctccgtggccagggtctgcaccgccgccgtgtactcccggtagacggtgaggtcctgccgggaggggtaggcgaaggcgatgtgcacgacccgctcgcgccactcggggtgggcgtccagcagggcccggtacgcgtgcaggccgcgcacgatgttcttggacagctcggtgcggtccacccggacgatggtcttccggccctcgcccacctgctcgcgcagggccgccatccgctcgtccacgtccgcctcgcgcgagcgccggcgcaggaagtccgcgtcggccccgaggccgtgcaccccgatcctcgtgcggcccgtgccgccgaggatctccgtgcagcagccgatgaacgcgtccgcccagcgccgggtcaggaacgcggcccggtccgcgccgaggatgccgcgcagcaactgctccgcgatgtcgtcgggcagcagccggaagtagtcgacgggcgcccacggggtgtgcgagaagtggccgatcctgaggtccgggcgcagctcacggagcatgccggggaccagggccaggtggtagtcctggacgaggaccgaagccccggggcccgcctcctcggcgagtgcctcggcgaaggcccggttgtacgtctcgtaggaggcccactgacggcggaactccgcgtcgaagaccggttcgacgggcgtctggtagagcagatggtggacgaaccacagcaccgagttggcgatgccgttgtacgcgtcggcgtggacctcggcgtcgatgtcgagcatccgcacgcctgcctcgccgaccccgcgtcgcaccgcctcgcggtccccgtcgccgagggccgcgcagacccacagcttgtcgtcgacggcgctcagcccggagacgagaccgccgcccccgcgcttggcgtcgagcgtcccgtcctcaccgagcgtgtacgagaccgggccgcggttggacgcgacgaggacctgggcggtggaggcggctgcgggttcggtgtgctcggagaccatgtagcggaacctagcccgttcgggaagcccccaaacgcctcccgggccgcccgcaccgcacgccgggcggcgcgcaccggccgccagcggccctccgcccgccgtcctcaggccgcgtggcgcgccgcgtactccgcgatctcccgcatcggcggcctttcctccgtgtccaccgcatgggtgcgggggacgaagccgtcctcgccgcgctcgaactgggtcagtgcgggccgcaccagatggccccgggagagccgtagctgcgccgtgcggtagatcgccgccgccatccggcccagcgcctgcccgtcctggtggcggtgtttgcgcacgccgacatcgacctggcccagggcgtccaaccccaccgtgtgcagcgcgtccaccagcaaccccagctccactccgtaaccgaccgggaacggcagccgctccagcaaggaccggcgcaccgcgtactcgccgcccagcggctgcacgaacccggccagctggggccagtgcagattgagcagcgggcgcgccaccagctcggtgacccggccgccctgacctgcggtgtcgccgagcggacggtcgtacatcgccttgacgaactggacccccgggtcggtgagcagcggtccgaccgtccccgagacgaagtccgccgagaagtccctgaggtcggcgtccacgaagcagacgatctcgccgctggtcaccaggagtgaccgccacagcacctcgcccttgcccggcagggccggaatccggggcaggatcgcgtcccggtggaccacccgggcgcccgccgcccgtgccacggcggcggtggcgtcggtggagccggagtcgatcaccacgagttcgtcgacgagccggaccttctccatcagctcccggcggatcgtcgccacgatcgcgccgaccgtggcctcctcgttcagcgcgggcagcaccacgctcacggacgtacggagcggatcggcgtcccgggcgtcggcgagccggttcagcgggcggtcgccggacgaccaggaacgcctggtcagccagcgttccacctcttcgagcacggtcggcactccctgtatgtgatccatctcgcggttcggacgactatctcaacggtccgatgcttcggttacagtcttgaacaacgcgtatggccgtcgcatgtcggggtcggagcgcacataaacgcctggatcgaagatccagcgccacagagctcatccagagggactgagggaacggcccgttgaagtcccggcaaccctcctgccgaccgcgaggtcacggtggggaaggtgccaattccgtcttgcggcgaaatgcgtcgcagggaagatgaggagaaagggacctccgccatcatggctgttcagaccgttgcaggtaacaccacttcttccgccccggccgtcgatctcggtcccgccgcggcgctttcctgccgcgagtgcggcgagcgtttcgaactcggcccccttttcgcctgtgcgtcctgtttcgggccgctggaagtggcctacgaccttcccaccggctccccggaggagctgcggaagcgcatcgaggccggcccggacaacatctggcgctacgccccgctgctgccggtgccggccgacgtcgcggagaggcccaacatcaaccccggcttcaccaagctcgtcaaggccgacaacctcgcccgtgaactgggcgtcaccggcggcctgtacgtgaaggacgactccggcaacccgacgcactccttcaaggaccgcgtcgtcgccatcgccgtcgaggccgcccgcgccttcggcttcaccaccctctcctgctcctccacgggcaacctggccggagccgtcggtgccgccgccgcccgggccggcctgcgctcctgcgtgttcatcccgcacgacctggagcagggcaaggtcgtcatggccgcggtctacggcggtgagctggtcggcatcgagggcaactacgacgacgtcaaccgtttctgctccgagctcatcggcgacccgctcggcgagggctggggcttcgtcaacgtcaacctgcgtccgtactacggcgagggctccaagacgctggcgtacgagatctgcgagcagctcggctggcggctgcccgaccagatcgtcatcccgatcgcgtccggctcccagctcacgaagatcgacaagggctttcaggagctgatcaagctcggcctcgtcgaggacaagccgtacaagatcttcggcgcccaggccgagggctgctccccggtctccgccgccttcaaggcgggccacgacgtggtgcgcccgcagaagccgaacaccatcgccaagtcgctggcgatcggcaatccggcggacggcccgtacgtcctggacatcgcccgccgcaccggtggcgcggtggaggacgtgaatgacgagcaggtcgtcgacgcgatcaagctgctggcgcgcaccgagggcatcttcggcgagacggcgggcggcgtgacgctcggcgtgacgaagaagctcatcgaggcgggcgtcatcgacccggcgctcaccaccgtcgtcctgaacaccggcgacggcctcaagacgctcgacgcggtctccgcgacctcgcaggtcacggcgaccatcaagccgagcctggacgctttccgggccgcgggcctcgtcgccaactgaccacccgagacttcaggaaggcatccaccatgagcgtcaaggtccgcatccccaccatcctccgcacgtacacgggcggccaggccgaggtcccggcggagggcgccaagctctccgaggtcatcgagtccctggagaaggaccacccgggcatcgcggcccgtgtcctggacgaccagggcaagctgcgccgcttcgtgaacgtgtacgtcaacgacgacgacgtgcgcttcgagggcggtctggacgcggccacgccggacggcgcgggcgtctcgatcatccccgcggtcgccggcggctgctgaaccgcccggggccgcttcccggcggcctccatcgcacctctgtgtgaccacagttgccccctccgcgagagaagcggagggggcaattctgtatggttgagcgcggtacagttggggaagccccgtccgctgcgcgtgccgcccgcatatgagaatgcgcccggccccgataagaagcagccaaagtacgtgaacctcttgcggcataagtgccctttgcccggcccgacttgcccgcaaatttcaccaaacccgcatattcgcgtgttcttctgtgcccagaattctcgtccgattgacctgttgcagagggcagttgggcggatacattcggccgcggtcgacgcgctgcggcgccgcgcaccctctcctgtcggagggtgagttccgacccgggcccgcgaagtgcggtcccgtgcaagggccagtaataggggagttaggcatggctcagggcaccgtcaagtggttcaacgcggagaaggggtacggcttcatcgcggtcgacggtggtgcggatgttttcgtccactacagcgcgatccagatggacgggtaccgcaccctcgaagagggtcagcgagttgaattcgagatctcgcagggccagaaggggccccaggccgacatggtcaagctcgccgtcggctgagctcggcgcggtcgtccgacgacactactcacgcacgtagggcccggcccccggatcaggggaccgggccctacgtgcgtcccggcggctccgccgggggtgcgccgctgtccgcctccgatgcgtgccgccgtccacatccgatgcgcgccgctgtccacatccgacgggggacgcttgcactcgcaggggtcgagtgctaatcattggcgttagcactctccaggtgagagtgacagaaacttggaccgggccggtgaggcccgcaggcgcggtggggcaaggaaccaccacgcacgcaggccgtccgtcgcgggcgcctctcggtccggagaatccacccctgtccgggaggaccacttcacatggccaagatcatcgcgttcgacgaggaggcacggcgcggtctcgagcgcgggatgaaccagctcgccgacgccgtcaaggtcaccctcggccccaagggccgtaacgtcgtcctcgagaagaagtggggcgcgcccacgatcaccaacgatggtgtttccatcgccaaggagatcgagctcgaggacccgtacgagaagatcggtgcggagctggtcaaggaggtcgccaagaagacggacgacgtcgccggcgacggtacgaccaccgccaccgttctggctcaggctctcgttcgcgagggtctgcgcaacgtcgccgcaggcgccaacccgatggccctcaagcggggcatcgagaaggccgtcgaggccgtctccgccgcgctgctggagcaggccaaggacgtggagaccaaggagcagatcgcttcgaccgcctccatctccgccgccgacaccgagatcggcgccaagatcgccgaggcgatggacaaggtcggcaaggaaggcgtcatcaccgtcgaggagtcccagaccttcggtctggagcttgagctcaccgagggtatgcgcttcgacaagggctacatctcggcgtacttcgcgaccgacatggagcgtatggaggcgtcgctcgacgacccgtacatcctgatcgtcaactcgaagatcggcagcgtcaaggacctcatcccgctgctggagaaggtcatgcagtcgggcaagcccctgctgatcatcgccgaggacgtcgagggcgaggcgctctccaccctggtcgtcaacaagatcaagggcacgttcaagtccgtcgccgtcaaggctccgggcttcggcgaccgccgcaaggccatgctcgcggacatcgccatcctcaccggtggcaccgtgatctccgaggaggtcggtctcaagctggagaacgccggcctggacctgctcggccgtgcccgcaaggtcgtcatcaccaaggacgagaccacgatcgtcgacggtgccggtgacagcgaccaggttcagggtcgcgtcaaccagatccgtgccgagatcgagaactccgactcggactacgaccgcgagaagctccaggagcgtctggcgaagctggccggcggcgtggccgtcatcaaggccggcgccgccaccgaggtggagctcaaggagcgcaagcaccgcatcgaggacgcggtgcgcaacgccaaggccgccgtcgaggagggcatcgtcgccggtggtggcgtggctctgctccaggcctcggccgtcttcgagaagctcgacctcacgggcgacgaggcgaccggcgccaacgccgtgaagctcgcgctggaggccccgctcaagcagatcgccgtcaacggtggtcttgagggtggcgtcgtcgtggagaaggtccgcaacctgccgatcggtcacggcctcaacgccgcgaccggcgagtacgtcgacatgatcgccgagggcattctcgacccggcgaaggtcacgcgctccgctctgcagaacgccgcgtccatcgccgcgctcttcctcaccaccgaggccgtcatcgccgacaagcccgagaaggccggcgcggccgctccgggcggcatgccgggcggtgacatggacttctgatccgccgcggagtcccgggacctcccgggcctccggctgatcgatgttccgcgtacgtcccacaggggcggtacctcctcacggaggtgccgcccctgtggcgtttcgtttgccgccgagccggcgtgcgccgcccggcctgcgcgcctgtgccgccccggcgcgcgggcgggatccgccggttctccccgcatgcttgggtgtgcaggcgggggccgtacggtcggggagcaggtggaaccggcggatctgcgtcccttgatggtggtgacggcagacggagggggtccgggtgggcgcggtggcgggaacgaaggaagcacacgagggcgagggagagggcgagggcagagggactgaggagcggtctgccggggaatccgtggagcagcccgcagggcgcgtcgtcaagcaggccgtgaagcaggccggtgggcaggccgtggagcagtccgcccggcagccgaccgggcgggccgccgaagaacccgaaggtggacccggcgcggacacgggcgcgggcacctcccctctccgtctcctcctctcccgggtccgtccgcaccggggtgttctcgtccgcgcgggtctgctctcgctcgccggatccgggtcgggtctcgcgatgccgctgatggcgaagcacgcggtcgacgcgttcgccgcggaccgctcgcccgcgggaccgctcgtcgcgctgaccacgctcgtgctggtcggagcctgcctctccgcgtacgggcgctatctcatgtcccgtacgggagagggcgtcgtcctacgcgcacgcgaccgactcgtgggccgcatcatgcggttgaaggtcccggcggtggaccggctgaccccgggcgacctccagtcacgcgtcaccagcgacacgaccctcctgcggacggtcctctccagcggcctggtcgagtcgttcaacagcgtgctgatgctgctggggacgatcggcttcatggcgtacatggacctgacgctgctcggcgtgacgctggtggtgatcgtcggcatcggagccgtgacctccctgctgatgccgcgtatccagcgggcccagctccgcgcccaggagtccgtgggcgcgatgggcgcggcgctggaccgggtgctccaggcgttccgcacggtcaaggcgagcggggcggaggatcgggagacggcggccgtcgcggcggccgcccggcacgcgcacgaccggggcatctcggtggcgcggtggtcgtcggtctccgacgtcacgatgatgatgtcgatccagctggcgttcctggcggtgctgggcgtgggcggcgcacgggtcgcctccggctcgctggagatctcgtcgctgatcgcgttcctgctctacctcttctatctgatgggcccgatcggcggcctggtcgagggctggacaggtttgcagagcgggctcgccgcggtgcgcaggatcgacgaggtcgagtcgctgcccggcgaaccggccgccgagcccggagccgtacggcaggagattcccgcgactccgctcggcgtcacgttccgggacgtgacgttcgggtacggggacgagcgggcacccgcgcacaagggggtgacgttcgacgttccggccggcggtctggtcgccctggtgggtccgtccggtgcgggcaagtcgacggtcttcagcctgctggaacgcttctacgaccacgattccggcaccatcaccgtggacggccgggacatccgcgactggccgctggccgagctgcgcggctcgctggcgtacgtggaacaggacgcgccggtcctggccgggacgctgcgcgagaacctcgtcttcgccgccccggacgccgaggagaaggccctgacggaggcggtgtcccggacccgcctggacaccctggtcgaccggctgccggagggactggacacgtcggtgggccaccgcggcgtcaccctctccggcggcgaacgccagcggatagccatcgcccgggccctgttgcgccgtccccgcctgctgctgctcgacgaggtgacctcgcagctggacgcggtcaacgagcaggcgctgcgcgacgtgatcctcgaactggcggagcagaccacggtgctggtcatcgcgcaccgcctctcca

SEQ ID NO: 2888 - DNA, 4169 bp, Unknown
  Kingdom: Bacteria, Phylum: Actinobacteria, Class: Actinobacteria, Order: Streptomycetales, Family: Streptomycetaceae, Genus: Streptomyces
gctccggggcagggcggtgggcgcgatccagacgacgagcctcgaagagccgcccgaacaggccgcgttcgtccggcggacagcggctgcggcgcgggtcccgacgctgcgggccgtggccggcgagcaccgccgggcgggcccggtcgactggcgggtcctctggccgcgccaagggtccgggggagcgggggcgatggtgcgggagccgaacgactccagcgtcaccctgcgcgtacgggcggccggcgggctgacgctgctgctcctcggtgacctcgaacccctggctcagcgggagttgctgcgcggccgggaggcttcgggcccggtggacgtcctcaaggtggcccaccacggctcggcgttccaggacgtcgggctgctccacagcgtacggccgaggctggcgctcatctcctgcggcgcggacaacccgtacggacacccctcggcccgcacggtgggcgctctcagggcgacgggggcccgggtcctgcgcaccgataccgacggcccgatcgcggtgacgggcacggggaaggagctgcgggcgatgggccggtcatgacatcgcgcgggtcagaccagccatgtgccggagagcaccaggtcgcggtcggcgagctcgttcacctcgcgccaggcgcgcacggtgtgggggacgatgcgcagaaacaccccgacggggacgcgggggtcccatcggagcttcgcggcgaaggccgcccttgtcgcggtgggaaggtcgctccctccaggatcctcgcctcgccctcgatcagcacacatcgcgggtggggtcgagggtgatgcggatcggccagcccggagtcctgggacccgacgtgggacctgtcatgcgtcttgtcatcaggtctgtcgtgggaccggtggtcctcggggcgggggcgggcgcagactgggcccatgacctcgcagacacccacgacgtccggcgcctttgtcccgggttccggcaacggcgacggcggcatcaccgccgccgccgtcgacgcctatctcacccggatcggcgcggaccgtccggtgcgggccgatatcgatgcgctgcgcgacctgcagcaccggcatctgctcgccgttcccttcgagaacctctcggttcatctgggcgaggacatcgtgctggaggaacgggcgctcatggccaaggtgaccggcggtcgcggcggcttctgctacgaactgaacggcgcgttcggggcgttgctgcgcgctctcggcttccgtgtgacgctgctccaggcccgggtgttcggcgacggcggccgtctgggcattccgtacgaccacatggcgctgcgggtggagaccgaggacggtacggggccgtggctggcggacgtcgggttcggcgacaacgcgctgtggccgctggcgctcgacgaccggacggagcaggaggacccccggggcgtgttccggctccgccaggcgccgcagggggacctggatctgctgcgcggcggctcacggcagttccggctcgacctgaggccgcggacgctgccggagttccggggcggggcctggtaccaccgcacctcgccggactcgcacttcacccggtcgctggtgtgctcccggtacacggagaccgggcgggtgacactcagcggacggaccctggtcaccacggtcggcggtgagcagcaccgtacggaactggtcacggacgaggaggtgctcgccgcctaccgggatcacttcggggtgcggctctcccgggttccccggcttcgcagcgatcgcggtgccggggcgtgacgccggccggtgacgcgcgaacggcgcggacggatgatccacacaggcggaactcgtaattcggaccttcggtagcacctgcgtacagctcgttacagtctgtcgtgattcatcgtgactcgccatatgtccgtacaccccattacaccgtgtagcagttccgtacaagaccttccgaggtcctcggtttgcctcgaacgccgcaatagtgatcgaatgcatgctcgtcggcgggccgctgatccgacaaggatgtccaccggtcagggcccgaagtgcggagcgcccctgggggtacgtagagatgttcggccgttggctgggaaacagaggccaggcgggtgggcgcgccggggccctcgccggattccaggtgccccctaccgcgggcgtgctcaactgccgggtgttggacccggtcaacgaaccggttcagcaggccgagttcgtcgtgaccgacagtgcgggccgcagggtgacaggcggcgagacggatcccttcggcagtgttctcgccacggtcccggccggtgactaccggctggcgatcacggccgagggcttcaccccgttccacggggcggtggcggtgaccgagggggcgcacgccaccctgggcgatgtgaccctccaggtggcgcagcccccgcagctgcccgaccccggtgactgggacatcgagccgaaccactcgcagatcggtttcaccgcccggcacatcgggctggcgcgcatccacggcaggttcaacaccttcgccggggcggtccggatcgccgaccgcatggaggactccgccatgcacgtgatcatcgacgcggcctcgatcgacaccaatgtgcagatgcgcgacgaccacctgcgctccggcgacttcctcgacgtcggccgctacccgacgctggagttctacagcgagcgcttcgtccaccggggcggcagccggtggggtgtcaccggtgcgctgaccctgcacggtgtcagccgtaccgtgacgctggacacccagtacctcggtatcggcaacggcctggagggcgagacgcgcgccgcctgccgggccaccaccgaactgcaccgcgaggacttcaccctcacctggcagaccatgctggcgcgcgggatcgccgtggtcgggccgagcatcgtcatcgacctggacatccagatcgttcccaagggctgagccgccccggatcgcccccgaggcccgagcccccccgggcctttcccgagggctggcccgccgggcgctacggcttctccagccagccttcgtactcctcggcgaacgcgtcgagagcgtccgggtccaggcgcccggccgcgtcctccacgaccaccagccactgggcgtcctcggcgtcgtcctcgccggccagcgcgtcccgtacgagctgaggctcctcggcgaccccgaagcggtccgccagctccccggccacctcctccgcggcgtcgcggtcgggcagcaccagtacatgtctcacatcgctcacccggtcattctccggtaccggcatccgtgccccgcgccccggggtgggcgggccgccgtagctgtccgcgctgtcggtggggcgtgggatgctggatcgcgatggccaccaggaagaattccaccgacgatccgctcgcgcccctcaccctcgccgtgggccaggaggacctcctcctggaccgtgcggtgcagcaggtggtggcggccgcccgcgctgccgacgccgacacggacgtacgtgatctggcgtccgaccagttgcagcccggcacgctcgccgagctcaccagcccctcgctcttcgccgagcggaaggtcgtgatcgtgcgcaacgcgcaggatctctcggccgacacgatcaaggacgtcaaggcgtatctcggcgcgccggtcgaggagatcaccctcgtcctgctgcacgcgggcggcgccaagggcaagggtctgctggacgcggcgcgcaaggccggggcgcgggaggtcgcctgcccgaagaccaccaagcccgccgagcggctctccttcgtacggtcggagttccgggcgcacgggcggtccgcgacgccggaggcctgtcaggcgctggtcgactccatcggcagcgatctgcgggagctggcgagtgcggtgtcccagttgatcgcggacgtcgagggcacgatcgacgaggcggtcgtcggccgctattacaccgggcgggcggaagcctcctcgttcaccgtcgccgaccgggcggtcgagggacgcgcggcggaggcgctggaggcgctgcggtggtcgttgtcgaccggggtgccccccgtcctgatcaccagtgcgctggcgcagggggtgcgggccatcgggaagctgtcctcggcccgcaccccctgcgcca

SEQ ID NO: 2889 - DNA, 3879 bp, Unknown
  Kingdom: Bacteria, Phylum: Actinobacteria, Class: Actinobacteria, Order: Streptomycetales, Family: Streptomycetaceae, Genus: Streptomyces
gctccggtcgactccccgcccccctcggctccgcagtccccgggcagcctggaccggttcttcaagatctccgagcgggggtcgaccgtcgcccgcgagttccgcggcgggttcgccacgttcttcgcgatggcgtacatcatcgtgctcaacccgatcatcctgggcagcgcgaaggacatgtacggcaaccagctcgacaacggtcagctggtcaccgccaccgtgctgtccgccgcgttctccaccctgctgatgggcgtcatcggcaatgtgccgatcgcgctcgccgccggtctcggcgtcaacacggtcgtagcgctccagctcgctccccggatgagctggccggacgcgatgggcatggtcgtcctcgccggcatcgtggtgatgctgctggtggccaccgggctgcgggaacgcgtgatgaacgccgtcccgaagtcgctccgcaagggcatcgcgatcggcatcggcctcttcatcctgctgatcggcctcgtcgactccggcttcgtctcgcgtatccccgacgccgcgcacaccaccgtgccgctccagctcggcggcagcggtcacctcgacggctggccgattctcgtcttcgtcctcggcgcgctgctcacgctcgcgctgatcgtgcgcaaggtgcccggcgcgatcctgatctcgatcgtcgccatgacggctctcgccctggtcatcgacgcggtggccggcctgcccggcggggcgtggggcctgacgacacccgcgtggcccggcaacccggtctccgcgccggacttcggtctgctcggcgaggtcagcctgttcggcggcttcgagaaggtcggcgtcctgaccggcgtcctgttcgtcttcaccgtgctgctgtcctgcttcttcgacgcgatgggcaccatcctgggcgtcggcgacgaggcgaagctgatggaccaggacggcaacttccccggcatcaacaaggtgctgttcgtggacggcatcgcggtcgccgcgggcggtgcgagctcctcctccgccaccacgtgcttcgtggagtccaccgcgggcgtcggcgaaggcgcccgcaccggactggcgagcgtggtgaccggtctgctcttctcggtggcgctgttcctcacaccgctggcgaccatggtcccgtcgcaggcggccactcccgccctgctggcggtcggcttcctgatcatcgcggggtcggtgcgggacatcgactggagcgactacacgctcgcggttccggcgttcctcgcgatggtgatgatgccgttcacgtactcgatcaccaacggcatcggcatcggcttcatcgccttctccgtgctgcgcctggcggccggccgcggccgtgaggtgccggtggccatgtacgtggtctcggcggtgttcgtcttctactacgcgatgccggcgctcggcctcacgtgatcggtggcgtcacgctccctcgggcgtcgccgtagaacttctccgtctcctcgacggccgccgtgaagcgttcgtcgaagtcgtcgcgaatgagcgtccggaccacgtagtcctggacgctcattccgcgtttcgcggcgtgctgccggagccggtcgagcagctcaccgtctatccgcaggctgagcactgtcgatcccatgtccagcagggtcgccgccccggagcgctctttgcgtcactttccgctcctaactcactcgttcgggtgatcagtttctcgcgcgtgtaccatcgggtggtatttaggttgggtaatgagttacgctaacaaacatgcctgacctgatccacgacggcgacagtgccgccgccgtgagctccctccgctccgccgtgatgctgctgggccgtcgcctgaagcaccagcgtgtcgacgagtcgctgagccccaccgagatgtcggtgctcggcacccttgcccgttgcggttcggccacccccggtgagctggcccgcaaggagcacgtgcagcccccgtcgatgacccgcatcgtcgcgctgctggaggcgaaggggctggtcaggctggaaccgcaccccgatgaccgtcggcagaagagggtcagccagaccgagcaggccgaggccatgctcgcggagagccgcaccaagcggaacgcctggctgtcccacctcgccgagggcctggacgaggacgagtgggagacacttcgggccgccgcgcccgtgttggagaagctcgcccacctgtgaccccgcgggcgcgccgacgatgatccgccgccggaccggaagcaccggccggtccgtcccggatcaccgccggagcgcccgtcgtcacgtcctcgtcggaccgaatgccgcagacgcccgaggaggcgaacccttttgagtacgggatccggagcagactccgcccccgcaccgacttccacccacgagagcaagaccggcgggaccttctcgtcgctgaagatccgtaactaccgcctgttcgccacgggcgccgtgatctccaacaccggtacctggatgtcccgcatcacgcaggactggctcgtgctgagcctgacgggttccgccaccgccgtcggcatcacgacggccctccagttcctcccgatgctgctcttcggcctgtacggcggcgtcatagccgaccggctcccgaagcggcagatcctgctcgtcagccaggccctgctcggcctgtgcggcatcgcgctggccgtcctgaccctggccggtgtcgtggaggtctggcacgtctatctggtcgccttcctcctcggcatggtgaccgtcgtcgacaacccggcccggcagtcgttcgtctccgagatggtcggccccgcgcaactgcgcaacgcggtcagcctgaactcggcgaacttccagtccgcccggctcatcggccccgccgtcgcgggcgtcctgatcaccacggtcggcagtggctgggccttcctgctcaacggcctctccttcctggccccgctcgtcggcctgctgatgatgcgcaccaacgagatgcacgcctcggtgaccgtcccccgcgccaagggccagctccgcgagggcctgcgttacgtcaagggccgccccgagctgatctggccgatcgtcctggtcggcttcgtcggcacgttcggcttcaacttcccgatctggctgaccgcctacgccgacgagatcttcgacggcggcgcgggcctgtactcgttcttcaacatcctgatggcggccggttcgctggccggcgcactgctctcggcccgtcgccgctccacgcggctgcggatgctggtggcggcgggcacggcgttcgggctgctggagatcgccgcctcgctgtccccgtcggtctggctgttctcgatcctgctggtcccgatcggcatgctcggcctgaccacgaacatcaccgcgaacacgagcgtccagatggccgccgacccggagatgcggggccgcgtgatgagcctgtacatgatggtcttcgccgggggtacgccggtgggcgccccgatcgtcggctggatcagcgacacgtacggcgcccgcaccggcttcgcggccggcggtgcgatctcggtgatcgccgccctgggcgtcggcttcgccctcgcccgcgtcggcggactccgcctgaaggtcgacctccgcccgggccgcccgcacgtccgcttcgtcccgcgcgaacagctggcgacggcggcgtagagcgcgcgacaccgcagtacggggaaacgccctcctcccggagcgaccgggaggagggcgttcttcgtgcgcccggacctgggagactcgcgcgcatgagcagccacagctccggccgtccgcccacccagcgcctcttcgccgccgtcctgccgcccgccggggccgtcgccggtctccgtgcggcgctggccc

SEQ ID NO: 2890 - DNA, 5400 bp, Unknown
  Kingdom: Bacteria, Phylum: Actinobacteria, Class: Actinobacteria, Order: Streptomycetales, Family: Streptomycetaceae, Genus: Streptomyces
agctcgccgaagaccatcgcggtctcggtggaggcgtcctcactcaggtcgtagcgggcgagctcgatgccgttggcccggttcaccacgcggatgaacgcgttgcgcacctgaccgaagctctggccccggctctgggcgtcgtggatcgagacggggaacacgatcttcgcgacctcggcggggaccgacgacaggtcgacctcgaccgactcgtcgtctccctcgccctcacccgtcaggttgtcaccggtgtggcggacggaaccgtcggggctgttgaggttgttgtagaagacgaagtggccgtcggagaggaccttgcccgcctcggagcacagcaacgcactggcatccaggtcgtgatcggctccggtcgtggtccgtacgtcccagccgagcccgaccgtcacggcggtcaggccgggggcctccttcgacagggagacgtttccgcccttggccagggtcacacccatgaatctcctccagtgctctgtcgatccgcccgtgcggtccgggccctgcggcttcctcgcgtccggggaccggtgaccggtgctgtcgtgcctgtcactcttgtggccgctacctgtacaaacgctcggcgcgacactccgggttcccggattgcgcaagccctgaagtgagcgacgacgggaagaggtggactgctgccctgccccctatcgcggtcggtgggcgctctcgtccttcatcgccctggccgggccgcctgcgcggactcggcaccacatcccgttccggacagccgaaaagaccagtgctagggggccatgcaggtagggcccgaggtgcacatggggcatccgaccgcccaaggaagtcgcaatgaggtctggatgcggcaaggagcgaccgtggcgaagccgcatcggtcaagaacgatcaacccgctcgaacgaagtcgaccgattgccatgctgtcggtccatagcgatgtgtgaaacccgaggcgcttcccacgatccctgcgattcccgcgatgcctgaagtgagattccagaagagagaagggacgcatgctgcccgagcacatcgacagcgacgagagcccccgcgccgaccgccgcactcccgggaacgtcggcaggagcacgatcggggaggacatcgcgctcaccctgaagatcgttgtggccggcggcttcggggccgggaagacgaccctggtcggctccgtcagcgagatccgcccgctgtactcggaggagacgccgaccgggagcgggcggggtcaggacgacaccgacgtggtggaagagaaggccaccacgaccgtagcgatggatttcggccgtatcaccgtccactccggcctgacgctccacctgttcggcacgccgggccaggaccgcttccggttcctctgggacgacctgtgcgagggcgccctcgcggcgatcgtgctggcggacacccggcggctcgaggactgcttcgccgccgtcgactacttcgagcgcgggcggataccgttcgtcgtcgccgtcaaccggttccccggcgctcctgaccatacggagcacgacgtcgcccgagccctcgacctcgaccggggcacgccggtcgtgctgtgcgacgcccgcgaccgggcatccggaaaagaagtcctgatccgtacggtcgagtacgccgggcgcatgcacaccgcccggcttctcgccgccgtcggctgacgtcccggtatcgcggccgcgtccttcagccgaccatgtcggccatcgcgaccaccttgtcgatccgcacccgcacgaccagttcgccgggcacgccgttgcgccggccgaactcctcggcggcatcggcctccacgtaacggtgggcgatcagagtcgcccaccgcaggagttccccggggtcctcgctcagctcggcatgtccctgcaccaccgcgaacgcgtatggaggccggtcgtcgtcgacgcagagggcgacccgcccgtcacgtgcgagattgcggcccttcacgctctccttgccggtgttgaagaccacggagtcgccgtcgagaaggaaccagacgggcgcgatgtgcggactgccgtcggcccgtaccgtcgaaaccttcgccgtgcgcgtgcccttggagaggaaggcccgccattcatcttcggtcatgtggtgtgccatgagcccatcctgagcccgatccccgcatggcgcgaagcggcgctccgagagttgaggggcgcttgcccccacggggccgttgcgcgaggcttacgcgcgtagcggggaacgagggtacggggaggacgagcacatgccgcttgaccggggacttgactggctccttgacgatctcaccagcagggtgcaattcatacggcacgccttggtgctgtcgaacgacgggctggtcaccggggccagtaccgggctcgcccgcgaggacgcggagcatctggctgcggtctcctccggtctgcagagtctggcacgtggctcggggcgccacttccgggcgggccgggcacgccagaccatggtcgagttcgacgaggcgctgctcttcgtgacggccgcgggcgacggcagttgcctgtgcgtgctgaccgcggccgaagccgatgtcggccaagtcgcctatgagatgactctgctcgtcaaccgggtcggcgaacacctcggagtctccgtccgccaaggcgggcccgacgacatcggacccttctgacctgcacttctcatcgccggtgaagagttatccacaggggtgacgggcgatgactccctcgggctaccgtgatcacggagagtattcgagccgacgggggaggacagtcatgacggtcaaggaagtgctacgagcgcatgtcaggacccggtccgtgcacgccggggcccagggcgcgcgggccgagtgcgggaacgtacgggccgatgcccggtccggggacgtcagcgcgcgggtggagggcgagagcgggcacaccccgtccgccgccccggcggcgacggtcgcggccgggcgcgcggcccaggatctgggtatccggcgtgctgagttcgagctcgcggtgcacctggggctgatcgccgtcgtcggcgcaccgggcggtgggcggccacgggtgcacgaggaggagatcgcgcgcctgcgggagcagccgggctttcccgatggtctggcggagcgggtccgcaccctgtgcgcgcaggcggagccggtcgaacctgcgctccgggagcgggcgcacgcggccctggtggagcgcctgctcgcccccgaccgcccgggggccgagctgtacgccttcgtccacggcgaggacgccgagctgatcgccgcgtacgaccgggctgcccggacggagaccgtaaggacccggctgcgcacccagcccgcctacgcggcggactgcttcaccgtctggaccgcccacccgcacgcgggccgcacctggccgccggtggccgccgctctcctcgacgacgtcctgcgccccgccgtacgcggtatgtcggccgaggaggtcgcggaggtcgaggcgacggtgggccgcacgggcagcagcggccgtgcggacgccttccgggactggaaccgtgtcagcgccctgggccgcctgggccgccggatcgcggggcgggtgcggcgggggtgacctcgggcacggccccccgccccatcgacgctgtgcggctcggcgccgatggggcctgaggggtgcgatcagggcaagaagcccgtcacccggaccgcacttccgaaggcgtgctcgtccgccctctccgcctggaaacccgccgaggcgaggattgccagaagagcgtcccgcatgcaggtctgcacggtttcgtagtggcggatcgcgtggggcagattcgaaggatcaaccccactctccagaaggttcacagccgctgtcgccagttcctcccgggtgttccactccaccagcactccgccgtcggcgagagggtccacctggacatccgcacccggtctgcctgaggcgtcctctccgagttccgctcggtgagcgggaatgcccgcccggtccagcgcgagacaggccgcatcggccagcgcctcgcgccggccgacgacctccggcggggctttcggcggcacctcgaatccgtgctcgctcacgcgtccctcactccccttcctgcttctgacctgccgacgagagcgccgagcgtccgccgccggcttgcttgacgtactttgccagcagttgtttcgccgcactctcgatgccggcgtagtagggaaccgaccaggtgaccggcgtgcctcccttgagagcgccggccagttccgaggcacaggccgcacacggttgccgctccgtgtagagagcggtgatctcgctggggtcgatcttcttcgccttcagcatgtccaggatcgccgtctccgagtggcccgagaagctgctgctcgccaccactagatccccggtcttcgggtcgttccatcccggcaccctggccacagcgacattgtgctgtgccccgaagaatccggattcggtcctgaactggtaagccatgcggctcaggtcgtcgctgttgtagcggatcaaaccgccgcaaccgtcggcggccgcggacgcacgtgcggcgaagcccctactgctgcgcgtgcagaactcgacgaactcgtccatcgcccggtagccgatgcgagcgacgacgtcgtcggccagacccagggcgcggagcccgttcagtgcgtcgaagaagccgatgccggtcctggctgcggcgtccgccgccctgaccgcgtccgcgatgggacggaggatcttgccggcgaacagcgtcgccacatccaccgcggcccaggcgcaaccgccccagctcccgttctcaccgccgggggtgagtttctgggcgcagcggatccagctgccgaagaggatgtcgatggggtcgacgccctgctggtactccccgatcgtgatggtgtgggtgacctcggtgtacagggtgtccgtcttgtgctcgcccaggtacagcgtgtccgccgaggggcacgagttcgcccatacctcgctggtgcacaggtagaggtcgaggtcggccttgtacccgatcttctgggtcatcgtgcagtcgccgtcgtaggcgagctggtcccaccagccgtcgcagccatcggtcttcttcaggacctgcggcttgccgacctgctcgatgcggtcgacgacgtagaagacgccgccgatgggtccgcccgcgtcgtccgggaccgttccggtctcgatctgctcggcgttccccgcgttctcggcctgcttcgcggcctcctgggcggactcggcgtacgcctgggcgtccttggcggcttcctccgcggctgtcgcggcgacgtcggcccgctcggcggcggctctggcctggctggcggactcctccgcc

SEQ ID NO: 2891 - DNA, 8929 bp, Unknown
  Kingdom: Bacteria, Phylum: Actinobacteria, Class: Actinobacteria, Order: Streptomycetales, Family: Streptomycetaceae, Genus: Streptomyces
tccggatcttcggcggtgcgttgggtgaggcgcacgccacgaagatccacaagatcatggacatggccatctcggccggtgccccgctggtgtcgctgaacgacggcgcgggcgcccgtatccaggagggtgtctccgcgctcgccggctacggcggcatcttccagcgcaacacccgggcgtccggtgtcatcccgcagatcagcgtgatgctcggcccgtgcgcgggaggcgcggcctacagcccggccctcaccgacttcgtgttcatggtccgcgagacgtcccagatgttcatcaccggcccggacgtcgtcaagacggtcaccggtgaggaggtcacccagaacggtctcggcggagcggacgtgcacgccgagacgagcggcgtggcgcacttcgcgtacgacgacgaggagacctgcatcgccgaggtccgctacctcctgtcactgctcccgcagaacaaccgcgagctgcccccgcgaaccgacccggacgactcggcccaccggcggaacaccgcgctcctggatctggtgccgaccgacggcaaccgcccctacgacatgaccagggtcatcgaggaactggtggacgacggcgactacctggaggtccacgagcgctgggcccgcaacatcatctgcgcgctggcccggctggatggcgaggtggtgggcatcgtcgccaaccagccgcaggtccttgccggggtgctcgacatcgaggcgtccgagaaggcagcgcgtttcgtgcagatgtgtgacgccttctccatcccgatcgtcaccctgttggacgtccccggcttcctgccgggcgtggaccaggagcacggcgggatcatccggcacggcgcgaagctgctctacgcctactgcaacgccacggtcccccggatctcgctgatcctgcggaaggcctacggaggtgcgtacatcgtcatggacagccagtccatcggcgcggacctcacctacgcgtggcccaccaacgaaattgcggtgatgggggccgagggtgcggccaacgtcatcttccgtcgccagatcgccgacgccgaggaccccgaagccatgcgggcccggatggtcaaggagtacaaggccgaactcatgcacccgtactacgcggccgagcgcggcctcgtcgaggatgtcatcgacccggccgagacccgcgaggtgctcatccggtccctggcgatgctccgcaccaagcacgccgaaccgccctcgcggaagcacggcaatccgccggtgtgacggtcgggggccctgccgatgggccggggtggcctggtcgccggaggtggtgacactccgggaacggctcacggcgggggtccgggtgctgtgccggccgggagaccgcgatcgccattgatcgacggatcccgaaagctctgttatagggcccggaatgtgccgtgtttcttgcgggtgtccccgaggtgaaatgtggaggtcggggaagggtggcgcggttgtcgcctgacaatcaggagggtacgaagcggaaacccacgccgcgtaccgtgctgatccattggctggagccgagcttattgcgcaggctgctgatgtgcgtgtctatggtgcggccaggtttcgcccggggatcgccccacacctgggtcataatctgtttgcgcgaaaagacactgcccggtcgtgaggcgagcagatacagtaaatcgaattccttccgggtcgcctctatgcgccgccccgccagacggatttcccgggcgcggtgatcgatgtgcagcgacccggccgcaatggagtcgtcggggacgaacggctgaagccggaccctgcgcatcacggcttctatccgggcggacagttctgtcagactgcacggcttgacgacgtagtggtcggctcccgcgcgcaggctgagcacccggtcgagttccgtatcgcgggcggtggcgacgatgatggcgacgtcgcagacggcccgaatgctgcggcacagttccactccgtccaggtccggcagatccagatcgacgaggagcaggtcggccttccggtgctgctggagcgcttcggcgccggtcctgacctgttccgcctcgtacccgtgtcgctgaaggcccagaacgagcaggtcggcgtcccgggactcgctctccacggcgagtatgcgcacggccttgcggtccgcgggttcctggggccggatgggggcgacgcgcacgggcgatgggtgcggaatgcgcggcgcgaccgttttcgtggatagatatgtcataccgagacagtctccatttgcgtccactggaacgaagtatgagtaagtatctccatgtgtgcacagggcgatcggatcatcggcatccagcgcacgcctgatggacggcgaacggcgatgtaggagatccgatgctgcatcggaacgaagtgggatgggatacgaaccggtccgtcgaaaaactggcccgcgcccatcgaggtgtcaacgaaaacatttcggccatggtgccccccccgtcccccgtgtccgctccctgtcgggtcggccgcctgcgtcatgacatcgatcatgagggttccccgcccccatgccagtcatacatggaaatcagcgttgccccgtcgccagagaaacgctgtacacgcgagtgtacagacgctagatgcgatgcgcacgaggtttcggtcgtgtcgtccggaggggccggaaggcgtgtgtgtgccgggacaagttcgggaggtccaaccgccccttccgtccagtccgatgggagtcctttgtcgggttttcgaatttgactgcggctccattccggagatggctgagcaggggtttcactgatccgggtgtgggtggggcgacggtgtctaccgtggcggtggagagggcggaatccgcggtaccgactcgccccggaggcgcgcctggtgaagtcggacgagcgcagggcggccgtgcgcggcgccgcgtcgagagcgacttccgcacggccagggggtccgaagggagcgagggcgcggccttggcgctgcgcccccgtccgcatagcgtctcgcgtagcagccagcgtcagcgcgagagaggccgtccgtgccgcacacccacccgtccccgtccccggcccccgaagacgccggggccgtcgcggaacgcgcccggcgcgccgcgcgcatcgaggcctccctcgccgcgcccggtgcgcccttcgccgtggtcatcggcgagcaggggacgccggagtacgccgacggaccccgtacgctccgggagttcgtggagaccacctgggcctaccgggacacgccgttcctcatcgccggtgaacagcggtactcctacgcggagttcttcgccgccgcctccgccctcgccgtacgtctgcgggagcggtacgggctgcgctccggcgaccgggccgtgatcgcgatgcggaaccaccccgagtggcagatcgccttctgggccgcccagttggccggtctcgtcgccgtaccgctcaacgcctggtggaccgaggacgagttcctccacgccctggcggactgcgagcccggggtgctgctcgtggacggggagcggctggggcggatcgccggctgggcccggcggaccggaacgcgcgtcgttctcttccacggtgaccacggtgaccacggggagcgccaggacggggacggaaacgggcttcgcgtcgagcggtacgaggagttccccgcacccgacccgctggccgcgccgcccgacgtggagccacggcccgaggacgacgccacgatcctctacacgtccggtaccaccggccgccccaagggcgcggtggccacccatctcgcgcaggccggggcggcgctcaacccccgctaccacgcggcggcctccgcgctggcgcgcggcgtcatccccgggcaggggcccgcccccgtgtccctgatgacgttcccgttcttccacgtcgccgcgttcaccggcttctacggtgcgatggcggccggcggcaccctcgtcctgatgcacaagtgggacgcggacgaggcgctgcggctgcgggacgcggtgggtctgttgcacagcgacggctccctggatctcgacccgacgctgcggtcccgggtgatcgacagctgtctgggccgccgccccgcccggatcccggtgccggagtgggccgctccgtacgacgccgagaccgcccggctcgacgcgctgctccgcgacatcggggactccgaatggcacgcgccggtgcgcctgcggtggttcgaggaggagcgcgaggtcagccgcaggaccacggtcgccggcgtgatcggccacctgacggcggtcgacgggctgctgtccgccgcgctcggcctcgacgacccgctcggcggcggcgaggctccgctggaccccaccgagcgcaccgagcggtactggtcctcgacacgccggccgcccacccgggccgtccgcgaaccctggcgggcccagagccacgagctgatccgtacggcctccttcgccggacggaacgtcgccgaggcctccgtctcctacggggccttcgccctgccgctccaggacgcagctctggaccgcgccttcgagtgctgggtgcacggcggggacatcgccgacgccgtcgactacccgtacgaggccccgtcggcggcccatctgcaccggatgatcgacctggcggcccggctgcttccggccgccgtggcgggacgccgccgctccggactggccggcccggcgaaggacctcgtcacggccggtgcgccgggccgctcggtccatctggagatcgagggccacggcggcggcgactggtacatcgcgctggactcgcccgccgcactcgggtcgcccgagcgcgcggtggcgcaggtggccctggacggggtcgagttctgccggctcgccgcgggtcacatctcgccggtggaagcggcggcgggccaggagggcgaccgcgaggccatccgcgacgtgctgttcgcgacggcctcgctcagccggctgtagggcctggcgacaggtgccgggttctacgcgaagatcaccgtacggcggccgttgagcaggatgcgccgctccgcgtgccacttcaccgcgcgcgccagcgcctggcactccacgtcccggccgatggcgaccagctggtccggcgtcacgtcatgaccgacccgctcgacctcctgctcgatgatcgggccctcgtcgaggtcggcggtgacgtagtgcgcggtcgcgccgatcagcttcaccccgcgcgcgtgcgcctggtggtagggcttggcgcccttgaagctcggcaggaacgagtggtggatgttgatgatccggccgctcagctgcttgcacaggtcgtcggagaggacctgcatgtagcgggccaggacgaccagctcgacgtcctcctcgcggaccagttccagcagtcgcgcctcggcctccgccttgttgtccttcgtcaccgggaggtgccggaacgggatgccgtacgaggcgacgagctcggcgaagtccgtgtggttggagacgacggccgcgatctccaccggcagcgccccggtgcgcgagcggaacagcagatcgttgaggcagtggccgaacctgctgaccatcagcacgatccgcatgcgctccgcgggccggtggatctgccactccatccggaaggcctccccgatcgcggcgaagctggcgcgcagcttgtccaccgtcacggtggcgtcggccgagaagtggacgcgcatgaagaacaggcccgtgtcgtggtccccgaactgctgactgtcctcgatgttgcagccggtcatgaagagatagctcgacacggcgtgcacgatgccctgtttgtcggggcaggagagcgtgaggacgtactgctcggtcgcggcggcgtccgaggcggcggagggggcgggctgcggcgcggtcatcctcgtagggtgccacacccgcccggcgtcaggccgctctggtcatgatgcggatgacgtccagcgagcgcggcggtatgtccggatcctccgcgtcgttggtggcgagcatcacatgggcctcgcgggccgcgtggacggcctcgggccagccgtggtgctccagataggcggagacgggggcgtccgcgccgacctggtgcatgatccgcagaacccgcagggcggcggcgtccacggcggcggcctcggcggagtccctgaatatggtgccgacgtacttctcggcggaccagttgtcgagccaggtgtcctccaccaggcggtacacggcgtcggtgacgtccccgtacccctcccggccggcgagccagcactcgtggtggaaggtggggtcggagagcatgtgcagcgccgagcgcacgttggtgcgccagcgccaccacggcatgtcagtgagcggcatgccgcccatggtggaggagcgacggccgcgacgggaagagttctccgaaccttgctgcacggtcgtcgatcgtacgttccttcaccgcgcccccgcacgggcccccgtaattcacctggaggtcaccgtgcgttgagaacggcacaccgcgccgttacccggcgcccgaaagagtcttggtccatgaccggacggcgacgccccacctttccccgccccttcccgggcgtcatcagcgcggcggcggcgggggcggtgctgctgtccggctgcggtgtgctccctggggcctcgggggggtccagggagcccgtcaccgtgatgacctgggcgcccgaccggtcggaggacatcaacgcggtgaagatggccggggtgcccgcgatggcgcagacgtacgcccgctgggtcaacgacaccggcggcatcgacgggcgcgagctgaaggtgatcgtctgcgacgagtccgacaccgcgctcggcgccgagcggtgcgcgcgggaggccgtcgggaagaaggtggccgccgtcgtcggctcgtacagccgccacggccagagcttcatgccggcgctggaggcgggcggagtcccgtacatcggcggctacggcgcctccatcgaggagttcagcagctatctctcgtaccccgtcaacggcggccagtcggcgctgctggccggtcacggacggcagttgggccgcagttgcgagcgggtctcgctggtgcggcccgactcgatcggcggcgacggcatgccgccgctcctgaacaacgggctgatggccgccaaccggcccgcctccaccgacatcctggccccgctggacgccacgtcctacgacgagcaggccacgcaggcgctggagcggtccgacggcggctgtgtgacggcggtgctcggcacccgtacggagacgttcttcgactccttccgccgcctggaaccggacggcgagcaggtcaggatctcctccgtgctgggcagcgtcagccagccgctcatcgaccgcacgggcggcgcgaacagccccttcgagggcgcctacgtcaccggctggtacccggacgcgaggaacgcgcgctggaaggagatgcgcgaggtgatcgggaagtacgccttcggggacaaccgcatcgacccggacgacaccgccgtgcagacgacgtggatcgcgtacacggcactgcgggcggccgtccggacgatcgacgacgaggaggtcacatcgggccgggtcgtggccgccctcaacgggggcgtcgaggtcgacaccggcggcctgaccccgacgctccgctggcgcttcaaggacctggtcggcacattgagctacccgcgcatcgtcaacacgaaggtgacgttccaggtggtccgcgagggccggctcaccgcccagaagaagggcttcgtggacgtctcggacgtcctgacggacgcccctcgcagctgaggcccttcgtcgcggtcgggccgggtccgggtctcagagctcggtgaacccgtgcttggtcaggccgtacttcgccgcgatctcgttccagagcctggacgcctcgcgcttggcctgggtggccactccgctctgctggttggccttggccgtctcgctcgtcgaccgggcctggccgcccttgcagacggacttgttcttcttggcctgccgcgcccaggtcgcgtagtgctcgtcggccgccgccgaggccttccaggcgcggttcagcgaggcggtcagctccgcgttctgcgggagcttgtccacggtcagcccttcgagccgggtcaccaggtcacggcgctgctgggcggcgcccttgaggtcggtgttcgcccggtccagttccttgcaggacttgatcttctcgaccgcgctgatcaccgcggcccggctgttgttgctgtcggccagcagcttgtcgagcgcctcggcctgcggcttcgccgggtcgggcgccgccttggcggtgggctccgtggccggtgaactctgcgcggcgaccggctgcttgtcatcctcgccggaatcgtcgccaccgctcagcagcgcgcccgcgccgagtccgatgacggcgcagcccacgacgaccgccgcgatcagcggaacgtgcgcggaccgccggcgcggtgcgtcgccgctctgctgcgggaccggcccgtcctgctccgcgcggccctggaagccctggagcccggacgggtggaccccgggtgcctgtggcggcaactggccgccctggggctgccgctgaggctggtgaccctgctgctggtacggggccgggggctgctgctggtacggcggcggggactgctgccccgcgtcgaactgcggcatctgctgcgtggcgcccgccggctgctccgtacggaacaggttgtcgaactccgcgggcggctgccggtcccccggcgcacccggcctgatcccgtacggagctcctccgggcaccgggggtatgagctgggtcgcgtcggcgtccccgccgccctgcgggggtcccacggggtcggggctgcccgggacgggcgcgatgtac

SEQ ID NO: 2892 - DNA, 6786 bp, Unknown
  Kingdom: Bacteria, Phylum: Actinobacteria, Class: Actinobacteria, Order: Streptomycetales, Family: Streptomycetaceae, Genus: Streptomyces
ccggagcccagcagctccggcgcggccaccaccccggccgacggcggggccaccccgggcgcgacccgcgactccggcggccggagcaccggttcggacacccagcccagccagacccagggcaccaaccaggcgcctccgcagcagaccaccccgcagcagccgccggcggccaccaccgccggacccacctcctccggatccaccggcgacgcgtcttccggaggcggcggcgaaccggcgcccaccggcggctcgacctcctccggcggcgagggatcgaccacgggcggcggccggaacccgatcggcggcctcctgggctgaccccgtacgacagcagcgaggggcggcccccacccggacggaagatccgggtgagggccgcccctccgtgtgagggcgacggctgtcagccgtcgtgggagccgagctcgcgggccgcctcggtcaggtccttcgcggtgtcgatggcccgccagtacgcgccgttcggcagcggatacccggccagccgacgctcgcgggccagccgcgggaacgtggtccgctcatggtcgccgcggtccggcaggagcttcgtgaacgcgggcgagaacacgtacaccccggcgttgatcagatagggcgagggcggcgactcgatgaagtcggtgatgtggccgaacgcgtccgtctccacggcgccccacgggatccggggccgggcgagggccagggtggcggtggcgtcgcgctccgcgtggaaggcggccatctcacgcagggagaaacgggtccagatgtcgccgttggtggcgtaccagggctgctccggatcgggcagccggccggccgcgtacttcagtccgccgccgcggcccagcggctcggtctccacgacggtggtgacccggagcggcagtacggcggcgtccagccactcctggagcacttcggcgaggtgcccgcaggagaccacggcgtcggtgaccccctcggcggccagccaggacagctgatggccgatgatcggagtcccggtcccggggatctcgaccatcggcttgggtcggtcgtcggtgtacggccgcagccgcgacccctggccaccggcaaggatcacggcctgcgtcggatacgtatgcatggcaggcacgatatgcggtgcccgccgtcggaaggcaccgctccgcgtgaccgcctcccgggccgagaggccctagctgaactgcgcgacgccggaggcgaacgaggtgtcgcagacgggccgggagaagcggtgcgcacgggtcgggccgtactgctcgacggcagccttgcccagggccctcgcgatcgacatgcagtggcgggcgagcgaggggcgctgctcgacggcgcgctggaggcccgtgagcgcggtgcccgggtccttctcctgcagctccacgagcagcttctcgcgcaggacgtcctgcggggcgtgcggcttcgcgggcttggaaacggtctccgaggaggcggccagcagctgggagtcggcgtccgactccgcccactggacgctggtgaccgcgagggtcccggacagaaccatgacgacgggcaggacgagagcgagggatcggccgatgcggcgcgcggtgtgggtcacgcagcgagcgtagcggccagtgatggcttggcgacaattcgtcacccctgcgggggatggttcgacgcgtcctttcgaatacgaggttgacgaaccagggtgaaatgccctgtgtgccggggtatttgctgccgcccggcaccgaaacccgaacccgccgggatcacgcaaacggccccgcacccccttgcggggagtgcggggccgggcagtacggcgggtggggcgtcagttggtgagacgctcgccggtggaggtcgcgaagacgtgcagctcgtccgggcgcgggacgacgtgcagctcggtgcccttctccgggacggcgcggccgccgacgcggacgaccaggtccttgtgctcgccaccgacctgcgcgccgccgtagacgaagccgtcggcgccgagctcctcgacgacgttgacggagacggcgagaccggccggcgcgtccgaggagtccttggtcagcgacttcgcggcggcgccgccgtgctcgacgatgtcgaagtgctcggggcggatgccgaccgtgacggtggtgtcaccgcggtccgcggcggcggtgagcgcctcgcgggagacggggacgacgctgttgccgaacttcacgccgccgtcggtgatcgggacctcgacgaggttcatcgcgggggagccgatgaagccggcgacgaagaggttcgcggggcggtcgtacatgttgcgcggcgagtcgacctgctggagcagcccgtccttcagcaccgcgacgcggtcgcccatggtgagggcctcgacctggtcgtgggtgacgtacacggtggtgatgccgaggcggcgctgcagcgaggcgatctgcgtacgggtggagacgcggagcttggcgtcgaggttcgacagcggctcgtccatgaggaagacctgcggctcacgcacgatggcccggcccatcgccacacgctgacgctgaccaccggagagcgccttcggcttgcggtccaggtagtcggtgaggtccagcatcttggcggcctcttcgaccttcgcccggatctcggtcttgttgataccggcgatcttcagcgcgaagcccatgttgtccgcgacggacatgtgcgggtagagcgcgtagttctggaacaccatggcgatgtcccggtccttcggcggcaggtgcgtgacgtcgcggtcaccgatgcggatcgcgccgccgttgacgtcctcaagacccgcgagcatgcgcagggaggtcgacttgccacaaccggagggaccgacgaggacgaggaactcaccgtccgcgatgtcgatctcgagctggtccacggccggcttcgtggagccggggtagacgcgggacgccttgtcgaacgtgacactggccatgctgaatcttctcctcaaccggcaggaacgtgccggacgatccgagtagggagtggtctggtccacagacgcgaacctgccgtgacgctacctggcgttcatgtgttctgtcagtacctcttgggtcacgaaaatcgcctcgcaacctgtggagggatggcaagagcaacgcacttttgacctgccccgcaacttaagagcttcctgcttcggcacccatcgccgaccggacgccaccctgaaggcgacaccccgccggtctcacacggactccacaggcatcacggccgacggcccgtcggtccggcactcatttcctacgtagtcacctgtcgcgcccgaaaaggtctctgggcacctcacgccgactatgccgtcagcaccacgtccgccatctcggatgccttgatcaccgacggcatcacccgccccggcggaagcgccgacgccaccagtccgtacaggcgcagaccctcctcccgcagattccgccccgcgttcacatcccggtcgtgcaccgcaccgcacccgtcgcaggaccagccacgcacggtcagatccaacttcggccccatcgccccgcacgcggaacagcgccgggtcgaggggaagaagcggtcgacgatgaccagcgtccgcccgtaccacgcgcacttgtaccgcaactggcgcagcaactcgccccatgctgcgtccatgatcgaccggttcaaccccgcctttcgccgacgtcccttccccctcggcgaccgtacgagagaggcgacggccaggtcttccaccacgagcacttggttctcgcgcacgaggcgggtggtgagctggtccaacgtgtcccgacggacgtcagcgatgagggcgtacagccgcgcgatctcctgccgcgccttgtcccggttcctggatcccctctccttgcggtgcagacttcgctggagagccgcgagcttcgctccgtacttcctgagcagccggcggtggtccaccttctcgccgtcgtccagcgtgaccagggtcgccagcccgaggtccagaccgaccgcctttggcgcaccgccgtcccgcagaaacaccggcggcaacggctcgatctgctcctccaccagcacggagacgaagaagcgccccgcccggtcacggctcacggtcagcttcactggtcgcactcccgccggaagtgcccgggaccagcggatacgcagcggcccggactgcttggccaacgcgatcagccccgtacccggccgctccgggtcctccacccagcggaagcccgtacggacataggtcgcggagtcacgggaacggcccttcttcttacgcttcggctgcctccccgagcccttgaagaaccgcccgaacgcggcgtcgagatggcggagagcctgttggagaaccgttgaggacacctcctgcagccattgcgtcccctcggtattccgccagcccgtgagagcccggcaggactcggcgaacccgagcgccacccggtgctcgcgccaggctttgtcccgcagggcgaggccctcgttgtaggtccagcggcaggcgccgaaggtcttgatcagctgctcggcctgggtgggtgagggatagcagcggtaccggtagacacgctggcgagtgtcggcttccggcgtccgccgctgcatcggcacggtcgcccgctgctgatgcttggcccggtcgggaacgcccaacgcctcacgcttgacgctcttggcctccgcgccggtgacgcggagccgtccgtccttccttgcggcctcgaccacggctcctccccctgtccgatagtcggatggcacttcagtgcgttcaacgaacaggtgagtgggaggttacggccgtccgatatgcctgtccgtgggggagcggggctgtgtagagttgtggcgtcttggtgcgcgctcctggtgtgcgtccttgcctccttagctcagtccggcccagagcggctgtcttgtaaacagcaggtcgtcggttcgaatccgacaggaggctcagcgtgaagcccaggccagatctcttctgacctgggcttctgtcgtcagcgaaagaggcgacgcccagtcggctgcggtcgcccgcccctcggtcagcgcccgagggccaatcgcatcaggggcgcggttataccgtgtctgacctgctgcttcctccggcggttgctccgtgacggcacacggtccggggtcgggaagtgtggccgccggcattgcgttttgggccaacaccaccgccgttgcgatcgttgccggtgggctcggtgccgtgtcagcggccctcgccggatatgtcgccaagacgttcatccgctccccggaagccgcagcgacccatctgcggtcctacttcgaccagccccttgagctctcccgctaccttgccgcggaacggctcgtcgccgacggagacctctcccaggagcagcgcggggaaatcctctccgtcctcgtccaagctatggcagccggaccgcaaccgccgcccacgccccagtccgtagttgtcgcctccgtgcccgggcaacaagggggcgtaggtggcgcggggctccagtcgccgcaggttccttgaattcacccgcaggttgggttgtggccgggatgctgcccgccgcaccgctgtaaggggtgaggggtgaacggaagccacctctcgaactctgcgtaccagggttgtcacacgcctggcctccgtacggagcgtggcgagacaatcgccgtccgtacccacaaggcaggggatctcatgactaatccgtaccaaccgcagccaagcccgtacctcaacacgccggtgccctccggcaggccgcgcatgttcaactccaccatcgtcaaggtgatctggattctgctgcccatcgtgacgatcggcatcggtgcggcggtcccgttcgtggtcgctgcggtgaagggggttatcaagccgtggccggccgttgcgtacgtcctggccgaggtgtcgatcctgggcgtcagcacggcagccgcaccggacggtgagagcccgttcgtcgggatgctgctcatcttcctcatcgtcgcgtcggcgacgcacacggctctgctcgacaacgaccgggtgagcatcggtaagtaggagaccgctcgaccggcgcaaggtgtcgggcctgtccctctggcgccgaaggctcgcccccatcgccactgcggtgggggctttcgctgcccgccacggcccgggcagtggtgctggtgtgggggaggagttctggctggtgatgccgatgtacttctccgcccggcatttcgccgaggacgggacggagcaccggaactgcttcgtcgactccgacggggtcgtccggtaccccgtcggcaccggcggcgaggaaaccgtcacgcactgggcggtgttgcccgcgctgtcgggtggttccgtgcacgtgctcctcggggctgacgtgcagcctgctcttcggggtgctgcgcggccttgagagtcggcgcgcggtgggcttgttcaggtgcgggttcgggtgtcgatggtcagttccacctcggtttccttccgggtgaaaccccttacggtccaggtgccgtcgtcgacgggggtgccggccgcggtggtgtaggcggcgaccgtgagggtggagcctgtcggggcgtccgtgtggagttctgccgccgtggccgttccgtcggagaagcgcaggtagacgtcgagcggctccggagctgccgcgaaggactccgggtggggcaggtcctggaggcggcagcgtgcgccggggaacaggtgggtgtgggtgcagagggccaggtaggccttggggt

SEQ ID NO: 2893 - DNA, 1503 bp, Unknown
  Kingdom: Bacteria, Phylum: Actinobacteria, Class: Actinobacteria, Order: Streptomycetales, Family: Streptomycetaceae, Genus: Streptomyces
gccacctggagcccgccgatccgctcggccggggtcggcagcacggcccgcatggcggtctccgcgatgacccgggccgaggcgagctgctcgttgccgcgccgcacgacgccgttgatgacgagggccagcaccgaggccgtgagcacggtgagcatctcgatgaccgggaccacctgggtggacgtcccgtcggagagccgcatcgcgatgacggagaggaccgcggcgatccccgtacggacggtccgggaccgcgagaagaacggcgcggcgatcagcggggccgcgacgaacagcgggaccgcggtgaagttgggcggagccagcgagtcgaacaccagcccgccgaggatcagcagggcgggcagcatccggacgaaccgcccggtgcgccggccgtcggacgtcagctggccctcccgggacccgaacaccgcacggcccacggcgtcgatactccccgccgtgccactacgccgctcgtcggccatccccacctgtgcactcctgcccggtccacccacggctgcggacggtaccgcgccccgcccaggcttcccggagccgcgccgagcggctactccgcgtcggccgaatagggggaaggcggacggcggccccgccttccgtggtcagtcggagagccggtgttccgcgtataccgtcaatgcgtcccgtacgaaggcggcggtgccgtccccgtagcgatcgtagttctttccgaagcggggatcggcgacatacatctcaccgagcccgatcacgtacgaacggctgggctcctcggccgaggacagccacgcgcagtgccgccgcgcgaggtcctgcgcctcggccccgtcggcggggagcccggcctccctggcccggccccaggcgcgcgcgatggcctcgtgctcgtcctggaaggccttcttctgttccggcccgagcgaacgccaccagcggtcgccctcctcgtacgcgtcccggccccaacgctcggtgacctcctgctcgtgggcagtgtggtcgaagccgtcgaacacttcatcggccatgagttccgtcccctcctgcgtcttgtggagagtggtccgcaccgaggcgatctgccgcccgatgcgcgcctgctcctgttcgagcaaccgcagatgcgcccgcagcgccaccgccgtgtcccgctgccccgcgagcacgtccttgatggcgggcagcgaaagaccgagctcccgcagcagcaggatgcgctgcagccggacgagagcgtcctggtcgtagtagcggtagccgttgctcccgatccggctcggcgtgagaagaccgaggtccccgtagtgccggagcgtgcggctcgtggtgccggcctgtctggcgatttcctgaatggaccactccatgccggaaacgctagatctttacgctgcgtcaaggtcaagccgaaccagcacggcgccggaaaacggtccgggcccggcacgctgtgcgtgccgggcccggaccttcagtagcggggacagg

SEQ ID NO: 2894 - DNA, 8413 bp, Unknown
  Kingdom: Bacteria, Phylum: Actinobacteria, Class: Actinobacteria, Order: Streptomycetales, Family: Streptomycetaceae, Genus: Streptomyces
accgggacggggtcgacgtgcccggagggcggaagggtccgcgccagggcgagcccgacgtccaccagcgacgaccggcgcaggcgggcgacctcgggcagcggggtccacaccgactcggcggtgtcgccgttcggctcgggccgcagccggccgccggtgacgcgtacgcggtagaacacgccgatgttctgatgctcgggtgcaccgggccgcctgcgctcgcccgccggaatcacccgtgagtccacaccgagcagacgctcgaccacggcctccaggccggtttcctcggcgacttcccggatcaccgcgtcgtacgggtcctccgattgctcgaccccgccgcccgggagcgtccacgtcctttcgccacccggacccacggcaagcgcgagcagcacccgcccgtcctcgatgcacaccgcgtacgcggccagtcgccgactcatgcggagaggctatccccgggcgtccggggactggtgtgcggaggcgggggccggagtccgaggaccggcgtccggtacccccctcacaactcaagatcatcacgatgcagaatgacctgtatgtcgataaagaacacgccgcaggcggccacgctcgacgatgccccgtcgatcagccgcaccctggcccgcgccttcgccgacgacccgatgatggggtggttcttccccggcggggcctcgcgcgagcccgacctggtccgttacttcaccacgatcttcacccggcagtacggccgccacggggtgtgcgagcgcaccgagtcggcggccgcgttctgggtgtcgccggaggggcaggagaaggccgttcccgacgcggagaccgtcgcggagctggaggagatcctgggcgaccgggctcccctgttccgggaggccgtcgaggccgccgcccagcagggacccaaggagccgcactggtacctcgcggtcgtcggcgcggacccggccgcccggggccaggggcacggggcggcgctgctgcgttccggccttgccaaggcggacgcggcggggctgccggtctacctggagtcctccaagcccgacaacctgcccttctacgagcacttcggcttcaccgtgctcggcgatgcccgactgccgggcggtgggccgcagttgtgggtgatgcggcgggagcccgtctcttccggccggtagccgtacgacggcagcgaggagccccggggttcgcccggggctcctcgccgtgtggtacgtctccgaccggcggctccgggggcaccaacggtggcggcggaggagcaggcccgaccccgaagaagagagctgcgcgggcgggtggagtggggcggtggttcttctgcttcgacatcgatgactcgggcgaagccttgcggacgtcgggcgaagcctccgaagggagcctcatttcggtgaggctctcagaaggtaccgagcgtgaatgtcacgtcgacctcagcgtcatcgacgaagggtgctccctctgcatcgccgaccttgaccaggtctgctcctccgacctccgcttcacgcgtcagtgacagccctttgcccgcccgccggtcacaccgtctcttccgcttccgcctctgcgcccgcccacgtctccggcgcccatacccccgaccgcttcagcgacgccgggcagtggcggaagatctcgtcgatctcgacgaccagggcgagcttcgggcgctggcccttcaccgtcatcgcgtcgaagaacggggcgtccgtgagaatgcgggcccgaccgttgatgcgcaggacgtccatcgcaccgggtatcaggtagagcagtcccacgcgcgggttcgccaggatgttgtggaagctgtccgcgcggcggttccccgggcggtccggcagggcgatggtgcccgggtccaggacatgggtgaagccgggggtgccgccgcgcggggtggcgtcgcagttgccggccgcgtccgacgtggccatggtgcacagcggcgagcgggccagcaggtccaggtcggcgtcggtgagccggtcgtggaccttgtcgatgacgatcgggtgcggggttcccagaagctcgcgcagttcggccgccgagcccagaggtacggccccggccagcgaatcggtgacgggggcggcgaggtcggcggcgtacgacaaggtggtgctccggagctcgtggggtgcggctgcgcgcggtcgaacaggcgctgttagggtgaccttactttgggcccccctgcgttccccgtccggggtggaccgggtgacggggtggccctcgcgcgaaggcgcacacgggcggggagcgtcggccgcgtgcccgtgccgacgacgcggccgacgaccaagggtgaggaacgacagtgcaccaccgcataccggccgctccggtggccgggtcgtgagcggcccggccctcctgaagaaggagaaaccggcgggcggcggccaggagacgcggcgcaagcgcagccggcccgttctcgccctcgggctgctcgccgccctcgcggtgctcttcctcaccgtggtcgccagcctcgccgtcggatccggcgacgtgcccttccgcgatgtcgtcgacggggtcctcgacccggacacctcggtcaaggggcagctcatcgtccaggaggtccgcatcccgcgcaccgtcgccgggctgctcgccggtgtggcgctcggcctcgcgggcgcggtgatgcagggcgtcgcccgcaaccccctcgccgacccccagctcctcggcatcaacgcgggcgcgtccgtggccgtggtgtgctcgatcaccctgttcgggttcacggtcgccacccagttcatctggttcggcttcctcggcgcgctgctctccgccctcctcgtgtacggagtcggctcgctcggccgggaaggcgccaccccggtcaagctggcgctcgccggggccgcgaccagtgccgtgctcacctcggtgaccagcgcgatcctcctccaggaccggggcagctacgaccagttccggttctggcagctcggcgcgctgaccgcccggagctccgaggtgctgtggcaggtctcgccgttcgtcctgaccggcgtcgtcctcgcgctggccctcggaccccagctcaacgccctctccctcggcgacgacctggcccgcggcctcggccagcgggtcgggaccatccggatggtgtcagccctcgccgtggtgatcctgtgcggcgcggccaccgtcgtcgccggtcccatcggtttcgtcgggctcgccgtaccgcacgccgcccggctcatcaccggccccgactaccgctgggtgctcccgtacagcatggtgctcgccccggtcatgctcctcgtcgccgacatcgtcggccgggtgatcgcccgccccggcgaggtccaggtcggcgtgatcacggccgccatcggctgcatcccgttcatctggctggtccggcgcaggaagctggtggaactgtgagccgggagaccgtcgtcgccgaggacgccgcgaacgcggacaaggagcggctcgccgacgccgtacgccaggtgtccgccgtacgcggccggagcctgcggcgctcggtgctcgtcggcgccgctctgctggccgccgtgatcgtcgcgttcggcgtctcgctgagcttcggcgacatggtgatgccgatcgggaaggtcgtcgccaccctgttcggcggcggcgacggcggatcgcggttcgtcgtcctggaactgcggctgccccgcgccctcctcgcgatcctcgtcggcgcgggtttcggcctctccggagccgtcttccagacggtgctgcgcaacccgctcgccagccccgacctcatcggcatcagcgccggggccagcgcggtcgccgtcaccgccgccctgctcttccaggtcagcggactcaccctctccgcgagcgccctcaccggctccctggtcgccggtgcggccatctacctgctcgcctggcggcagggcatcgccggccagcgcctggtcctcgtcgggatcggcgtcggcatgggtctttccagcatcgtctggtacgtgatggcccgctccgaggtcaccgacgcgcaggaggcgttccgctggctcgcgggcagcctcaacggccgttcctggggccaggtgtggccgctgctcgtcgccctcggtgttctcgtcccgctcaccgtcctcgccgcccacgcgctgcgtcctctccagctcggggacgacgccgccgccggactcggcgcgaaggtcgagggcggccggctcgcgctgctgggttgcgcgaccgcgctcgccggggtggcgaccgccgccgccggacccgtcgggttcgtggcgttcgtcgccgccccgatcgcccgccgcctggtcccgggccggggtgcggccctgccgcaggcggccctgaccggagcgctgctggtcctggtcgccgacttcgcggcgcagcacgcgctgccctccgtgcagctgccggtgggtgtggtcaccagcgtcatcggcgccccgtatctgctcctgctcctggcccgcgccaaccgcgtcggcagcgggggctgacgtgacgaagcggacagggacggaacagacagtgcgggcagggacggaacagacagttcagaaggacgacgaaaggcatggccctgtcgtggccgagcacactctggaagcccgggacgtccggctcggttacggcgaacgcgagatcgtccccggcctgagcgtggcggtgccgcccgggaagatcaccgtcatcgtgggccccaacgcctgcgggaagtcgacactgctgcgggcgatggcccggctgctggcaccctccgccggggcggtgctcctgaacggccggtccatccaggagatgccgaccaaggaggtggccgccgtgctcgggatcctgccgcagagccccacggccccggagggcatcacggtctccgacctggtcgggcgcggccgttacccgcaccagggctggttccgccgctggagcgcggaggacgacgaggccgtcgcgcgggccctgctgtcgacggacgtcctcgaactcgccgaccgttccgtggacgagctgtcgggcggccagcgccagcgggtgtggatcgcgatggcgctggcccagcgcacggacatcctgctgctcgacgagccgacgaccttcctggacgccagccaccagctggacgtcctggacctgctcaccgacctcaaccgcgagcagggcgtcaccatggtggccgtgctgcacgacctgaacctggcctgccggtacgccgaccacatgatcgccatgaaggcggggcggatcgtcgcggagggacggccggtcgacatcgtcacggaggaactggtcggcgaggtctttggcatgcgctgctcggtgatccaggaccccgcctcggccaccccgatggtcgtgccgctgggccgccaccacgtgaagggcccgcccgcctgagcctcgtgcgggaccgcggggccttcgtacgaaaacatggggccctcgtacggaaccgcggagaccaacccgatggcaccgttgtcattaggtgaggctaacctaaagggcatgaacgcttccgcttcccgcgcccgacgctcccgccgcacctcagtcctcgcggccggtgctgtcgccgccctgctcgtcggcctctcggcctgtggttcgtcggacgactccgacagctccgcgtcctccgcctccgaagcctccaagggtgccttccccgccaaggtggcgacgaagttcggcgaggtcaccgtcgacaagcagccccggcggatcgtcgcgctcggctggggcgacgccgagaccgtgctcgcgctcggcggccggccggtcggggccagcgactggcttccgttcggcggcgagggcgtcggcccgtgggccaagggcatgtacgacaagaagccggagctgatcggcacgatggagccggagttcgagaagatcgcttccctccagcccgacctgatcctggacaccaagtccagcggtgaccagacccgctacgacaccctgaagaagatcgctccgaccgtgggcgtccctgagggcggcgaccagtacaagctctcgtgggagcagcagaccacgatgatcgccgcagccatgggcgtgccggagaagggcaaggagctgatcgcggagaccgagaagaagttcgaggccgccgcgaaggcccaccccgagttcaaggacaagaccatcacggtcggctcgcgtacgtccgagggcttcggcgtctacgtcggtggcaccgggcggatcgacttcgtcgagcggctcggcttcaagaacaacccgaaggccgaggcccaggccggcgagggcttctccgtgtccgtctccaaggagaacctggacctgctcgacgccgatctgacggtcatgaccccgatcggcatcccggccaccgacatcagcggcgacccgctgtacaaggcggtcccgtcggtgaaggcgggcaacgacatcgtcttcgacgacaaggacatctcgcaggcgttcgccacggactcggtcctgtccgtctcgtacgcgctggagaaggtcgtcccgctcttcgcggagaaggtcgcgaagtagcaccgaacgcacggcgcgccccggccccgggagaacgggggtgcggggcgccgctgtgtgccgggcggacgcgctcgacggtgggtgtgtcaggccgccggggtcgcggccttgatcgcggagatgtcgaaggtcagcttcaccttgtcgctgaccatcacgccgccggtctccagcgccgcgttccaggtcagaccccagtcggagcgcaggatgtcggcgctgccctcgaagccgacgcgctcgttgccgtagacgtcggtggcggagccgttgaactccaggtcgatggcgagcgggcgggtgacgtccttgatggtcaggtcgccggtgatccggtacgcctcgccgcccaactgctcggccttggtggagcggaacgtcatgtgggggaacttctcggcgtcgaagaagtcgccgctgaccaggtggccgtcgcggtcggcgatgccggtgtcgatgctggcgatcttcacgtcgatggaagcggaggagttcgccgggtccgtgccgtcgacgaccagcgtgccctcgtgctcgccgaaggagccgcgcacgttcgtgaccatcgcgtggcgcacggtgaagccgatgctgctgtgcgaggggtcaatggtgtacgtgccggtcagggcggccagcgccgggtccaccgcgggggcctcggtgacggtgggggcggcggtcgacttgcggttgaacagagccatggctcctcctcggggatgcgctgcgggggacggatcgaacggcgtcgaaggtgttgttcaaccttcaacaagttcgactgtaaccgcatctagttcaaagttcaacatctagcgtccgggttccctcgaccgagtgcgcggcgcggagccgggtgactgccccggaggtgcgccgccctctggcggacgcgcgtagaactcgggcactatctccctgcccggcatacgcggctcagtgcccgtacgccctctgatttgtcatgagcaggaggaatccccccatggtgacccgtccacgactccgctccgccctcaccgccctggccctcgtcctcggcgccctcttcgcgcccggcatcggcgctctcggcagcggcgccaccgaggcgcacgccgtgaccaagctgacccacgcgcaggcgacctcccggttcagctcgtccggggtgacctggtcgtcctccggtggctgctccgaccggaacgtccccacctgcacgtcgttcgaccagctcaacctggcgagcgcccagggcgcgcagaccctcaagagcgccaccggctgcgcgctcaacatcaccggcggcacggagaccgggcacgccggcggcacgtactcccactggaacggctacaagctcgacttcgccaagagcacctgcctgaacaactacgtcaccggcaccttcacctacatcggcacacggggtgacggcgcgcgccagtaccagtccggctccggcaacatctacgcggacgagggcaaccactgggacgtgacgtactacaactgcggcggctgctgacaggaacgatggccgggggccgtcccgcaccgggacggcccccgcgtccggggccgcgtcgccccggtcctccggtcctacgggatcgggtcggcgtccgggccctcctgttccagcaggtcccgggcgaagtcctcccactgcgcgtaccggtccgggtacgcggaccgctggaccgcctggcacacgtcgccgggctccatcgactcccagccctcgatctggagcagtcccggattggcgctgggcgagggcagtccgtagaaggacttggacgcggtcggtacgtgggtgatctgcgcgggcgtgccccagccc

SEQ ID NO: 2895 - DNA, 1754 bp, Unknown
  Kingdom: Bacteria, Phylum: Actinobacteria, Class: Actinobacteria, Order: Streptomycetales, Family: Streptomycetaceae, Genus: Streptomyces
  misc_feature (1437)..(1438): n is a, c, g, or t
ccggctcccccgtcgctcggacgagatcggcatcactcgggtgtcgctcaacttcgccctgtcccggtccgtcttcgggaggggatcgcggcgccggcgtgcatcctcgccgacaccgcgtaccgtccgtccgaccgatccgggggcccgttccatgttgttcgagaagagcggatgagccgtctcccggtcctgcgccgggcggccgtacgggagtggggcccgctggtcacggccgtacggcgggggctcgccggacgcggtgtgcgggcgctcgcgctgacgacgggcgcggtggcgctgacggcggccgtccagctgacgcagaaccaggcgtggggctaccggccggtgcagaacctcggagccgtacgggccgaggacccgctgtggctcgctctcctgcgtacgccgctgtccctgttcgtgcccgcgctcgatctgccggtgtggggcgcgctggcccagatcctgctggtgttcggcgtcgcggaggtgtgtctggggcggtggcgcacgctcgcggtggcgtatctggccacgctggccggaacgctgtacgcgcggatcggcgtcgcgctcgggccggagggcttcctcgggctgcccgactccgacgcgcgggtggtggacaccggtccctcggcggcggtcgtggggctcgcggtatacgtctgccatcagcggcgggcccggttcaccggggcgctggtggtcctcgcgatggtggtggaggtcctcgtcaaggacaacctggcgggccgcgagcatctggccgccatcgccgccgtcctggtggtgtgccgcgtacgggactggcgcgggcggcggcgcgttcaggacctggtcgcgggcggcggcgggacgcggtccggggcgccgccgatgaggtcctggaacttccggcgcggcccggcccagcgcacgtcgtggtggtaggcccgcagcagtgcccgggagcgggcccgatggcggtggcggtagaagcgcctggcccagggcgaggtggggcgggccagccggatcgcgccgaccagcgcgacgaaggggacgagggtgccgagcaccgccatccgcgccttgcccttgaacagggcgatcaggacgaagcagaagttgatcacgtacgtcgtgatgacgccgagtctcccctgctgctcctcgtcagtgacgtcgtcgacgccgagcggcgagaagcccgccaggaccagcaccaccaacgagacggtcagcacgaccacctccacgctctggcggccctcctcggtccagtacacgtcgtccagatgcaggatcagggcgaactcgtccagcaccagaccggcccccaccccgaagatcaccgcgcagatcccggcggtcacgccgtgccgcccgccggccaccgcgccgaatccgccgatcaccgtcagcacgaccccgggcaccacgtggtgnngtgcgggtgaccgcgaaggtcaggacgaaggcggccagcgcgaggagcagcggcagcttgccgggctccgcgatgttgtcgtgccaccagtgacccatgccacccactcccgttacgtcaggtttcgcggtgataggcgcgtttcgcccaatctatcggtgggacccagcggctagcctgcgcgcggtgacctccctgaacagccacggcatacgtttcgccttcggcaccctgaccgtgctgcccgtccgcgtgacccgctgggaccgcccgaccgcgcgctccggaatgctctgcgccccgctcgccgggctcg

SEQ ID NO: 2896 - DNA, 8081 bp, Unknown
  Kingdom: Bacteria, Phylum: Actinobacteria, Class: Actinobacteria, Order: Streptomycetales, Family: Streptomycetaceae, Genus: Streptomyces
gcgctcttcccgggcgccgagttcgtcgtccagcggggcgccgggcacttcccgtggctggacgacccgggagccttcgcccgtgcggtggaggccttcctcgacccggacgtccgcacggtgcaggcgggcggggtccggctggcgtaccgggtgtggggcgaggaggcgtccccgcccgtcgtcctcctgcacgggcgggccggctccagcgagacctggactcggatcgcggaggacctggccgccgaccaccgcgtgtacgcccccgacttccggggccacgggctgagcgactggcccggccgctactccttcgagatgttccgcgacgacgtgcacgccttcctggaggcccgcaacctggccggcgcgacggtcgtcggtcactccatgggcggggtggccgcctatctcctggcccagcgggaaccgggcctgatcggacggctgatcatcgaggacgcgcctcccctccacccgctcgacccgccccggtcaccctccgcgcgcccggagggcacgctcgacttcgactggtccgtcgtccccgacaccgacgtccagctcaacgaccccgacccggccgtccggagccggttcccgcggatcaccgcccccactctcgtcatcggcggcggccccaccagccacatcgaccagggacagctcgcgcagatggcccgggtgataccggacgccgaactggtcacccttgacgccggtcacctgatccacaccgagcggcccgcggaattcctcgcggcgatccggtcgttcggactcgcctgaccccgctcgcggtcggccggaagagatcgcggtgagtgacctgtccgggccggccgggggctgcgccgttcgactttcggtagtggtcggcaatccggacggcggagtcggggacgctgctcaagagtgccggagccgtggacgaggacggttcaccgctcaccacggaagaggtttcggagctcgtccgtgcagtccacggtactgacctggcctcgcgagaacgccaggattccgtcgcccccgtcctgctcggccttgtccagctgcgtcttgacgcccgcgatgaactcgcggcactcggcgctgacaggcctttcgggcggcgggtccggtgccgaggcggacttcagtccagcggtggcggcaaggccgaccccgcacagcaccgcccacgcggccacccacgtgcggcgccccatccgtatcggcttcggcattcaggcatcctacgagcgctgcggtgggctcggcgacggatcgtcacggaaagcagagcccagcggtcgttacccacagccaacagcggctccagacgtcgccattcagcttcggtcggatccctcggccggtcatgcacgaccgtcgaacccgtggacggcgtggacacgctcagcatctgcgatgccaccacgacaactccgggtcggtcatgggctcgtgccgcgttcgcctgagcagcacctcatccaggctctcgacctgcacccggagctcggcagcggcgctcgccggcagcatgaacagagcctcttgcagcttgtcccgagcccagccttcaccacagcacggacaggcgaactcggcctctccgcacctccaacggcgcttggagccgtggacgcggacagaccagacgctcagcgccaccgacacgatgcccggggtcaaacgctcccgttcgagcgcgcggacggccgcgttcgcggctcccgacagtctcgggacatcgcgatagcgcacccagggccgtgcccagccgcgttgaggcggccgaagcgaagccggtgttctacgcggcacggccccttcggacatcagtcatgggcggcatcctcccacagcccgagatcgaccggccagaacccgggatgctcgccggccacgtcactcaccgtccggggcgggcggacgggggtacggtccggcgccggtgatcacggccggcggacgcgcacatgtcccctcgggcagccggtgacgcaggggacttggcggctggtcctcggctgtccgtgcgggcgtactcgttgaggtcgatctcccgaggcggggtgatggagggtagaccggctcatatatcgtctgccgatatcgagggccgtaagagaagcgccgtgagtcgctgaggagtgagtccatgagcaagccgtcgacggacgtcgggccgcaggagttgcagcggcggctcggggtgtccgacgccgtggtgatcggcctggggtcgatgatcggcgcggggatcttcgccgcactcgcaccggccgcgcgcgcggccggctcagggctgctgatcggcctggccctggccgcggtggtcgcgtactgcaacgccacctcctcggcccggcttgccgcccgctacccggcctcgggcggcacctacgtctacggccgcgagcggctcggtgacttctggggttacctcgccgggtgggccttcgtggtgggcaagaccgcttcctgcgcggccatggccctcacggtgggctcgtacgcatggcccggccaggagcacgcggtcgcggtcgcggcggtggtggcgctgaccgcggtgaactacgccggggtgcagaagtcggcgatgctgacccgggtggtggtggccgtggtcctggcggtgcttgccttcgtggtggtcgtctccctcacctcttccgcgtcgagcgcggcccggctcgctgtcggggacgacgcgaccttcggcggggtgctccaggcggcgggcctgctcttcttcgccttcgccggatacgcgcgcatcgccactctcggcgaggaggtccgcgacccgcggcgcaccatcccccggggcatctcgatcgcgctcggtatcaccctggtcgtctacgccgtcgtcgccgtcgccgtgctgagcgtcctgggcccgcaggggctggcgcaggccgccgcgcccttgtccgacgcggctcgggcggcaggtgccgactggctggtgccggtggtgcgcgtcggtggggcggtggccgcgctcggctcgctgctcgcactgatcctgggcgtctcgcgcacgactctggccatggcccgcgaccggcacctgcctcacggcctggccgcggtccaccggaaattcaaggtgccgcaccgggccgagctcctggtgggagccgtggtggccgtggtcgccgcggccggggacgtgcgcggggcgatcgggttctcctccttcggcgtcctggcgtactacgccatcgccaacgcctccgcctggaccctcactccggacgagggccgcccggccagagcgatccctgtcctcgggctggccggctgcctcgtcctggcgttcgccctcccggtgtcctcggtgatctggggtgccgcggtcctggccctcggcgccgccgcttacggggtccggcgcacggtggccgcacacagggcgtgaccgttggtcagacggtcgccctgcccggcgcggaggcgggacatcgccaggctgccgaggaacacgccgacccgccaggcgctacggtgccccgtcgtcgcccagcacctcgcgcgccagctccctgagtgcccgacggtcctcgtccagggccttcttcccggcctcggtcgcccggtagacacgccgggtgcggccgtcgaccaaccgctgctcggagaccaacagtccgtccgcctccagccggtgcagcgtcggatacagggtgccggggctgatccgatagccgtgggacgccagctcctcggacatccacgctccgtggatctcctcctcggccgcgtggtgcaggatgtgcagccgcaccgcaccccgctggaactcccgcacctggacacctccggcagtgacgaaaccgatatcggtatccgatcctacgggaggggcgctcacgctcacgcggccacccgggcgcacccctcagccctggtcggtccccgccgccaccgctttcgcccatcggtagtccgccttgccgctcggcgaacgccggatccggtcggcgagtaccagcgcgcgggggatcttgtagccggcgagtcgggtccggcagtgcgcctgcaccgcatccagcgtcaacgcctgcgcgctctcccgcagttggaccacggcggcgacccggctgccccagcgctcgtcgggtacgcccgcgacgagcgcgtcgtacacgtccggatgggacttgagcgcctgctcgacctcctccgggtacaccttctcgcccccggtgttgatgcactgggagccccggccgagcacggtgacgatgccgtccgcgtccacggtcgccatgtcgcccagcaggacccaccgctcctcgcccctgcggaagaaggtgtcggcggtcttggccgggtcgttgtagtagccgagcgggacatgaccgcgctgggcgatgcgacccggctcgccgggtgccaccggctcgtacgtcaccggatcgaccacggccgtacgggtgttgacctggacccggaagccgcgctccggacccgaatcggccgtcgccgtgccgttgaaaccggactccgaggagccgaagttgttcagcagcatgaccgtcggcacgagcgcctggaactccgcccgcaccgagtccgacatgatcgctcccgagctggagacggagaacagcgacgagcagtccgtcccgcgcagtggccccttcaggcagtcgatcagcgggcgcagcatcgcgtcgccgaccagcgacacactggtgaccttctccttctcgatcgtccgtagcacctcggcgggcacgaacttacggtgcacgacgacgcgttggccgaagttgaacccgatgaacgcggtcagcgtggaggtcccgtgcatcagcggcggggtggggaagaaggtgatcccgtcgccgcccgcggcgacccgctccgccagttcctgcggcgccttcaccggctcgccggtcggtgctccaccgcccaggcccgagaagaacaggtcctcctgacgccacatcacgcccttcggcatgccggtcgtgccgccggtgtagatgatgaactggtcgtcggcggagcggggggcgaagccgcgtccggacccgcccgacccctcggcgtcggtgaacggcacgaccggcacgaccggcacgaccgggggagcggcgggggccggccccacccgcaccagatggcgcagttccggggcctgcggggcggccgccgcgacccgctcgtcgaactcgccgtcgaagaccagcgccgccaggtcggcgtcccggtagagatagaccaactcttcctctacataccgatagttgacgttcaccggcacgatccgggccttgagggcacccaggaccgtctggagatactcgaccccgttgtagaggtgcagccccaggtgctcgcccggccggatccccgcgtcgatcagatggtgggcgatccggttggcgccggcgtccagctccgcgtacgtgagccgccgctccgcgcccgtcccgggatggtcgacgtacaggagcgcctcgcggtcgggcaccgcgtcgacgaccgactcgaacaggtcggcaaggttgtactccaccgttcctcctgaccccgggtgactggcgactcggccgtcattagagcgccgggcggcacaagtgggaaggggtggcgtccaaagaatctgacgagctgtcagaaaactattgaactgcgccccctcctcctgcaacctgttccaggtctggagacaggagtcggtcatgggcggtacggaacatctcaccgtgcggcgcgaaggcgccacgctggtgctcaccttgaacagaccacaggccaggaacgcgctctcgctgccgatgctcgtcggcctgtacgacggctggctcgcggccgacgcggacgacacgatccgctccgtcgtcctgaccggcgcgggcggcgtgttctgcgccggcatggacctcaaggccctggcgggcggcggaatggagggggaggagtaccgggagcggatgacggccgaccccgacctccactggaaggcgatgctgcgccaccaccggccgcgcaaaccggtgatcgccgccgtggagggcccctgtgtcgcgggcggaaccgagatcctgcagggcaccgacatccgcatcgccggagcgggagccaccttcgggctcttcgaggtacgccggggtctcttccctatcggcggctccacggtccggctgccccgtcagatcccccgcacccacgccctcgaaatgctcctcacgggccgcccgtacaccgccggcgaggccgccgccgtcgggctcatcggcagggtcgtgcccgacggaaccgcactggaggaggctctcgccgtcgccgagcgggtcaatgcctgcgggccgctcgccgtcgaggccgtcaaggcctcggtctacgagagtgcggagctgacggagagcgaggcgctggccgccgaactcaagcgcggatggcccgtgttcgccaccgaggacgccaaggagggcgcgcgggccttcgccgagaaacggccgcccgtgtaccggcgcgcctgatcgccgagccctcggtcctgagtcctcgggcccgaggcctcggccctgagtcaaggaggcagtagccatgtccgacgtcctcagcgccccgctggtggtcgaattccccttcacccgctcgctcgggcccgtccagagcgccttcctctccggactgcgcgaacgcaccgtcctcggcgtccgcacggaggacggcacggtgctcgtgccgcccgtggagtacgaccccgtcaccgcgaacgagatccgcgacctcgtcgaggtcgcccccactggcaccgtcaccacctgggcctggaacccgtccccgcgccgtgaccagccgctcggcacccccttcgcctgggtgctcgtccgcctcgacggggccggcaccgcactcctgcacgcgctcgacgcgcccggccccgacgccgtgcgcaccgggatgcgcgtccgcatccgctgggccgcgacgcgcaccggagccattaccgacatcgcctgcttcgagccgtacgacggccagcccggcagcaccgaacccgccccgcacgccggggatttcgccgaccccgtcaccggcatcgtcaccccggcccgcctcgactacctccacacccccggccgcgcccagagcgcctacctcagcgccctcgaaggccaccgcaccgtcggcgaacgctgccctgtctgccgcaaggtctacgtcccgccgcgcggagcgtgccccacctgtggggtcgccaccgccgaacaggtcgaggtcggcccgcgcggcacggtcaccacgttctgcgtcgtcaacatcaaggccaggaacctggacatcgaagtcccgtacgtctacgcccacatcgcgctcgacggcgcggacctcgccctgcacggacgcatcgccggaatcccgtacgaccaggtgcgcatggggctgcgcgtcgagcccgtttgggcggagggagcccggcatccggaccactaccggcccaccggggagcccgacgccgactacgacacgtacaaggagctggtgtagatgcgggacgtggccatcgtcgctttcgcccagaccgcgcaccggcggcgcaccgacgaactctccgaggtcgagctgctgatgcccgtcctccacgaggtcctgggcgcgaccgggctcaaggcgaacgagatcgggttcacctgctccggttccgccgactacctcgcgggccgggccttctccttcaccatggcgctcgacggcgtcggcgcccacccgcccatctccgagtcccatgtcgagatggacggagcctgggcgctgtacgaggcctgggtgaagatccggaccggcgatgcggacaccgcgctcgtctactcctacggcaagtcgtcgcccggccgggtccgcgacgtcctcacccgccagctcgacccctactacctcgccccgctctggccggactccgtcgcgctcgccgccctccaggcacaggccctcgtcgacgccggcgtcaccgacgaacccgccctcgccgaggtcgccgcccgtaaccgcacggccgccaccggcaatccgtacgcccagctcaccggagacgtccccgcgggcgactacct

SEQ ID NO: 2897 - DNA, 3707 bp, Unknown
  Kingdom: Bacteria, Phylum: Actinobacteria, Class: Actinobacteria, Order: Streptomycetales, Family: Streptomycetaceae, Genus: Streptomyces
tcgacgaccttgccgccggttccggtcaggtccgtgcgcccgatcgtcgccgtggtcttcagcgccggggccccggcgggaagcgggaaggccggctgtcccgccgccgcgaagcaaccgctcgcggtcaggatccactgggcgtcgaccagcgaaccggtgcaggcacgcttcgcgtcgccctcaccgatgtcgagcttcgcggtgaaggcgtacgaaccgctcgcgaccgcgtcaccgaccacagcctgcgccggggaagtgaccgtcagcgcaccggccgcggcgaccaccgcgaacagtgccgtaccccgcacacggcgggaagatctcaaagacacgtggacttcctcacttggactgtgcgtcgcaactcggttgcgcgcagcgagatttcaatgacacaggaatgggccgccgcagcagactgggcgttcggccgacgggcggttgcgttgaacggtggggcgatcagctggctccctgcgcagaaaggactatgcggaggtggacagctcgatgagcgtgtggtcgcgaccttgcgggtccgtggactggccgacacccctccactcatcctttgccagggcgactttctgctcactgttttcgactgtcagggtgatgtcggtctcatgcgaagcgcttccctttattccgtacacggcagggatctccacgctgaggtagccaacttccccggtggttcggaagcatgtctgaccggtggtgcgtgaatacaccaccatgaggtcactgctggaaccgcattccgccagaatgatatgaccgtcgccgcgcttcaggacgatgccacgctcttcctggattttatctgcctgtggatagttgtaatcctcgatgagggacggcggggcttcagcggtcaggtgggtaacggaaccgttcttggtttcgtcggcgaacgctactgttgcaactgcggtcacgcaggcggcagttgcgacaacggcagtgatcatgcagtgcaggcgtttcatggtaatcaccttcctgtttaccgtaaattgttctcgcctatttgctccggctttctcggagctggaggcgggggtgtgatattccgggatcgggaacgaattctagtatttggatggagtcggtctttgtgggagaaaaatctcttctcaaagctcttctcagaggaatgcggccatggcggcgatgatcgccgcaagggtcagcaggaagacggcggcctgaggtccggtcatctcttccatcggcttcccggaacgcttcagatccagctgacgccggatgtttttggcgaagatcaatcttgcagcagtcaagctgaatgtgatcgccacatacagcatcagtggggtcgcgtccttgccctcacctgtcgtcgtgctcgagaagacggcggcggcgccggcgagcggaagcagaacggaaagggccttggtccttgccgtgatggcgagggactgggcggcaacggcgagggcaattccagatgcgactgcggccacccaccaatgagtgagagaaaatgacgatgtaagcatggcgatcccaggtttatcagcgctgctcagtgctttcggaggaggcggccgagggctcgggccgccccctccggttgtgacagtgcctgttaatgcagccagtcgatgaatccgattactgtggtcgccgtgtcgctgacgacgccgtgcactttctcgcccacggttacggccacccgctcgaggtcgtcaccaatgccgaacttgctgagcagcttgccctttccgacgagcactccgccgaccaagaacaagccgagcgccttcttgaattctgtactttcccagccccacccgaatccggtgaggatggcactcacaccctgaaggccaatcgaaaccagtcctgccacggtggcgggcaaggcggcaggagcgtatccgagcagagatgccgtgccgaggatgacggagattcctccggacaccgcactccagtgggagaccgcgtctgcccagtccttggcatctttgatgtcttcgggccagagcccccagcctttggtgtccccggtgttgtcgttctcggcgctatccaccgggttggcaccggtttgcttgttctgcttcgccttttcgaccgccgccttcgctgcggcctcggcctcggccttccgctttacggcagcgatctggcgagcctggctggcggcggcggaagcggctatcgcgtcctggccggccttgatcgccgcggcgtgggcgctggcagcggatgcctgggcctgggacgcggacttgaccgcttggagcgcggatccggacgcttggcgcatcgagtagttcgccatccgtgccgcgccccgcgcagtcgtcgcggcggtctgagcgttcttggccgactgggcagcggacgctgctgatttgtccgccgcatccgcgttgttcttggcctcggaggccgcgcttgcagcgtccttcgcgtaggtctcggccttcgccgcccactcggtggcttcctgcgctgcctggcgggcctcagccgcggccttggacgcccgtgcggcgtcctccagtgccttcgcagcgacgttcgcagcgcgcgcgagcgtcgcacggatcgcagagatgtgagtggcacggtcctggtccaggcgcgcgacgttccacttgccgtgggtgacgaaggcgcgccgcatctgggcggaaccttccagaacgatctgcgcggccgagcgcatgtagggaccgccggattccaggaggccgaagacttcgacccggtcgtcctccttggtcgcctccggcaactcgacgctgaagaatctgtgcagggccgaggctgttccgcccgccagcgccgcctcggccttctccctcacagtctttccgggagttgcgctcaggattttgaacgcggccatgcggtagtcggtgactgccgcttcgatcacgccgtgatccaggaaattgcttgcggcattcgaggcaccctcggccagtgcagagagggcggcctcagccacgtcggccgtagctgagccggcgactgtcaggactgtctcgcggtcgtcctgttgctgtgccaggagccggtcggtgtcgatccagttggccacatcgtggtcggagccggcgagagcgaactcggcggcgccgcgggtccaggtgccggaggcatccagcagtcgcacagccgcctttcggccagtcgcaaccgcgctcgcggtatccccgagccggagtgccgattcggctgcggcgatgaggtccttcgtctccgaggcggtcttgtccgcctcggtacgttcccgattggcccgtacgatgtcctcggtctccgcctgcgccctcagccgggcctcgaggactccgagttcggtgtcctcggcgatccgtgacgactctgccgtgcgagcggcctgctcaacagcctgtgcctccttgacggcgttggaggcggtagtcgccgcctctaccgcggccttcgcgaactctgtggatcgcttggcgtattcgatcgccttgcccgcgttgtccgcagcgtcctcggcggcagctgctgccctctccgcgtgcagcgcagcactgttggcggcatcacgagccacacgggcggcgttcgcggcacggttggccaaggtctgcgcagttcctgcggcccgggtcgcccgtgcggcagcggcgtcggcctcggcggcagcctgtcgggccctggcggcctgggcc

SEQ ID NO: 2898 - DNA, 3928 bp, Unknown
  Kingdom: Bacteria, Phylum: Actinobacteria, Class: Actinobacteria, Order: Streptomycetales, Family: Streptomycetaceae, Genus: Streptomyces
cctacaccgaccacctccccgccacctaccagcccaccaacgcggtcccgcagatcgtccacgtccaccaggccccgccggaccgcaccgttcagcgtctcgcgctcggctccggcgtgggcgccggggcggtcgccgccggcgtctacttcggccccctcctcgtcggcctcctcaccgccatcgccgcgaacctagcgatcctcgcgttcctcgccgtcgccctgacgtggggggtcgtgagcgtcgtgaagtcggttggaggtgcggacggcaaggccaccgctccctcgctgcgcaggggccgccgtcgctgacggccctctgtccgtccggtctcgcaaccgggcgggtggagggccggacagaccggcccccaccagggaggttccatcgtgtacagctacacccgagccgagtcccgcgagcgctcccgtctgttccgcaagggcttcaagcaggccctggccgactgtgtcgacgccaaggtcaccgcccgcatccatgccatcgatgaggctgcggccgagcgtgggcagcgggagttgaaggcgctgcacgaggtgcaggcgaccgcccggcagaacctggccgccgcgaaggccgccgagcgcaccgcgccccgggccgacagggccgccgcccgtgaggcccggaagcaggccgagcagcgcgtgaggctcgctgagcgggccgttcacaaggccgagcgcgactgagcgggggcggccggacccggccaaggaaaccggccaccccccttcccccgtcccgaaccatcgagcaggaggaagtaccagcatgacggacaccgctgccccggccgcgcatctgcggccggtccccgacctggacgacgacaccgagaccaccgcgccggtcgcggtcgacaaccccgccctgcccgaaccgaaggtgagcgtggagaagcgcaagccggtcctggccgggtggctgaccgaccggcgcgacttcaccgccaccgcccgccacgccggcgcgaacgccggatacagcgccctcttccacggcgtcaggctccctgtgtatgccgggcgtctcgcgctgatgtcaccgcggggagcctgccggttcatcgccaccaccaaccggtggatctgggaccgcgaagcagcccccctgcgagccgccgccgtccgcgcggaagacgtggaggagtacatgcgcctgtcccggctgcgggccggacgggtccggctgcgcggcctggtcaccctggtcgccgccgtgttcggcgccggcttcgccctctggctctacgtcatggcccccgcgctcatgtacgcgttcgccgccggcggggtgctgctcctcggcacggccggtcagcagcctgacgccccggtcatcggccccgccgtcctgaagacggaggttcagaagctcaccggcagcatcgtgctgcgcggtctcgactcgatcgggaacgcgaagatctccgccgcgatcaagaagggtggcgagatgaacgggctgcgcttcaccagcgaaatcgtccgcgacggccccggctaccgcgccgacctcgacctcccgtacggggtgacgcccgaggacatcatggaggcccgcaagccgctcgcgtccgggctgcgccgcaaggtcggctgcgtctggccctcacccgaccccgccgagcacgaaggacgcctggtcctgtgggtcggggacaagccgatgaacgagaccaccaaacccgcctggcccctgctgaagtcgggcacggtggacctgttcaagccggtggtcttcggcaacgaccagcggatgcgcgacgtgtccgtgacgctgatgttcgcggccgtcgtcgtcggctcgatcccccgcatgggcaagacgttcctgatgcggctgttcctcctcatcgccgcactcgacccccgcgccgagctgcacgcgttcgacttcaagggcaccggcgacttcggcgccctcgaacccgtctgccaccgctaccgggcaggcgaggagaacgacgacatcgaatacgtcctcgacgccctgcgggagctgaaggaggagctgcgccgacgcgcgaaggtcatcaagtccctgccgcgctcccgctgccccgaatcgaaggtcacccccgaactggccagcgacaaaatcctggggctgcacccgatcgtcgccgggttcgacgagtgccaggtgcccttcgagcacgaggagcacggcaaggagatcgaagccatctgcaccgacctcgtcaagcgaggcccggccctcggcatcgtgaccctgttcggcactcagcgccccgacgcgaagtcgctgcccaccgggatcagcgccaacgcggtgctgcggttctgcctcaaggtcatgggacagcccgccaacgacatggtgctcggcacctcgatgtacaaggccgggtaccgggccacgatgttctcccgctcggaccggggcatctgctggatggccggtgaaggcgacgacccccgcatcgtcgccagtgcctttgtggacgcggtggccgccgagcagatcgccgcacgcgcccgccaggtccgtcaggagtacggcaacgtcaccggccacgccatcggcgccgggccggagaagtccgggcagtccgatgtcctggccgacgtcctcgccgtcatcgccccggacgagaagtccgtctggtgcgagcggatcgccgcccgcctggccaccgcgctcccggacgtctacggcgggtggaagggcgagaacgtcaccgccgccctcaagccccacggcatcaaggccgggcaggtctggggccagaccgacaccggggaaggcaagaaccggcgcggcatcgaccgcgccgacattactgctgctgtcacgcgccgtaaccagaacaaggctgccgcctgaccccagcacggttgctagacctagcacccccggctgctaggtctagcacccccgctagcaccccgaacccgccctgagctgcggcctagtgtctagcagcccacctgcggaaacacccgaaaacccgcctgccgaagggatgtgagcccctcgtggcgctcgctagtctcctcatcctcctcaccgccgctggttacgcagtgttgtgtgcggtgaagccgttcgctccgtgccggaagtgctccggcaccggcgtccgcactcgccgccgcaccgtgaccgtctgccgccgctgccacggcgaccgcgcccggctccgcatcgggcggcggctcctcaacaacagccgcagcatccacgcggccggtacccgaccccgcaccaccgaccggaaggccgccccgtggcagtgacgctctccctcgtcgccctcttcggactcgtcctgttcttcctgctgcggtccggcagcctcacgcccggcggtgcgttcaccgccgctgggttcgggttcttcctcgcctccaccggagccgccgaccccatcaacgagatggccgcggccatcgtcgacgccatccccagcatctgagggagcaccccgtgcgactgcgcatccagctcaccggctgggaccgccggaccctgaccctgaccgacaccccccgccccgactgcccgctctgcgacgggcacggcgggctcgcctacgactacggcgaccacaacggggagtacgccggcaccgactgggacccctgcacctgctgggacgaaacccgctcctggaccctgctccggctcccgcgcctgccccgcatcctccgccgtccgaccccacccaccgacccctggtccaccaccagccactagcaagaggagagcccgtgccccgaactcccgctcgccgcacatccaccccggagacggagccagtcgagatccggctgatcgcccgcgatggcatcgcccagcacctcgccgcgcagatcgccgccgccatcccggcatgcaccgccccgcgtttctacccctcccgcaaaacccc

SEQ ID NO: 2899 - DNA, 1054 bp, Unknown
  Kingdom: Bacteria, Phylum: Actinobacteria, Class: Actinobacteria, Order: Streptomycetales, Family: Streptomycetaceae, Genus: Streptomyces
  misc_feature (270)..(271): n is a, c, g, or t
cccccgccctcgccgaagccaccggagcggaccgagccgccgcgcccccgggccgtagccctgccgacataccgcaaaccgacccgcaaacagccgcggagtgggccgtcactggtgtccctgactctgctcatcaccgccccggcggtgttcgccgttgccgtgctgcgaccgcgatcgtcccgctgaccaggagagatgcatgtccgaatggctcgtactgagcattgccatggcgtccgcctgcgcggtcgtcctcaccatcgccgnncgctgcacgaggtgcaggcgcgggcctccgtctatccggcggaggtccgcgaccgcatccgggcggacgtcgaggcctatgtcagtcatgtggtgcacgacgaatggaaggcgatgtccgaacacaacaccctcaccgagcgcggcacacagttgctggacaaggtgcgggcggacgtcaccgactacgcgcccagaaccgatcacgaggggcaggcctaccagccgctggtcgaccaggttgcggcggcggacgacgcccgcagctcacgtgggcagaacgccggggcgacgatgccgggggtggtctggttcgggctgatcatcggggcgctggtgaccgtggggctgatcttcaccctccagatccgcagaacgttccgcgaactgctcctggcgggcctgttcagcgcgctgatcgctttcctgctcttcctgatctgggacttcgacgcacccttcggccggggcatctcggccaccgcggacccgttcctcgacatgttcccgggggtcgcccgttgaggtcccgcaccccggccggtgagccggccgggggacatcgctgacccattcgccggacaccgatcgcgtgccgggatgaccgctcctagcgtgtcgggcatcgaggtgcatttttcctgctatgtggaaattggttccgcagctgcccctcggggaacccggaggatccaccatgcgcgcgatacgtgtcgcaccgctcgtcctgctcggcgccagtgctctgacgctgctggccccgtccgccgcccacgccgcgccg

SEQ ID NO: 2900 - DNA, 12794 bp, Unknown
  Kingdom: Bacteria, Phylum: Actinobacteria, Class: Actinobacteria, Order: Streptomycetales, Family: Streptomycetaceae, Genus: Streptomyces
gggcggggtaggtggtggaggggaggcgtacgggtcggtcagcggaccgactccaggacctccgccgctcccacggcctccgcgatctcggagagtgcgtcggtctgcagggtgagcagctccttctcggacatcccgaggtcggcgaggaccccgagctcaccgatcggtcccgccggcacggcgtccgggtcggggccgtcctcatccgggtcgacggccgcgggggcggaccgttccggttcgccgtcctcggtgccgtcgaggtcgacgagctcctccagggcggcgatctcgtcctcggcccctggttcgcggccgagcatttcgtcggtgagcaggatctccccgtacgaggagcgggcggcggcggacgcgtccgagacgtagattcgggggtcctcctcaccgtccacccggacgacgccgaaccaggcgtcctcctgctcgatgtagaccaggaccgtgtcctcgtccaccgaggcctcccgggccagatccgtcagatcggacagggtctccacatcgtcgagctctgtatcgctcgcttcccacccgtcttcggtgcgcgcgagcagtgcggcgaagtacaccgtgactctcccactggtcataggcgaatcggtccgacgggagggcgaacggtgatccgtccgtcctgagccccgcccaaccggcatcgtggcagaaacaagcgccgtgcgagacctcttcgaccgttgcgtcggccatcagttccaggagtgcctggtcggcggtcgccctgacgggcggatcggcgggggagcgcgccggtggtacgaggaggattcaccaacggaacgtgcgcatccgcatctgttgccgcatacgggccgcacgggcccggcgcggctgcacccggtcgcgcagctgcttggcctcgtgcagctcacggaggaactgggcgcgtcgtcggcggcgggcggcgtcactctcctgcgcgtcctcgacgtcattcaccgcgccctcggcgtcgcgcccgtcgcgcgggccgcgcgaggccgggttgcgccgcagttccccgtcagccatcgacacaccaccccagtgctgggtccgtatgcccccaccttccctccgaacaggtggttgatgccagcgcagagtgccgggcggcgcggttactgttgacgcatgcggatccacgtcgtcgaccacccgctggtggcgcacaaactcaccacgctgcgcgacaagcgcaccgactccccgaccttccggcggctcgccgacgagctggtcacccttctcgcctacgaggccacccgggatgtgcgcaccgagcaggtcgacatcgtgaccccggtgacgcccacgaccggggtgaagctctcgcacccccgtcccctggtcgtcccgatcctgcgcgccggcctgggcatgctggacggcatggtgcggctgctgccgaccgccgaagtgggcttcctcggcatgatccgcaacgaggagacgctccaggcggagacgtacgcgacccggatgcccgaggacctctccggccgccaggtctacgtcctggacccgatgctggccaccggcggcaccctcgtcgcggccatccgcgagctgatcaagcgcggcgccgacgatgtcaccgccgtcgtcctcctcgcggcgcccgagggcgtcgaggtgatggagcgcgagctggccgggaccccggtcaccgtcgtcaccgcctccgtcgacgagcggctcaacgagaacggctacatcgtgccgggcctcggggacgcgggcgaccggatgtacggcacggccgaatagggtccggacagggccgttccacgattgcgcgccccgtcccggcgtcgtacgtaaccgtacggtgccgggacggggcgcgcgtcgtgtgcggggttcggcagagcgtgcgcggggttcagcaggagggggacggggccggggccggcttcgtcagggccgtcatcgccgcggtggcctcctgcggggtgctgaacgccttgaacttcgtcccgaggatcaggtcgacctcgcccgtcctgcgggtgtccgtcttctgcaccgtgcccgccagctgggtgccgagcaccgtgaaactgccgttcttcgcggtcggtgcgccgagcagcacgcccgtgcccggcaccttcttgtcgtacgccttcgtcgcgttgcccacctcgccgatggcgaaaccgcgctttttgagctcctcggccgcggacttggccagcccgctgcgcgtcgtcgcgttgtagacgttgaccttgatggcggccggcttcggcagcgccttggcgggagccgccgacggcttcgcggtgggacagtcccgtttgtggtcggccgcgctggcgctcttgtcgccgccggtgaagacgtcgatgagctgcaatgtgccccagccggccaggctgagggcgacgacggctccgatgcccgcgaggaccagcctgcgccggtgccgggggcgacgcatacgggggtaggcgtcgcccgtgatgcggtactttccgcccatgccggggggagtgagcatgctcatggacgcagcgtagtgcgacccggtgagggcgcgtacaaaatgatcaacgtatggcacccggatgagcgtgaaaacacccgaaaggcccgaatcgggcctcggtggggtgcggaacccgggtggggtgtgcgtgcccggtgcctcgcggcggtgcgcgcgggcgggcggggcgatgtcagcccatgtccggggcggtatcagcccatgtcgaggacgcgggcgtgcagcacctggcgctgctggagcgcggcccggaccgcccggtgcaggccgtcctccaggtagaggtcgccctgccatttcacgacgtgggcgaacaggtcgccgtagaacgtggagtcctcggcgaggagggtctccaggtccagctggcccttggtggtcacgagctggtccaggcgaaccggacgcggcgcgacgtccgcccactggcgggtgctttcccggccgtggtcggggtatggcttcccatttccgatgcgcttgaagatcacacggaaagcctaccgggcaagggccaccgggcgcagccagggaacctcaccgcgatgccggtgcaaaggccgtattgcgccgaatagggcgggataccgggacaggggcacgtgggtgagcccggtacgggatcgatccagagggattccgtgccgggctcactgccggttcaccgtgggtgcggtacgccgctcacggggcctgggggcctgggccgctactccgcgacgcggccgtgaccctcgcgcaggccgccgccgctgccaccgctgccgggcgtacccgtgccggtgtccggggtgaccgggcgggtcagggagcgcaggtcgtgggcgtacgtcccgacggcgttggcgatcacgtcgacgttggtgtcgaagtgacccatgtcgatgttgtccaggtcgtcgcaggccgcgtggtagcaggggtcgtacgcgatccccgcctcgccgccgaacacctcggcctgggccgccgtcttgatgccctccgcaccggtgtcggtaccgccggacgggatgccgacctcgatgaacggcccgtagtccgagcggccggtgaagtcggtgccctcgtgcggcttgcccttgccgtcgaggaactcgttgatgtcgcgctccagttgggccgagccctccgggccggcaccctcgccgacctggtcggagttgtcgccgtcgaagacgaactggacgccgttgggcgaggcgatcatgtcgaagttcaggtagagagcgatctgttcgcgctgcttctcggagagcgccgcgacgtacttctccgagccgatcaggccgttctcctcggccgaccaccaggcgaaccgcaccttgttggcggggttgctcttcgacttcgccagcttcagggcgacatcgagcaggccggcggatccggagccgttgtcgttgatgccggggccctcggtcaccgagtcgaggtgggcgccgagcatcacggtccgcgccgtgctgccgccgggcgtctcggcgatgacgttgcgggtggggcggtcctcctggaactcgcgtatctcgaaggagaccgtgacctcgccgcccgcgaggtcggcggcgagcttctcgccctcctcctgggtgaggccgccggtcgggatcctgcctgcggcgacctcgccgagcgtgccggacaggacgccctcgacgttgttgtagatgaccgccccggccgcgcccgcttcggcggctgccgcctgcttctcggcgaaggagcagccgccgcgcttgatcagcgcgatcttgccggtgaaggccgtggccgcgtagtcggtggcctcgcagcccgtcgtcccgtcgacgggcaccgcgacgagcgctgccgtcaggccgcccacctcggtcgacggcgtgtacgtcatggccttgatcgtgacgtcgcggggcgtcggcgtcaccacggagagcttctcggccagcgtctccgtgtaggtgaagcggaagttctcgtacgagaccttgtacccggcccgctggagctggcggtagacgtacgccgccgatgcgtcgtggcccagggagccggcggcgcggtgaccgtcggtcgagtcggctatcgcctggaactgctggaggtggcggtaggcgtcgcgtgcggacgcggtcctcaccaactcccgtgacagcttggccgcttccttcccggggtcgtgcggcgcggggcgtccggggtgcggggacgcggccaggaggagcggtgtggccagggcggtggcggccacgaccgccatggctctgcgacgtgttgcgtgcacaggagtccttccggtctgaacggctggtgctctgagcagctcagtacctgaatcgccggcgctccgagcggctcagtagctgaacagctgaacgaatgtgctgcgaaagctagcgagtggggtgacgcctgtgaacagatgtggccggattcgatcggtgggagggaggtgtcggcctgatccgacgctcgatcacgtcacttgtcgggtgacgaaccgcctggtttcttcgccgcttcggccgtcttcgccgtcttcgccgtggtcttcgctgtcgtcttcgcagccttggccgccgccttggcctcctgcttgtacgcgcgcacctcggcgagcgactccgggcccgtgatgtcggcgaccgaccggcgcgatccggcctccccgtacggtcccgccgcctcccgccaccccgtcgggcgtacgccgaactgcttgccgagcagcgccaggaagatcctggccttctgggtgccgaagccgggcagcgcgttgaggcgttccagcagatcggcgccggtcgccgcgtcccgccacaccgcgctcgcgtcaccgtcgtactccgccaccaggaactggcacagctgctgcacccgctgggccatggagccggggtagcgatgcagggccggtttggtcgtgaacaactcggtgaaggcgtccgggtcgtaggcggcgatccgtcccgcgtccaggtcgtcggatcccatccgctccgcgagtgtgtaggggcccgtgaacgcccactccatcggaacctgctggtccagcagcatgccgacgagggcggccagcgggctgcggccgaggagctcgtcggcctccggattctgggcgatccgcagggtgatgtccttgccgctgtcgctcgtggtcatgctgccgatcatcgcgagcacggcgggcgacggcgaccgggagtgcgccgatggcctcttccctgtcggccgaaggcagtaaggaggagcgggacgtccgtggcgtgcgcgtccgtgccgccgcgctgcccgatgaggcagttcccgatgccccggccgggcgggggcacggcctggacggcccgggggccgcgccgtaatcgtggaacgccgaggacggtgcggtcaggggagatgatcatggacgcgcacgacatcgagcaggaacagcacgagcctcacggacccggtggacaccacggacacgccgggcgggaccagacccacgagcgcgatgagcagcacggcgcaaccgctgccgaggcgcccggcgagcgggaccaccacgtcttccgggccgccgccgcgggacgggccgatgtggtcggggcggccggcatggggctgatccagcggacggccggcaacggcgcactcggggcgatggtccagcggtcccggtccggggccgccgcacccgccgccgagcaggccgaggccgagcaggctgagcagacggggcacacggggcacacggggcaggtcgaggagcagcggtcgccggtgcacgacgtggtctcctccggcggctcgcccctggacaccgacacccggacggacatggagagccggatgggcgcggacttctcggacgtccgcgtccaccacgactccgccgcgcacgagtcggcgaagggcgtcggggcgcacgcgtacaccgtgggcaacaacgtggtgttccagcgcgacgcctacgaccccgggtcgccgcagggccgcaccacgctggcccatgagctgacccatgtgatccagcagcgcaacggcccggtggaggggaccgaggccccgggcggcatccgggtcagcgacccttcggaccggttcgagcgcgaagcggtggcgaacgcggaccgggtgctgtccgatcccgcgccggaggcgaccccggccccggccgcacccgtgtccgcccccgcttccaccgcttccaccgcttccgccgtgcagcgggcggccacggaggacgaggacgagcaacccgccgacgtacaggggtcgttcgtgcagcgtgcgacggagaagaagccgggggaggaagaggaggaggagactcccccggcctgagggagtccgctccggtcggtcggtcggacggaggggcggacggagggtcggagggtcgctcggcccgtcccggcgcgggcgtcagtccgccgtgtccgtgcgcatcgtgccgcccaggaacatcgaggacgagcaccgcgagggggccggagcgcccaccggcttgccgacccgcctgcagtcgatcgtcatcgtgaccttgccgccggcgggcaccaggatcggggtcacgaagtggtagtcggagtcgcggaagttctccagaccgaggctcaggacgcgggtgtcctcgccggccgtgacggtgaccgtgcccgcgtcgccctgcgggttctgcaccacgatgtcggtgagctggaaggtgtggccggccggtacctccagggccgtcccggtgttcgggccgccgcccaccgcgtcctgcacccgggcctgcgcactggtcggggcacccgacgccgcgtcaccgctcccgccgctgccgcccgaggcggagggccccggtgacggagtgggactcgccgggccgccgcccgtgcccgcgccggcggagtcgccgcctccggagccggcaccgcccggttcgccctcttcgggggccgtgctcttgtcggccgcggcagccgaccgtaccgcctcgggagtgaccgcctcccgggccgcggacttcaccgccgggcgcagcagcgcgtaccagagccccaccaggacgaggagcagcagagcggcggtgagcagggcccgggggagccagcgcggcaggatcggttcctgctggtaggagccgtccaccagcaccggtgccggcgcctcctcgccctcgggtggctgcggggcggcgaacacctggaaggcgtgcgtcaccggcgtaccgcgccacatccgcttcgccgggcggacccgcagcttcgcgaactccgcgtgccccggctcgatccgcagctcggaggcggcgaacaccacccgcgcctgctccgtaccgggctgggctccgagccgtacggtcaccggggtgttgccccggttgtcgacggcgaactggtgccgtccgctccgcgagccgttcgagccgcgcgggaccagttcggcggtcgtctcggtgaacggcaggacggtcacccggccctcgggcaccacggtgtcgctccggtcgccggtcggcatcacccggaccccgaacgtgctctcgcccgcgaggaccgtcgcttcgcgcggcggacgcatgaccagggagacggttccggagtcgccggggtacagggagaggaccgcgggctccatcgccgaccaggcggcacacgtgccgaccacctcgaagtggtattcctcgacggtccggccggagttgagaatttgcaggggaagggtcgtctcctcgcccggtgcgacggtgacggacgacgcgtcgaggcttgcggtaagactcataggcggaccgtaggaccgggccggggggcgggcaccggtcacggaggaacactttcgggcagatgtgatgcccgaggcaacctttcagtttcctcacgggtaagaacgggaatctttagaccgcctcacaacggatggggcggacgaatacagctgtggagcttgtgcctgcagtgtgacgcttccggctggtgcccagggggagcattcgcatggagcgcatcactgtcgttttacgcgcgcaagatccgatttcccaggccggagtggccagccagctacgggcccgccccgaggtcaccgtcgtcgagcggggtgacggcgagccgacgccccaggtcgtggtcatggtggtggacgcggtggacgacgaagtgctgcgcgtcctgcgcaacatccagcgcaccagcacctgccgcacggtgctggtgaccacggacatcgacgaacagaagctggtcagcgcggcggagtgcggggtcgcgggggtcgtcaggcggtccgagtcgacgccggaccatctggtgcaggtcatcggcacggtggcgcggggtgagggacatctcccctccgacctgctcggacgtctcctcgaagaggtcggcaggctccagggtcaggtgctcggtccgcgcggcctgcacttcaccggcctggccgcgcgtgaggtggacgtgctgcgcctggtcgccgaggggtacgacaccgcggacatcgcgacgaagctggcgtactccgagcgcacgatcaaaaacgtgctgcactcggtgatgacccgtctgcaactgcgtaatcgctcccacgcggtggcgtacgcgatgcgacagggccttatctgacggccggttcgcctacgccattcacatacgccgctagaagtacgtccttcacgcacgtgtagcgcgaatgcgcgaatgcttctgtgcgaacacttctgcgggaacacctctgcaccatcgggcagttcggccttcccgcggaagtgactcgtcattctccgcacgcggccggtcggtgcgcgacggtggcctccgggtattcggcgggacgcggggaggggaactctgtgcggtggtttcagccaggaacgggaccgcgaaggcgagcggccgggctcgttctcctgctgttggccgccggcctcgcccccgcgtcgggcgtgagcggtgtggcgtccgccgtgcccgtgccgccggagccgtgggtcaccccggcgacgctggaggagacgctcgacccgggcggttcgacgggtgtggacaagcaggtgcggactccggcgatcccgccccggccggatgtggtcctgctggtggacggtacggcgagcatggccgacccgatcaggagcgtccgggagaacctgcccgccatcaccggcaagatcctggccgagcagcccgactcgcatttcgcggtggccacgttcggcgaccaggagggcgacgtcaacgccggattccaggtgctcacggcgctgaccgccgacctggtgaaggtgcaggagggagtcgacaagctgaggaccgacctcggcggggcgagccgtggcccgtcggaggactggatcaacgggctgtggcagatcgccgacggcgcgggcggcacgacggtgttccgtgacgggtcgagcccggtcgtggtgctcgtcggggacgcctccagccactcgcccagcaacggccacaccatcgacgacacgatcttcgcgctccaggacaagggcgtacgggtgatcggcgtcgatgtcgagagcacgatcggcgacggcctcaacggcaacggtgatgccggagacccggactacgtcgaggatccgcccaccaccccgggccaggccacccgcatcatcgaggccaccggcggccggctgctcggaggcatcgacggggaccgggtcgccgaggcgatcatcgacggcttcgacaacctccccacctccgtcggctaccgcctcgacgcctgcgacccgcatctgaccgtcgccctcgacccgcccacccggcagctcaccagcggcgagaccgcgcacttcgcggagaccgtcgatgtgtcggaggacgctccgcaaggcacgacgctgacctgcaccgtgcagttcctgctcggcacccaggtgccggggacggacacgatcgggtcggccgcggtgcccgatccggacttccagcagcagatcagcatcgccgtgaacgacgtcgacgtccccgtcgtcaccgtggacgaccgtacggccagggcgcccgacgacgacggcgcacgcatcgacttcacggccacggcggcggacccgcaggacggggcgctgccggtgacctgtaccccgccgtccggatcgctcttcccggtcggaacgacgacggtcacctgttccgccacggactcggcgggcaacacgggggcggacacggcccggttcgaggtcctggaacccgtggtcccgccggacccacccactccgccgccacccccgcctccggcctcggacatcgcggtacgggccgatgtcagtcctggccgtacgtacgtggggcggcccgccaccgcccggttcacgatcacgaacgcgggcccggacacggcgaccggcgtcgtcctcgggacggtctggccgaggacgggcgagtcgaaggaccggagcctgtccggtccgagccggtgcacggcggcgcggccctgcacgatcgccgccggggaccggatcgaagtgacgcagaagtcgacctaccgggcggcggtcaccggtgacgtacgggccaccgtgcgtggcacgctgcccgacgggcgcagggcgaacaaccgggacgtggaccggctgagggtccttaagccctcgctgacggtcaccccgcaggtggcgaaaccggggcagccggtcctggcccggggcaaggactttccgccgggcgagaccgtacgtttcacgtggaacatcggcatcaccgcggaccggtccggcgtacgggtcggccgggacggaaccttcgaggtgcaggtgctggtcctgcgcaaggacacgctgggcccgcgcgtcctgcgggcggaggcccgggatctgccgcgcctgcggaaaccggtgctggtcgtccagcacaacctccagcccccggacttcgcgggccggtcatgagtgcggacgtgagtgcggtcgtgagtgcaggcatgagcgcggtcatgagtgtcctccgcgcgtcgaaggcggtcatcggatgatccatgaggtggacgacgtcctgcgggccatgatccgggccgaggtgctggagggccgccagatcgcggtggtcttcgacgccccgacccgggagtgggcggccaaggtcaacgccccgatggtcaacctctacctgtacgacatccgcgaggacatgcggcgacgggagcggggcctgcacaacgagtacgacgaacgtggggcgatcgtcgcgcggcgccgtccgccgcgcttcttcaagctgtcgtacctgatcacggcgtggacgaagcgcccggaggacgaacaccggctgctctcctccctgctggcctgcctgctgcggtacgaggcgctgccgccggagcggctggcgggctcgctggccgaggtcggggccgccgtcccgatgtcgatcgcgctgccgccgccggaggaccggtcgttcgccgatgtgtggagcgcgctcgggggcgagctgaagccctcgctggacctggtgatcagcgttccggtgacggcgtccccggtctacgaggcgggtccgccggtgggcgacgaggggctgcgagccgcgttcggggacgtacccgcgtcggcgccaggggagggcgcgggcgtgagcgcgacggaggcgcagccgggccggccgggtctgccggtctacgggtcgcgtcctggccggccggcccgggagccggcgcgagccgcgggcggcgaacggggacgggcggtgtccctgcggatcacggagcggcggggcacgccacccgaggaaggggacgtatgacggcgcgggacgctgtcggcccggacctccgccacctgctcgcccgggcggcggccgtggagcggcgtatccggcacgcggtggagctgaggcggagcaccgatccggacccggacgacgacttccgggggctgtacctgacggacgagaacatcgtgcggctgctggacgaggagggggccagggggttcccggcactggaggagcctctggccgggggcgagtcgagcgctgctccggccgaggagcagacaggttcccgactggcccgcctcgcgcgggagttcggtctcaccgcgctcgacacggagatccttctcatcgcgctcgtaccggatctggatgatcgcttcgaggcgttctacggctatctgaacgacgacgtgtcccgtcgccgcccgtccatcgggatggccctgggcctgtgcggcgtggccctctccgacccggcggcccgtgcccggctggccgcgggggcgccgctccgggccggcggtctgctcctggcggaggacctgaaccgcccgttcctgagc

SEQ ID NO: 2901 - DNA, 14548 bp, Unknown
  Kingdom: Bacteria, Phylum: Actinobacteria, Class: Actinobacteria, Order: Streptomycetales, Family: Streptomycetaceae, Genus: Streptomyces
gcgtcgcgggcatcgccgccagcgccctgcccagcgtggtcaccctgcacgtcagcggcaccgccgagtccggcacgggcaccggcttcgtcctcgacggccagggccacatcctcaccaacaaccacgtcgtcgccccggcggggtcggacggggacatcaccgtgacgttcagcagcggagagacggcgtccgccgagctcgtcggcaaggacagcggctacgacctcgccgtcgtcaaggtccgcggggtctccggactcaagcccctgccgctcggcaactccgacaacgtccaggtcggcgacccggtggtggccatcggcgcgcccttcgacctgtccaacacggtgacctcgggcatcatcagcgccaagcagcggccgatcaccgcgggcggtgagaagggcgacggcagcgacatcagctatgtcgacgccctccagaccgacgcccccatcaacccgggcaactccggcggaccgctggtcgacacccaggcccacgtcatcggcatcaacagcgccatccgcgcggccgacagcggccggggacccgaggcgggcggacagtccggctccatcggcctcggcttcgcgatacccatcaaccagggcaagcgcgtcgccgaggagctgatcagcaccggcaaggccacccacccggtgatcggcgtcacgctggacatgaagtacaccggcgacggggccaaggtcggcacgaagggcgccgacggcgcgcccgccgtcgcgaagggaggacccgcggccaaggcgggcatcgagtccggcgacatcatcaccgaggtcgagggccagcgggtgcacagcggcgaggagctgatcgtgaagatccgggcccaccggcccggcgacgacctcgaccttaagctgacccgcggtggcgaggagcggacggtgaccctgacgctcggctcggcgagcggcacgtgacggccaccgcgaggtaccgcccggacaccttcgacaggtacctttgagcggtccgggcagctgggagacccgggccgcgatcgcacggagagcacgcggagaacacgaggagcagcaaggtgttcaatgacataggcgcactggagctgttgacgctcggggtgctggccgtgctggtcttcggacccgacaagctgcccaagctgatccaggacgtcacgcgcaccatccgtaaggtccgcgagttctcggacagcgccaaggaagacatccgctcggagctcggcccgcagttcaaggacttcgagttcgaggacctcaaccccaagacgttcgtccgcaagcagctcatggacggcaacgacgacctggggctgaaggagatccgcgagagcttcgacctgcgcaaggagatgtccgacgtcaccgacgcggtcaacgggcgcaccccgaccgcggccgataccgccaacagtgcggcgaacggctcggcgggcgcgtcggcggaaggctcggcgcccagcctcaccaagaccggcgacaccgctcctgacctgctgaagaagaccccgcagcagacgccgcccgagcgcccgccgttcgacgcggacgccacctgaccccggtcaatcccgactcgcccggacggtatggctattctccatctgtccggttgcgaggatgcccaagcccgcggggggcgggccgctccggatcatgactgatcgaggaggcggccgcgcagatggagacgacgagtcggattgatacggacggtgtcccgggcacggccacggcggaggaggtgccggcgaagcggcgtaccgtcgacggttacctgggagcgaccttcccctggtacgggctggacgaggccttcaccggcccgcgctggctgatgcaggtcggcaccgcggcggacggcacggtgcagcacggcgcgacggggcacggcgacgagccgtcggtgaagtcggacggctcctccgacaaggagcggttcgcggcggtgatcaccgtggccgcgagcccggtgagacgcagcggcgacggtacgggcgtgctggacgccaccacggtgtcctcggccgcctggctcgcgggctccggcctgctggcgtacacctggccgccgcagatggaccacaccctgcgcgacgactggctggaccagcagaccgagacggcgttcaccctcgccgacgacctcggcagcgcgccctggtcgacgctctccctcccggtggacggggtgccggtggagttccactaccgcgagtccgagttcggctgggtcctcgccggatccgcccacgagggcgtgcacatcggggcgtacgggcggggcatgagcgcgtacggtctcggcttcgcggccatcaaggacatcgagacgtacgcgtagcaacgcgacagggcgggccggatgaccaccggcccgccctgtgccgtcccgaggagcgtcagaacttgttgcgcggggtgatccccaacgacatgcccgacaggccgcgctgacggccgcccagcttctgcgcgatcgagcgcagcgcgctgccggccggggagtcggggtcggacaggacgaccggcttgccctcgtcgccgccctcgcgcagccgtacgtcgatcgggatcgagccgagcaccggcacctcggcgccgaccgtgcgggtcagcccctcggcgacccgtgcgccgccgcccgagccgaacacgtcgaccatctcgtcgcagtgcgggcacggcatgcccgacatgttctccaccacgccgacgatcttctggtgggtctgcacggcgatcgatccggcccgctcggccacctcggccgctgcctgctgcggggtcgtgacgaccaggatctccgcgttcggcacgagctgcgccaccgagatcgcgatgtcgccggtgcccggcggcaggtccagcagcaggacgtccaggtcgccccagtacacatcggcgaggaactgctggagcgcccggtgcagcatcgggccgcgccagaccacgggcgcgttgcccggggtgaacatgccgatggagatgaccttcacgccgtgcgcggacggcggcatgatcatgttctcgacctgggtcggcttgccgtccgcaccgagcatccggggcacgctgtgcccgtagatgtcggcgtccacgacgccgaccttcagtccgtccgccgccatcgccgcggcgaggttcaccgtcaccgaggacttgccgacgccgcccttgccggaggcgaccgcgtacacccgggtcagcgagccgggctgggcgaagggcacctcccgctcggcggtgccgccgcgcagcgagctcgccaggtccttgcgctgttcgtcgctcatgacgtcgagggtcacctcgacccgcgacacgccctcgacccgggcgaccgcctcggtcacgttccgggtgatcgtctcgcgcatcggacagccggagaccgtgagatacaccgtgacagcgactacaccgtcaggatcgatctcgaccgatttcaccatgcccagctcggtgatcgggcggtggatctccgggtcgttcactgtcgacagtgcctcaagcaccgcgtcttccgtagccatacagacgatgttacggcgcggagtgctacgggcgggtagctcttcagcggtcgccttcgtcactctcggccgggagcagcacctgccggtcctccatgtccctcaccaggtcctggagttccgagcggatccagtcccgggtggcgacctcgcccaggcccatgcgcagggccgcgatctcccgcgtcaggtattcggtgtcggcgatggagcgctcgttctgcttgcggtcctgctcgtgcgtgacccggtcgcggtcgtcctgccggttctgcgcgaggaggatcagcggcgcggcgtaggaggcctggagcgacagcatcagcgtcaggaagatgaacgggtactggtcgaagcgcaggtccttgggcgcgaagatgttccacaacacccagatgatgatgatcagcgtcatccagacgatgaaccgcccggtacccaggaagcgcgcgatccgctccgagaaccggccgaacgcctccgggtcgtactccggcagcagccgccggcgcggatccttcggctggtccagccgggtgcgcgggggccgcaccaggcccgaggagccggtcgacgccgccttcgcccgctcatcacccgccatgaccgatcccctcctccccgtgcagatccgtctcgcgccagtcgtccggcagcaggtggtccaggacgtcgtccacggtcaccgcgcccagcagcgaaccggtctcgtccacgacgggcaccgagaccatgttgtacgcggccagatagctggtgaccgtcggcagcggggtgtccggcgacagcggcaccaggtcgctgtcgacgatcgagctgaccagcgtgaacggcggatcgcgcagcagccgctggaagtgcaccgtgcccaggtacttcccggtcggagtgtcgtcgggggagcggcacacgtacacctgcgcggcgagcgccggagacaggtccgcctgccgcacccgggccagcgcgtcggccaccgtggcgtcgggcagcagcacgatcggctcggtcgtcatcagaccgcccgccgtccgctcctcgtacgacatcaggcgccggacgtcggcggcgtcgtccggccgcatcagcgccagcagccgttccttgtcctcctccggcagctcggagagcaggtcggccgcgtcgtcggggtccatcgcctccaggacgtcggcggcccgctcctcggcgagcttgccgatgatctcgacctggtcgtcctcgggcagctcctccaggacgtcggcgagccggtcgtcgtccagggcggcggcgacctccgcccggcgtttcggcgagaggtggtgcagggcgttcgccacatcggtgggccgcagccgttcgaaggtggcgaccaggctctccgcaccctggccgtgctcgtccagcgagaagccgctgaccgccgaccactccaccgtcagggtctcgcccttgcggcgcagcgccccgccgcgccccttgcggacgaagtacttgtcgatctcccagtcgcggcgggccggcagctgctggatggccacgtccaggacggtgacctcctcgtcatcctccaccagccgcacccgccggtccaaaaactcgccgaggacgagacgctcggtgggccgctgttcgaagcgccgcatgttgacgacgccggtggtgatgacctggccggactcgactcccgtcacccgggtcatcggcaggaagatccgccggcggctgatcacctcgaccaccaggcccaggatgcgcggcggccgtccgccgacccgcagcatcgccaccagatcacggacccggccgacctggtccccgttcgggtcgaaaacgggtacgccggacaggtgcgagacgaagacccggggggtgactgctgccatcctcggcctccttcgtccgtccgtgtccaccgtgtccgtgacgttccgcgaggccgtccgcgcccgaccgtcccggccgacgccgccgaccagcggatttcgccggtacgccgggatcaggctagcccgtaccgccgcaccgcgccccggcggacccgtccgtacggctggctgccggacggtgcgcgccgcccgggtacgctgccgtctgccacccccgatcgcagttgagaggcagtgcgcccgtgacctcttttgccccggccgtgcggaaccatcgccggaccgctctcgctctcgtgctgtgcggagggctcaccgcggccctggccgcctgcggcacggaggaggacccggacaaggggaccaacggcatcgccagactctccgccgccgagatcgacgagaaggccagagcggcggccgacgcggcgagcgccgtacgcctgtcgggcacgctcgtcagcaagggcggcacctaccggctggagatgaagctcaacgcggagggcggcatgggctcggtgacctccaagaagcagagcttcgccctgctgcgggtcgacgacgagctctatctgaaggcgcccgccgagttctggacccacgaggagagcggcggcggcgcgggcgggtcctccgacgtggcggccgccgacaagctgggcggcaagtacgtgaaggtccccgagggtgaccccagctaccgccagctgcgcggcttcaccgacaagaaggtcctgctcgacgggttgctcgcgctgaccggaaaggtcaacaagggcggccgggacacggtcgccgggcagcgcaccatccagatcctgggcggcaagggcgagggcggggcgttcgacgtctcgctggaggaccagccgtatccggtccgggtggcccggggcggcggcgggggcacggtcacgctggccgactgggggcaggccttccctctggaggcgcccgaggaggacgacaccgtcgactacggcggccagctccccaagtcctccggctgagccgaccgggacccccgctcagctcacgggggcccggctcagcgcttcccgcgacgcttcaacaggagccgggggagcgccgccggagcgggctgccgggtggtggccccggtcggcagcgggacggccgccagcgaggtgtccggcagcacggtgctgacggtttccggcgtcagccgcaccacggtgcactcgcgcgcccaccgctccgtcatcgactcggcgtccggcgcgttcagccgcttgcccttcagttcggcgaccgccgcctcccactcctcggagtgcggcgggaggaaacgggacgtagcgctccaggcgacgatccggccgcccttgtccttgctgcgtacggtcacctcggcgcggccgccgtcggccaggccctcgggcagtggctgctcgccgggcccgccgccgaccaggtgcgccgcgccgtcgtgccagacgtgccagacggcgcgggccggcccgtcgccccgcacccagaggagaccggacttcttcgtggcctcctcgacgagggccctctccagcaggtcggcggcggcatcgggcgcggcggcgtcagtcatgggcgcgagcctagacccaccggcaccgctcagagccagccgttgcgcttgaggatgcggtggatggagaaacagaccgccccgatgacgcccagcaccagcggatagccgtacttccactccagctcgggcatgtagtcgaagttcatgccgtagacgccgcagatcatcgtcggcacggcgatgatcgccgcccaggaggtgatcttgcgcatgtcctcgttctgcgtgacggtcgcctgggccagattcgcctggaggatcgagttcagcagttcgtcgaagccgaggacctcttcctggacccgggcgaggtggtcggcgacgtcgcggaagtacttctggatgtcggggtcgaccagccgcatcggtcgctcgctcagcagctgcatgggccgcagcagtggcgagacggcccgcttgaactccagcacctcacgcttgagctggtagatccggcccgcgtccgagccgcgcgggcttcccttggccggggtggagaagacatcgatctccacctcgtcgatatcgtcctgcaccgcctcggccaccgcgatgtaaccgtcgaccacatggtcggcgatggcgtgcaggacggcggaggggcccttggcgagcagctccggatcgtcctggaggcggtggcgcagcgcgcgcagggagccctggccgccgtgccggacggtgatgacgaagtcccggccggtgaagcacatcacctcaccggtctccacgacctcgctggtcgcggtcagttcggcgtgctccacgtagtggatcgtcttgaagacggtgaacagcgtgtcgtcgtagcgctccagcttgggccgctggtgggcgtggacggcgtcctcgacggccagcgggtgcagcccgaactcccgggcgatgccagcgaattcggcctcggtcggctcgtgcaggccgatccacgcgaagccgccctcctcccgcacctggagcattgcctcgtgcggtgtcggggtcgcgggtgccaccagccggcggccgtcgcggtagacggcgcagtcgacgacggcgctggaggcggaagggtcgcgggtggggtcgtacgcgttgtagggggcgctgttcttacggagggacgggcgcagggacgggcgcacggcggcgcgcaggtcacggatcatcgacatggctggctccttcacggagggccgtcggcgagggcgtggaacagcccggaatggggacgtgcgctcacgtccgcaaagcgggcggcaccgcgcgggcgcgatgacggcgttcgctacagacaggcaaaaacgaagggctcttccgtcgcgcgaactgctgtcggggagtcatccggacacgacggcgatgtcggcaccgggcgaccgacgaggcgtcggatcaacggcaaatgcgaggcgcggaagagcggttggtactgcacggtcgacttggatccatagcagtccccacctcctccggccggtcccccgtgggggacgacgtgtcgtcgggacgaagaagagcaacgcttctgcgtgctgtcccgaccggcggccaggctatcagccaccccaggcccaatcccctactttgcccattccccgcgcgatctatgctcgcggcatggcagaaattctcgctctggtcgaggcccggctccgctccgccctcggggaaccggacgcccgagccgatgtgacgttcctgggcaccgaccgcatcgaggtgctgcgcttcctcgacggcgatgtggtgcgctacgcgacgctcggcatgtccggtcagccgatggccgaccccacctccccgctcgccgacccggtgaagggcccccgcgccgagctgatcctctccgtacggggtgggctcgccgacaccgaccaggtgctgcgcccgctcgccgtgctggccgcgtccccgcaggtcgagggtttgatcgtggccgccggggcctcgctggacctgggggagccgctgtggaccggggcgccgttcacctcggtgctcgtcgcagagtccggtggtctggtggaggacctggagctggacgagccgatggacccggtgcgcttcctgccgctgctgccgatgacgcacaacgaggccgcctggaagcgggtgcgcggcgcgcaggagctccaggagcggtggctggcgcacggcacggacctgcgcgacccgctgcgcacgtccgtaccgctggactgaccggcccgggaggtcagtcggcgaagaccgccacgccgtcctcccgtgcgtggaccggctccagctcctcggcctcgtggttcagcgccgtacgccgtacgcccacgacggccgctccggcgagggcggcgagcgctgccaccacgaacgggacgtggacgtcggtccactcctcgatcttcggggcgaggaagggggccgccgccgcggcgaaccagcggacgaagttgtatccggcgctcgccaccgggcgcggcgcgtccgagaccccgagggccagttcggtgaagacggtgttgttcatgccgatgaacgcgccggagacgatcgtggcgacgacggccgtgccgtggctgccgtatccgaggaccagcaggtcgacggcgagcagcaccagggaggccccgagcaccttgagcgagccgaagcggcgctggaggcgcggggcgaccagcacggagaagacggccagcagcaggccccaggcgaagaagaccgcgccggacttgtacggggtcatgtccagcacgaacggcgtgaaggccaggatcgtgaagaacgcgtagttgtagaagaacgccgaggccgcgaccgaggcgagcccgccgtgcgccagcgccttcaccgggtcgagcagcgacgtcctgcgggcgggcttcggctgctccttgaggaacgcggcgatgcagaggaagccgatcgccatcagcaccgccgtgccgaagaaggggtagcgccagctggcgtccccgagcaccgcgccgagcagcggcccgcacgccatgccgaggccgagcgccgactcgtacaacaggatcgccgcagcgctgccgcccgccgccgctccgacgatcaccgcgagggcggtggagacgaacagggcgttgcccaggccccatccggcccggaagccgaccagttcggcgacggaggacgaggtgccggagagcgcggcgaagacgatgacgagagcgaggccggccagcagggtcctgcggccgccgatgcggctggagacgaagccggtgaccagcatcgcgaaggcggtgatcaggaagtacgaggtgaacagcagcgacacctgactcgccgaggcgtccaggccccgggcgatggacggcaggatcgggtccaccaggccgatccccatgaaggccaccaccgaggcgcccgccgtggcccagacggccttcggctggtgcaggatgccggtcgccgtggctccttcgtcgaacgggtcctctccccgcacgcctccctgtgtggctccctgcatgggttctctccttctcctccgggccctccggggcttcttcggctccggatcgatgcgttatgcacagaataagttagacaagctaataagtgcaagctacatctattcttcccggtcagggccacgctgcggacgggtgatcgtccttgacgcgaggaccggcggggaggacggttggtccttatgaggggcgaacccagttgcccgaagtgcggtggccgggtcagggcgcccggtctcttcgccgacgcctggcagtgctccgtgcacggtcaggtccacccgatgcagccggtcatcccgccgagcgtcgaaggtctcggcgtcgtggtgcaccgcgctcaggtccccgtctggatgccctggccgctccccgtgggctggctgttcaccggcgtcgccagcgcgggcgacgaccgcagcggcggacgcgccagcgccgtggcctgctccggaccaggcccgctgggcgggatgggcgagctgctgctggtcgccgaggagctcggcgtcggcctcggcgcccggtacgccgggatcgagggcccggaccccggcctccatctcgatgtcgattccgcccccgacgccaaggtgcacgccgcaggccgccccacccctctctggcacgtgaggaacgctccgtcggaccgcgccgtcttcgcgggcgaggcgcgggggctgtggctctgggcgatcctgtggcccgagcagtccgggctgctgatgtacgacgagctggtgctcaccgacctgcgggacgccgggggagaggtggacctcgtcccctgcggcgcgctcaccccccgcctgctcgccgcccccgaggcgccgccccggcaggcgacgggcgagcggtagggctgtgagcgcggccggacggccggcgcgcggcggttatccttgagcggtccccttgtccgcccgcgagccccggagtcacgcgtcgtgcgcatcgacctgcacacccactccaccgcgtcggacggcacggacacccccgccgagctggtcgcgaaagccgccgcagcaggtctggacgtcgtcgcgctcaccgaccacgacaccgtgggcggccacaagcaggccatcgacgcgctgcccgaggggctcaccctcgtcaccggcgccgaactctcctgccgcgtcgacggcgtgggcatgcacctgctggcctacctcttcgaccccgccgacgccgagctggagcgcgcccgggaactcgtgcgcgacgaccgggtgccgcgcgcccaggagatggtccgcaagctgcgcgccctcgacgtccccatcgcctgggagcaggtcgcccggatcgccggggacggctcggtcggccgcccgcacgtcgccgccgcgctcgtcgaactcggcgtcgtacccaccgtctccgacgccttcacgcccgactggctgggcaacggcggccgggcgtacgccgagaagcacgagttcgaccccttcgaggcggtccgcctggtgaaggcggcgggcggggtcaccgtcttcgcccacccggccgccgtgaaacgcggcgcggtggtccccgagtccacgatcgccgcgctcgccgacgccggcctcgacggcgtcgaggtcgaccacatggaccacgacgagcccacccgggcccgactgcgcggcctcgcccgcgaactggggctgctcacgaccggctccagcgactaccacggcacccggaagttcgtcgagctcggcgcgtgcaccaccgaccccgagatctacggtgagatcacccggcgtgccacgggagccttcccggttccgggcgccggcggagccggtcacctctaggaggcgtccggcggatcaccgccggacagtccccgggcttctttcccaccgcaccacctctccactccccgcgcgccccggtgcgtaccgtcgcgtgccggacacggcgccggccgccgcgcggacccccgcgccccctctgtaccgcccgctcttctctcgcaaggctcactgtgttcgacgtcgctgtcttcggatccctttttctcaccctatttgtgatcatggacccgcccgggatcacgccgatcttcctcgccctcaccgcgggccgccccgccaaggtgcagcgcaagatggcgctccaggcggtcatggtcgcgttcggcgtgatcgccgtcttcggtctgctcggtcagcagattctcgactatctgcatgtctccgtgcccgcgctgatgatcgcgggcggtctcctgctgctgctcatcgcgctcgacctgctgaccggcaagacggacgagccgacacagaccaaggacgtcaacgtggcgctcgtaccgctgggcatgccgctgctggccgggcccggtgcgatcgtctcggtcatcctcgcggtgcagcacgccgacggtgtgggcggccagctctcggtgtggtccgcgatcgtcgccatgcacgtggtgctctggctgaccatgcgctactcgctggtcatcatccgcgtgatcaaggacggtggcgtggtgctggtgacccgtctcgccggcatgatgctctccgccatcgccgtccagcagatcatcaacggcgtcacccaggtcatccagaactcctgaacccgccccgcgcaccacagcgcccccgcacggacgttccgtgcgggggcgcttcgtctttagcggcgcaatgcggtgaggcgcggggcctcatcaggcgtcatgagcccatgagcgttacgaagccgagctgtcggccggccggatgtagatgcgctggcccatcgctgcggcctgctgcacgatccggttgacggaggcggcgtccacgacggtgctgtccacggcggtaccgtcgacgtcgtcgagtcgcatgatctcgaagcgcatagggcttcccttcgtctgatcctcctgctggagaactactggcgccggtggggcgtcccaccggcaagactaggaacgcgaggcttccctcgcgttccacgtgggttacaacggcttgccccctgcaaacattccctacgctaaggaaattttttggatgtctaagtacccgtcggtagccacgtcaccacagaccatgaggttcgcatgaacgaggcggacccgcagcccatcggcggagccggcctcggcgcccgcctggaccgcaccaacgagctcctccagcggatgctcatcgaggtctccaagaccccgtcgacgcacgccatcttcgtggacgccggctatgtgtacgccgcggccggactgctcgtcaccggcaccgaggaccggcgctccttcgacctcgacgccgaagggctgatcgaggccttcatcgacaaggcccgcacgatcttcgcggacagcaggctgctgcgcgtctactggtacgacggggcccgccgccgcatccacaccaccgagcagcaggccatcgccgaactccccgacgtcaaggtgcggctcggcaacctcaacgccaacaaccagcagaagggcgtcgactcgctcatccgcaccgacctcgaatccctcgcccggcaccgcgccatcagcgacgcggcgctcgtcggcggcgacgaggacctggtctcggcggtcgaggcggcccagggctacggggcgcgcgtgcacctctggggcatcgaggccgccgaaggccgcaaccaggccgaaccgctgctgtgggaggtcgacagccagcgcaccttcgaactcgacttctgccgcccctacgtcacgcggcggcccgtcaccacgtacgaggacgacagcccggccccctcccgggaggacgtccgcttcgtcggcgcacagatcgcggccgcctggctcgccgcgcgcggccgggagtccctcgccgacctgctgcccggccacccctatctgccgggctccgtcgaccaggacctgctggtggaggcggaacgcctgctccagcactcgctgcgcggccacgcccacctgcgacgggcgctccgcgacggcttctggcagcacctgcaatcgcagtactgacggaagcggggccggtggcggcgcgtcggacggccggtgggacgcggcgggggcgccggcggcgtgtcaggcggccggcaggccgtcccagaa

SEQ ID NO: 2902 - DNA, 12759 bp, Unknown
  Kingdom: Bacteria, Phylum: Actinobacteria, Class: Actinobacteria, Order: Streptomycetales, Family: Streptomycetaceae, Genus: Streptomyces
cgggccgagctgcccgcccgcgcgcgcccgttcctcccgttcgcgcttcaggtagaagagcgtgtagtcgacgcccaccgccaggccgatgagcaggatgaggttcgtcccgactcccgcgtcgggcatgacgtgcgaagcgaccatggacagtccgatcgccgcggcgatcgaggagagtgccagcagcagcggcacacccgccatgatcaccgagccgaacacgatgagcagggtgatgacggtgacgggcaggctgatgcgttcggagagcgcgagatcctcatcgcgctggtcgttgacgcccttgctgatggcgggggatccggtctcctccaccaccaggtccgggtggtccgcgctcaccgccgctgtctgctccaggagcggtacgacgttcttcttccccttcagctcgggtccgttcaggaccacggagaccagcaggacctcgccgtccttcgagcggacgggagcggccacgcgctccacctcggggaggccccgcatccgctcggtcacgtcctgggcggccgcaccggcagcctccatgtccagctcccccgacctggcccggatcatgatccgttcggtgggggaacgctccagaccgccctcggtcgccgtcgcctcggcgcgtcccgcctcgccgacccagaagtccttggtggtggcctcgttggtgcccagcgcgatgccggccgcgaggcacaggacgacgaacgcgaaccagccggcgatcgcccgcccggcgtgccgggcgctccatcgggccatacgtacagggagaagtctcatgccggaaatcctggccgcaggggtgcggcggccgacacgccctgccgactgaacctgttgtccaccgaccggtggacaagggggccgcgtatgtccgggcggtggcgcgccgcgagggagtccggaggactcctccccaaggacagcacgagcgccgaagttgtcaagtgccgtgcgggtcccagaagttcttcggtcggaagcgttgacgaaacattccgtgcggctctaacttcatcgcgtcgtacttcgtacgtcatatatgagacgcgatacgcgagatgtgagagcccgtcacccatgaccttcgcccctgccccgatcccgtcccggacccagtacgtgctggaggccatcaagcacgccatcctcaccgcgcagttgagaccgggacaggcgctggtggagaccgaactcgccgcgcagttcggggtgtcgaagactcccgtccgcgaggcgctcaagacgctcgcgggcacgggactcgtggtgatgagccagtacaagggcgtcaccgtacggctcgtcgacgcgaccatggccagggaggtgtacgacgtccgcctcctgctggaaccggaggcgctgcgccgctccatcacccggggcgcctcgttggaggcggcccaagaggccctggagcgggccgacacggcggccgacacggcggacaggtcgctggccaaccgggacttccaccgggccctgtacctgccctgcggcaacccgctgctctcccggatgctcgacgaggtccgtgaccaggcggcgctcgtgtcgaccgtggcctggtcggccgtcccgtcctgggagcgcgaggcggccgagcaccgcgagatcctgcggctcgccctcgccgatgacgcggaggccgccgccggggccctgcaccatcacatcgcgtcgttcgtacgccgcgccttccccgacgacgaagacgggggtgacgtcgcgtgaaccgcctgctggacacgctccaccagcacctcgacgaaaggccagtccgcatggaccactctccgctgaaggcggccctcgcagacgttgtggcgatcccggtgacgccgttcgccgaggacggaggcatcgacaccgcgacccaccgcgccttgatgcgcaggctgctcgacggcggcgtccgcgtcgtcaccccgaacggcaacaccggggaattctacgccctcacccccgacgagcggcgtctcgtcaccgagctgaccgtcgaggaggccgcgggacgcgccaccgttctggtgggcgtcggtcacgacgtgccgacggcggtggccgccgccgagcacgccgccgaggccggtgcggcgatggtgatggtgcaccagccggtgcacccgtacatcgcgcaggaagggtgggtcgactaccaccggtcgatcgccgaggccgtgccgcagctcggcgtcgtcccctacatccgcagccctcggctcgccggcgagcggctcgccgaactcgccgacgcctgccccaacgtcgtcggcgtgaagtacgcggtccccgacgcggcccgcttcggcgcgttcgcccgggacgccggtctggagcggttcgtctggatcgccggactcgcggagctgtacgccccctcctacttcgccaccggcgccaccggcttcacctccggtctcgtcaacgtcgcgccggccgtctcgctcgacatgctggaggcgctgcgcgccggggactacgtggcggcgatgaaggtctgggagcgcatccgccgcttcgaggagctccgcgccgaggagcagtccgccgacaacgtcaccgtcgtgaaggaggccctgtccgcgctgggactctgccgccgcgaggtacgcgctccgagccgggtgctgcccgaggcccggcgagccgaggtcgccgggctgatatccgagtggtccctgtgaccgacgcgtccacccggggcccgggaaccggccgtatcgcgcccgaggaactgcgcagccaccggtggttcggcgccgacggactgcggtccttcagccaccgggcccgcacccgtcagctcggctacctccccgaggaacatcttggcaagccggtcgtcgcggtgctcaacacctggtccgacatcaacccgtgccacacccatctgcgcgaccgggcgcaggcggtcaagcggggggtctggcaggcgggcgggttcccgctggagttcccggtcgccaccctgtcggagaccttccagaagccgaccccgatgctctaccgcaacctgctggcgatggaggccgaggagctgctgcgctcctatcccgtcgacggcgccgtgctgctgggcggctgcgacaagtcgacgcccgcgctgctgatgggcgccgcctccgtggacctgccgaccgtcttcgtgcccgccgggccgatgctgcccgggcactggcgcaacgaggtcctcggctccggcacggacatgtggaggtactgggacgagcggcgggcggggatcatcggcgactgcgagatggccgaactggagaacggtctggcccgctcccccggccactgcatgacgatgggcaccgcctccaccctgacggccgccgccgaggtgctgggagtcaccctgccgggcgcctcgtccataccggccgtcgactcggggcatgagcggatggccgcggcttcgggtctgcggatcgtcgacctggtcatgcggcaggtgacgttgtcacagattctgacggcggaggcgtacgaggacgccgtcgccacggttctcgcgctcggcggctccaccaacgccgtgatccatctgatcgccatggccggccgttccggcgtgaagctcaccctggacgacttcgaccggatcgcccgtacggtgcccgtcctcgccgacctccgtcccggcgggcggtacctgatggaggacttccacttcgccggcggtctgcccggcttcctggggcggctcaccgacgtactgcacctggaccggcccacggtcgcgcacgacaccctgcgcgaacagctcgacggagctcccgtccacaacagcgacgtcatccgcgagcgctccgacccgctggccggggaaggcggggtggcggtactgcgcggcaacctctgccccgacggggccgtcatcaagcacatcgccgccgagccgcgcctgctgcgccacaccgggcccgccgtcgtcttcgacgactaccgggagctccagcgcacgatcaacgacccggtcctcgccctcaccccggaccatgtgctcgtgctgcgcaacgccgggccccagggcggccccggtatgcccgagtacggcatgctgccgatcccggactacctgctgaagcaaggcgtgcgggacatggtgcggatctccgacgcgcggatgagcggcacgagttacggggcctgtgtcctgcacatcgcacccgagtccttcgtcggcgggccgctcgccctggtccgcaccggcgacctgatcaccctggacgtcgaggcccggctcctgcgactcgacgtcgacgacgaggaactccatcggcgcagggccgcctggtcaccgccgcccgcccgctacggacgtggttacggggcgctgtaccaggaccagatcacccaggccgacaccggatgcgacttcgcgttcctggcccggcagggagaagtccccgacccgtacgcgggatgaaccgggtcccgtgaccgtacgcgggcggagccgggccgcccccctctgtgcaccgcactcccccgggccgttccagctcttcttagcaagcgctttcaccctcagtggccagcaggccccgtacgtccagcgcatcgagcacctcccagagatcggagacgcgtcatggccccatccgcagccgtggccacaccgccgcccaaagagtcccggcgccgccgggcgagcccccgccgcctgccgtatctgctgatcgcgcccgcgggcctgctgatgctgggcttcatcgcctacccggtgatcagcgtcttctactacagcctgcagaactacaacgtcaccaagccgtggcggaacggcttcgccgggctcgacaacttccggcgcgtcttcaccgaggacgaccagttctggccgacgctcgggttcagcgcccagtgggtcgtcacccaggtcacgctgcaactcctcctcggtctggcgctcgccctgatcgtcaaccagaccttcatcgggcgcgggatctcccgggccatggtgttctctccctgggccgtctccggtgtgctgaccagcacgatctggatcctgctctacaactcctcgaccggcttcagccgctacctcgcggacgccgggatcggtgagtacggcacgtcggtgctctcggacaccggaaccgtcttctgggcggccaccgtcaccgaactctggcgcggagtccccttcttcgcgattctcatcctcgccgacctccagtccgtctcgaaggagttgtacgaggcggcgtcggtcgacggcgcgggccggctgcggcagttcttccacatcaccctgccccacctgcgggacgcgatcatcctcgccaccctgctgcgcggcgtctgggagttcaacaacgtcgacctgctctacaccctgaccggcggcgggcccgccggggagaccaccaccctgccgctctacgtggccaacaccggtatcgagggccacgacttcgggtacgcctccgcgctcaccaccgtcgcgttcgtgatcctcctcttctgttcgatcgtctatctgcgtctgagcaagttcggaggcgaccgcacgtgaccgccctgctcaccgagaagaacggaaccgctcggcggtcccccgctcacggctccccgccgtcgtcgccgcgccgccgtcccgggcgggagcgcgccttcgacgacgtaccgcgctggcagatctacctgccgctcggcctctacctgctcttcaccctcatcccgttctactggatgctgctcttcgccgtacggcccgccggttccacgtcgctggtgccatggccgatgaccggagcgcacttctccaaggtctggaacgagcggagcttcgccgtcttcttccagaacagcatgatcgtcggcgtcgcgacgctcgtcgccacgaccctggtcgccctggccggcggctacgccctggctcggttcgacttcaggatcaagggcgcgttcatgctcgccctgctctgctcgcagttcatcccgggcgccctgatgctcgtaccgcttttcgagatcttccggaacctccagatgatcaattcgctggggagcgtcgtcatcgcggagacggtgttccagcttccgctgtcgatcatcctgatcagcggcttcatcaagaacgtccccgtctccctggaggaggccgcctgggtcgacggctgctcgcgcttcaccgccttccgcaccgtcgtcctgccgctcctgcgtcccgggctgatcgccgtcgggtccttcgctttcgtgcacagctggaaccatttcctcttcgccctgatgttcctgagcgagcaggacaagcagacgatcccggtcggcctcaacacgctgatcggcgcggacagcgtcgacctcggcgcgctcgcggcgggcggtgtcatcgcggccgtccctgtggtgatcgtcttcgccttcatccagaagtggctcatcacgggcttcagcgccggcgcggtgaagggatgaggaaagtgaccgtccccgccacgaacccggccgtccccgggccagtcgtcccgaccccgcacgccgccgtgcccgtcgtcctggccggcgcccggggccacggccggtggcacctcgccaatgtgcgccggctccagcaccagggccgggtcaggctggccgggatctgcgagctggagccgctgaccgccggtgaactcgccgcctccggcttcggccccgacgagtcgcccgagcagtccgacgacttcggagcgctcctggacgccagcggagcgcgggcggccatcatctgcacccccatccagacccacaccgagctggccctcgccgccgccgctcggggcgtccacctgctgctggagaagccacccgccgccggctgggccgactactccagaatggccgaaggcgtcgaacgagccggcatcgcctgccaggtggggttccagtccttcgggtcgcacgccctgcccgccatccgcgagctggtgacctccggagccatcgggaacgtcaccggtttcggggccgccggcgcgtgggtccgcgacgacgcctacttccggcgggctccctgggccgggcggcgcaggatcggcaccaccgatgtggtcgacggcgtcctcaccaatcctctggcgcacgccgtggccaccgcactcgaactggcctgccggggccgggccgaagaggtcgtctccatcgagacggaactgttccgggcgcacgccatcgaggcggacgacaccagcagcgtccgcatcaccaccgccggcgggccgcgcgtcaccgtcgccgtcaccctgtgcgccgaacaccccggggagccgtacgtcatcgtgcacggcgagaagggccggatcaccttctggtacaagcaggaccgcgtcctggtccagcgcgccggacggggacccgaggagaccgtccacggtcggaccgatcttctggagaaccttctcgaccacctggagcacggcacaccgctgctggttccgcccgcgtccacgggggccttcatgcgcgtcgtcgaggccgtacgcaacgcccccgagcccgccccgctgcccgaccgtgcctgggagacccggcacgacgggccggacggcggggcgcggcgggtcgtgccgggtatcgactccctggtcgccgccggggccgagtccctcggcctcttctcggaactgggcgccccctgggcccgggtggacgaggcggccgcctcatgacccagtacgccacggatccgttccccgaccttccggccacccttgcctgcggcgccgacaccgtcgcccactacggctacgcgccgggggcggagggccgcccccgcctccaccccgtcaccaccctcggcgggatcaccgtcaccgaggagcgcccggccgaccacctccaccacctgggcgtctccgtcgccgtccccgatgtggccgggtacaacttctggggcgggcgcaccttcgtacggggccgggggcccaccgcactcgacaaccacggcgtccagcgccacctggcccggccgtaccgcagcccgaacggcttcacccaggagctcggctgggaagccgccggcgtcgagctcctgcgcgagcaccgcaccctgtcggccacccggacctccggcaccacctgggagctggacttctccttcgtgctctccaatgccggggacatcgacctctccatcggcagccccgcgaccaacggccgcccgggagccgggtacggcggcttcttctggcgggcgcccaaggaggccgcaccgcccacggttttcagcgccacgcacgagggcgagagcgaggtccacggccgcaccgccgactggctggctctcgccggggacggctggacgctcgtgttcgtgggggcgaccgaggagacgcgccgcgatccgtggttcgtgaggacctccgagtacccgggcgtcggctccagcctcgcggcgcgcgagcggctgcccgtggccgccggagcctcggtcgtgcgccgcatcatcaccgtcgtcgtggacggcaggacggaccgggagaccgccgcccggtacgcgcgcgaggcggtggccccgtgagccggccctggacctccgacctcggtgacgggacgtaccgcaaccccgtcctgaacgccgactggtccgaccccgacgtcgtccgcgtgggtgacgactactacctcaccgcttccagcttcggccggtcccccgggctgccgctcctgcactcccgcgacctggtcaactggaccgctgtcggacatgctctggaccgtctcgaacccgctgacgacttcgccgctccccgccacgaccgcggggtctgggcgccctcgctgcgccaccacgggggacgcttctggatcttctggggcgaccccgaccacggtatccagcagatcaacgcggaccgcgtcgagggaccttggagcgccccgcatctgctcaaggcgggcaaggggctcatcgacgcctgcccgctgtgggacgaggagaccggcgaggcctatctcgtacacgcgtgggccaagtcccgctccggcgtcaagaaccgtctcaccggccaccggatgagccccgacggccgtgaactcctcgacgagggatcgacgttggtggacgccgaccggattccgggctggttcaccctcgaaggccccaagctctaccggcgcgacggctacttctggatcttcgcgccggccggcggggtggagaccggctggcagggtgccttccgttcccgggacttcctcggcccgtacgaggaacgcgtcgtcctcgcccagggccgcaccggcgtcaacggtccccatcagggcggctgggtgcacacctccgcgggcgaggactggttcctccacttccaggcccggggagcgtacgggcgggtcgtccacctccagccgatgcgctgggacgccgagggctggcccgtcatcggcgacgagggcgaacccgtccccctgcacaccaaacccgtcgcccccgcccagccggtgacagcgcccgccgtcgacgacgacttcccaggcggccgacccggcacacagtggcagtggacggccaacccgcgccccggctggaccacccggcacagcgaggacgggctgcggctcacctgcgtacggaccgcgtacgagcacgacctgcggctgctgcccaacatcctggtccagcggctgcccgccgaagagttcaccgtcgacgtgcacctcgcgctggacagcggcgaaccgggtgccaaggccggcctcgccgtggtgggcgacgccttcggctggatcggcctcacggtcgccgcggacggcacatctcggctcgtccaccgcttcgccgagggcgtcgccgcacacgaacgggacgcggccgactcccgcgcgtcccccgccggacgggccacgctgcgcgtcgaggtgacggcgggggcccgctgccgcttcttcgccgacaccggcgacgggttccggccctcgggccaggtcttcgccgccaccccttggcgctgggtcggagccctcctgggcctcttcgccaccgcaccggccgggacgggccccgccggaacggcccgcttcaccgcattccgtgtcaccggcccgaaccccccgcagaagtgcgttcgtaacgaaccatcactcccgcatcaccagacagagaagagccgacgatgaccatttcgaagacacagcggggacgtgccgcggccgcggtctccatcgcggcggtgctcgcgctgacggcgaccgcgtgcggcgacgacggcagcggctccggcacggagggcagcggaaagggcgagatcaccttctgggacaacaacggtggcccacgcaccgccatctggaccgagatcatcaaggacttcgagaagcagaacccggacatcaaggtcaagtacgtcccgatcccgatcgccgacgtccagtccaagtacgacaccgcgatcgcgggcggcgggctgcccgacgtcggcggcgtcggcacggcctacctggccaacatggtctcccaggaagctctggaaccggtcaacgaccggctggagaagtccacgctccagggcaagctggtcgagtccatggtcgagagcgtccgcgcggcggccggccggggcgacgacgtctactccgtgccgacctccgccaacaacggcgtgctctggtaccgcaccgacctgttcgagcaggccggtctgaaggcgcccgacacctgggcgaatttctacacggcggccgagaagctgaccgacgccaggaacaacaagttcggctacacgatccgcggcggcgccggctccatcgcgcaggcgctggacgccgtctacggacagtccggcatcaccgagttctgggacggcgacacgacgacgctcaacgacccgaagaacgtcgccgctctggagaagtacgccgggctcttcaagcgcacgacgcccgcggccgacgtcaacaacgacttcacgaagatggtggcccagtgggacaccggcacgatcggcatgctgagccacaacctcggctcctaccaggaccacctcaaggccctcggcgaggacaagttcgcgggcatacccgctcccatcggggacggcggcacccgggtacaggtctccaaccccgtcgacggcctcggcctcttccggtcgagccggaacaagaccgcggcgtggaagttcatcgagttcgcggcctcccacgcgtccaacagcaagtggaacgagtcggcgggcgccatcccggccaacaccgaagccgcgaaggacccgtggatcaacgagaccgagtcgaccgcgctggccgcgaagaccctgaccgacggctccacgaagatcgtcgacctgccctattacctgccggactggaacaacatcagcaaggcggacaacgagccggaattccagaagctgctgctcggcaagatcacggccaaggcgttcctggacgagatggccaaggagctgaacgccgccaacaaggagtggaaggagatcggcaacggctgatccggccgcctcttccgaccctcccccgatgacggggaccggcagcggtccggtcgcgctccgccgccggtccctctcccgcgcacgcgcgcaccccgagagaggcagccctccgtgtcactcacccgcagacagaccgccgccgcactgctcaccgtgcccctcggcccggtcctcgccctcaccgccacccccgcgctcgcacacggcggccggggcgggggtgaggtcggcagaccccgggcgcgcacgatccacatcgccggtgactccacggccgccgtgaaactcgccgccgccgcacccgagacgggctggggcatggcgctccccttcttcctcgccggtcggctccgagtcgccaaccatgcggtgaacggccgcagttcgaagagcttcctcgacgagggccgcctcaccgcgctcctgaccggtgtccgtcccggcgatctcgtcctcgtccagttcggccacaacgaccagaagaccgaggacccggcccgcggcacggacccctacaccacctatcaggagtacctgcgccagtacgtgcagggcgcccgcgcacgacgcgcgcgaccggtactggtcacctcggtcgagcgccgccggttcgccgccgacggcaccgcccggcccacgctcggcgagtacccggcggcgatgcgcgccctggcggccgaggagggcgtccccctgatcgacgtccatgcgctctccctcgcccgctggcaggagctggggccggacggtacccaggcctgcttcctgtggctggaccccggcgactcgcccaaccaccccgccggcgcccgggacaacacccacttcgcaccggtgggcgccatcgaggtggcccggctcaccgcacgggcgctgctgggcgaggacgtgctcgccgcgcgcgacctgcgccgcctggacgaccgggtcccggcggagtggatcacctggtccgggccggcctgacgcactcccccatctcctccctctctcctcccttcctctcatcccttcttcctctttccgacaccacagaaggattcgccatgcccgcacgcaagcgtcatacccgcgccatcgccgtgaccctgggctgcgcctccctggccctcaccctctgcaccccggccctggccacctcgcgtccccgccaccccggccccggcgtcgagcgcgccgtactgcccgccggagacggctgggccgccgacgacggctccaccacgggtggcgcgaacgccacccccgaccacgtctacacggtgaccaaccgggccga

SEQ ID NO: 2903 - DNA, 676 bp, Unknown
  Kingdom: Bacteria, Phylum: Actinobacteria, Class: Actinobacteria, Order: Streptomycetales, Family: Streptomycetaceae, Genus: Streptomyces
tcctcatgggcctcggcaccacccgggtgccgaggcccatgaggagcagcaacgccgtcgtgctgatcccgatcgcgttggcggtcgcgatgccgtccacgccgaagcggtacgtcagggcgtacccggcccccatcgtgaccagcagcccggtgcccatggcgaacgccgggaaccaggtgggccgtccggaagagaagaacggccggctcagcgcgccgaccagacagtggccgagcagccccagggcgtacacccgcatgacctgggcggtggacgcggtgtcggtggcttcgaacgcgccgcgctggaagagcacttcgatgatctggggcgcgtagccgaggacgaccgccgtgccgagcagcaccaccgtcccggccagccccaggtcccgttcgacccgcagccgggccttctcccggtcgcccgcggccatggcctgcgcgaccaccgggaaggtcaccgtgcagatcatcagcgacagcaccatcggcagctgcgcgaccttctgcgcgtagttcagatgcgagatcgcgcccgccggcagcgtggaggccaggaaccgctccaccagcacctgggactgacggctcaccacgaacaggaccaccggggccaggaccgcgaatcccagcggcggagcggtccgcgccctccgccgctgggattcgcg

SEQ ID NO: 2904 - DNA, 6298 bp, Unknown
  Kingdom: Bacteria, Phylum: Actinobacteria, Class: Actinobacteria, Order: Streptomycetales, Family: Streptomycetaceae, Genus: Streptomyces
tccggccccgctgcggctggtcgcgggccggatggctgaaggtgtcgcagaaacgtttctgcgttcggttgcggcgtacgggtgtcaggtggcgccgggacccggtcccgcagcgggcgccgcggtgatcagccgggttctggcccggcccatcagctcttcgcgctcgtcctccgtcaggccgccccacactccgtagggctccctcacggccagggcgtgcgccgcgcactcggcacgtaccgggcagcgcatgcagacctccttggcggaggtctcgcgggcgctccgggccgcgccgcgctcaccctcggggtggaagaacagggagctgtccacgcctcggcaggcggcgagcagctgccagtcccacaggtctgcgttgggtccgggaaggcgggagaaatctgccattgcttgtcccctcggagctgtgctgcgtcggaagcggcatctcgaccgtctgtgatcgacggcctgctgtgatcggaccgtctgtgatcggtgtgaccgaagtctcgaccgtacatctacggtgctagtagatgtaaatatgactgattgcgaatctagccacagacacccccaaaagggaagaaatggtgccaaaaagggcatgccaacgagtgaagattcggttgacgggtgaatcacccgcgccgttctcctccgtatacggcccttcacgtagagtgccgaacccggccgcccgacccgtaactctttcgagtgaccgtcgttaagggaacggatgcggttgacggatatccggctcgggcacatgtccgagggggtcaaccgcacaggtgacgacttgtatcagcctggaggctcaaggtgacgcgcatcagctgcggaggacggtcatgacatccgtcctcgtctgcgacgactccccgcttgcccgagaagcgctccgtcgcgcggtggccaccgtgcccggcgtcgagcgcgtgacgacggcggccaacggcgaggaagtcctccgccgctggggtgccgatcgttcggatctgattctgatggacgtacgcatgcccggtctgggaggtgtggagaccgtccggcggctgctctccgccgacccaggggcccggatcatcatgctgaccgtcgccgaggacctggacggcgtcgcactcgcggtcgccgccggagcccgcggatatctgcacaaggacgcctcgcgcgccgagctgcgggccaccgtcacccaggcgctggccgacccgacgtggcggctcgccccgcgtcggctgcggtccgccgagatgggggcggctcccacgctcaccgcgcgggagatccaggtcctcgaaggcatgagccacggccgctccaacgcggagatcggccgtgaactgtttctctccgaggacacggtcaagacccacgcccggcgcctgttcaagaagctcggagcctcggaccgcgcccacgcggtggccctcggattccgctggggcctggtccgctgacgaccggcccgggccgcgccccgtccgcagaccggcggacggggtcacggagcgggccgtcggctccacaccccgtatccgggtgcccgctcggcggtgccatgtgacgcttcccggccgatgacgcatccttgagtcgtggagttcctcaggaacgattcggtcgagcggaaggggagggcgcaggacatgacatccggcgcacccgctcataacgcttcggtgcacaactcgggacgcgatggagcggaccgggcggcctcagggcaccatggtccgatgcgcgacgacgaaaccacggtgatcggtgccctcgtgcaccgggccgtcgacggcgacgcgcaggccacccatgatctgctggcccatgtacaccccctcgccctgcgctactgccgctcccggctgaaccgactccccggtgatgctcgccacttcgtggaggacctggcgcaggaggtctgcgtcgcggtgctgatggcgctgccgcgctacaaggacaccggaaggcccttcgaggccttcgtcttcgcgatcgccgggcacaaggtcgccgacctccagcgcgccgcgatgcgccacccggggtcgaccgccgtcccctccgacgagatgccggagaggcccgacgactccctcggaccggaggagcgcgcgttgctcagcagcgatgcggcctgggccaagaagctcctcgccaacctcccggagaaccagcgtgagctgctggtcctgcgtgtagcggtcgggctgaccgcggaggagaccggccagatgctcgggatgtccccgggtgcggtccgggtcgcccagcaccgtgcgctcagtcggctccgggcgctcgccgaacagtagtggggacaccctcgccggctcgccggaggcgctgtaggaagctacagaacagccaggtgatcttgatcgtggaatgagacgcccgtggagcccgttagcatggacatccgcaccgatcaaggccatttggggaaggtgtcatgactgcaaacgtcgacggagtgcccgagaagttcgcgacgctcgggctgacctacgacgacgtgctgctgttgcccggcgcgtccgaggtcctgcccaacgcggtcgacacctcgtcgctcatctcgcgcaacgtacgggtgaacatccccctgctgtccgccgccatggacaaggtgaccgaggcccgcatggccatcgccatggcccgtcagggcggcgtcggcgtgctgcaccgcaacctctccatcgaggaccaggtcaaccaggtcgacctggtcaagcgctccgagtcgggcatggtcaccgacccgatcaccgtgcaccccgacgccaccctcggcgaggcggacgcgctctgcgcgaagttccgcatcagcggcgtgccggtcaccgaccccgcgggcaagctcctgggcatcgtcaccaaccgcgacatggccttcgagtcggaccggtcgcgccaggtgcgcgaggtcatgacgccgatgccgctcgtcaccgggcgggtcgggatctccggcgtggaggccatggagctgctgcgccgccacaagatcgagaagcttccgctggtcgacgaggcgggcatcctcaagggcctcatcacggtcaaggacttcaagaaggccgagcagtacccgaacgcagccaaggacgccgaaggccggctgctggtcggcgcggccgtcggcgccagccccgaggcgctggaccgtgcgcaggcgctcgcgtccgccggggtcgacttcctgatcgtggacacctcgcacggacacaacagcaacgccctcgactggatggcgaagatcaagtcgagtgtcggcgtcgacgtcatcggcggcaacgtcgccacccgcgacggcgcccaggcactgatcgacgccggagtcgacggcgtgaaggtcggcgtcggacccggctcgatctgtaccacccgcgtggtcgccggcatcggcgtcccgcaggtcaccgcgatctacgaggccgcgctcgccgcgcgtgccgcgggtgtccccgtgatcggcgacggcggcctccagtacagcggcgacatcggcaaggcgctggccgccggggcggacagcgtgatgctgggcagcctcctcgcgggctgcgaggagtccccgggcgagctgatgttcatcaacggcaagcagttcaagtcgtaccgcggcatgggctcgctgggcgcgatgcagtcccgcggacagggcaggtcgtactccaaggaccgctacttccaggccgaggtgtcctcggacgacaagctcgtccccgagggcatcgagggccaggtgccctaccgcggcccgctggccaacgtcctccaccagctcgtcggcggcctccgccagaccatgggctacgtcggcgccgcgtccgtcgaccagatggagagcaagggccgcttcgtccggatcacctcggcgggtctcaaggagagccacccgcacgacatccagatgacggtggaagcaccgaactacagccgtaagtaacgcgggaagcaaagcatcagcgcaggtgaggggcggaccggagttcccggtaccgcccctcactcctgtgtcggggatactggtcagcgcagacgtagagggaaaggccacacatcgtgactgagatcgagatcgggcgcggcaagcgcggccgccgggcttacgcattcgacgacattgctgtcgttccgagccgccgcacccgggacccgaaggaggtctcgatcgcctggcagatcgacgcctaccgcttcgagctgccgttcctggccgctcccatggactccgtggtctccccgcagcacgccatccggatcggtgagctcggcggtctgggcgtgctgaacctggaaggcctgtggacccggcacgccgacccgcagccgctgctggacgagatcgccgggatgccggtcgagtccgcgacccgccggctccaggagatctactccgcccccatccaggaggagctgatcggacagcgcatcaaggaggtgcgcgactccggcgtcgtcaccgccgccgcgctctccccgcagcgcaccgcccagttctccaaggcggtcgtcgacgcgggcgtcgacatcttcgtcatccgcggcacgacggtctccgccgagcacgtctcgggcgcggccgagccgctgaacctgaagcagttcatctacgagctggacgtcccggtcatcgtcggcggctgcgccacgtacaccgccgccctgcacctgatgcggaccggcgcggccggtgtcctcgtcggcttcggcggcggcgcggcgcacggcaggcaccggcaggggaagcgtcagcagccgccgaagcagcgcggcggcaagcagcgggaccggcaggactcgctgctgccgcccgaccggtccgtgcgcatgcccgtggaggcctgggaggaggagcgcccggcccgcgcacagcgtgcgcccaagggcccccgggtgctgcgggaaccgccgcgccggggagaggagtcctcctcgccgcgcagtctgggccggctgctgctcgtcctcatcctgctgctgatggccgcggccgtcgcgtacgcggtgatgttcctgccgaagcaggaggcgggcggcggcggagctccggcgtcgcccaccggctccgccgcaccgcctgccgcctcgggggagcccgagccgtccggatcgggggacgggtccgccgatcccggctcccagcagccgcagaccagccggtcggcggtggcgctcgccgccggttacgcgctccgcaaggacgcggagggcttcgagatcggcgtaccgaaggactggcagcgcagccccgccaacgcggaccggcagatccgctacggcagcgacgggttcaccctgctcgtggtgcccggccgggacacggtgaagacgggaggcgccgatccgctggactaccagcgggacaaggagcccgagctccagccgttccgggactccagctggtcctcctcgtccggactgcgcagggtcgacgtgggccggcaggccatggccgaaggacagttcacctggcaggagagcggcgggcgcgaggtgttcgtccgcaatctcgccatgatcgtcgacggcagataccacgtcatccaggtcatcgggccggagagcggccgggacaaggtcaccgagatctacgagcaggccatcgcctcgtaccgggtcacctgaccgccggtcccacccggccgcaccgcacgtgctcgcctgaccgcacgtcatcgccgccgccccgccaagggcgttgtgcggtggcgacaaccatcacagtgcggtctcgtgggcgatcccctgttccgccgcaccgctccgcctccgtaatctggcaattcgaggaacggggcggggacatcacgtggatcgatcacagagcacggacgcgggactggtgctggcggggcgctaccggctgggcgacgtcctcggccggggtggcatgggcaaggtctggcgcgcccacgacgaggtgctgcaccgcacggtcgccgtcaaggagttgaccgccgggctgtacgtcgccgaggccgaccggctggtcctgcacgccaggacgcagaaggaggcgcgggcggcggcgcggatcacgcaccccggcgtcgtcaccgtccacgacgtgatcgagtacgacaaccgcccctggatcgtcatgcagtacgtcgacgggccctcgctggccgactccgccaaggagagcggcgaggtcgcaccgcgcgaggcggcccgcatcggactgcacgtgctgagcgccctgcgcgccgcccacagcgccggggtgctgcaccgcgacgtcaagccgggcaacgtcctgctg

SEQ ID NO: 2905 - DNA, 1893 bp, Unknown
  Kingdom: Bacteria, Phylum: Actinobacteria, Class: Actinobacteria, Order: Streptomycetales, Family: Streptomycetaceae, Genus: Streptomyces
cccatcctctccagctgtcccatcagctgctgcgccgccacttcccctcccaccccagcggccaactcgacgccagccgggcggcgcagcagctgatgggacagctggagaggatgggcgtgccctcgcacgaccgggaacaggtgctccagcgcctctcaccggacttcctccgctcccatgtgcacgagctgaccaccgacgggatggcactgccggtccactaccgcacctggacgagcccgcaccacctgccggtcggcggcagccccggccagctgcagctcaccctcacgccggtcaccaccaccgtggaacggctgcgtacgggatacgagctggaggactaccgcaccaccgcccgcgacgacgtcgacggccgatcccaggaccgcggtgccgacgtgacgctcagcgccagcgaacgcgcggcgggcagcggagtgttgaccgccaatccggccctccagggcaccgccgccaagcagcggtcgagcaacgtgaccgaggcggtcggcagtacagcgatgcccaacatcgccaccacccaggcgcacgccgagatcgtgaccacgtacaccctgacggccacgctggtggacgcgtccgggaagccgctcggccccaccgccaccgcccccgtcggcagcctcaacgagatcctcccggcgagcctgctcaccccggacggcgacggcgtcgacggcgcgctcaccgagcaggacgtgcccgaaccgccgcgcggggtcaccgtgctgaccgccgatcaggcactgccggagtccatcgcccagtggcggaccgcagaccgggagaccggcgagcgggacccggacatcctgcccttcgatgatgtgatcggctccggcatcctcgccgtggacatcctcggctcggccaacgtgcgggacgccctcaccctggccaccgcccgcgccgacggcttccccggtgacctggatctcggcgagcggcacacgggcagcacgctcaccgaacgcgtacggatggcccgccacaccccgctcacggctctcggtaccgccccggcccaggcccagcaggaggccacctcccaggtcggcctgaccgcgggcttccgcgaggcgctcggcaccgacgggtcgccgctgcccacccagtcctccgcccgcctcctcggccagtcccacaccgccgactcccgtctctacgccaagatgcaccggggtggcgcccggctgctggccgtggagaacaagccgcgtatggaggccatgcagcggcggaagaccggcgacgcgctggacgcgggcatcaccgacaacgtcgagggcgcggtcagtacgtcgccgctggcgggcaacagcaacgcgggcgtgaccaaccccggcgccacggtcccgatcggcggcgccaacgacgcgaccgccctccgaagcgccaccgacaccactctcggcacccacgtcaaggtcgtcaccgaccgcagcatgctcttcgcggtccccgtcagctggctctcggtggccgaggtggaccaccgggtcaccgacagccgcccgatccaggccctcggcaagcccaagcgcggaccgcgcgccgtggaggccgagaccaccgccctggtctggctccgcgaggacatcgcccgcgactacggcctcctggacgacaccaccttccccgacgaggcacgcacggcctgggacgaccaggcgaagtcggcggccgacctcgccaccgccgagaagaactactacgacgcccgcgccaggacccgggaggcctggctcgacctgggtcccgaggagcaggccgcgctcggggacgacgaccgggccacggtcctgccccaggccgtcgcccagtccccggccgtcactgcctggcagacggcctggggcaggaccg

SEQ ID NO: 2906 - DNA, 11966 bp, Unknown
  Kingdom: Bacteria, Phylum: Actinobacteria, Class: Actinobacteria, Order: Streptomycetales, Family: Streptomycetaceae, Genus: Streptomyces
cgcgttccgtacggcttcgcgttccgtacggcttcgcgtggtgcgcggacgtggacctccgcgcggggctggggtcctgtcggtggtggccgatacgctcgcccacatggctctcaacacgtccgctgaagcgccgctgcccgtcggtgaggtgtcccggctcatcggcgggtggatcgaccggctcggcgccatctgggtggagggacagatcacccagctgtcgcggcgcccgggtgccggggtcgtcttcctgacgctgcgcgatccgtcccatgacatctcggtgagcgtgacctgcttccggcaggtcttcgaccggatcgccgatgtggtgacggagggcgcgcgcgtcgtcgtgctggccaagccggagtggtacgcaccccgtgggcagttgtcgctgcgggccacggacatacggccggtaggcatcggtgagctgctcgtgcggttggagcagctgaagaagtcgctcgccgccgagggtctcttcgccctggaccgcaagaagccgctgccgttcctcccgcagctcgtcgggctcgtctgcgggcgcgcttccgccgccgagcgcgatgtgctggagaacgcccgccgtcgctggcccgccgtgcgcttcgaggtccgcaacaccgccgtgcagggggtgaacgcggtcgcccaggtggtgcaggccgtcgaggagctggacgcgctggacgaggtcgacgtgatcgtggtggcacggggcggcggcagcgtcgaggatctgctgccgttctccgacgagcagttgatccggaccgtggccgcctgccgtacgccggtggtctccgcgatcggccacgagcccgattcgccgttgctggacctggtcgccgatctgcgggcctccacgcccacggacgcggccaagaaggtcgtccccgacgtgggcgaggagctggagcgggtgcagcagttgcgggaccgggcgctgcggaccgtacggggtctgctggaccgcgaggagcgggggctcgcgcacgcgctggggcgtcccgcgatggagcggccccagcggctggtggacgagcgcgaggccgaggtggacgccctcctcgggcgcagccgccgggtgctgggccatctgctggagcgggccgattcggagctgtcgcacacgctcgcccgggtcgtctcgctgtctccggccgcgaccctggagcggggctacgcggtcctccagcggcccgacgggcatgtggtccgctcccccgaggaggccggggcacccggcgagccgctgcgggcgcgggtgtcggagggcgagttcacggtgcgggtggacgggtgaggccggggagcgggacggccgggcggccgtatcgccggggcggcagcccccacattgtcgtaacagctcacgcatagggtggatcacatgacggacgacgacgggacgacggcggctgccgccacgggcacgctcgggtacgagcaggcgcgggacgagctgatcgaggtcgtacgccggctggaggcgggcggcacgacgctggaggagtcgctggccctgtgggagcggggcgaggagctggcgaaggtctgccggcactggctggaaggcgcccgcgcccggctggacgcggccctggcccgcccgcaggaggacgaccagggctgaccgagcgctcgcgtgacccggcgggggcgcggtgcggccgtcggcacgcgcgcggcggtcggcgccccggggcggccgtcggcagtcggcagtcggcagtcgggacggaggccctcgcgcaagacagacgcgctgtgcaatggatcactcccggccagttttagttgaaagttaacctatctctggcgtacgttcgggacttctccccaccgcgtacgttcggaaggtttgcaccagatgtccctcgttctcgaccccgccgcccaggacctcctcttccgtgaggcccgtaccgccaacacgttcaccgacgagccggtgaccgacgagcaggtccaggcgatctacgacctggtcaagttcgggccgaccgccttcaaccagtcgccgctgcgcgtcgtcctggtccgctccgccgagggtcgcgagcgcctggtgcagcacatggccgagggcaaccgcccgaagacctccacggccccgctggtcgcgatcctggccgccgacaacgagttccacgaggagctcccggcgctgctcccgcacttcccgcaggccaagaacatgttcttcgcggagcgcccggcccgcgagtcggccgccggcctcaacgccgcactgcaggccgcctacttcatcatcggcgtccgcgccgccggtctggccgccggcccgatgaccggctacgacgccgcgggcatccagaaggagttcctggacgacgaccacaccccgctgatggtcgtcaacatcggcaagccgggcgaggacgcctggttcccgcgcagcccgcgcctctccttcgccgaggtcgtcacgaccgtctgagcctcggcggccgaacccggccgcccgtacgcgagggggccccctcgcgtacgcgggtgcggtccgcgccgcgcgtcaggaagccggcgcggcgggcggcgtcgtcttcagtgcggcggccatctcgaccaggctctccttcggcgccgagccggtcaccaccgtggtgtggcccttcccgggcaggacgagcgcgttgtacttcgcgccctcccagtactgccactcacggccggccacggtctcggtgcgcccggtgtccttggccttccggctgacctcggggacgtacgtacccgccgcggtggtggcctgctcgaccgcgacgtacctccggtcctcgtcgaggaagcccaggtgccaggcgtcgcccgcgacggcgtcgtaccggacggaggtcgccttccactccttcggcagaccctcgggagcggccaccgggtagggggcggcggtccgcacggtcgccagttccacggtgaagtcgacggccttgatcggatcggcgtgctcgtccttcgggatgaagatgtagatgacgcccgcgcaggcggcgatcaccaaggtcgacaggagcatgtcccggactgtctgcttgcctcgcttgcttgccacgggatccatggtggcacgcggcctgacacgcccggccgcagggtgcccgtcgcggccgcgacgccgggagcgctcatgcgtgacccggcctgctcattttatcgacctaccgatagagtcacagcaccctcatatccggtcgtcgccgtacagaaaggtgcgctccgatgtccgagcatcatctgccgtcccaactggaggtctccccggaggcccccgaccgcaacctggccctggagttggttcgggtcaccgaggccgccgccatggctgccgggcgctgggtgggccgcggcgacaagatcggcgccgacggcgccgccgtgaaggccatgcggaccctcgtctcgaccgtctcgatgaacggcgtcgtcgtcatcggtgagggcgagaaggacgaagcgcccatgctgttcaacggcgaacgggtcggcgacggcaccggcgccgaggtcgacatcgcggtcgacccgatcgacggcaccacactcaacgccaagggcatgccgaacgccatcgccgtgctggccgcggccgaccgcggcgcgatgttcgacccgtccgcggtcttctacatggacaagctggtgacggggcccgaggcggcggacttcgtcgacatcaacgcgcccgtgtcggtgaacatccggcgtgtggcacgggcgaagaactccacgcccgaggacgtcaccgtcgtcatcctcgaccggccccgccacgagggcatcgtcaaggagatccgggagaccggcgcacggatcaagttcatctccgacggcgacgtcgcgggctcgatcatggcggcccgcgagggcaccggcgtcgacctgctgatgggcatcggcgggacacccgagggcatcatctcggcgtgcgccataaagtgcctcggcggcgtcatccagggcaagctctggcccaaggacgaggcggagcggcagcgggcgctggacgcgggccacgatctggaccgggtgctgtcgaccgacgacctcgtcagcggcgacaacgtgttcttcgtggcgacggggatcaccgacggtgagctgatgcgcggtgtgcggtaccgcgcggagacggcgaccaccgagtcgatcgtgatgcgctccaagtccggcacgatccggacgatctcctcgacgcaccgcctgtcgaagctgcgcgcctacagcgccatcgacttcgaccgcgcgaagtagcgcggagcggtagaagcgcgcggagcggtcggaaccgcggacagagagggggtgcggagagcggaacatcgctccccgcaccccctcccccgtgtgcgcgggcgcgttcagcccgccgcggctatgtgctcggacgtcgtcgcggccgtgagctcgatgtcccgccgtcgtcgccgggccagcgccacccggcgctccgcggcggtgagcccaccccacaccccgtacggctcgggctgcatcagcgcgtgctcccggcactccaccatgaccgggcaccgggcgcagacccgcttggcggcttcctcacgggccagccgggcagcggtcggttccttcgacggggcgaagaacaggccggcctcgtcccggcggcaggccgcctcggaatgccaggggcccgcatcgtcctcccgggcgggggtccgctgggccggaacggcggcgacctgcagaggatgatgcggcggttgcagcacggtctactcctgacgacggctacggcttcgcgagcgagagtcgatgcagcactccctacccgctgtgcgtacgcctatgcactgcgtggcaccagcgcgcggcgcaccgtaatgcgccgctgcggctttctggccgattaccggaggtcgtccgtcccgccgtattcagtggccgagatgtttgcgcagccgccgctggaggtccgcgacgaacttcccccgcttcggcctggcttcgacggtcccgaacacggaatagccgttcaccacgaccaccggcgcttccgggtccgccgattcgagcgtgcgcacttcgaaggtgccgaagacacccgtgccgttgccgcgcagggaaatgttctccggcacccggatgtcgacgctgccgaagatggacgtcgcattgatgacggtgaagcgttggccgaaaagcgcttcggtcagatcgatctccacgctgccgaagagcgcgaaggcgttcgtccggccgccgacccgccaacggcccttgcgggtggcgctgctgaagaccgcgacgagattgtccgcggggccgtcgggactctcggggccgtaggagtacggctgggagtccgggcgggccgtggggccggaggacgcgggcaggtcccggaccagtggctggagttcgccgacggtcttggcccggtagaccaggtcgatccgctccgcgtgctcgtccgccgtcagacggccctcggccatcgcctcccgcaggatgtccgcgatccggtcgcggtcggcgtcggaggcgcggatgccatcgctgtccaggacttcggcgggcggcgggacggccggtgcgaggggctgctggggctgcttctctaggtccaccgacccagcgtacccagacgcgatagatcgcgaccacccctccaaccggcgtgccccggctccggcgccgcactccgggacggcgtccaggtgagccttacctcacaggatcctcccggcggcggcgctctaccctggtggatgcgctgcccgagggaggtcagccgctgtcgccgagtgaggaatggccgtcatggcagagtttgcgtactccgatctgctccccctgggggaggacaccacgccgtaccgtctggtgaccgccgagggtgtctccaccttcgaggccgacgggcgtacgttcctcaaggtcgacccggaggcgctgcgcacgctggccgccgaggcgatgcacgacatctcgcactacctgcgcccggcccacctggcgcagctgcggcggatcgtcgacgacccggaggcgtcctccaacgacaagttcgtggcgctggacctcctgaagaacgcgaacatcgccgccgcgggcgtgctgccgatgtgccaggacaccggtacggcgatcgtcatgggcaagcgcgggcagaacgtgctgaccgagggcggtgacgaggaggccctgtcgcacgggatctacgacgcgtacaccaagctcaacctgcgctactcgcagatggccccgctgaccatgtgggacgagaagaacaccggctccaacctcccggcccagatcgagctgtacgccaccgacggcggcgcctacaagttcctcttcatggcgaagggcggcggttcggccaacaagtcgttcctctaccaggagacgaaggccgtcctgaacgaggcctccatgatgaagttcctggaggagaagatccgttcgctggggaccgcggcctgcccgccgtaccacctggcgatcgtggtcggcggaacgtcggcggagttcgcgctgaagaccgccaagtacgcctccgcgcactacctggacgagctgcccgccgagggctcccccaccggtcacggcttccgggacaaggagctggaggagaaggtcttcgagctgacgcagaggatcgggatcggcgcccagttcggcggcaagtacttctgccacgacgtgcgtgtggtgcgcctgccccggcacggggcctcgctgcccgtcgccatcgccgtgtcctgctcggccgaccgccaggccaccgcgaagatcaccgccgagggcgtcttcctggagcagttggagaaggacccggcgcgcttcctgccggacaccaccgacgagcacctcgacggggcgggcggggacgtcgtggagatcgacctcaaccggccgatggacgaggtgctggccgagctgaccaagtacccggtcaagacccgcctctcgctgaccggcccgctggtcgtggcccgcgacatcgcgcacgccaagatcaaggagcggctggacgcgggcgaggagatgccgcagtacctgaaggaccacccggtgtactacgcgggcccggcgaagacgcccgaggggtacgcctccggctccttcggtccgacgacggccggtcgcatggactcctacgtggagcagttccaggcggccggcggctccaaggtgatgctcgccaagggcaaccgcagcaaacaggtcaccgacgcctgcgacgcgcacgggggcttctacctcggctcgatcggcggccccgcggcccgcctcgcccaggactgcatcaagaaggtcgaggtcgtcgagtacgaggagctcggcatggaggcggtgtggcgcatcgaggtcgaggacttccccgcgttcgtcgtcgtcgacgacaagggcaacgacttcttcaccgagcccgccccggcaccgacgttcaccagcattccggtgcgggggcctggtctcggctgaccccgccccgtagaggtgaccgggagggcccgtccgcgcggacgggccctcctcgcgttcgcgcgttctcagccgtccagcaggcccgaggtcgcgaccagataccccagctgtgcccggctgttgctgcccagttgctcggagaccttgcgcatgtgctcggcgacgctgcggcggctcatgccgatccggcgggcgatggcggcgtccgtctcgccgttgacgacggcctggaggatggcgcgctggaggtcggaggtgacgacgggggtgcgcagcggcgcgcgttccgggcggaccgggaccgcgcgggaccacgcctcgtcgaagtggcggaccaggaagcggaccagcgacgggtgctggacgcgcagagcggtgtgcggctcgtcggagaacgggatgagcgcgaggtcccggtcgaagacgatgaaccggtccgccacctcggccagggtcctgatctcggcgccctcggcggtcacctgctcgatgtaggcgagtgtggtgcggtccgaacggacggtgtgctggtagagggtccgctgccggatgccgcggcgcaggttgcccaggtcgcgcgggagcgactgctccaggacgtgggccgggcgtccgccgccggggtgggcggtgcggacctcggcgcggcagccgctgaccccggcgtccagcgccttgctgatgacggccgcgccggagagccgggtgaggacgggacgttcctgccggtgcatctcggcgtagaggccctcgaaggcggcgagggtggcgcgggcggagcgcagcgtgcggcgctgctcgacgatcgcctcctcgatcggggcgagcgcggcgaacgaggcggtctccggcggtacggggatgaggtagccgggtgactcctggtcggccaccatcaggtgcagggaccgcaggcaggggggcgcggcgccggccgggaggccgccctccgtcagcgcacggcgataggccgcgagcgccgcctcgcacggttgttccggtatcgaccggtccgagggtgattcacggcaatcacataccggtgagggggaatgatcgtccttcacaaggatgcagattacctttgtgcaatcgggagtcccccgtccggcgtccgtgctcgacgagtatgtccgggtgacatctggaatgggcagtgcggacgggccgaaggcggacgatacggacgacgacgcccggaaggcccgggacaccgcggtctccgagcgccgttttcgattcctcgtcgccggatacgcggtgtcttcctacggcacattcctgaatatggtggcgctcaatctcttcgtctacgagacgacgggccgggcgctggccatgggactgttcatggcggtgcggctcgcctcgggattcgtcgcaggtctggtcgtgggcggtctgctcgcccgtttcagcgcgaaaagcatcatgctgtgggcgaatgtcggacagggcgccgtgatgctggtgctcatcctggcgcccgacggcatgctgaccggggcgctgatggccgtctcggtggtgatcggggcgtgcgggacgctgttcatggtggcgttgcgcagttcgatcccggagatggtcggggaggaccgcagggcctgggcgaactccctctcgatcaccggtcgttcgctggccatggtggcgggcttcgcttcggcgggcgtggtggtgtccctcgtcgggtacaccgccgccttccttgtcgacatggcgacgttcgtggcctgtgcggtgacggtggccctgctgccgatcgcgggtggcaagggagccggcagctcgtcccccgaggcccccaagggctccgatagctccgatggcttggaggccacgaaggacgcctcggccgagagcagcggcaggcgccggcggcccgttgccttcctcgcgctcgccgccgcacccgggatgggcctgatggtggctctgcgcggggtcgacgcgttcggttcctcgtcccacaacgcggcgctgccgatctactccacgtcgctcgacgcgtcgaatcccgcggtgttcgtcagtgcgttctggtgcgtgtgggcgctcggcaacatcggggcccagcaggtgatccagcggtacgcgcagcgcaccggacgctccgtgggggcgctcggattcggctacggaacggtggtgatgtcggcggcgttcatcgcggcgttcgccgggttcccgctggccgtgacggcggtgatcgcgctgatcgcgggggccgcggacggcctcaccgaggtcgcgtacacctcgcatctccagacacttccggccaccttgcgcggccatgccttcggtctttcggccactttcgagaacctcggtttcggcgtcggcatgatcctggtggcggcggccctcgaccggttctccccgctggccgtggtgggctggtcccacggcgccgccatcgtcgtcgccgtggtgttcctgctgagggtggcgggagtgcggcgggcggagcgtacggggctgcgaaaggaagaagccgttgagggacgaccggatcgcggtgatcgggacggcgctgaggtttcccggggctgacacccctgaggcgtactggcacgacatccggacgggggccagccgcgtacgccgtttcacccgggccgagttcgccgcggcgggggtcccggcggcggagtacgaacggccggggttcggcggcgcgagcgcactcctgagcgacgtggacggcttcgacgccggcttcttcgggatgagcggacgggaggcggagctgaccgatccgcagcagcggctcttcctggagtgctgtttccacgccctggaggacgggggatacgcgggcggcgaggaccgttacgcgggcgatgacggcggctccgtacggatcggggtgtacggcagctccggctaccgcatgtactcgctgcacagctatctggcggagaatctggcggcggaggccggctcgggcgactggatgaccgccaagcaggtccaggtcggcaactaccccgacttcaccgccacccgggccgccttccggctcggtctgaccggtcccgcgctgacggtctcgacggcctgttccagcgctctggtctcggtgcatctggcctgccaggcgctgcgcgccggggacgcggacctgatgctggtgggctccgccgccctgcatctgccggaggtcaccggccaggtcccggtgaagggttccaccctctcccccaccggcacggtccgggccttcgacgcggacgcggacggcaccgtcggggggaacggggccgccgccgtcctcctcaagccgctggcacgggcgctggccgacggcgacaccgtgcacgcagtcatcctgggctcggcggtcaccaacgacggctcggacaagacgaccaacgacggtacggggcgcgggggtttcgccgcccccgggatcgccgggcagcgggacgcggtactcggagcactgcgcgcggcggacgtggacgcggcgtcgatcggctacgtggaagcgcacggcacgggcacgctgaagggcgacccgatcgagttcgccgccctgaccgaggcgttccgcgcacacaccgaccggaccggtttctgcgcgctcggctcgacgaaaccggccatcggccacctggacagcgcggcggggctcgcggggttgatcaaggccgtcgaggtgctgcggcacggggtggtcccacccctggtgaacttctcccggcccaacccggcgctggcggtggacgacagcccgttcctgctgccggtacgggaaaggccctggccgctggcgggggtgcggcgagccggtgtgcactccatcggcatgggcggtacgaacgctcatgtgatcctggaacaggcgccggagaccccgcgcaccgcgtcggcctccgacgacgtgcccgtgcccgcgctgctgccgctctcggcggcggacgaggacgctctgcgggcgtacgccgtcctgctgcgggaccatctggcgggcgagcgggaccgtccgacgggccgagccggctccgccacctcccccgccgatctgctgaccaccaccgcactcggacggcggctcctgccgcaccggctggtcgtcacggccgcggacccggtggccggcctcgacgccttcctgtccggagccccggcgggcgaggcgtacaggaccggggtcgccgacggcgtacgggagaggcgaccggtgttcctcttcagcggccagggcggcgggcatccgggcatgggcgcggaactggcagcgcgcttcccggtggtggccgaggtgctggcagcctgcgcccgggtgtacgcggaggagaccgggcgggacgacttcctggaccggatcgtcggcggacagggccccgagcgctgggacaccgccttcgcgcagcccgccctgttcgccctccagaccgcccaggcccggctgtgggaacggctcgggatcaccccggcccgggtcgccgggcacagcgtcg

SEQ ID NO: 2907 - DNA, 4754 bp, Unknown
  Kingdom: Bacteria, Phylum: Actinobacteria, Class: Actinobacteria, Order: Streptomycetales, Family: Streptomycetaceae, Genus: Streptomyces
aggtgctggaggagaccggccaccactgcgccccgggggaccggctgccgacctcccgctatgcggtggacggccggcccaaggaggtcgcctactgggcggccgaggcgacgggcggctccttcaccgccaacgacgaggtggaccgcatcctgtggctgccccccgacgccgcccgcgtccggctcacccggccccgcgacgtccggcagctgatcgccctgctggacgctctcgccgcgtcctgatcaccgctccggacccgccccgcacccgcctgcccgacacggttcacctgccgttcaccctctcccgtcggcggcttcacctgttctgcctaatttcggacgtacacggtgcgcggcggcaagccacagcaccgctcctcatcgcacgccgtcgtagaacgaactgaccacggcggctcctggaaggaacacccgaaagtgaagcttcagcgcaagaaccggcttcgtgccaccgcgctcggtgccctcgccgtctccggcgccctggtcctcacggcgtgcggttcggacgacaacaccggcggcgggacggccggtacgggcgagaagacgaccgccgcgtcggacgtcgactgcggcaaggccaagggccagctgcgcgcctccggctccagcgctcagaagaacgcgatggacctctgggtcaagaactacatggccgcctgttccggcgtgcagatcaactacaactcctcctcctccggcgagggcatcgtcgccttcaaccagggcaccgtcggcttcgccggctccgactcggcgctgaagcccgaagaggtcgccgactccaagaagatgtgcaagacgggccagggcatcaacctcccgatggtcggcggcccggtcgcggtcggcttccacctggagggcgtcgacaccctcacgctggacgcctcgaccctcgccaagatcttcgacagcaagatcaagaagtggaacgacccggcgatcgccaagctgaacgacggcgtgaagctgccggacaaggcgatccaggccttccaccgctccgaggactccggcaccacgcagaacctcggcaagtacctcggcgcggccgccccgagcgactggaagtacgaggccgagaagaagtggccggcccccggtggccaggccgcgtccggctcctccggcgtcgccgcccaggtcaagcaggtcgacggcgcgatcggctacttcgagctctcctacgccaagtcccaggacatcacgaccgtggacatcaacaccggtggcgccgccccggtgaaggccacctcggagaacgcctccaaggccatcgccgccgccaaggtcaagggcaccggcaaggacctggcgctcgacctcgactacaccaccaaggccgagggcgcctacccgctcgtcctggtgacgtacgaggtcgtctgcgacaccggcaacaagcccgagaccctcgacacgctcaagtccttcctctcctacaccgcctccgacgacggccagaagatcctgaccgacgccggctacgccccgatcccggccgagatcaacaccaaggtccgcgagaccatcggctccctctcgtaacacccggggcggccgggcccacccggcccggccgcccaccggcgcaccccgccaccggcgccccgcgtcaccggcgtaacgcgtcaccggcaggccggcccggcgcacccctccggaccggcccgcctcccgcccactctccatccggtgcaccgccgccaggggagcacaccgctcccccacacagaccggaaagaccatggcttccaccacaccgatagacacgccaccggcgccgccggtcccgcggcccagcccccggtccaccgggcgcatgggcgacaagatcttcctgggcctctcccgcggctcgggcatcctgctgctcgtgatcatggcgtcgatcgccggattcctcagctaccgctccgccatcgccatctcgggcaacgaaggcaacttcctcaccaccttcgactggaacccggccggcgacccgcccgtcttcggcatcgcggtcctgctcttcggcaccgtcgtcagctcgatcatcgcgatggtcatcgcggttccgatcgctgtcggcatcgccctgttcatctcgcactacgcgccgcgcaggctgtccgcccccatcgcgtacgtggtggacctgctggccgccgtaccgagcatcgtctacggcatctggggcgccctcgtcctggtcccgtacctggagggcctcaacctctggctcgacgacttcttcggctggacgtacctcttcgacaagaccgagatcgggatcccccgctcgctcttcaccgtcggcatcctgctcgcgatcatgatcctgccgatcgtgaccagtgtcagccgcgaggtcttcctccaggtcccgaagatgaacgaggaagccgcgctcgcgctcggcgccacccgctgggaggtcatccgcctctcggtgctgccgttcggccgctccggcatcatctccgcctcgatgctgggcctcggccgcgcgctcggcgagacgatggccgtcgccacggtcctctccccgagcttcctcatctcgctgcacgtgctcaacccgggcggcgggacgttcgcccagaacatcgcggccaagttcggcgaggccggaccgttcgggcgggacgccctgatcgcctccggcctcgtcctcttcgtcctcaccctgctggtcaacggcgcggcccggctcatcatcgcccgccgcaaggagtactcgggggccaacgcatgagccacgcacccaccggcgtcgtcgagcgcccgacgcccgcatcgcccaacccgaagagcagcctcggcagccgctccctgccccgcttcgcaccgctcggcttcgccgccgtgtcggtcgcgctcggcgtcggcatcccgctggccgccggctggcacagccgcatccagtggggcatgctctcggccctgttcttcctggccatctcctacgtggtgaccacgatcgtggagaaccagcgccaggccagggaccgcctcgccaccagcgtgatgtgggtctgcttcctcgtcgccgtcgtcccgctggcctcgctgctgtggacgacgatcgtccgcggctcggagcgcctcgacgtctacttcctcacccactcgatggccggtgtgctcggcgccgagcacaccggcggcgtctaccacgcgctgatcggcaccctggagcaggtcggcatcgccacggtgatctccaccccgctcggcctgctgaccgccgtgtacctcgtcgagtacggcaagggcgcactggccaaggccgtcacgttcttcgtcgacgtgatgacgggcatcccgtccatcgtggccggtctcttcatcctgtcgatcatgctgatcgtcggtatcgagtcgtcgggcctgatgggctccctggccctgaccatcctgatggtgccggtcgtggtccgctccaccgaggagatgctcaagctcgtccccaacgagctccgcgaggcgtccctcgccctcggcatcccgaagtggcgcactatcctgaaagtggtcctgcccaccgcgatcggcggcatcaccaccggcgtcatgctggccatcgcccgcgtcgccggggagaccgcaccgatcatcctggtggtcttcggcagccagctgatcaacacgaaccccttcgaaggcgaccagtcctcactgccgttctacatctacgagcagtacaaggtcggcgaggtcgcgtcctacgaccgcgcctgggcagccgccctggtgctgatcgccttcgtcatgatcctgaatctggtggcccgcggcatcgcccgctggaaggccccgaagaccggtcgctgacgcggccacagcgacctcccgaaagaagcagtgatttccatggccaagcgcatcgacatcagtggcctcagcgccttctacggcaaccacaaggccatcgaggacatctcgatgaccgtggagccccgctccgtgaccgccttcatcggcccgtccggctgcggcaagtccaccttcctgcgcaccctgaaccggatgcacgaggtgacccccggcggccgcgtcgagggcaaggtgctgctggacgacgagaacctctacgacgccaacgtcgacccggtcaccgtgcgccgcacggtcggcatggtcttccagcgcccgaaccccttccccaccatgtcgatcttcgacaacgtggcggctggtctgcggctcaacggcagctaccgcaagagcgagctgagcgacgtcgtggagaagtccctgcgcggcgcgaacctctggaacgaggtcaaggaccgcctcaacaagcccggctccggactctccggcggccagcagcagcgcctgtgcatcgcccgcgccatcgcggtcgagccgcaggtcctgctgatggacgagccgtgctcggcgctggacccgatctcgacgctcgccatcgaggacctgatcggcgagctgaaggagcgcttcacgatcgtcatcgtgacgcacaacatgcagcaggcggcccgcgtctcggaccgcaccgcgttcttcaacctcgcggcggtcggcaagcccggccggctcatcgagatggacgagacggagcggatcttctccaacccgtcggtccaggccacggaggactacatctccggccgcttcggctgagccaccccgcaccacccacagacagccttgcggtgctgcatggcggtgccaccacaaggcgaaagggtccgcccccgttctcgt

SEQ ID NO: 2908 - DNA, 3791 bp, Unknown
  Kingdom: Bacteria, Phylum: Actinobacteria, Class: Actinobacteria, Order: Streptomycetales, Family: Streptomycetaceae, Genus: Streptomyces
ccggtccaggagcaccgccgcggcgcgcagcagcacggccggggccttcagcggctggatgcggcccgcgaagagcgggatcagcgcgtcctgcggcaggccgagccgggcccgcgcggcggcacggccgtcggccgggcggaagcggtccaggttgacgccggggtgcacgacggcgacggcggcgggatcggcgtcgtagaagcggacgagctcgtcggcctcctcggcggtgttggcgatcagccggtcggaggcgttcacgatctgggtctcgccgatgacccgggcgggcggctcgggggtgtcgccctcggcgagcgcggcgttcttgaccttggccatggtgtgcatggcgtgcacgagcggcacaccccagcgctgggcggcgagccagccgacctggccggagagccagtagtgggagtgcacgaggtcgtagtagccggggcgctggccggcccaggcctgcatcacgccgtgcgtgaaggcgcagagctgggcgggcagctcctccttggcgagaccttcgtacggcccggcgtcgacgtgccggaccaggacgccgggcgccagctcgaccgcgggagccagtgagccggtggtggcccgggtgaagatctcgacctcgatgttgatcgcggcgaggcgcttggccagttcgacgatgtagacgttcatcccgcccgcgtcgcccgtgccgggctggtggagcggagacgtgtgcacggagagcatcgcgatgcggcgtggcttgcgggaggctccggagaagcctccggggaacctgaggcgcgcggccgtgcgggtggagccgagccgggagacgtactggctcacctcgtcggtcctcctcgatcggggcatgctgaccggagggcacggtggtcctccgaagggcgagaacagtggaatcccgcctttcatttccgttttgccaaatcattacgttgccgggcggcgcgtcgcgcggcgacgacgggaggtccgggaagccgcccggcccctcccgtcgcatacgctcgacccatgcgccagcgccccatcggcaccgccacccgcgggaccaccaaccccaaccggctgcgccgcatggaccgctggatcgccgacgcgcacggccccgccctgcgccgcgccgggacgccggtggccgtcgacctcggatacggggcggctccctggaccgcggtcgaactgctggaccgcctgcgcaccgccgagccgcgcaccgcggtggcgggcatcgagatcgacccggagcgggtcgccgccgcgcagccgtacgcccgcgagggcctcaccttcgtgcacggcggcttcgaggtcccgctggacgtccggcccctgctcatccgggcggcgaacgtgctgcgccagtacgacgaggaccaggtcgccgaggtctgggggcggctgtgctcccgcctcgctccggacgggctcctggtggaggggacctgcgacgagatcgggcgccggcacgtctgggtggcactggggcccgagggtccgcgcacggtcacgttcgcgacccggctcggctcgctggagcgtccgtcggatctcgcggaacgcctgccgaaggcgctgatccaccgcaacgtgccgggcgagccggtccacgcgttcctgcgggacttcgaccgggcctgggcgacggcctccccgtacgcctcgctcggcgcacggcagcgctggatcgcggcggtgcgggcggtgtcgggcgactggccggtgacggacggggtacggcggtggcggcagggcgagatcaccgtgccgtgggacgcactgcggcccaacagtcgatgaacccttgcccggaagggcagaaatcctccgctccgggaacgccgcaagggcatcgttcgtcccagtgaggggagatggcgcaggtcgaagcgccgtccgggccggggagccggggggaaatcatgatgaagtggccgtgcgggggcggtatgtgacgctccaggtgccgtcggcctctgttgctttacgggacgacatggcacgatcgcgacgttgcagaaaagttactgacggtaagtcagatgtgcactacccggcttctgttgcttttctcgcattcgccgtactcgccgcattagttgcattcgttgcctttaccgccttcgtcaccttcatcatctttgtcgcctcctcccgggggcgggcccggagtaacaacccggagggggagctcgtgaaccgacgccactgcgccactgccgccatcacgctggtctgtgcgctggccctgctgacgtcgacgggccaggccatggccgccccggttccggagccctcgccctccgcgccctcctcccccgccggctcgccgccccgctactccaacgcggacctcgaaaaggtccgcgagcagatcgacacgctgtaccggaaggcgggcgcggcgacggacgcgtacaacctcgccgaggagcagacgaagaagcagtccggagagatcgtgaagctggccaaggcgatcgtcgacggccaggcgcgcatcgccgccctgaaggaccgggccggggcccaggcccgcgagcagtaccgcaacggcggcctgccgcccggcgcgcagctggccctgagcaacgacccgaagctgttcctggacggactcaacaaggtccgccagagccagcacgcctccaagtcgctcctgaccgatctgaaccagacgcaggaggacctggagacgtacacccaggacgccagcgcgaactgggagaagctggagacgaaccgggtcaagcaggccaaggccaagaagaagatcaacgcccggatcaaggcggcggagaagctcgaatcgcagttggaggagaaggagcgcgaccggctccgccagctggagcgggacgccgcggacaaggcgcagaccgcctggctctcctccggcgccgtcaaggacgtcagcggcgaggcgagtgagggcggagcggcggcggtggccttcgcgacggcgcagataggcaagccgtacgtctggggagccgagggccccggttcgtacgactgctcgggactgacctcgcaggcgtggctggcggcgaagcgcccgatcccgcgcacctcgcaggaacagtggcggctgctgccgcgtatcgacatccaggacatgcgccccggcgacctgatcatctaccacgccgacgccagccatgtcgggatgtacgtcggcgacggcgcgatcgtccacgctccgcgccccggccgcaacgtcacgctggcgggcgcgggctcgatgaagatcctcggcgtggtccgcccggacaagtaggaccgacccgggcggggacgctgccctcccgagcccaagagcgggagcaggtgagctgggccacgtgagcggggccacgccgccgctcgtcggcgcgtgatgtttgtcatgcgcgcttccccgccatgagggcggcccatcgcgccggatccgtgtcgggacgcggcttatggcggcgcacatgacggggccggtccccgtgcgccattccgttcccccgccgaggaccgctatcgtccccgactggcggatcgtcgatcgtcgacccgccgcgccctcggggggagggaaggaaactcgtaacgatgcccgtacccgtaccgcggcagcgacccgttcccgctgcggagacctcgcacggcgacctcaccctgctggtgatcgaggacgacccggcgggcaccaccatcaccgtccccgaactctcggcagcggccgggacccgggtccgtatccgcaccgcccgcaacctcaccgaggccgcgcggctgctcac

SEQ ID NO: 2909 - DNA, 4033 bp, Unknown
  Kingdom: Bacteria, Phylum: Actinobacteria, Class: Actinobacteria, Order: Streptomycetales, Family: Streptomycetaceae, Genus: Streptomyces
aggcctgaccgtccgcccggacggtgtccgcgaggcccggcgtaccggtgtccttgccggacaactgcatgtcctccgcgatgctctccgggcgggtgggcgtcggcgagtccgggcggggctcggggtggacgaggacggcgtggtcgttgccggggctgaagcgcagcagtggttcgccggtcgcgccttcgtgggagctgacgatcttgtcgaagaccgacttgtcgaatgccgtcggcgggttccagaacatgtgcgcgccgtgcgccacggccatgtccttggcccgcatctcatcgatcagcgcatcgtgtgccggatgcgaaatccgcgaaccgtccggggacgacacatcgaacagatcatggtctccggtgatggggcgacggccgccctcgtcatcgaatccgaacacgattccttcgtgcacggtgaacttgccgtcggcctcataccgggccatcttcccggccagctcatggaactccgtggaccgctggttgaagcgcgagaccacccggtcccacgcctccaccggaaccgacccctgatcgggcagaaccggcttgaagtagccgaccagacccacagtccccgcatcggcacccagcaggacatcaacctcattgacggtcttcgccttgatgtcctgcggcttcggcaaagcccccgcatccagccacttcggcgccgacggattagtcggccgcacatccaccaccacattccggtcccgcgccacatcacggaacttgtcgaaattcttctccggaatgccgtacgtgtgccgggccgtgtaggagtcgatctgtccgggcttgagcttctgcgtccaggtgaggacggcgtggtcgctgttggggctgaagcggagcagcggttctccggagggaccctgatgggagctgacgatcttgtcgaagaccgacttgtcgaaagcggtcggcgggttccagaacatgtgcgcgccgtgcacgacggccatgtccttggcccgcatctcatcgatcagcgcatcatgctccggatgcgaaatccgggagccgcccggggacgacacatcgaacagatcatggtctccggtgatggggcgacggccgccctcgtcatcgaatccgaacacgattccttcgtgcacggtgaacttgccgtcggcctcataccgggccatcttcccggccagctcatggaactccgtggaccgctggttgaagcgcgagaccacccggtcccacgcctccaccggaaccgacccctgatccggcagaaccggccggaaataaccgaccagacccacagtccccgcatcggcacccagcaggacatcaacctcattgacggtcttcgccttgatgtcctgcggcttcggcaaagcccccgcatccagccacttcggcgccgacggattagtcggccgcacatccaccaccacattccggtcccgcgccacatcacggaacttgtcgaaattcttctccggaatgccgtacgtgtgccgggccgtgtacgcgttgacgacgagggagttcaccgggagcggagcgggaggcgtggttccgtcggtccccggctcgtcctgccggccggccggggccggcggggcagcggactccgggtggtgcaggcgacgggccagctcggcggtgtcgtcggggccgaggcccagttcggacagcggcagcggggcgttggacagcgaccaggtgatctgcgcggagcgcgcgtaggcgaggccgagcacgtcgggctgcgagacgagggtgtccgggggaagttcgggcggtggaggcggcagcagggcgtcgagcgtcgtcgcgggggtcgcaccggcccgcagtgcggcggcggcttcgaggaacgccctgtactgacccggggtggggccggtggccgggtcgacgttcgtgccgttggtggcggtgtgccagtcggtgaccatccggtccagcaggtccggggtcatccggccgtcgccgtaccgggcggcggtgcccggatcgcgccagcgcaggccgtccacgtacgcgagggcggccagcaactcccggttgccggactgctgttcggcatccggtccgagggcctcgcgcagggtgcggatctgctggagggttcgggcacgagcgaaggcgtcggccgggtccgggcccgcgtgcagtccggcgtcgcgcgccaggccgtccaggtcggccccggcgggctccggggtgaacagccgccaacggcccggcccgtccggaccttcgccgaggaccgcgcggatatggccgtcccggtccttcgcggtgcccgcctcggtcgtcggcgcgtacaccgggcgcccggtccggttcgccacgtgctgggcgaccggcagtcccgcgatcatcggctgctgtccggtctcgcaggagaacagcaccagcggacggtcctcgtctccgtcctgggcccaggacttgagcagctcgccgagctgcacaccgctgaccttgatggtggggtaggtggcgttgtccgtcccgagggtgacggtgcggggcgtgccgtggcccacgaagtagtcggcgccccgctcggtgccggagccggggagcgcggccggcgggccggtgaagaccgtacggggagcgggcggcgcgtcggtggacccgggaggcgggggctcggccgaggtggtgcgcaccccgcggaagctgtcctggcccagcagcgcctcacggccggcgctccgtcccgtaccgtcctcggccgggctctgcgagatggtcaacgtccgtacggccacgccgggttgcggggcgaaccgcgcctgcggcacgaagcgccggagctcgctgaagggcaccgtcctgctgtcgagcgtggtgacggacggctcgggcgtcggggacggcgtgcttgcggcgcggtcggtactgctcgtggtgatcggggtgaccggctcgtcgcccgtgtcgatgacgctttcctgccgcgactccgggtgcaggtcggcagcggtctcgtcctgcggcgggcggggactcccggtgtccagagcaccgttgcggatcagggattcgaccatctgcggtaccgagcggccgccctggaacaggctgtacatgttgtcgggcacgaccgggcgcaggccctgctccagcaggagtttcggcaacaggatctgcacgttggaccggaggttgccgtcctggaacgggtggaccacatgcagcgcccggatcgtgcggacgatggaggtgagcttgaccgtgtcgtcggcgtcgggttcggagacgcgtgcgtagtgctgctggaagagcgtgtcgacgaggccgggtgccgagttcttgccgtagttggtcgccagcgacgggttgttgtgcatgaaccgggtcaggatggtgaccggccggggcttgggcagtggcgtggaccagtcacggctggtcgtgtcgtagaccagcagttggtcgccgatgcgctcgtcgaagatgtcgtcggcgagcgtctcgccccgcagcgggaactgggtggcaccgccgccggaccagccgatcgtccggccgaggtggccggtggccagcccgtgcatggtccggtacgaggtcgagtccatgggcgtcgcgacggtgccggggtcgccgaggaactgcgtgtaggccgacaccatgccctgttggaatcccggcgagcggtcgtggtcgtagtaggagccggggtcgtccgggaaggcttcgagcgcggcctggtggttcttggggtcgatgtagaaggtccaccactggtcctccggcaggaaatcccgaagtgtctgagggggttggtcctgtgccgggtcggcgggccgcacggtgatctgcccgggcgggggcgggggcgccgaaggtgtggcagtggggtttccgtcgtctcggcccgactccaggtgcaggtcggtggccgtctcggcccagggccgggcatcggcggccgacttggaggcggcgggtacgtcggtgctcgtcgtgggggccgtcgatgtggtgacgggcagcggcttgatgtccggcacggtgtccggaggggt

SEQ ID NO: 2910 - DNA, 12911 bp, Unknown
  Kingdom: Bacteria, Phylum: Actinobacteria, Class: Actinobacteria, Order: Streptomycetales, Family: Streptomycetaceae, Genus: Streptomyces
gcccggcccggcagccacgaacacgccaccggtgaaaacccccgcccccacgggccccatgatcccgggcggcataccggccgacgagttccgctccgccatggcctccctcgccgccccggtcaccgtggtcacctgctacgacacaacaggcaccccacgaggactcacagccagcgccgtatcctcactgtccctggacccgccactgctactggtctgcctggaccgcgaatcccgcacccacgacacactcgtctccgcggacgccttcgccctccacgtgctcggccccgaagacgaagcactggcgaaacggttcgcgggcccgaccgagcagcgcttcaccaacgtctccctggacaccggaccgacgtcgtaccgtgccccgcaactcacggactgcgccctacggctgacctgtgcccgacacgacgtgatcgagggaggcgaccacaccatcctggtagggcgagtcatagcaaccgactgtctgggccgcccggccggaggcctggtctggcatcaccgaggcttcgcccacacgaaacccaccaaaacccccacctgaacaccaccacaccaccagcacgcgccccggcccgcgccaccacccccgacacgcgccaccaccccgacaccacgcgccgagccggaccggtagggccgggggggtcggtggccaccggtccggaccggcggccaccgaccccccgatgtgccacgccccgcaccggcccccaccaagccggaccggtacggacccggggggacaccggcgggccggcccgccggggcgcggcaatgcgaaccgggccgcgaaaccacacaaccccgaacacccccgcagagaactgcaggaaccccaacaggcgagagcaagtggcagcacgggggccgggggatgcgaggttcggattcatgagagttaccccccacactgtccccatgtcgttcaggggtcccggggcaagagccatcgaggccatcgccgtcggccgctcacactcgggcactccacccggggcagcttcgtcaccagcccttgtgcggggcctggttctccgggtcctcgggatgcctcacccgccgcttgagctcgtaccgcgagaggccggtgtggccgcggcgtgctcggtggtggcccgctgaacggccgccgtcgtctctacggtgagccgcccctcccgctggtccgcctagacggcccgctccaggtcaatcaaggtgcccggaattttgatctctgtcctgaggccagccggccagacacctgtcggccaccgtcgaggcgctcgagcgcgtccgagccgcctactggtccgctgactgcccagtcgttacggccgggggcacggtcacctgcgcgtcagactgttcgccgggggccggcgtctctgcgatgccctcgaccgtcggttcggcgtcggcagcgacgacaccgcgggcgcggaacctgctgacgagcatggtcccgcccacgcccacaccaaggccgaagatggccccttggctgcgggccaccatctggccgaccttgatgcccttctggaatcccgccagccggtaggccgctcgcatggctgcggggccgcccagcttcgcggcttcggcggtgagctttgcgtagtcccacatcttggggcgcctcgtttcgtgtcacaggtccggacggaccgatgatctcagggcggcgggacgccggtggccccatcgcgacttctcgtcaccggctgctgccccctcccccgatggtgcgcccgcaccggtctccgccctcctgctcccccgtgccgaccttcgcccggttctgcacggtcgtcgaggcgaggagctccgtacaggcccatcacgacaccgcccccacggtccaaggaggcatgtttcggtagtaccaatggccgccgtcacgctaccgagcacaaaaggacgcgaccgggagcgcgttgggatcaaccgggagcgaaaagatcgaaacgcaccccggaaggccgtcacccacctcatctgccacaacgagcgtccactgcctcagccggcccgaagatctgacacccgatcaccgtaaaggcgggcacggtgcacgccttccacccgagcatcgtccactcctcgtcgggcaacaactcccccgaccgccgcgcgctcccgctgatcacgtacaacgcggtcgacgacgccccggaggaccccacccgacccggccttctcgtgaccagggactcgacgcgcgtcacacctctcgtcgacgaccggctcggcctcgaagtcctgccgccggcgcaggaagcaggaagacggacggcggaggatggcggagaagccacaagccggaagacggaccggatcacagcaaagacaggccgggaattacaccgagcggctccgcgtgctcgggcggcaggtccaggaaggacagacaggtggtaggagacggctggcagatcgacgtctgcaatgctcccctgcagcttgcccgggcacaccccgtccgagccggcacctcgcctgtcggcaccccgccgcgagtacccggccacgtcactctccgtgcacggctgcagggcgatgaacctccaaaacgactgcggtcccggccactgttcggtcctcgtgcatggtgatctgccgaccgggttgtacgtgcgtccagtgggagggggttaggggcacgaggcgaaccgaggcctgcccgccgggctccagaatgggcacgttctcaacccagagcgcggcgatgctgaccgcacgttcaccggtgggagagaggcccccgatgtcccacatagggcgcagaacaccgttgccggaaaacggcgttgtgcgtcggccctcggcagcagggcagagcgtcagctctgctcggatgacgccgttacggatctcggcgcaccgccaacggcaccaggccgcgctccgctccatctgcagctgctcagccgctgcggcgagcttctcccagaacgccagagggatcgagcgaccgccgccgagttcctccagcaggccaaaggcgatctcccactcgtcgtgggcgaggtagtcccagatgtcttccaccgtgatgtcgttctcagtcgcggtctccgccgggaccagaagggaggccgattcgagcagaccaaggacgtccatgcgctcattgtcgaccctgtgcaagagctccccgcactcgtcctgcggatctcgtgcggtgtcggccggggtgagaggtgaagcggcctgtacccgtcgaacagctcgtactggcagggaatctgtttatgctcgccgtgctgtacggcctgcgaaccagttggcgagttctccatggctacgttcacgagaatgggctctggctcaacttctgtgacgcggtaccttcccgtcacgcccatcggacgcgtttgcgcaggagttggaatactgcgcggccgaacatctggcgcccggggtcgccttgcacgcactgtcggctgtggacggcatcaacggcccgaccgcggccgacctgcgtcgacgccagtacgcgtacgtcaggatgccgagcatgggaccccacaggaccagagggacgtaggaggcatagaagtagacggtctcccagccgccggccttgctcgggaaggtggccggcagcggatcgccgttggtcttggactgggtgacggtggtgatgatcgcgatgaccgtgaagaccagggtcaggatcgtcgccccgatcgtggccgggacgacggcggcggccgtcggtacccgccgcccaccccatcccggcatccagcgcgggaacacctcgccccagcgggcgaccagcccgacggcggtgaaggcaaggacctcggagatgagggtgagaaggaggacgtagccgttcatcgcccagtccgcgatcgacccgccacgcttgtccgcggtgaacagcacgcccaggcgccagaccccggacgggagcaccaccagcggcaccgcgtaggcgactaggcgggcccagcgcgggacccctgcggcgggctcgtgcgccgcacgccacatctgaggcaggcggccctcgcggcgaggcgtgtttgctgcttcgtcggtggtcgtagtcggcctggcctggcacatctgcgctcctcacgtccacgggccggatcggtccgtcttcgagactcgcagcaggcgagaccggtcaggatcgctccgcagaccgaacaacctccgccgggcgggcgagcacgaatccggacgctccgcctcagggatgacgggtcgccggaggacgactcgtccgttcgaccaggttcactggcaaagaggccgaagcgactgggttcgctgtcgaacggctgtcgatgacagcggacagtcacagaagttgagccagaatcgaaactggtgaagcccgctctcggcgtctcgaggcctcccaatcgggcgagcgggcacccgggccggcgccggttccgatttccgtctgcgctgcttcccgctccctcgtcgcgggcactggcccgggtttcagtaatgtccgttccatgactgccctcaacgccctcgtccgcctctgcccaccgcccgccgatccgccgcccgcggtggactgggcgcaggccgagcagtccctcgggacggccctgcccgccgactacaagcagctcgtcgagacatacggcgacggcgtcttcgacgagacgatctggttgctcatccccgactccgcccatgacacacgcaacctgcacgcgcagacgacggaacgggacggggtcctggccgggctctgggaagtgggcgaggagaagccggtcggcctgcaggaggcgggggcgcggatcctgccatgggcatgcgagcggctcagcggggcgttcctgtactggctggtacggcccggtcagcatcccgacgagtggaccgtgctctacaacgagggacagggcccgctgtgggaaccccacgacatggggtgcctcgccttcctgctggcggtgctcacaggaacggcggaaacggagtacttcggctacctctacgacgtgctgaaaccgacggagcaccgcttcgcggcggccgaccggatcctccgagcgcccgaacagtgacgctgccgcgccgctctctcgacgaccccctcgtctcagagttctccccatccggctgccgcgtcggtgagccgctcacggacaacggtgagcgccgggttggacggcgcgccgcggcggaccgcgaggtagatggtgttgagcggaggcgcatcggagaagtggagctgggtgacccggcctgcagccagcgccggttcggcgaggtagcgtggcaaggccgagattcccgcgcccgcttcgacggccgccaggaccgcgcggaggtcaggggcgacgagagcgacgggattggcgggacggtggccgaactcgctgcgccagtaacggcgcaggatgggcagctcttccccgtaggcaacaagcggcagtgcggccagcgcgtcggccggtgcggtccggagccggtcggcgtctacggtccgggccatggacggcgggccgatgaggaggaactcctcgtcgacaagcgggacggcgaggagctcacggtgggtgggccggatggccgagacgaccaagtcgagccggtctgcggccaattcggtgagaagatcatgggcgaggccgaatgtggcgtggaggtacaggccgcggccggtgagcggggcgagggcgggcagcacccgtagggtcatgatctcggcggcgccgcccatccgtaccgtgccgcgcagggccggctcggcctccgtggagcccaaggcgtcatggaggctgtccaggtgcaggctcacgcgggcagcgagagcagcagcgcgcggtgtgggggtgactcccttgcgggagcgggcgaacagcggctccccgatctgctcctcgagtcggacgagttgcccgctgacggcgggctgtgtcacgcccagcctctgggcggccgcggagagggagcctgttcggtagatctccaggaatgtggccagcaggtccaggctcggcacgcgctcttccttttttcgttgcccaggcgccggtcacccggtaggtgcggcgtggcagctcagtgtagggatgagctcccgcgccgagaggagtgtgggccggttcgtgtgcgttcttcatgtcagcggttgacggaccgtccatccggggcttcggttcgctcgacggcgaaccgcccgtatgcgcattctggtggccgctggacagtcgtcacgttcgtccatgccggtcgtcaggcccggtaagggctgtcaggacgtgaggtcggcccgcaaggtatggcggacggtctgagcgcggatgaggccgtcgcggaagacggagacgaaggtgcccactccgtcctcaacgcgcgcttccccgccttgtgtggggtcaggaccgcccgggtcgatgccccgaaccgtcatcacagacggagatgaagggatcggccttgttggttgcgtggacctcttttccgtccggcgcgatcgcgaaccagtgggggcctcgggcaccgacctcatcgccgactgccctcgccagtctctcggtcgatgaactcgatcacctcgtcgttagggccgtggacgaacacagccggaagctcatcgggtcggctccgtcagccgtgatcttcatgggtccggagaggggcgggcgcccgcggcgggcgcgcggtcggagagtgcggggacatcgtccgtgcggatggcgaagcgaaccagcgcggccacacgtccacgctcgtcgtcggtggggcggcgcgcgggatccagcggcagcgacgacgaaccaccgggcggggtctccagggcgtcgagcagctcgatgagccggtcgtcgcctgcgtcgaggaacacggcccggtcgacaccgtcggcgacgctccactcccggacgaagcggaagccggcccctcggtgtacaaggtcacagaaagcgtccaggtcgtaggcgcggacggcagtgtggtcgagacctcgatggagaatggaggtgatcgcaggcctctctcttacgcccaagaggttctggcgttggatgcgctgcactgcggggatgatccgacggccgggagggccagctcggcgccggtgatttccggccgtcggaaaagacccgccctcggttcaggcgccgagggccttgaggacggactcggccgtggccgtgctcgactgcgggttctgacccgtgatgaggttgccgtcgatgacgaccgtgttgctccaggccgcacccgtacgcggaacggctccccggtcccgcagccgggactcgacaaagaacggtgtgttctcccccaggccgccctggcgctcctcctcgtccgtgaacgaggtcagggcccgaccggcgaacgtgaagctgccgtccgccttggacgcgctcagcagaccggcgacaccgtggcacagagcggccacggtcttgctctgctcgtcggcttcgttcagcagtcggccgagatcggcgtcctgaacgaggtcggccatcggcgcatgcccgcccgggatgtagatcgcgtcgtagtcgccgacactcacatcggacagggccagcggcgtggcgagttcgctcgcgatgccggcgaggtaggactggaactcctccgcgtccgctgcggagacaccgccctgctcgctgaggctgagcgcatcgacgttggacttcgcaccgcccggggtagcgatgtccacctctgcaccggcggccttgaggacgcggtgagaggcagcgacctcctcggcccagtagccggtggggtgggtggagccgtcagctagctgcagcgtggtagcggcagagatgaccataagaatcttcgacatggttgcgcctgcttgtcggtagggaacgggtatgtcacgcggcgagccgcatgccgccggatgtcgggcggctaggggaacaaccccagaatccatcaccgatcatccatcgacacctcaggatccataagaattcttatggcagctcgcttggcacagcgtgggtatgtggaagaggacccccgggtacgcagcccgcggcacccagtctcacgaacgtggcatttcctcgcgcttctcgccgatcggtgggaagctgcaagggggccggggccatcagttttggactggtcacgatcccggtgaatgtcgtgtccctgaccgaaggtcacgttgtccccttccaccgggtgcacctgaaggacatgggccgggtgcggacctggaaggcctgtgagctcgacgaccgggtcggctcccaggacgacgtcggcaagggttacgagatcgcgaaggaccgggctgtcccggtgacggacgaggaggtcggcgaggacaagatcgagcaagccctccagtttgccgaccggatgacgatcgagggcctgtcggctccgcgacgcgtaccgcgaggcactgggtctgcgcgagccccaggaacgtcaagccgccgccgtcggaccaaggagccacgattttgcggttcccggcccaggagcagggatgagacatgcgttgcgttaactgtggacaagagactgagtatgaatacgagcccctcgtgggtggctcgccggagagagggttggtacacgtcagcagcggtatgacggtctgtttcccggagcgtggtccgggaagtccgatggtcaaagctccggtgccaccgcacctccgccaccttctgaaccaggaaccgcaggtgcctccgccaccacccgggttcctgatcgaggaggacgatcccggttcggagacgtgcagtccgacctcactgtgactccgtgtcacgcgggctgcccagccatcgaagccctctccgacgcggaccgtggcctggcaagtggtccgcatgacacaggagatgccctcccgtggatcccacgaccaccgcccgtcacgtcaggtccgccacggccctgccggcgttgctgtcgtagcggtcggcgcgagctgccgtagcgtcaagtcggtgcgccagtcgccagtacgcggtgaccagcagcacccgcccctccagcagtcggctacgcgaccggcctctgtgggcgcgtcacctccttcacacagcagctgtgttaccgacgtgccaagacagcgcgggtctctgcccggtgaatggggctgtccaggaaggctccggcgccgtaatcacagcagacaccgcaacatctcttcatggccgcagtgccgtcctgcgggcagtcaggatggacatcgctgcggtcccacagcggccctgagcaggcactcgcggtcgtccacactgatcagtccgtccggaagggtcccctcccccagcaatacgcgcaggtcggaagcgtgtgcggcgaaggcggccctgcaccactcgcgttccgggtgatcggagtccttcccgaacagcagcatctggcgttcggcgtcggcgtcgacggggagagacagctccgcggcaacgaccaggagttccaccagatcggaccgcaccgtgatgtcagggacagctgccagacggatcaagaagggcaggacggccggcatcacagcgctcacatggaagacgctgttcatcaggacgttctccagcacgggcagagccgcggagccggctacctcatccaggagaccgcggaggaggaaccggatcccggcagggcacccgggaatccgcgaccagtcgacatcggcacagcccagcagcgcggggtggtcgcgttcagctcgctccatctgcggatggtcgcggaggaaccgggcgacggcagcctctttgaccgccgcgtccatcacacacatctctcggcccctgccccacgcgccgaacggcgtccgcgaaactcttcccggggcgggcgccgaacgcaagtaccgggccagtagccgccacttcccgccctggggagtcgcgccccagcccagcactggattccggggcagcgcttagtgatcggctctggaagtccttcgggggggaccctgggcgggcgtgcctgtcgagtatcgccgagctcctggctggcacagcggttgacgagggctgccaccgcccgtccggatggccaccgccatcaccgaccgtctggctggctgtaggctcgacgtcaacatttcggcggcggcggaccgcgcgttcgtccaccaggtcatcgtcgacggacacacccggaggtgtgcggcaacccaacggattgggcgttgacctcagtccgggcgagggaacatgcgctcgacggcggtcaccagtgcggcacgacgggcggcgatagaggggtccgcggcctggtctgcggcagcggcggcgatttcgggctgaccagcccaggtcatggcgatctggttgatcagggcgaggatgtcgatcgggtcccagaccgggtcgagcagcccggtgcgctgagcgtcgcgaagtttgtcgagcttgtcggcgatcgtggcctggaggcggctggtggtgttgcctgcggacccggccagttcgaggcggccccacgtgatcaggcggtaatggtcagggcgcgccgcgaagtggtcgaagaggatgccggcgtaaccgggcaggtcggccggatcgagctgagtcgcctcgacgagtgcggtcgtctcgcgttcggcgacgtgcgcgtaaagggcttccttgctgcggaagtaggcatagacacgttccttgctcgtcctggcctgcttggcgatgcggtccacgcgggctccggcgatcccgtgccgggcgaactcctccttggctgcggcgacgatccgctggcgcgtggagtcggcggactcgcccgcgatggcggcgtccgaggtcaggccagggccggtggagcgagacatgactccaggataggcgaccgaaccgttcggtttgcgcagcagtccggacaggcataggttcaaaccgaacagtttggtttggtcggccgacagccgacatgacacaaggagcgaactcatgcagcaccgcaccctgggacagcggggactgcgcgcctccgcgctcggactgggcgtgatggggatgtccatggcctacggcccctcgaacgacgaggacggcacctccaccattcaccgtgcccacgaactcggtgtggacttcttcgacactgccgaggtgtacggccaaggcaccggcagcaacgagacgctgctcggcaacgcagtcaagaacttccgcgacgaggtcgtcctggccaccaagttcggcttcgacatggccggcgagacgccggggagcggcgtcaacagccgccccgagaacatccgcaaggtcgccgagaacagcctccgctacctccagaccgaccgcatcgacctcttctaccagcacatctccgaccccgacgtaccggccgaggaggtcgccggcactgtcggtgacctgatcaccgaaggcaaggtgcagtacttcggcctgagtaacgtcggcccccagtacatccgccgcgcccacgccgtcacccaggtcacagcccttcagtacgaatactcgatcttcgaacgcgaggtagaggacgagatcctgccgatcctgcgggagttggggatcggcctggtgccgtacccgccgctcggccgcggcttcctctccggtgtggtcaagcccgccgccgagtatcccgaggacgacatgcgccgctgggacgagcgctggcagggcgagaactacgcctacaatctgaacgccgccgagcagctccgaaagctcgccgccaccaagggcgccacccccgcccagctcgccctggcctggctgctcgcccagggcgaggacgtcgtcccgatcccgggcacccgcagcgccacacgtctggaggagaacgtcggcgccaccgacgtggaactcaccgaggccgacctggaccgtatccgggaggtcctcccccagggctccgcaggcagccgctacccggcctcggtgatggccggcttccgcaccgactgacagcccgtactccaagttcggctgttccgggcaagcgccggcgagcagcggctgcgcgtcctcctggacgtggctatgaccgggaggacacgctggcagctcgaccagccggccgaaggacttccggaaccgaccactgaagattggctggtgtgagtgcacgggcgcggggttaccggaatctcggaccggtcgagctgacggtcgcggtccggcctggcagcggtgggattgccccggcatcggctcctggtcaaagggcgctcgcgctctgacgacgcgaggttcgggcgaccctccggcgctggtgtggcccagggtgacatcgagacgtccggcgtcccggtcgggtgtcagcgatggccgctccggggagcggggatcctcggcaggagctcccacagggggcgtgagccgccggcccaggtggcgagggttctccggtcggcgaggtgcatgtgaagctgcgtggccagcggtgggcaccgggtggagaagcggccgttggtgacgaccaggacgatgtccgcgccgtagagctggcgggcggtgccattgacccgctggaggtcgggagtgccgacggccgaaccgcggtccccgtccttccggtgtttgcactggatgacccaggtgcggccgagcgggtcggtggccaggacgtccgctccgttgtccccggctccgccgatctgccgggcatccgcgcacccgtcgcggagcatcagatcccgcaccgcgtactcgaagtcgcggtggtgcagggcgtccagctccgggagtccgtagcgcagggcctgttggcgcacgcgatcccaggccagctgctgctgtcgacggtggacccaccctgctccggcggtcaccgcgatggctcccagcacgatcaggatccaccagttcaccagaagccaggagaccagggcccacagcgcggcgacggccagggcaccggcgccgaacatcacctgggcatcgcgttgccgctgccggcgggagcgg

SEQ ID NO: 2911 - DNA, 12053 bp, Unknown
  Kingdom: Bacteria, Phylum: Actinobacteria, Class: Actinobacteria, Order: Streptomycetales, Family: Streptomycetaceae, Genus: Streptomyces
cgtcgtcgccaccgccggcaccaccgacaccggcgagatcgaccccctcgacgccatcgccgacctctgcaccacccacggcgccgaactccacatcgacgccgcctacggcggacccctcctcttcagccccacccaccgcaccctcctccacggcctcgaccgcgcccacagcgtcaccctcgacctgcacaaactcggctggcagccggtcgctgccggagtgctggccgtcgcggacgccgggatgctcgcgccgctgtccctgcgcgccgactacctcaacgcggacgacgacaccgaggccgggctcccggacctgctgggccgctcgatccgtaccacgcggcgccccgacgcgctgaagatggcggtcacgttccgggcgctcggacgccggggactcggtgaactggtggagcactgcgtgcgtacggcccacgagttcggccgggccgtcgacgcccgtcccgcactgcgccgccgtcccggcgacatcgggatcagcaccgtactgttccgcccgaccgtggccgacgcgctgccggacgaggcgggcgacgccgtggtcgccgctgtccgccgcaccctgctcaccgaggggcgcgccgtcctcggccgcgcgcaggcggaagacggcgacggccggcgccgcctctggctgaaggccacactgctgcacccggacgccgcggcggccgagctgctgccgccgggccgtcccaccgagctggttagggaccgggcgcaggcgatgcggacgctggtcgaggacgtgctggaggtggcccgcctggacagcgcatcggagcgggcggagctccaggaactgccgctcggcgagttcgtcagccgccggatcggcctgctgaaccccgacgtgaccgtacgggtggtgcacgagtcgtgggtgtccaccgatccgcgccgactggagcgcatcctcggcaatttgctcgggaacgccgccaagcacggctcgaccccggtggaggtcacggtcgagggccgggtggtgcgggtccgcgaccacggtccggggttcccggaggagctgctgcgggacgggccgagccggttccgtaccggaagcatggaccgggccgggcacgggcacgggctcggcctgacgatcgcggcgggccaggcgagggtgctgggggcccggctgaccttccgcaacgcggcgccctcgggtgcggcggagggcacgggtggggcgatcgcggtcctctggctgccggagcacgcgccgacggtcaccgggagtttcccggtgctgcggatggcggaccagcggcaggcgtcggactgagccgtacgcccgtcggcacccgtggcgcacccgtcgcgcgcgtcggacacccatcgggctgcgggaacgccgacggcgaccccgaggagtgagccgtgaggctgtcctcgacgtcgccgtcggacgggtgacccgggcgcacgccccgggtaccggggtgtaacgggtccactgactcttttcggttgtgctgctcgcccgccgggtcccggcgggtgggcggttacgccggccggatcagatggagacgtgcaccgagcggaggaacgcggccgggttcagcgccgagccgtagttcggggtggtgcgaatctcgaagtgcaggtgcgggccgctggagtttccggtgttgccggacagagcgatcttctcgcccgtcttcacggtctcgccgaccttcacgttgaccttcgacaggtgcgcgtactgcgagtacttgccgttggagtgcttgatcacgacggcgttgccgtacgcggggccgtcgccggcgccgttcgggccggccttcacgacggtgcccttgtgggcggccacgacgctggtgccgaccggcacggcgaagtcctggccggagtgcttggaggcccagcgggcgccgccggtgccgtagctggcgctcagcgtgtacttcttgaccggggtcttccaggaggcggcgttcttcttcgccgccttcttcttgtcctcggccttcttcttcgcgtcggaggccttcttcgcggaggccttcttcgccgcgtcggcggccttgccctgcgcggtcgcctgctgggcgaccgcgtcggcggccgtggcggcggcgaggggagcggcagcggcttcaccgccgctggacgcgaacgccgatccggcacccagcaccacggacgctcccaggccggcggccaggacggcgccacggacgcggaaggcggacgggcggatggtgtgctggttcgttgcgcgcttcatacgaggaagtcctccgaaggtgagtggacccggcgtgctgtccgggcttgctccaccttggtaacccgcacccccgccggtgctcaaacaccccatctacgaagaaaagccgtagagggggccgggggaattcgtcgcgcttgtccccctgcgaggagtcggcgcgggctacgaaatccttcgcacggaagacgtttagcgcctgttccatgagcccttttccggacatggcaccgcgaaagggctgtatcgcccagagcctcgaaagggcccgccaccgccgggccgaaggtcccacggccgatcacggcgctttctcctagcccgggtagtaggcctgtttcgggctgtgcgccttgtcaccgccggtgggacctaagtccttccgattcgggaccttcggcctgctgcttcactacgctggcgggaaagcggcaccgcaccccgggggaccccatgacggccgagaacacccacgcactcgacggcatcgagctcgccgatgccgtcgcgtccatccgcaaccagctcatcgacgcggcgacccgggccacggaccacccggtctccttcgcggtcggcgacatccagatggagttcaccctcgaactgcgccgggaggccaaggcgggcggcaaggtgaaggcctgggtggtcgaggcgggtgcggacgccgcccgcaccacgggccgcacgcacaaggtggccttcaccctgaccccgcgcaacgccgccacgggcgaggcgtgggagatcgggacggaggacgacgggtccacggcggggttcggcgggagcacggcgcaggacgacgggccgacggcggggttcggcgggagcacagcaccgcacggcgggtccacggcggggttcggcgaggggtccgcccgcacgtgagtacggtgagtccctccgtcacccacccctccgaccgcacggtggtcgtctccggggtcctccagggcagcggcgtcctcctcaccgacctgctgatcctgacctgcgcccatgtggtcaagaccggcaccgtccacgtcgcccacccggacagcccggagcgcacccgtgccacggtcgcctggatcgactaccgcctggacgtggcgctcctccaggccgtcgagccggtgcggcccgttcctcccgtacggctcggcgtggtcgacacccgccaggcgatacccgggtgcgagatcaccggcttcccgcgcgtccagcgctacggccgcgaccagcgcctggaggcggaccagtacacggcgacggtcctgcccatggcgggccgggtccgcgacctgctggtctgcgatctggacggcccacccgccgcgcgcccggacgacgagccggccgccctgtccgggctctccggcggcccggtcttcatgggggacgtgctcctgggcgtcgcccggcaggtcccgctccagcgcgacggccgccgggtcgaatgcgtcccgctcgccccggtcctggcggcgaagcccttccgcctcgtctgtcagcggaccggaatcgacctgcgcgaggaacgcgtccacggcagcttcccgcgtgacctgcggtacgaggcggagtacgcccaggcgctcggcgtcgcctaccgccgtacgaagatcttcggcctggacgagctgagccgacacgacgccgagtgggatctggacacggcctatctcagcctggaggcccaggcgcaggcgccgtcggcccgcgccacgggccccacccggtcgattccccagcgcatcgacgcccttctcaccggccgtccccgggtcctgctgcgcggcgaggcgggcgcgggcaagacgacgctgctgtggtggctcgcctcgcacgcgtcggcccggaccctggtcgacgcgctggccccgctgaacggactgatccccttcgtggtgcccctgcgcacgctgcgcgcccgcggcggtacgttcccgggtccggcggagctgtcgggggcggcgggcctggtgatcgacactgccccggagggctgggcgggccgggtcctggagtcgggtcgggcgctcctgctggtggacgggctggacgaggtgccatcggaggaccgcgaacaggcgcacacctggctcgcgcagctcctggcccgctacccggacacccgctgcgtcgcgaccgtacgaccgctggctgtggaacctgactggctgcgctccgagggcttcgaggaactacgcctgttgccgatgcgcaacgaggacatccaagtgtttgtggcctcctggcaccaggcagcccggttgtccgaacaggacgacaccgagcgcttggacgaactggggcacggcctctcccatcagttcgaccagaatcccacgctccgtgacctggcccgtacaccgctgctctgtgcggtgatctgcgccctgcaccgccgccgcgacggtttcctcccggagacccgctggaagctgtaccgctcggcactggagatgctcctcggcgaccgcgaccgccgtcgcagggtcggtgagcccgaaggcatcgccctggacgtcgagaacgccgcccagctcctccagcggatcgccgtctggctggtccgcgagggtcagtcggagttcactcgggaccaagcgctgcgccaactcggccgtgcgctggcggggatggcgcgggtgagctctcagggcccgcccgagcggatcctcgcccacctcctcaaccgcagcggcctgctccaggaacgcgccaacggcacctaccagttcatccaccgaaccttccaggactacctggcagcaaaggaactcgtcgaggacgaccacctcaacgaattgctgcggcacgcaggcgaggaaccctggcaggacgtggttctgttggcggcgggacactgcggacgccgccagctctccgcgttgatcgaaggtctgctggatgtgggtgaccaccatgctcagagcacgaaccacaccgccgacatgcatgtcctggctgctctgtgcgccgagcattcgacctggctggacgaggcggtacgtcatcgggtccggcaatgcacggcggcgctgtttccaccgacggacggtgatcgggtagacgccctgagccggctgggcgaggcggcactggagtacctgccggatccgagcgtgaccgcgtccgacgaacccgccgagcacgtggccgagctgatcagcaccatcgggggagccgcagccgtaccgcacgcacgctcatggctcctcgcccatcccgaactgagcggcctgttcgcatacgagtgggaaggttttccgcccgacgcttacgcctccgaagtcctggccatatgtgatcttccgacggtctacctggccgtgggagaccgccgacggctggccgcactgcggcatctccctgcgctccggtatctgtacttggacgtggacgcgcccgactcggaggtacggacggctctggagggaaagggagtcgtcgacctcaacctggatggcaatcggtggctgaccgacttctcctgtctgcggcccgccgcccggtcactgcggcacctgagaatcgctggctgccccgctgtccgggacgcgactcacctcagcgagctgaccagcctggagactctgtgcctgaatgtctccgaggtgccgatcgcggaccgtgctgtcacggccgacctgcctgccgggctgaagtcactggagctgacagggctcgcgatcgagcggctcagcgacatcactcctcatccacacgtcgaggatctcgctctgttctcgcggcgagcactgtccctggactgcctcgacgcctggcctgccctcacggctctggaggtttctgacctcggtgactgggggggaagctctcaccgccctggcttcgtttccgtacataaccgagctgaccttcagcgcctttccctgggacaaccttcccgtcaccgagcagccccttccgctcatcgacgagctgaccgtccaggcccccttgggcggcttggggctggagcacctccgctccctcttccccggccttgcgcatctgaccctggacgagtcacacgatgccggcgcattgaatctagaaccgctcggcgaatggcctgggctcgccgtgaccatcaccggtcggaatgcggtcacgctcatcggtacggaccccctgggcgaccgtctcacggtcgatatccactgaccgacaactaaaggggctgccccggaccggtacggataccggttccggggcagccccttcacacacgctcgggctcacgccctaggcgcgcgtcacgcgtccttcgtgaggttcgggccggcgccgcctgccgcctgctcgatcggcgggacgtcgggcagtgccgacttctcctcgccgcggaaggtgaacttctggtcgtcaccctcaccctcggtgcccacgaccacgatgtgaccgggacgcagctcaccgaagagaatcttctcggaaaggatgtcctcgatctgccgctggatcgtccggcgcagcggccgggcgcccatcacggggtcgtagcccttcttcgccaggagcgacttggcctcggagctgagctcgatgcccatgtcgcggtccctgagccgctcgtcgaccttggcgagcatgaggtcgacgatctggatgatgtcttcctcggtcagctggtggaagacgaccgtgtcgtcgacacggttgaggaattccggccggaagtgctgcttgagctcttcgttgaccttggtcttcatccgctcgtagttcgtcttgacgtcgccctgggcggcgaagcccaggttgaagcccttcgagatgtcccgggtcccgaggttggtcgtcatgatgatgaccgtgttcttgaagtccacgacccggccctgggagtcggtcaggcgaccgtcctccagaatctggagcagggaattgaagatatcggggtgggccttctcgacctcgtcgaagaggacgacggagaacggcttgcggcgcaccttctcggtgagctggccaccctcctcgtagcccacgtagccggggggcgaaccgaagaggcgggaaaccgtgtgcttctcgctgaactccgacatgtcgagggagatcagcgcgtcctcgtcgccgaagaggaattcggcgagcgtcttggagagctcggtcttaccgacaccggacgggccggcgaagatgaacgagccaccggggcgcttcgggtccttcagaccggctcgcgtacggcggatcgcctgcgaaagggccttgatggcgtccttctgcccgatgacgcgcttgtggagctcgtcctccatgcgcagcaggcgggaggactcctcctccgtcagcttgaagaccgggattccggtggccgtggccaggacttcggcgatgagctcgccgtcgacctcggcgacgacgtccatgtcgccggccttccactccttctcgcgcttggccttcgccgccagcagctgcttctccttgtcgcggagggaagccgccttctcgaagtcctgggagtcgatggccgactccttgtcgcggcggacgcccgcgatcttctcgtcgaactcgcggaggtccggcggcgcggtcatccggcggatgcgcatccgggatccggcctcgtcgatcaggtcgatcgccttgtccggcaggaagcggtccgagatgtaccggtcggccagggtcgcggcctggaccagcgcctcgtccgtgatggagacccggtggtgggcctcgtaacggtcgcgcaggcccttgaggatctcgatggtgtgcggcagcgacggctccgcgacctggatgggctggaagcggcgctcgagagcggcgtccttctccaggtgcttgcggtactcgtcgagcgtggtggcgccgatggtctggagctcaccgcgcgccagcatgggcttcaggatcgaagccgcgtcgatggcgccttccgcggcacccgcaccgaccagcgtgtggagctcgtcgatgaacaggatgatgtcgccgcgggtgcggatctccttgaggaccttcttcaggcgctcctcgaagtcaccccggtaccgggagccggcgaccagggcgccgaggtccagggtgtagaggtgcttgtccttgagggtctcgggcacctcgcccttgacgatcgcctgggccaggccctcgacgaccgccgtcttgccgacgccgggctcgccgatgaggaccgggttgttcttggtccggcgggacagcacctgcatgacccgctcgatctccttctcgcgcccgatgaccgggtcgagcttggactcacgagcggcctgggtgagattccggccgaactggtcgagcaccagggacgtggagggcgtgccctcggcgggaccgcctgcggtggccgcctccttgccgcccgaatacccggaaagcagctggatgacctgctgccggacccggttcaggtcggcgcccagcttcacgaggacctgggcggcgacgccctcgccctcgcggatcaggccgagcaggatgtgctcggtgccgatgtagttgtggcccagctgaagagcctcgcggagcgacagctccaggaccttcttggctcgcggggtgaaggggatgtgcccggaaggagcctgctgcccctgcccgatgatctcctccacctgctggcggaccgcctcgagcgaaatcccgaggctctccagggccttagcggcgacaccctcaccctcatggatcaggcccaggaggatgtgctcggtgccgatgtagttgtggttgagcatccgggcttcttcctgagccaggacgacaacccgccgcgcgcggtcggtgaacctctcgaacatcgttaatcgctcctcagagcggtcggtcagtgaggggtcggtcccctcccagtccttccgcatgctagtcccgcaggacgggacagctcattccaactgccgacatccgtccggatcacccccgcaccggcggggattcttactgccgaacagctgacaactgctccaacccgatggtgcgagacgatgttcccgcaggccaggcagatacccctttcgccagtacgccgatggcgaacgtgagacgcctcggccagcgtgtcgccccttcccactaggaaagtcttacccgcaatcactgacagtccatgcggcgcgccccggttccctccgctacgggcgaacatccttgcgctgctgaatgctctcgcgcgcccccacggccgggacggaacgtgatccgtcgcgaaccctgcgtaactccggggctcgttcggcggttcatcggacatgacccccgccgtccctcagccccgatcgtcgcccgataccgctccgggttccgccgacgccgcacttgcccggcggtacgcgacggagctgggctgggccaccgcgggccggactccgctgcggctgctcaccgggacgctcttcgatgtgctggagctgcccgccgaggccggtcacgccgtgctgctgcgcggtgtgcgcaccggtcccgtgctgctgtccggtacgcggatggggctgctggtcgccgcgggcggcgccgatgagctgccggggctgctcgactggctggagtggggcccggtcgcgctggacctggccggcgtgggtgcggggggccgcgtcacggccccgcctctcccgggcaccccgggggactcgccgggggccgctgtgtggctgcggcccccagagccgagacgtgcgcccgggccggggctgccggccctcgcgggcttcgggagcagcggtggggatgcccccgatctcgtacgcctggtggacgccgcggctaccgaatgccatcgggtccggttgtcacgcgcccgttccggagtgctgacaagggatggagcggatcagccgttggccttctcgtaagcctcacggatctcagcggggacgcggccgcggtcattcacattgtggccgttctcccgcgcccaccggcggatttccgcggtgtccttgttaccgccggccacggcacggcccttgccgcggcccgtggcggcacggccaccggtgcgacgtccacccttggtgtagggctcgagaaggccgcgaagcttgtccgcgttggccgtggtgaggtcgatctcgtacgtcttgccgtcaagggcgaacgtgacggtctcatcggcctcgacgccgtcgaggtcatcgacaagaaggacctgaaccttctgtgccacgggatttcctttcatcgaaaatggagtacgcggaaaggaaaccgcttttccctcgaaaacacaaacccccgggagaggttcagcagcccgagaagacgggaaacgtgcgcgattcggacatagggttgcaggtccttctgcagatcacaggtgcagaagcatccggctgttgcccaaggtgttcggcttcactcgttcgagaccgaggaactccgcgacaccctcgtcgtaggaacgcagcagctcactgtagacatcggtgtcgacaggcgtctctccgatctcgacgaagccgtgcttcgcgaagaagtccacttcgaaggtgagacagaaaaccctgcgaacaccgagccatcgcgcggtctgcaagagcttgtccagtacgtgatgcccgacccccgaccccttgatgcgggggtcgacggcaagggtccgcacttctgccaggtcttcccacatgacatgaagtgcgccgcagccgatgactgtcgcgtcctcgtcgcgttccgcgacccagaactcctggatgtcctcgtaaagggtgacggtcgctttgtcgagcaggatgcctccggacacgtacccgtcgaggagtcgtcgtacggacgcgacatcactcgtcctggcgcgtcggacagtgatggcgggcttatttaccgacgggtcggtatgaagttcggtatccggatctctttgtggctgctctggggacatgccccgacgctatcgcccgctctccggcgtcgcgtcatcggccggggcgtcatctccggcggcgccggcggtcggttccgcggggttgccgggggcggtttcggcaagattgggggaaaccatgcgaacagcatcctgcagcgcttcgcgctgttcggcggacatcatgccgaagaacgcgacaagcgcggcggcggggttgtcactgcgtgaccaggcttcgttcatcagtgcggccgagtaggcggccctggtggagacggccgtatatcgataggcccggccgtcgacttccctgcgcacccagcccttctgatggagattgtccattaccgtcatcacggtcgtgtaggcgatggaccgttcctgctgaaggtcctcaaggacttcccgcaccgtgaccggtcggttccattgccagacgcgcgtcatcacggcgtcttcgaggtctcccaattggcggggcacgagatcactttagtgccatatgtcccgaatgctctggtatttacacagcaaaagagcgcacggctcggacgagtcgtgcgctccggggacgcgcgtcgggaagatacggggcgggcgggccgctcgcgcgatcagacattctccggacgagcggtctgctttacggattccgcgcgggcgagcgccgcgtccaccgcgccgtcctccttggtcttgttcggaccgccctggctcttgacgatgatcacgatcagggcgatgaagaagacggccatcaccacggggggcacgagcgcggatacatagtccatgccgtccagagtaacgagcccggaacggcccgacgcggcgacctcccggtgggaggccgccgcgtcggatgcagcgtggggatcagccggcggcccgctcctcggacgggggcggcgcgggccgccggctgatccc

SEQ ID NO: 2912 - DNA, 8966 bp, Unknown
  Kingdom: Bacteria, Phylum: Actinobacteria, Class: Actinobacteria, Order: Streptomycetales, Family: Streptomycetaceae, Genus: Streptomyces
ggccgcggcggccggggcgagggtgagggcgaggcgcagcagcaccgcgacgaacacggccaccgcgggggaggcctcgacgagcgtgtggggccacgaaccgcgttccaggggctccggggtgtcgaggtggtagccggtgagacggtccgccacggcggtgacgagcagaggcaggggccagacgatcaggccgcgcagcgtgtacacggcgagcaccggtcgcagccgtcccgggaccgggtcccctgagcggttttcccgggcggttgtggcggagtccgcggactccgccacaaccgcccgggagcacaccgactgcagggccgcgcccccggtgccgaggagaagcaggaagagcgggagcgtgccgacggcgaccaacgccaggtcggtgtggtcgtgcaggtaggggtcctcgacgtggtggtaccagatgcgttggtcccgcatacgggtgaagacgggccaggcgagcgcgaatatcgcggtcgtcaccagcagcccggccagtccgtacagtccgacgatgcggaccgtcgcacccgccagcgcgccccggcgccgccgcaggacggcgaacgtcgcggcggcgaggccgggttgggtgctcccgctcgtcggcggcacagggtggtcgggtcgtgggggcatggggcgagtttcctccgcgttccgctttccggtccggtcgtcggctccgtcgcgttcccgggaagacgcagggcgggcccggcacggttctccggcgggtgtcgtcgcaccggtggtgccgctgtacgcccatcccggcagcggctctggatcatgatcggtcgctttgtgtgtcaccatgtgcacgcagtgtcaccgcgctgtcgcctcgggtgacccgtgcgtcggcgcccctgcggatacccgtttccccgcgtggccccacccgcgaccggtactggctgccgggaagagggctgcggcaacacccctatcaccagaaggatttcacccatgcgcttccgctccgcccttcccgccgttctgggcgccgctctgctgctcgccgccgtaccttcctccgcgtcggccgccgagggacagttccgctacgactacgtgaccgtcgaggggtacgaggcgaccggcttcctgaacagcccgcccagcggcgagtgcgtcaacctcccgggcgtcggcctggagaaccccgagcccggacactccccgaagaaccgtacggacgcctgggccgaggtcttcacggatgtcgactgcgagggtgattccttccccctccgcccgcacaccggtggggcctcggagcggctgaaggtgcgttcggtcgtcttccactgacataccgccgcacgctgctgggcacgccgctgagcacgccgccgcccgcggccccgtacggggccgcgggcggcggcgtgctttccgggcgggtcgctccgggtgcacgccccgccggtgcgcgggccggaacactcctcggcaggtgcttggtgggggcctgtcggtgaacgacctttgcataaaagtgcgtcgttgcgtatagtcatgccatcgatcaggagggttaccgatggtggtacgagcagcagtggcaggggcgagcggctacgccggcggggagttgctccgtctgctgctggcccacccggacatcgagatcggcgccctcactgggcactcgaacgccgggcaggcgctcgggtcgctccagccgcatctgcggcccctggccggccgggtgctggagcccaccaccgccgaggtgctcgccggccacgacgtcgtcttcctggcgcttccgcacgggcagtccgccgccgtggccgagcagttgggggaggaagtcctcgtcgtcgacatgggggccgacttccggctgaaggacgccgacgactgggagacgttctacgggtccccgcacgccgggacctggccctacgggctgcccgagctgccgggcgggcgcgcggcgctcgccgggtcgcggcggatcgccgtgccggggtgctacccgaccgccgtgtccctcgcgctctacccggcgtacgaggccggcctcgccgagccggaggccgtgatcgtcgccgcgtcgggcacctccggggcgggcaaggcggccaagccgcatctgctcggctccgaggtgatgggcaacatgaccccgtacggcgtcggcggcgggcaccgccacacgccggagatgatccagaacctcagcgccgccgccggtgagccggtcaccgtctccttcacgcccaccctcgcgcccatgccgcgcggcatcctcgccacgtgcagcgcgaaggcgaagcccggcgtgagcgcccagagcctgcgcggggtgtacgagaaggcgttcgcggacgagccgttcgttgacctgctgcccgaggggcagtggcccgccaccgccgcggtccacggctccaacgccgtacaggtccaggtcgcgtacgacgcggcggccgggcggatcatcgtgatcagcgccatcgacaacctcgccaagggcaccgcgggcggcgccctccagagcatgaacatcgccctcggactccccgagggcacaggtctttcgacgatcggagtggcaccgtgagcgtcacggcagcacaggggttctcggcggcgggcatcgccgcgggaatcaaggagagcggcaacccggacctggccctcgtggtcaacaacgggccacgccgcgccgccgcgggcgtcttcacctccaaccgcgtcaaggccgccccggtgctctggtcggagcaggtcctcaaggggggtgaggtcaccgccgtcgtcctcaactccggtggcgccaacgcctgtacgggaccccagggcttccaggacacccacgccacggccgagaaggccgcagaggtgctggagggccacagcgccggcgagatcgccgtcgcctccaccgggctcatcggtcttctgctccccatggacaagctgctccccggcatcgagcaggccgccgccgcgctcagcgaacacggcggcgagaaggccgccatcgccatcaagaccaccgacaccgtgcacaagacggccgtcgcgggcggcgagggctggaccgtcggcggtatggccaagggcgcgggcatgctcgcccccggcctggccaccatgctcgtcgtcctcaccaccgacgcggatgtcgagagccccgcgctggacaccgccctgcgcgaggccacccggaccaccttcgaccggatcgactccgacggctgcatgtccaccaacgacacggtgctgctgctggcctccggtgccagcggcatcaccccggaacagggcgagttcgccgaagccgtacggaccgtctgcgcggacctcgcccgacagctcatcggcgacgccgagggcgcgtccaaggacatccggatcgaggtgatcaacgcggccaccgaggacgacgccgtcgaggtcggccggtccatcgcccgcaacaacctcctcaagtgcgcgatccacggcgaggaccccaactggggccgcgtcctctccgcgatcggcaccacgaaggccgccttcgagccggaccggctcaacgtcgccatcaacgacgtctgggtctgcaagagcggcggcgtgggtgaggaccgcgagctcgtcgacatgcgctaccgggaggtcaggatcaccgccgacctcgccgccggcacggagtcggccgtcatctgggccaacgacctcaccgcggactacgtccacgagaacagcgcgtacagctcatgagcaccgcgcggaagcacaccgcactcccgaaggcacagatcctcatcgaggcgctgccctggctgacccggcaccacggcaagaccgtcgtcatcaagttcggcggcaacgccatgatcgacgaggagctgaaggccgccttcgcccaggacgtcgtcttcctgcggcacgccggcctcaagcccgtcgtcgtgcacggcggcggcccgcagatcagcgcccagctcgacaagcagggcctggtcagcgagttcaaggccgggctgcgggtcaccacgcccgaggcgatggacgtcgtccggatggtgctcgccggacaggtccagcgcgagctggtcggcctcctcaaccagcacggccccctcgccgtcggcatgacgggcgaggacgcccacaccatcaccgccacccagcaccggcccaccatcgacggcgagctcgtcgacatcggccgggtcggcgagatcaccgccatcgacaccggggccatccaggcgctgctggacgacggccgcatcccggtcatctcctccatcgcccgctccgccgacgaccatcacgtctacaacgtcaacgccgacaccgcggccgccgcgctcgccgccgccctggacgccgagaccctgatggtcctcaccgacgtcgaaggtctctacgaggactggcccaacagcgacgacgtcatcagccggctcaccgcgagccagctggagaagctgctgcccgagctgtccagcggcatggtccccaagatgcagggctgtctgcacgcggtgcgcaacggcgtcgagacggcccgcgtcatcgacggccgcgtccagcactcgatcctgctggagatcttcaccgacgagggcatcggcacgatggtcgtgccggacgcccctatcgacgtacacacagggcctgaacagggggaatcatgaccggcacagaggctgcgggactcacccagcggtggcagggcgcgttgatggacaactacggtacgccccggctgccgctcgtccgcggcgagggcgcctacgtgtgggacgaggaaggcacccgctacctcgacttcgtcggcggcatcgcggtcaacgccctcggccatgcccaccccgccgtcgtcgaggccgtctccacccagatcgcctccctcggacacgtatcgaacctgttcatcgccgagccgcccgtcgcgctcgccgagcggctgctccagctgttcggccgtcaggggcgggtcttcttcgccaactccggcgcggaggccaacgaggccgccttcaagatcggccggctcaccggacgcacccacatggtcgcgaccgagggcggcttccacggccgcacgatgggcgcgctcgccctcaccggccagccggggaagcaggagccgttcgtcccgctgcccggcgacgtcacccacgtgccgtacggggacgccgacgcgctgaaggccgcggtgaccaccgacaccgcgctggtcgtcatcgagccgatgcagggggagaacggcgtcgtcgtcccgcccaagggctatctggaggccgcccgggagatcacccgggcggccggtgccctgctcgtcctggacgaggtccagaccggcatcggccgctgcggccagtggttcgagcaccaggcgcaccaaggcgtcgagccggacatcgtcaccctcgccaagggcctcggcggcggactgccgatcggcgcgacggtcgccttcggcccggcggccgacctgttgaagccggggcagcacggcacgacgttcggcggcaacccggtcgcctgtgccgcgggcctcgccgtcatcgacaccctcgccgccgacggtgtgctcgccgacgtcaaacggctcggggagaagatccgcgacggcgtggaggcgctgggacacccgctggtctcccacgtccgcggtgcgggcctgctgctgggtatcgtgctcaccggacccctcgcaccgcaggtgcagcaggcggcccagggagccggcctcctggtgaacgcgcccgcccccgatgtcgtacggctcatgccgccgctgatcatcggtgacgcggaggtggacgcgttcctggagatcctgccgagcgctctcgacgcggcatacggggacggacgatccggagcatgaccctccggagaatgaggcgacgacgatgaccgaggcgcaggaatccgagcacggcgggccgtccgtgccgcagacccgcaccgcccgccaccgccggatcgtggacatcctgaaccggcagccggtccgctcgcagagccagctggccaagctcctcgccgacgacgggctgagcgtcacccaggcgacactctcccgtgacctggacgagctgggcgcggtgaagatccgcaacaccggcggcgagctgatctacgcggtgccgagcgagggtggattccgcaccccgcaggcgccgctgggcggctcggccaaggaggagcggatgcgccggctctcggccgaactgctcatctcggcggaggcctcggccaacctcgtggtcctgcgcaccccgccgggcgcggcccagttcctcgcctcggccatcgaccaggccgaactgcacgacatcctcggcaccatcgcgggcgacgacacgctgatgctcatcagccgcgacccgaacggcggccaggcgctcgccgaccacctgctgaggctcgctcagaacgaccgctgaacaggtctgttcagtagcgcgtgatcgcggtcgggcccgaggaggtgccgaccgcgatgtgcggttcgcgctccgggtccgcccaggcgaggatctccgccatggcgtcggccgggaccgagacgcacccggccgtcgccccgcgcccgttcacgtgcaggaagattcccgcaccccggccccgtaccggacggtcgtagttgaagccgatcaccagcgcgcgggcgtactgcgtgccgtaggagacgaggtgctcggcctccgccgcccggcagtgggccgggcgcggttccacccagcggttgtacgcccgcgagtcgttgtcctggcaccaccaggagtcctcggtgacctcgcggtacggatacgtcgtgccggccggagcgtcctcgatgccgaaggcgtacggcaggtcgtacagcccggtgggcgtggtgctggtgccctgctcccgggtcgccccctcggccagcccgcctccaccgaagcgcgcgggcgccgacccggcctccgtccacctccccccgcgccgctcccaccaggtcacggtccccgtcgtggagccggcgtccgcggcctcggcggtgatcagctgggaaccgccgcccgtgtccgccagccggtccggcaggggaggggtgtctgcgggtccggccccgagggagccggccagggcgaggagtacggcggcggtcacgagtgatctgcgcatgctccggaccgtacggcggcctgcggccgtgtcccaccggacctgctccgtacggcccagcggctcaccggctcaccggggccgtgcacccgcgcgaggttcgacggcctccggaaggcgtcccacgccaggtgaaacggctgggcacaccgccctgaccggctgttttgacaaacaatacggaggactgcatagttatacccatcagtgattgcaccgtaaggagaaacccgtgaccgagcgcgtcgtactcgcctactcgggcggcctggacacctccgtcgccatcggctggatcgccgaggagacgggcgccgaggtcatcgccgttgccgtggacgtcggccagggcggcgaggacctggacgtcatccgcaagcgcgcgctcgcctgcggtgccgtcgaagccgaggtcgcggacgccaaggacgagttcgccgaggagtactgcctcccggcgatcaaggccaacgccctctacatggaccgctacccgctggtctcggccctctcgcggccgaccatcgtcaagcacctcgtcgccgccgcccacaagcacaacgccgggatcgtcgcccacggctgcaccggcaagggcaacgaccaggtccgcttcgaggccggcatctccgcgctcggccccgacctgaagtgcatcgccccggtccgggactacgcgatgacccgggacaaggcgatcgccttctgcgaggagaagaacctcccgatcgcgaccaccaagaagtccccgtactccatcgaccagaacgtcttcgggcgcgccgtcgagacgggcttcctggaggacatctggaacgcgccgatcgaggacatctacgagtacaccgagaaccccgccgtccagcgtgaggccgacgaggtcgtcatctccttcaaggagggcgtgcccgtagccatcgacggccgtcccgtcaccgtcctccaggcgatccagcagctcaacgatcgggccggcgcgcagggcatcggccggatcgacatggtcgaggaccggctcgtgggcatcaagtcccgcgaggtgtacgaggcgcccggcgccatcgcgctgatcaccgcccaccaggagctggagaacgtcaccgtcgagcgcgagctggcccgctacaagcggcaggtcgagcagcgctggggcgagatggtctacgacggcctgtggttctccccgctgaagcgggccctggacggcttcatcaacgaggccaaccagcacgtcaccggcgacatccggatgaccctgcacggtggccgcgccgtcgtcaccggccggaagtccgaggagtcgctgtacgacttcaacctcgccacctacgactcgggcgacaccttcgaccagtccaaggcgcagggcttcatcgagatcttcggcctctcctccaagatcgcggccaagcgcgacctcgcctgaccctccttcgttgaacagccgcctccccgtcgtcacgcggcagggaggcggccgcatatccgcaccttggcctacgcctgggcctttgcctttgcctttttgaggagcacgcagtgagcagcaacaacggtgacgtccggctctggggcgcgcgtttcgccgacggaccggccgaggcgctggccaggctgtccgcgtccgtccacttcgactggcggctcgcgccctacgacatcgccggctcccgagcccacgcacgcgtcctcagcaaggcgggcctgctcagcgaggacgagctgacccggatgctcgccgggctcgaccagctcgaagccgacgtcgcggacggttccttcaccgggaccatcgccgacgaggacgtccacaccgcgct

SEQ ID NO: 2913 - DNA, 22464 bp, Unknown
  Kingdom: Bacteria, Phylum: Actinobacteria, Class: Actinobacteria, Order: Streptomycetales, Family: Streptomycetaceae, Genus: Streptomyces
ggccgacccgtcgcggccacctcactcagtggccgcgacgggtcggccgggaaagtggcgtcgtacatggccaggccgtggtccgtccagacccggagcccgtcgtggagcggtgcggtacgcgatcggccggggtcggccggcgacgggtccggcctgttgcgggcgtcgcaggcggccatgaaggggccgagggtgaagtgctccagccgctcccggcggcgagcctcaggggcgacggggcggtagccgcgcgccttgagcgcgtcggcggccgggcagcggaatccgctcttcttgaacatgcccgcggagaccgtgatgcacggggtggttcggcggaccccgtcagggggaagccagggttgcgacatttcctgatccttttctacggtcacagacattcacctttctcgaacaatttttccggtcgggctctttcgacgggaaggaacggggatattcatgggacatctcgaagagatcgaggaaatcggcaacatcgagaagcactatgaggtattggggatgacgggcgccgggggtcagggcgacctctaccccgcgcatgaacttcggaccgggaggagggtcgcggtgaagacccagaaggcgcggaccgtaggaaccagcagtgatcaccggagcgccggcaggcacctcctgaaggagggcaaccgcatgctgaaactgaccggcatcgacgagattcccgagatcttcgcgtccgggacgtaccggaaccgcaggtgcctggtgatggagtacatcgacggtccgcagctctgggactcctgggcagaggcaaaaccggtcagggacccggaaacggtggcgtcggtgatcggccagctctgcgagatcctgcagaaagtgcacgaccggaagctggtgcacggtgacctcaagcccgagaacgtgatcgtcgagccggacggacgccttcgcctcatcgacatggggcacgcggtggaggaaggagaagaaacaaaatgggatctcggcacgttcggatactccgcgccggaacagtggaaacccaacccgcacgggctgaccggccgggccgacatcttctccctgggctgcatcctgctggagatgaccgtgatgtctctcccctacggcggaatggaggagcgcgtcacccggcaccaccccgtactcccgcccgaccgactcgacgcggtccccgtggaattccgcgacctcgcgcttcacatggtccggtgggaggccgcggagcgcccggccgatatgcgcgaggtcttcgaacggatccgccgccacctcccggagccgggctcacgtcggcgcccgtcgaagcgcctgaggcccgacacgacggagtactggcgcgcccgtccgcaccggccgtgacgccgcaccgtccgccgacaggcgtcatctcaggctctccagcaacgcccggacctccccggcctctgcgctgtccatccgctcccgcagcacgagaacacgctccaactgctcgaccgcggccccggtgtcccccgcggacaccaggacgtccgcgaagagccgccgcaccttggcctcgtcgggccagtgctcctgctcgcggaagatgtcgcacgcctggcggtacaacaggactgcttcgccccgttcagagcgggccaggtgcactttggccagggtgaacagcacatcggcccggccgctgcgatccgctgtccgctcgatggccacgagggcgtccgcgcaccagtggagcgcctcgtcatgctcaccccgatcgtagtgaatggccccgatgccattcagggccgccgcttctcccgccgggtcggggatctcccggtacagctccaaagcccgtcggaggtgttcctccgcttccaccgcctcgccctgcttgcgcagcgtgacgccgagcgcgtagcaggatcgggccaggctgagacgactctcctcgctgtcgtccgtctcgctgaggcgaacggcccgccgcagataccctgcggccgaggcgaattccatgagccgccactgggtccccgccagcaggcggtacacatgagcgcactcgaccggcgatgcccgggtctccgccaccgcgaccgcggttcgcaggaacttcagcgcgtcggcaagcttggagcgacgccactggtagggcaccaggaccaccggcagcagccacatgtaccgctcgatgttccggctgacggccagttcgaagcagtgccggaccgtctcgtactccttgtcgagcgcctccgcggcctcctccgggtcggccggctcgggcagcaccgtcaccccgtccggttcaccgatgggcagcacgcgtcggcggtccagcacgcggtcgcacccccgaacgttctgcaactggtgctccagcacctgccgcacggtggctgccttcagctcttccgcgtcctccggagtcacgacgtccaggtggtagcgggcgaagacgcgcaccaggtcgtgcaggcggtagcggtccaagcgaaactccaccaggttcgctgccacgagctgccccagggcgcggtccgtatccatctccccgcccacgccgccgaggtccatgaccgcgtcccaggagatgctgggaccgggatggacggccaactgccacagcaggaacctggcttcgccgccgagagcacgcgcggagacacccaacgccacccggatcgacctctcgtgctcgggcacgtggaggacctccagcctggctccctcctctttcatctgggccagcagatgcgggagggcacgcagcggacggtccttgagccatcgctccacgacgacgagcgccagtggcagattcccgcagagccgggccacttcggtgaagacaggagcgtgcttggcccggtccttctcgggcacgttcgcccagagcaattcaagagcctcttcgtccggcaacagctccaccttgtgtcgatgcaccccttcctgtgaccgcaacgcaccgagatcgtcccggctggtgatgatcacggcgttggcgcccgctcgcgggagcaacggaagcacctgctgggcgtcggccgcgtcgtcgaggaccagaagcaccgagagacgagccagggccgaacgcaggaccccgaccttgtgctggagtcccgtcatctccgtcgagtacggcggcacggccgccaggaggccgtccagcacgtgctcgggctcggcgggcgggatcccggtgtcgctgaatccgttcaactccctgtagaggttgccgtccgggaaacactcccgcagtcgctgagcgagagcacgggccaacagcgtcttccccacacccgccatgccggtgatcaggaccaccggcacccggccggcgtcgcggtccgtacggacggcgtcgacgagggcacgaagctccggctcccgcccgacgatctcgcggtcggagggcggcagttcgtccgggacgggcggccgcagcgtcctgccctcccagggctctccgttgcgtaacctgtcgatgatgtcctggagttctccgtccggcctgccgtaccggccggtccagtcgtcgaggaggctctcgcgcttctcgtcggccatgtcccggccgaaggcgatcaagtagtacccgcgcaccctggggttgaccggcagccacgcgtaccacttttccgcttcctcccggagccacttctcctcggcggttcgccacgcggcgtccagcaggtcgcacacggcggcaacgcgctcatcacgcatccgctgccggatcttctcgaagcccttctcaagcaacccccgtaagggctcgtcgtccttccactcctccagggcgtgacggagccgctcgtacttctccagaggtgaccggagcgcggccgcctgctgccggcccgccaggaagcggagatagtcgacgctctcggccgacgcgaggagcgtgcagtaacccgacttgcccgcatggggcaagaacgctttccctaatcgtctgcgcaggtccctgacggcccagtccaacttgtcaccgacgtccttcccttcccagaggacttcggcgatctcacttctgctgcacctgcaccccggcgacgtgaccagcatcgcgaacagggcggccgccttcgttgttccgaagacaacctcctcgtccgccacttcgacgccgatcgagcccagtacccgcgcgtccatcgttcaccccttccgcgcacgacagcggggcccgcccccggtgaccttgcgacaccccttgatcagtgcgcagcagcgacccgcttcatacgcgtgcgctccttcacgccccccaactactcagttatcactcagttttcgttccgcaggggtcctggccggccgggcacgatggcatcagccgctcgccgaaccggtcgagacggcaccgttcccgatcaggaaggacctcccgcacatgaacaaccgccagcgcagtcgcaggctgagccgcctcaggacgtctcccggcttcccgccggagcgccgccggagggcggccaccccggccgaggggacggcacccgcgaccccgcggaccgagtcgccggacccctcggcgtccgacacggcctgacgctcggcatctgaagggcgcccgcctccgggcgggcgccccttatccgctcagaacaagcgacacgctctttcgagcggtaggcccgcagccacccaaagtcacaggcgtctgtagaaaagtgagacgcctgaggctacttcccgttttgtccggttctcgcgaatgcccgcagcagcgcatcgagaccgcgacaagctcgcctctcttcattcggcgcctgaggccctcactgggccaaggagggatatttcatgattggttcctacggaacaagcgcattcgcctcagtgaggcggcacttcgatcaccctcgggtcaaggacgcgatcgccttgaccatcaccatgaacgcggaagcggacgtaacgacggcggagcctgtccggctgaccgctgccgccgcccatgaagccctctacggaccggacagcgacccgcggatctctgccgcgatctgggaggcgacgctcgcggccgcacagaccgatgacaccccccacggaaccgcgaagctgctggcgatccgactcgccctgccgatgctgagcgggacggctcatcgcgtctgcgggcgcctgcgcgcagacaggtcggacgtggaggccgagatgatcctggcctttctgggcgagctggcggtgtcggacccggcagcacctctccacatcacaccgctgatcaaggcggcgcgcaccagggcgtggcgcttcgcgcgtgaggggctgcgggagattccctccacccaggtggagcgtgtctcccaggaccgcgcccttacccctgccgggacaacggaatccagttcttcgccggagggtctggacgtacaggtcgaccgtccggacggcccggaggggctgcgggcaccgcttcgcttccgcgtacgccccgagcacctgcgggaggaagctctgaccgtcgcacccagcggggcggcggtccgcccgccggcctaccgcccgcgaaggcgacggcgttcccggcatcgcgtcggaaccctgccgatccgcccctctgcggggcggccgtgacacgcgggcccggaggccgcttgggcttcaccgaactgttcgacctgccggtcgcgatcgatctgcgcacggcggcccgcgcgctcgggatctgtaccgagaccgcgtatcggctgaaccagaggggcctcttcccttgcccggtcctacgcgtcggcggcaggtaccgggtatcgaccagcgagttgatgcgcatcctggggatcgatgagcgccccgtgtatgccgtagacctggagtcggacgaggaaccgggtgaagtgccggggaagcgttccgggagcagtactccctaggtctcccctgcccatcggccgtgcggccccggaacaacagacccggggtcgcacggcggccgcggcaacgcacccgccacgtcggacttcggtgcgacggcaccggcacgccggcccggtccgagccgacagcggggccgtctgccgaacccgcacgaagcgctgacgctgaccacgctgacgggtaggggaccggtcggaaaaagggaagcgggacgtgaagcgcgctgaaaggatggcgctggccggggtcagccgacccggcgcagcacggccgcccggcgaccctgccatccggcccgtgacccacccgtcccgcgacccagcaccaggagacacacccaccgtgacccgcaccagcgccgtttcgctgatccgttcccgctccctctccgacgtggccgaatacgcctacgcggccaccgcgcccgccgagtcccggctgatcttcctcgccggatcgtgtccgctcgacgagcacggcaacaccgtggccgtgggggacttcgcgggccaggcggcgaaggccgtggagaacctccggaccgcgctcgccgacgcgggcgcttcggtcgaggacgtcatcagcacaagggtcctcgtggcctcggcccggcaggaggatctcgtgaccgcctggagggtggtccgggactcgttcggcgagcacgacgtgcccagcaccctgatgggcgtcaccgtgctcgggtacgcggaccagctcgtcgagatcgaagccgtggccgccgttctcgactccccgacgtccggtggcccggccgacgccccatcggcgtaagggcggggtgaagctccgcgccccgtacggacgcgcggaccgcgcccttcggtcccatgcgggtcacgatgggaagacccggcgtacgcggggccggtacacacccgtcactcgaacggcacacccccacatcatcctcatctcatatctgagataacctgccgtcatgtcagacgactacctcgtacgcatcggcaagctcatccgtgacgcccgtcagcaccggggctggacacagacgcagttggccgaggcgctcgccacgagccagagcgccgtcaaccgcatcgagcgcggcaaccagaacatcagccttgagatgatcgcccgcatcggtgaagccctcgacagtgagatcgtgtcgctcggttacgccgggcccatgcatctgcgggtcgtcggcggccgccggctctccggggccatcgacgtcaagaccagcaagaacgcctgcgtcgcgctgctgtgcgcctcgctcctcaacaaggggcgcacggtcctgcgccgggtggcgaggatcgaggaggtgttccggctcctggaggtgctgaactccatcggggtgcgcacccgctgggtcaacgacggcgtggacctggagatcgtgccgcccgcgcagctggacctggaggcgatcgacgccgacgccgcgcgccgcacccgctcgatcatcatgttcctgggtccgctgctgcaccggatggagcagttcaccctgccgtacgcgggcggctgcgacctcggcacccggaccatcgagccgcacatgatcgcgctgcgccggttcggcctggagatcgccgccacggagggcctgtaccacgcgcaggtggaccgctccgtctcccccggccgacccatcgtgctgaccgagcgcggcgacacggtgaccgagaacgccctgctggccgccgcccgccacgacggcacgacggtcatccgcaacgcctcgtccaactacatggtccaggacctgtgtttcttcctggaggcgctgggcgtacgggtcgacggggtcggcacgacgacgctcaccgtgcacggggtcccgcagatcgacgtggacgtggactactccccctccgaggacccggtcgaggcgatgagcctgctggccgccgcggtggtgaccgagtccgaactcaccatccgccgggtgccgatcgagttcctggagatcgagctcgcggtcctggaggagatgggcgtcgactgcgaccgcaccccggagtacgccgccgacaacgcgcgcacccgtctggtggacctgaccgtgcggccctccaagctggaggccccgatcgacaagatccacccgatgccgttccccggcctcaacatcgacaacgtcccgttcttcgcggcgatcgccgccgccgcgcacggccagaccctgatccacgactgggtctacgacaaccgcgcgatctacctcaccgacctcaaccgcctcggcggccgcctccaactcctcgacccccaccgggtcctggtcgagggtccgacccggtggcgcgccgccgagatgatgtgtcctcccgcgctgcggcccgccgtggtggtgctgctggcgatgatggcggcggaaggcacctccgtactccgcaacgtctatgtgatcaaccgcggttacgaggagctggccgagcggctcaactcggtgggcgcgcagatcgagatcttccgcgacatctgaaaacctgcaggagaagctccgccacacccctcctgacctgcacaaatgcaaggcgagcaggggcgtgacggagtccctgggacttctctgggactttggatcaggaacgacgggattcgaacaccgccctctccacatgatgagtcatcgagctggcgtcatacagtagggaagtcggcgttcccgaaagtcatggggaaatttcgatgcgtttagcaagctctggaatcgtcgagggcgtcaaacgagcgtcgcctccgcctataccgcgaggctaatgtgacgtgccctggtgagtgcgacgtaaagcgcacggtgagcctcgtctccgggattgagcccccttcgcagagcctcctcgtcggcctcctccagccgcaccccgaccctattccactcacgtcccttggcctgatgacacgtcaagccaggaacgaggccccccctttccatctccagacgcttccgcagattggtgagagcggtgcgcggtgtccgcttctgagttgccgccgaatcgataggcaccagcgtcactaccgcgtccgccagggacgcccagatcgcaccgagatcaccctgcctcttcaacaacccaagtgcgctctgcagatgcgggcgcagtctcgcgagaatttcattatccgtgatgcccagagtggtccgggcgtcgtttaggaagacggctggtcggccgatagcgttatgggcgagttcgttcagaagtagtgtgcacacggcctcttggaaccggcccatcctgcccctagcgatggccagaggcagaacttgggagtccgcgtcccacagcatcttccactgccgcgcgaggacaacatcgacgtctcgtgctgtccctgcggaaagggacgtcctctccttgcaacgcaatcgttgcgccaatacctcctgcgagatgctgccacgccatctgaacgaggtctggaggttcacgcgttcaaagtcaagcagcccgatgagacgaggtacgttctcgggccgcgcgccacgaaatccatagagggcctgccaggggtcgcccacaagagtgacagagagccccgcgtctgcggcgagacggatgatctcgaggtccaggtcgttcgcgtcatagacctcgtcgacgagcagggaacgaatcgtcgtggcgaagtaagccttcacggaagcacggatgccctcgatgcagagagcggcctccagaacctcacgtacgttttcgtgcgtgcatagcccttcgccgatcgccgtggtgaaggccgctagatccacgtggccttcccgttccactcgtcgtatggagccggtgacgatgtgcctaccgtccagagcgagaaccggcttgtcacgagtgtaggtaattggcaggtgggtgcgccaggcgtccagcacatccagttcaaggtagttgcctggccactgaagaatgccggaccttagcaggtggaaaagtagatcattaaggatcgtgtcaagcgtgactatgcgatggggccatcccagtgctgacgatccccactgacgggaaacgcggctgcgtatttcctctgtagctgagcgagtaaagctgaccgccacgaccgcccgatggtcggccgcacgcgcgaagcgatgaaggccgaagcgctggttcgagactgttgtcttccccgagcccgggaaagcctctatgtagagaaggcggtgcgtactcgctgcggcgaggagctgctcaggtgtgagggatcgggtgcccggcgggtgactactcatagtccgtcactcgaagtgcagccgtcggccaagcgccaagaggagggcgtcgggactggagagcgtcccaaggtggcgcgtctgcctctggtgcggtggggtccggttcgcatgctatctcgtctgtccattccgggtcttcctcgtcgcccggccaaaagaagtcatccacgtcggtaatcggcaggtgatccgcatcccggccgccgtccgctataagccagtctggttcaacaagggtctcgaagggatcgaggttcttcgtaggggtaccttcctccgccgggtcggacgggtataggaagtcgaagagccgctgcatgtgctcagggaccttaggcgggtcggccgcttccccgaggctcgcttcattggctgccgagagcagaccggcaacggccagggcaaactcgcccttcttgctggagccccgacctgccttgatactgggctccttgtctttgcccttcttcgcgctccggaatagctcgtacacagtctgggctgttacgttctcctcgtccaggcccacctctcgcagggcctcggcgatcaagagctcgttgcctccggtgatggacggttccagggtcgggtgactaacgaaggcttcaacgaccgaggggtcgtggtcggggagccatcccggcttcttgcgttcctcgctgtcgaaggcaagatcgctgtcgacgaggatcgccagcttggtgcacagttcgctgccacgggtggccagcagatgcaccggccactgtccgaccttccatcccatgtgcacgatactgagtgcgtcgatgaaagcatgcttgagcgtgtcccgtccggcccaggccctgccgaactcccggaggacagcagcgtcggtgactccctcgaccaggacgaggcggtcggcgaagaggccagcagaccgactcgcgtccaaatggagtcgagccttccgtagcgtgacctcgcggtgctcgaccggcacgacatctgcgactgtgcggcacacccgtcccttctccgtccgccgtacgacgacgagttcctccggggcacaggacgtgatgatgtccgtcgcgtgactggagaggatgacctgcagttccggccgcttcgtgacggtcctgcgcaagtatcggacaagagcgtgctgcagctgcggatgaaggtgtgcctccggctcttcgatgacgactgtggcgtggaagggcttcgcgccgaagaaggagtcctcctccgagtcggcgtcggcctgtgcttgttcgaggttccggactgcctgctggatctcctcctcctccgtgaggggctgcagatcagaggcatccaattgggaccaggcagcatcctggggaagctcggtggaatcaggtatcgctgccagcgtcacggctatgtgcagtaggttgacgtatcccaacccggacacttcaagaggccgggcgaaggtgcgcccctccaacacggcgagcatgagttccagcacgcgggctaggtaggtgtcgtcaatgacctggccgcgtatgtaaggccactgaggactcacgccagccgacaagtctgtcatgtgatcgcgaatccgcgcctcgaccgcatcgatgatgctttctttggctagtctctccaagagctcggaggcccgtgcccggagacccaccaagttccgggtgccgctcagacgctgctgttcggcacggagtagttccaccaggatccgcgcctctcggcgggccaactcgtccagcggatgacgccaggccggcaggtagatgagcttgaacggatccaagtccagagacctgccgtgtgccgcatggaccttcgcggtgacgctgccgagcctacggctcagcgtgacaccccatctctcggctacttcaccgagccgttggtgaccgacggtgtgcagctggcgtccgagacgtccttcctcggccaagctatcggccagcttgtatgccacctcaatggtgcgattggagtcttcgggcgcgagcgtggcggatccgtaccttggtagaaccgggaagcgggaaccgggatgggcgaggtagagcgcatccgtgagggtcgtctttccggcaccgttggccccgatcagcacactgaaccggctgggcagatgacagaccatctcgccctccgtgctcgcccgaaacccactcaccgcgatacgactcaggtgcaccgtgccccccatggacaagaagtacgtgagtagccatcatcacccccagcactgacaaggccactcctgtcacgagcacttgcagtcctaatggtggccgagtgtttatgggaaagtcgctggtccgatggcagacgatccatcgtcggcaaggcgtgacctcacaaactagttcgggacggccccttggcggtcaaagcctagaaggctcatcaccggctgaggaccagcactccgccgagtaggtaagaagctccgctccatccgtgccggatggagcggagcttcactcatgccgcgacggtgagtgcaacgtccaactgctcccacgcttcgagcactgcgttgtgggcatcgggctggaggtgcgcgtagcgccgggtggtctggaagctctcgtggccgaggaggtactggaccttgtagagggagactcccttctggacgagccacgaggcgcaggtgtggcgtatggactgggccggatagtgcggggcagggggctgctccccgtcggatagcaggcacgcggtggcccgcgacctagctagatccacgagatctgccaccctgcactcgccacatgcgtcgaggaccggaacgagttgaggcgggctccctcctccacgcgtccccgtccgaaagcctcagctcatgacccccaccacaaggacaggccgcggctgacgagttcacggacaagacctgagaccacccaccctcccgctgctttcagcgcctcgaaccgccaagcctggtcacgccacttcgctgcgaattccttcaccgcacgtcctctctccaggtccggcctcttcagccggtcgtcggccattgatccggatccgtgcggtgttcagcgggtcgttttcctgctgaacccgacatcgccgcaggccagacctggtgaaatggacgttcaacgaaagttcggactgaacgggtgacggatggacgaccagtccgcggccaagcggctcgcgacggagctggggcagctgcgcacgaacgccggatcccctacgtacgcccagatcgcacggtggggacgccagcagagtcctccggtcagtctcggcaagagcaagctcagcctgtggttcagcggcaaaagcgttcccgaggacggccgccccttcgccgtcctcgtggaactgctcgaagcaagggcccagcagaggtccggcacacctcggcgcggggtggccgcatggcagatgagacggacagcggcggaccgggaacgacgccgtgagaccaagggcctccctcgccgttcggccggggacggcccgtccgcctccgggccgacgccgggaacctactcggtgcggcctccgtacggagagctgcccgcccgccttcatggccgggacagcctgttggccgatctggagcgggcgctggccgaggggcacgagcaggtgcaggttctgcacgggctcggcggatgcggaaagacaacagcggcgctgcggcttgcccggcacgcccgggacctcggacatcaggtgttctgggtgtcggcgacgacgaacgagcggttgctgacgggtatgtctcaggtggcccgtgaactgggcgtggccgaagacggcctcagtcgcgcatgggcggggcagtcaagcgcgctggatctggtgtggcgttgtctggaccgtgcgggcgagcgctggctgctcgtcgtcgacgccgtggacgacctctcggtcgtcgcttcggagcacggctcgccgggggacggcacagggtggatccggccgagtcgttccggcctcaccgttgtgacgagtcgcgtcggcaaccccctgctgtggggaacggaagcagtgtgccgagcggtggacatgctgtccgccgaggacggggcgaaggtcctcactgacctggcgagagacgccgggccggtggaggacgctcgtacactcgccgcgagactgggcgggctgcccctgggactgcacttggcaggctcatatctggcgaagacacgaaggagcctgggcttcgcgcgcggcgtcatggatgtccggcccgtgggggacttcgccgggtacacggccgaactcgaccggctgggcgccccactgctcgacgcgggtggatcattcacgtcgggcacggacgaccggcggcttcgccgactggtgagccacacctgggagatcagcctcgacctgctcacccgacaagggttgcctgaagccagattgctcatgcgggtcctgtcgtgtttcgccccgacccccttccccaccgtgctgctcgcctacggtctcctagctccggaggacgggttcccggaaggattcgaagagggcgaggcggccatcgacgcactcatcgacgtgggcttgttaaacctggccgacgtggacgtctcggtcggcggaagcggcacggcgaacgcggcaaacttgtgcctcacagcccacccgctggtactggagaccaacgcggcacaggtgcgcggcggagacgaaaccgccgaggtgtggcgggccgccgcccgcgtcgtgcgatggatgggaggaggtacggatacgcctgatcaatggcgaaggtggcaggtactggtcccccatgttctggctgccctgcgctccgctcccgcgaacgacgtggagtcgttggcctggttcgtcgaagtcggatgggcctcctacggctactgcctggcctccaaccaccggggccaggcccatgaactgctcaggttgatgatggagcgtgccgccgccctgccggaaaaccgccccgtggtcggcgcgattcgtggccagtactacgaggccatcggcaatgtggacgaggctcgccggctcttcgaagagagccgcgctgagcgagggccgcaggacgcggaaacactgcaattccagttccgatgggcgcgcgccctgcagtcgaccggacagctgcccgccgctgaagaacagctgcgcgcgattctggacggcctgcgctcgagcggctccgtgagcaacaggttgctgatccactcggtccttgtcctggtgctcgcggcacagggcaaggacgagagggcggccgcggaggcgcaggcgctgatgtccgccatcgagacggaaccggccgaactgggcatccctctgcttcaccaggtaggtcacgcgctcacggaaacgcgtcagacggaacaggcagagagcgtgtacggtgcgctcctctcccgactcgatgaagcggacgaacagctctcccccctctaccacgacatttccctgcaactgctcggcctgcttctgcacgggggacgtgaacgcgcggccatcacgttgatcagccgtctcctcagtctctacatgccggccgggaacgactccccggcaagccccgcgagtctcgtcgacctcatccagacccggctcgaccttcagctggaactggcggagtgcagcagcaccgaggacgagctgcgggggttgctgcgcgtgagcgggggcatcagcttgctcatcgtcgagttgcacatcgcgctcgcccgcctgttcatcgcacaggaagacttcactcaggccaacgaacagctggagctggccgagaaagccgcgaccgcagccgacgtcggcacggtgcccctgtggacggtccccctctggaaagcccggtacctgtgcgcacaggggcgctgcgcagaagccctgagctgctacgaacagacggtcgcgctgctcgccgatgaccccgacggcatggcatgcgtcatggaggaagccgctgactgtctcgccacggtctcgggtggcgaagcccacgtaggtcagtgggggtccggcaggagggcaatggattgagcgccactctaccggccaggatcacaacgcactccacatgatgcgtcaccggcagcaggtcggcgaactgctcatgcgcgcctcaccgaccgtcccgccgttccggcccgtcagggctccatcccctgagataacgagtgggccttccgcatctcgtaccctcgccggaccgcctcagctggcagtccctgcagcagcagaatcgaccttcagcggagcccagacggcatggccagtcggcgctcgtcgtctctgagcgccgacacggtcggatggaggttccccagtcgtgagggaacgggaaccgaatccggttctccttcggccgttgactccgcgcattgggatgcgggccgtccgcaggaagcagctccagcctcggcccaccgtacggaaccttctcgatgcgcttgcccgctagttccaggccgtgccgtttcgcatagttgacgacacgccgccactccgtgacctcgtcgtcatcaggggcggtgacccgaacgcggccctcggcgaggagccgctcgatcaactcatgagccgactcccgccgggctcgcgcgacgggcctctcgctgtacggcgtccgagggttaacgggcgctgccggctcaccgccatcagcgaccgcagagtcgtcgtcgatcatcaggactccaccatcccgcaaggtatcggccgagcgccagccactcgacgcctaggctccaccgcccgcgccggaaacgaggccgttcgatgaacccgtactgccgcattgagccgaaagtcgcccgtgagccgtgtgggagtcccctgggacttttctgggacttacagccccatcaaccggcacgagcatgaaagagccgaaaggccattcgcgcaggtcagagcccaccacccgcccatcacagcaggtcacggcgctcgctggtctcttccgcgacatctgacatgcgactgccgccgcacctggtccgacctgccactgagcgggtcagagagggatgcggcggcatctcgtcccggaccgtgcgcctgttggggagcgcgacgcgcccgcgatcacgggtcggccgtcgcgccggactctgccctggctgccggaggaggcgggccggaccgtccttctgggagctcctcctctcccgttacggtgcgcccgccttcgggcgcgctgcggccacccagcgggcggggtcggtgccgttcaggcggatgggagcgttgcgggctgtggacggtgagacgttgaccaggctcttctcgcggctcgtccaggcgaggcgcggcgcggtcgtcacggcttcatcttttcggcctcccggatttcgtggaggtggatgagaacgtcgtaggacttgccgatcgcgatgtcgcggggcttctcggggaactgcgtgccgatgttgagcgtgggccgggcgacgttcagccaggcgcgcgcggcggccggtgccttgcggacgtcgaggtagaagtcccggtgacgggcctggtcgagggtgtgctcattcctgccgggctcggcggcgcccacggtgaacttcttccactcaccgccgagggcggcgtccttcgacaggaacgagccctggttgaaggtgaagccgatgggcaggtacttcttgcccatggtgtcgcgcaggaacgacccctgtgtcttggagtacagctcggggttgtcggaaacgtagccgacgtggttgttctgcgccgacatcaggatcttgtcgccggtgtgcttctgccaccacgtgacgttctgggccatgacctcgtcgcggaagcgctggaggctgttcagggactcccggtcggcgggattcaaggtgaggaacttggcggtctgggcgatggagcgggcgttctgctcgacccagtcgaaagggtctccgccggagcccttgtggctgctgaccagttccagggcctgctgcgccttggcggcgagttgctgccgctccgcgagcggcttggccaggtaggcgaaggcgtcgtcgatgggccgcaggccggtgtagagctcgttgagccgcgacagcgcctcagggtggttcttcttcacatagccagtcactcgttcgaagaatgcgtcattcaaggagggagcgccgatgtcgtcacccatgaagtgcacgggacggtcggggtggttgcggttgtagtcgcgcatccactcgatgagactcacgaattcttcgcgttcccaaggagagttggccagcgtctgtgcggcgatctgccgggcgtcgcccttgccggtctggaggtagtcgtcgatctggagccccgcggaccagctcagctccagggcgaaggtggtgaagcccttcttctccaccaggtggcggaagacccgctccttcatggtgaagaactcgtgggagccgtgggtggcctcgccgaggccgaccaccttggcgtcgccgatcatcgcggaaagggctcgcagatcggccgagcttccacccggctccgtcgagcgcagcggatgagcggcccgctccagtacgtgtacggggtcctgcttccccctggccgtcgggaccgtgtcgacggtggccgccttgaccgccacgggagcaaggacggcccctgccgcgatcgccaccaccatgaggagccgcgggcggctgatccgcttcttgtgagtagtcactgtttgtacctttcgatcaacgtgcgttggggttctgatctgatgaaggcccggggtcccggtgtcgggtggaggttgagaaggcggtcgttcactgccgaggcctggtgatcgccttcggtcgttcactgctgaggccgggtgatcgccgacggtggtggcagcttgtgccggcagtcacgcttgcaagcgcggtgatcccgaacttctcctcggcgaccttcggcgccgccgagccgtacttctcaggcaggaagtcaccgaactgactctcggtgacccggtacatcagcgcctgacccgctatggccagtcctgttccccacagcacccggagggtgcctctccatggatctctcatggagagtccggccagggtgctaatcacggggactccggttcgaaggatttctcggacagttcccttccagcacatcaccggagttcgcgcagatcgtcggagtgcgggacgagaagccgtacggggccctggtcctggccgtccaccggaccgggaccctggtcctggtccgatctcgacccaggggcggaaccggagctgcggtacacagggacaatggcgtatgccaggcatccatgccgggcgggccgtccgcgtcgcggcggagatcagcgaagaagggaccaccatggcgacgcgccgcagcgcctcgcgctcgcgccaggaaccgcgcgggcgcctcttcccgccggacgccgacacgttgccgtgggcccgcaacgatgtcctgctgaccatcggtgcggccgtcgtggacctcgtcgggtacaccgcgttctcacaggtcgcaggcgtgcccatgtcgagtgtcggcatcctgctgctgacggtgtccgcgctgccgctgctcatgaggcgccgcttcccgctcaccgtcatgaccgtcagcctggtgctcgtcgcgctgctgaacctgacgacgtccatcagccatcacttcggcgtcaccctcgcggtcgccctctactcggctgcccggacgggccgtccgtgggcgacggccgccctggcgatcggagcgatcggcgtcaccctgctcaccccggatctcgccggcccgcacgggttcctgaacgtgacaagcgcctgcctcgccgccttcctcattgccgccaccggcctcgcggtccatcggtggcaacaggagacggaggccaaccggcggctcctcgccgaccgggcgcttgccgaggaacgccgccgcatcgccagggagctgcacgacatcgtggcccaccgcatcaccatcatgcagctgatggcgggcggcgcccgtgccaacctcgaccacgaccccggtgtcgcccgcgacgccctggtcaccctggaggagtcggggcggctggccctgcgcgagatgcggcaactcctcgacgtcttgcggaccgccgaggacacggcgaccgaccggcacggcaccccggaggagccgcagcccggcctggccgacctcgatcgcctgatcaaggagtcccggcaggccggacagcccaccgagttgaccgtgcacggcgaacccggaccactgccgccggtggtcggtctcacgctctaccgggtcgtccaggaggcgctgaccaatgcccgcaagcatgcggggcccaacgtcccggtgaaggtccgcctcacctgtcgacccgagcgcgtccatgtgtccgtcaccgaccaaggcgcgatggacgcggcagcgtttccttcgggacccggcgtcaggcgtggcgccggttacggtctggtcggcatgcgtgaacgggtcgccctgcacggcggcgcgctggaggccggtccgctgtccgaggccggcttccgggtcgtggccagcctcccgctggaagcttcgacgggcgagaatgaggaggactgaccggtgaacgggacacacgccgacaacgaggtcgcgggcgagcggatgatccgggtactgattgcggacgaccagccgcttgtgcggcgcgggctggccctgatcctcggcccctctccgggcatcaccgtggtcgcggaggcggaaaatggcgagcaggctcttgtgtccgcccgcgagcaccgtcccgacgtcgtggtgatggacatccggatgcccgtccttgacggtgtggccgccaccgagcgactggctcgtgacctccccgaatgccgggtgctcgccctcagcaccttcgacatggacgagtacgtggtcgccgcactgcgcgccggcgcatacggtttcctccccaaggacagctcgcccgaggacctggtggccgcgatccgcaccgtccgtgcgggcgaggccgccgtcgctccccgtctgctgacccggctgatctccgcctatgtcaggaacgagcaggtggcacccccgaaccgtcggcggcccgccgcagaaaacacccacggtctcaccccgcgcgaggtggaggtctggcggctggtggccaccggcctggacaacaaccagatcgcacacaccatggagatcagtgtctccaccgtcaagaaccacatcaccagcatctttgacaaactcggcgtccgtgaccgggcgcaggctgtgatcgcggcctacgagtcgggtctggtggcagtcccacgggccgccgacccggactgaaccgagccttggaggaaggggagcgcatcgaccgaggcggggctccctccggtgggccgggttcggaccggagatggactggagatggaccggagatggatggagaatcgccggtcgaacgagcgctagcgcacgacggagcaggcgccttccaagcgctcggccgcggggtcgagtcccgccgggggcgccatcggcaccgcgactgcgcatgcacctgacactggctaatgtgtcgcctgtgactgagcacggggaactgatcagtgggcgctaccggttggttcagccggtcggccagggcggcatgggccgggtatggctcggcttcgacgaaacactcggccgcgatgtcgccgtcaaggagatcctggtccctcccggactggacgaccggcagcgggagtcggccctccggcgcatgatgcgcgaggcccggaccgcggcccggctcaatcaccccggcatcgtcaccgtgcacgatgtggtggagcaccggggagctccggtcatcgtcatggagttcgtccgtgggcagtccctggccgcggcagtccgggaacagggccgtctctcgccgcagcgggtggcggagataggcagcacggtcctggacgccctctcggtcgcacacgcggccggggtcgtacaccgggatctgaagcccgacaacatcctgctcgccaagggacgcgccgtcctcacggacttcgggatcgccagcaccgccgatgcgaccacggccctgaccagcgcgggaacagttctgggcacgcccgcctacatggcccccgagcaactcgagggcggaccggccacggccgccggcgacctgtggtccctcggagcgacgctctacgccgcggtcgaggggcagcctcccttctccggacccaccctcacctccctcgccgtcgccatcctgaccctggccccccggcccgtcgagcacgccgcttccctcgcacccgtcctggcggaactcctcgtcaaggatccggagcggcgagccaccgcggagcacaccgcgcgggccctcgcggcgctcctgcccgcaccgcgcgccgaacccgccgctc

SEQ ID NO: 2914 - DNA, 4483 bp, Unknown
  Kingdom: Bacteria, Phylum: Actinobacteria, Class: Actinobacteria, Order: Streptomycetales, Family: Streptomycetaceae, Genus: Streptomyces
gattctcgtcacccgctcttccacgaacccccaggtcatcggcctgggggttcgtcgttgtctagacctccctaagcgccttgcaccacctacgcaccacctgaccccttttcgcgctcctcgcgcgccttctcgcgggccttgcgcaccatccggtccagcccgcccgccacctcctgctgacgttcgtggtcggagtgctgatagatcagggcggccttctccgtcgactggccggcgcgcaccatcgtgtccttgagcgtggcccccgatcgtgtcgagagggtgtggccggtgtgccggagatcgtagaaacggaagttctccggcagcccgaccgtggtccgcgccctgcgccacttccgcccgaaggtggagcggcggaacggcttgcccttctccccgacgaacagcagtccttccggccccttctccgcgtaccagtccatatgccgctggaggtctttccgcaggaactccggcaggacaaccacgcgcttcccggcctccgactttgtcggcccctcggcacgcttgcccgtggccagctccggagctgccttgcggacgacgacggtgacgttgtccacatccacgtccttgcgccgtagttccgcctgctcttccggcctcatgggcccgtaggccccgaggtagaccatcaagcgccaccggatgccgatcgcgtccgcgagcgcgtcgacctgggcgacagtcgccacctggcccgactgcgagacctcctttccggcaccccgaatacggcacgggttccggcggatcagctcgtcgtcggtcgcggtctccaggatggctttcagcagccggtaggacttcgcgacggtcgtggcacccgtggcggtcagccgctccgcccgccactcccgtacgcgcggcggggtgatctcgttcaggtcgaacacaccgaaggtggggacgagatggagcctgagcagccgggtgtacagctcctccgtgagaggcgcgacgcccctttccgccacccacttcgtcgcgtactcctcgaagttcaccgcaccggcgtccgggtctcgccacgcgtcgcgggtcatgtccgcttcgacctgcgagagccagatctcggcatcggtgtgggtctcgaacgtctcgggcgcccggcggcgctcccccgccgggtccaggtaggaggcggtccagcgcccggaccggtactgcctgactgcaccgaaccgacgcatcgtcatcttcttcgcgttcttcttgcgcttggccatcaagcagccctcctcatgcggcgacgcggccggatcggttcaacggtgttggcggcaaggaactcttcgacggcactcgccggaaagcgcacgtgggtaccaaccttcaggtagcggatgcgccgctcagccacgagacggcgcgggaaccgctcggtggtgcccagcaacttggccagggccttgacgtctatgtacgtctcttccagtggcgcgggcctggccgtgctgggcacgactgcgagcctgcgaccggggtgagcaaggttggccatatcgcctgactcctgtcctcagtgcgcggcgagtttgtccgagctgtggatttctgcgtcaccgcgtcacccgcgtcacctagggggtgtgacctgcggttttgggtgacgcagcctggtgggtgtgcgtcacccgtgcgtcaccttctgcgtcaccggatgacgcgggggtgacgcgggtgacgcaggggtgacgcagaattcggtgtctgcgtcaccccttgcggtgcaggtggggggccgttttccgtccctggtgacgcaggtgacgcagaccttccctacttaggaaaaagaagggggtgtctgtagtagtggcggtagttcttcaggcgaagtgaggggcccttcgggcacgcctcttgggcggcgttccgccgaacagcaagaggagcacccggcggcgtggcgaggggtgctcctcttgcttgtccccggggaccggtgcggtcagaacgccgccgcctgctccggctgctcagggggcggggatgcggccgggcgggtcatttcgaggtaccggcctgctttggtgcgcccgctgtcgatgagcacgccccgggcggcgagcgtgggttgaaggcgcttcaggcggtcggagagcaccttgccggtggtcggccatcctttaggcaggggccgtagctcctcgccgctgtagaggcggctcagggcgttcagccattccgtggacgtcatgcgctgctctcggccggggtcgagagtttcggcgtgctggaggacggtctgcgcgaggaggtcgccttcgatgacgtcgtcgttcaggtcatccaggctcgcccgatacgcgggcagcgccccgaggccggtggcggtgtcgagctgggcgcagaggtgggcgaagtccgccatgcgcagatcggtcggagtctccgcttcggttgcccggaccttgacggtcaggtcgaggagcgagccgaggaccacgggcagtacctcttcgtactccgcccacagctccgcttcggtcctgcggacggtgggccgctccagccgcaggggcaggaggcgttccgcgaggtcggggcggaggatgccgacgtcgatgccggtcaggagcagggggcggcggtagcgggcccggtgaacgtccccgtcggtgaacagggcacgcttgacggactcggctccggtgacgatgcagcacatggcgtcggacagggccggagtcatgtgggagaggttgtccagggcggtgacccatccggcggccacggccgcgatcaggttctcctcgtcgttcggagcccgccgcaggtccccgctcatcccttccacgatccgcaccagcatccgccccccggtcgacttcccggcgccctgggggccggtgaggaagggggcggggacggggacgccggggccgaggcagccgatgagccaggcgatggccaggcattcggtttcagcgttggcgaagttgcacagccgcatcaggaggtcgatgcccttgccgtcggtgtccttggtcggcagaggcagttccccggtgagctgggtgcgccgccagcacacctcccgagggtccggcaccgcaatgtcccacccggtggggtggatgcggacggactgcccgtccgcgcggccgaggtcgagccaggtggctccgtcgaagccgggggcgacacggatgtgcacggcctgggtggtctcggtcatcgccagcgcctcgatcaggtccaaggcttccttgagcgcggtgccgttgaagacgccgaccccgtccttgaacatgccgaccatgagttcctgccggtggctgcccgtcgtgccctgggagcggatcggacgggcgacggggtggccgttcttctgcgcgtagacggtgccgtcggccgtgcggaagtaccggaagtgggactgcgcgtagtcgctgatgacctcgcgcgccgggttcttctcgtcctcggacatgtcacatccccagtgcggtacgggcgttggaccacgcgtcggtgcagtgccgcgggctctcgcccttggtctgcgccgccgcgaacaaccgggcggcgtgggcgtcggtcaggcacccgcaccggccgtgggcggacagcaccgcgaggaacgtgcggtacacggtggcgtgcacggcgctggctgcctcggtgatgcgctgctcggccatcgcgatgccgcgttccaggtaggcgggtgtgcggtgacggcactccccgcccccggtcggcacagccacggtgacgggccggaccggcgacggtttcttgacgattagggcccgcacggcctcgggcagggcggtcatggtgccggtgccgcggccgagccaccgggcgtaggacatggtcgacttgatgtcgacaccgtcccggaccgcgttcgcggactgcatggtcccgcggtagatccagtgctcgcctcgcgtcgttgccacggtgcgggttccgggcagcgtccggcgggcccacgcaatggcgtcggcgtggtcgaggtcgacgacggtcagcccgattccgccggggtgccaggcgacggccgccgcctgcttccaggacgatgcccacgcgggcccggtgagagcgtcgtggtcggtggtggctgcggcccacgcgtggcaggggcgggggcactggcaggggccgggggtcttcatgttcggccggccaccgcacgaggtgtacaggcaggcggggcagttggcgaacgggaccttccccgctcgcagcggcaggaccggaacgcctcgggcggccaggtcgagggcggtggtcaggtgggcgttcatgcggccacctccagctcggtcgcggccagtagggcgagagcggctgtgccgatccactgggtgtaggccggggtgatgcattcgcggatgccgtcgcggttcatccagggcacgcccatgacgttgcgggcgtgctggacgccggagaagttgccgacgaactgcccgtagtggccgggcgggatggg

SEQ ID NO: 2915 - DNA, 7444 bp, Unknown
  Kingdom: Bacteria, Phylum: Actinobacteria, Class: Actinobacteria, Order: Streptomycetales, Family: Streptomycetaceae, Genus: Streptomyces
ggcgctggggggtggcatggaacctcctggggcgggagacgtggatgcccgggcccggtcggcggctcgccgacgtggaggagcgggggcagtgccccgaccgtagaggagtgtgacctgcgtcgcatagatgcctaccggccagtaaagcggtgcgcccgcgtcccgttctccgcgctgtgccacggtgcgatagtgggggcgcgtcggcaaggggccgaccggagggggcaccgtgtactacgaactggccgaccggctggtcatcgggatcgcgtccagcgcgctcttcgacctgaccgagtcggacgccgtcttccgggagcagggcgaggagagttaccgcgcccaccaggagcagcacgtgggtgaccggccgggaggcggtcgccgccgggctgcccgccgggcacgtcctgggcgccccctacgaggacgacgtcgacgaccacgacctgcggatctccttcgacttcgacggggtcctggccacggacgcgtcggagcaggtcttccaggagggcgggatcgagaagttccgcgcccacgagatcacgaacgccgggattccgcacgacgccgggccgctgagggacttcctggcgaacgtgaaccggatccagcagcgggaggagcaggagtgccggaagaaccccgactaccggatccgcctgcacgtctccatcgtcacggcgcgcaacgcacccgcgcacgagcgggcggtgcagagcctcaaggggtggggggtgaccgtcaatgacgcgttcttcctcggcggcatcgacaagggccggatcatgaagatcctgaagccgcacatcttcttcgacgaccagcagggtcacctggagagcacctcgcggaccaccccgagcgtccacgtgccgttcgggaagctcaacgagccggcggcgcccgcggccccggacgcctgacgccgcgcgtcgtccggtgcggctacgcatgatacgtagagtgacggacaagtgggtgacgggagccgacggaatgcgccgccgcggccggtgggtccggcgggcggccgaggtgccccgcccccgctgcgtgccgccgggcggcgaggtacggtcaccatcagggccccggccagtgagaattcggtcaacggccttgtacggacagtgagtagaggagagacatgagcgtcgacaacgacgatttccgccgccggatccggtccgacattccccactccgcgcgcgtctggaacgcatggctgggcggcaaggaccactacccggtggaccgggagctggccgacgtggtgagcgcggcctacccgcagatggtcgacatcgcccgtgcctcacgcgccttccagatccgcgcgatccaccacctggcctcggcgggggtacggcagttcctggacgtcgggaccgggcttccggtggcgaacagcacgcacgaggtggcgcagagcatcgcgcccgagtcgcggatcgtctacgtggacaacgacccgatcgtcctggcccacgccgaggcgctcctgaccagctccccggaaggccgcacggcctacgtggacgctgatctgtccgatgcggacgcggtcgtggacgaggcggccaagacgctcgacctgtccgaacccgtcgccgtcctcctgctctcgaccctggggcatctcgttccggccgagggcatcgaggtcgtccagcggtacctcgcccggatgccctcgggaagctatctggtgctctgcgacacggtgacgacgcctcagacgctggccgcccaggaggcgtacgcctcgggtgacaacccgccctacctcgtccggaagccggaggagatcaccgactgcgccaagggactggagctggtcgagccgggcttcgtctcgatcgaccgctggcggcccgaggaggacgacgcggtgccggtcgaccagtgggggctcgtcgcccgcaagccgtagccgtacagcggacggagggctgcgcggcagaccgggctgtgggtgcgggagaggggtgcccggacccacgggggtgccgttcagtcactccgtcgtttcatggccgtgtcctcgcgcaatcggctggtctggcgggcgagcgaacccacacggtccgccaacttccggtgcgccgacgtgagatgcggtccgagcgcggtcagcgggtcgaccagggcggcggcgtcgtccgctgcgagggcctgtcggagccggtccagtggggggtcggccgagtcggggaggtcggccagcgccgtgatctggccggcgagggaccgtaggtcggccgcgttctgccgggcccacgcggtgatcgagcggtcgcccgcccggcggtcccgggtcgcctggacccgctgttccccggtgctgccctcggtgccggggcgcagtcgcaggtagcgccgctcggccgcctggcggctggccacgcccagcgggtctgccaggtcggcccagctcgcgcccgccgcgcgtgccgtctcgatcagtccggtctcccaccccgcgagccgctcccgcacctcacgcagcagttggagcgaggccagggcctgagcccgatcggtagcgggcgccggtccggaggccgtgccctcgttgtcgatgtgggcctcgcggagcgcctcgtcgatgttcttcagagcggctgacgcggcgaggagggagacggcgtccggggtggggtgctggaacggctcgggccgggctggcgtggacacggaagctcccttgcttgctcgaaaatctggtcatcctttcggcgacatcgtgagttgtcatcgaatggatgacatgctacaacggtctcaggtgaaaagcacgggccgtccgcccgatcgactggaggtgtttccgtcatgctgatgcgtaccgaccccttccgtgaactcgaccggatcaccgagcagctcctgcgtcccggcacctggtcgcggccctcggcgatgccgatggacgcataccgcgagggtgacgagtacgtggtggcgttcgatctccccggcgtcccgccggacgcgatcgacatcgacgtcgagcgcaacatgctgaccgtcaaggcggagcgccggccggcggtgaacgccgaccatgtgcagatggagctctccgagcgtccgctgggcgtcttctcccggcagatcgtgctcgcggattcgctcgacaccgaacagatcgacgccgattacgaggcgggggtgctgaccctgcgcatcccgatcgccgagcgcgccaagccccgcaagatcgccattggcggggagtcccggcgcaagcagatcaagggctgacccgggtccgcccgcgacagcggcgagggtcgggacggaatcctctcgttccacccgctcccggccctcgcccggcatccacccgagggggtagctgcggtgaccctgcgatgggaggcgttcctggatcggatccgggagcgcggcgagtacgaaacgcgaacggaggccgaacgcgccgcgcgcgtcgtcctggccctcctcggcgctcacctggtcggcggggaacgggccgaactggccgcccggctgccggagaccatggccctgatcctgctcaacccgctccaggccgccgagccgctctcccctgagcgtttcgtacgtgccaccgcggcctggatcgagggagccggcgaacagaccgcccgatgggacgtcggagctgttctgagcgtcgccgcggaggcggcgggcggggagctcacccgccgcatcctgcttcaactgccgcccgggtatgacgtgctcttcggtgggcatccgaagagcgcgtgagcttgacccatcacgttgcccctcccgtgccgccgtgtcggtgagccgtcggagcgggcagcgctccgatccgagtactgacgagaaaggctgccgacacgatgatccatgagcctgggggcgccggcgcaccggcgggcacgacgttcgaccggctgctggagaagatccgttacgagggcgcctacccgacgcgcgaacgagccgaggagagccttcgcgctgtgctgggtgcgctcggtcggcaggtcaccggtgatgagcgcgtcgcgctcgccgcggccctgcccagggaggccgccctggtgttcacctccgaagcgcccgctgtgaagcagctgcccggtgcggccttcgtccgtgatctcgccgcgaacaccggcggcaccccggcgaccgcccggtgggacgccggggtcgtcctgagccagatctccgctctgctgggggacgatctcgtcgcccgggtcgtcaacagcctgccgcccggctacgcgctcctcttcggccgcgccgaactcctcgcccaggccgcctgatccgactgatccgaagacctcgcggcggcccgaatccagggccgccgcgaagcgggacggcagtgccgctgtccgggtccactaccccgggcccggctaccggcggatcgtcaccggctcgatctccgcgttgttgtgccggcgcgcccagttctccagggcgacccggcaggcgtggtcgaggtgacgcagaccggtcaggtccagctctatcggctggtcctgcgggagcttctccaactgctccaggatgcggggcaggcgcaggaaggtggcgttcccggtgagggtcaccacgacccggccgccggtgagccgacgggtggtgagctggacgtgcgaggtctcccacgccgacttgaccaccgccagcagcaggccgagcacgaccccctcgaagaggttggtcaccacgatggcgatcgcggtgaccgccagcagcacggcttcccctcggtgttcgcgccacagcgggccgaactccctggcgggcaccagcttgcacccggcgtggacgaggattccggccagggcggccagcgggatgatcccgacggcggcgggcagcagcgcggcgaagagcagcagccacaggccgtgggcgatccgggagagtgcggtggtcgccccggcctggacgttggcggcgctgcggacgatgaccgcggtcatcggcagcgcgccgagcgccccgcagagggtgttgccgacgccctgggccaccaactccttgtcgtagtcggtgcggggcccgtcgtgcatccggtcgacggccgccgcgctgaacaggctctcggccgaggcgatgagggagaaggccaggacggtgccgatgaccgccacatcggcgagccgggcgaactccgcaccgccgggcggatcgatggcctgcagcagcccgttcacatcggccaccgccggccgcagaccggccagggaggcgacagcggtggccagggcgaccgcggcgaggggggccgggacgaggcgtacggtggccgggagcttcggccacagcagcagcacggcgaccgttccgacgccgaggccgaacgcggtcagggcctccttgttcgtgatgatctcgacggcgagaccgggaagtccggccagcttggcgagaccgctgcccggctgttcggtgtcggccatggcgtacacctggcccagcacgatgatcaggccgatgccgccgagcatgccctgcaccacggagacggagatggcgcggaaccagcggccgaagcgcgccaggcccagcaccacctggagcagcccggcggccagcacgatcgggccgagcgtgctgaggccgaattccttgaccgcctcgtagacgagcacggtgagtccggcggccggtccgctgacctggagcctgctgcccggcaggaagccgacgacgagaccgccgacgatgccggtgaccagacccagttcggccggtactccggaggcgacggcgacgccgacgcacagcggcagggcgaccaggaagacgacgagtgacgccagcaggtcacgtcggacgacgtgggggttcttgagttccttcgcggaaatcacggtggtttcccttgtgggtacggtcgcgcccggccggagccgagcgcgcgagcgtgggggaggggaaaccgtcaaaggcgggcgaactcggtcccgcgctccggtcggtgaacgctgacggagccggtgtgcacttcgtagtaccaggcgtgcaggccgagggtgccctcggcgagccgctcgcgcaccgcggggtagccccgcagggtgtggagctgggcgagggcatgggcctggatcgccagggggaggtcctgggggtccgcggcggggtccctgccgtccgtggagtgctccagccagtggcggacggcgggcatggcggagaggtcgtcgccgcggaacacggcgcccacggcaccgcagtgggagtgcccgcacacgatgatgtcgcgcacctggagcgcgcgcagcgcgtactcgatggtcgcggcctcgcccgtggggcggtcctccgccggataggacggaacgatgttgcccgcggtgcggagttcgaagagctgacccgggcgggcgccggtgatcagtgaggggacgacacgcgaatccgagcacgtgacgaagagtgcttcgggggtctggccgtccgcgagacgttcgaagtgctttgcgttcgcggcgacgtgctcggtgaatgtccgggcgtgttctacgagggactgcatggtggcctgcctcctgcatccagcggtgccggggagcggtgtggtcgggtcatattgacgaatgcgcttttcataccggatgaatgttcggaatggtgagggtgcctcaccttgcgttttgccggacggcggtcgcgatgaggcccactccggtcgctccgtgcggatacgacttcagctgagcatatcgaccagaactttgctatcgcattaccttctcgtgaaggaacgtaaatgcgccacccgtgtcattcattcggcttgttctttgtgatagccaaggggcggggagtgtcgccgggggaggctgcgccgtcagtggcggcgaccgtgcagaaagaggtgcggctcgggtgcgccggccggatggtccggggtgaacagcgcgctgtgctcccactccacggcgaccccagcccgcgtgatcagggcggtgaactcctcagcgccgaagctggagacccggaccggctgccccatgaaaaccgcgtcgacgccctcggcgtccaccggcaccgtcgcggcgaccagaaggccgccgggccgcagcgaccgcacgagccgctccagcagctcgcgctggtctccgcgctccatctggagcagcgagaagtacacacagaccgcgtcgaacccgccctcggacagggggagatcgcggacgtccgcacaccggaactccgctgtcggcacctgccgggccgcgagcgcggtcatcaccggcgacacgtcgacgcccagcacccggtgccccgcgtccgccagggtctgtgccgtgggccggccagtcccgctgcccacgtccagcacccggctccccggggccaggtccgccaggagcctctccagcgactcgcggtgggcggccgaagcggcgaaggcccgttcgtactc

SEQ ID NO: 2916 - DNA, 3243 bp, Unknown
  Kingdom: Bacteria, Phylum: Actinobacteria, Class: Actinobacteria, Order: Streptomycetales, Family: Streptomycetaceae, Genus: Streptomyces
cctcacggtcggcggacggagcctggccggagggatcgctctccccggcgggcgcgggcacccgcggctcgccgttcgccttgcgccgccggtccgccggggaggacgactggaggcccatcccgcctccggtggtacggaacagttcgtcggcccccggcagactcactcggcgtgacaccgggcgagcacctccctggcgagctggcgataggcggctgcgccgaccgagttggaggcgtaggtggtgatgggctcgccggcgaccgtggtctccgggaagcggaccgtgcggccgatgaccgtgtggtagacgtgctcgtcgaaggcctcgacgacgcgcgccaggacctcgcggctgtgcaccgtacgggagtcgtacatggtggcgaggatgccgtcgagctccagctcggggttgagccgctcctggaccttctcgatggtctcggtgagcagcgccaccccgcgcagcgcgaagaactcgcactcgagcggcactatgaccttgtgagcggccgtcagcgcgttcacggtgagcaggccgagcgagggctgacagtcgatcacgatgtagtcgtagtcggccatcagcggcttcagggcgcgctggagcgtggactcgcgggccacctcgctgacgagctgcacctcggccgcggagaggtcgatgttgctgggcagcaggtccatgttggggaccgcggtcttgagcaggacgtcgtcggccgtcatgccccgctccatgagcaggttgtagacggtgaggtccagctccatcgggttgaccccgaggccgacggagagggcgccctgcgggtcgaagtcgacgagcaggacccggcgtccgtactccgcgagcgcggcgcccaggttgatggtcgacgtggtcttgccgacgccgcccttctggttgcacatcgcgatgatcttcgcggggccgtggtcggtcagggggcccgggatcgggaagtacggcagcggccgtccggtcgggccgatgcgctcgcggcgctggcgcgcggcgtcgggcgcgagggtggccgcgtactccggatcgggctcgtactcggcgtcggggtcgtagaagtgcccctcgggcacctcggcgaagtcggcgaagcggtcggtgtcccggctgctctcgttgccggccgtggcgttcacgtgtaggccgtccatcatctggggggctgtcgtcatgtgctgttgggtggcgaaggtgcggacagcgacggagccgacagcttcgagcccgatcgggctcagaccccgtgcaggcatccctggttgaccacccccgggagtaattgtcgactcattcacaagtcgtcttacctccttggacgtgaccaggaaacttatcgataggtcagcgtggcaccatgccgacgattggcgactctatggcgtgtcaccggtccgcagcaacacaatccgccggacccggcccgatgtgtcggcaatcgaacgcctcactgtcaagggtgcacagcgaccaagccgcacatttcaccgctgcacgaaacgggtaaagggttacgttcggcgcgagttgcgcaagggccccacagggcccgatacgcgtccggccggaccttgctcggcaaggtccggccggacgtgcgatgttgacggaggaggttgacccgtcagccgaggagcgcggtcagctcgacgtgcgggagaccgtgcgcctcggccacctcgcggtaaaccacctggccctcatgggtgttgaggcccttggcgagagcggcgtcgcggcgcagggcgtcggcccagccgcggttcgcgagctccacgatgtagggaagcgtcgcgttggtgagcgcgtaggtggaggtgtggggcaccgcgccgggcatgttggcgacgcagtagaagaccgagtcgtggacctggaaggtcggctcggcgtgggtcgtcggacgcgagtcctcgaagcagccaccctggtcgattgcaatgtcgacaagtacacttccgggcttcatcttggcgacgagctcgttggtgaccagcttcggagccttggctccggggatcagcacggcgccgatgacgaggtcggcctcgacgacggccttctccagttcgaaggcgttggagacgacggtctgcaccttggtgccgaagatcctgtcggcctcgcgcagcttgttgatgtcgcggtcgagcagcgtgacgtggaagccgaggcccacggcgatctgcgtggcgttccagccggagacgccgccgccgatgacgacggccctgcccgccgcggtgccggggacgccgccgggcagcacgccgcggccgccgacggagcgcatcaggtggtacgcgccgacctgcggggcgaggcggcccgcgacctcggacatcggggcgagcagcgggagggcgcggttcgcggtctcgaccgtctcgtaggcgatcgcggtggtgccggaggccagcagcgcgtcggtgcactcgcgggaggcggcgaggtgcaggtacgtgaagagggtctggtccttgcggagacggtggtactcctcggcgaccggctccttgaccttcagcagcaggtcggcggcggcccagacctcgtcggcggtggacaggatccgcgcgccggcggcgacgaactcctggtccgtgatggacgagccgacaccggcgtccttctcgatgacgacctggtggccgtgacggacgagctcatgcactccggcgggggtgatcgccacccggaactcgttgttcttgacttcgcgggggatgccgaccttcacgtcgatcacggtccttggctcggagggtcatccgggcacaacggtgcatacccggacatatacagcataaatggagacgccgcagaggaacgcggcagagccagtctaatgaaggacttcgcgctgtctagccttacaaagcctcaattttctgacgaagcactacggatttcgtaggcagaaggctcctcgcccagcaatctgtcggcagcaccccggtgcagcctggccgcagcgggatccccgagccggtccagcgtgtcggccagccgcagctggagcgccgcctgaagccgcacgtcaccggctcgccgggccagatcgacggcctcttggcaggtctggagcgaatcgtgcggccggcccgcgtactcctggacccgggccgcctcgctcagcgcccgcgccggggccgccggatcgccgagccggcgccggcccgccgcggcggcgcgccagttccgcagcgcctcgc

SEQ ID NO: 2917 - DNA, 7943 bp, Unknown
  Kingdom: Bacteria, Phylum: Actinobacteria, Class: Actinobacteria, Order: Streptomycetales, Family: Streptomycetaceae, Genus: Streptomyces
ggcgatccggcctgggacctcggccggcccgccgcctggtacgccgccggactcctggcccccgaggactggttcgccttcctggacgcctaccggtccgccgggggacccgcggtgccggccgacggggacccctggtccgaactggacgtcccggcccgcgcgctgacggtgcagacggcggccctcgccctggccaagtgcgccacggaacaacggcatccggacgagcacgaacagctgatgatcgaatcctgtgcccgaatcgctacgttgccgcccgagttggccgccgaccacgcgtcgtagggtgaacggaccgccgccgggcagacattccggcgacggcacaaacgagggcgaggagccgagccgatgatgcagtgcccgaagtgtcacgcgcagatgaacacgtacaaccgcaatggcgttcagatcgagcagtgcagcggttgccgggggatattcctcgactacggcgagctggagtcgctgacccgcctggagtcccagtggtcccagcaggctccgccggcaccccccgccccgcaggcctacccggccgctcctgccgcccacgcccccgcctggggcgcaccgcagcacggcgggcacggtgggcactacggccaccaccgccagaagggcttcggccgcatgctgttctcttcctgagcgttcctccgtgacccggcgaccaccgcgccgccgggtcacggagggggcggtccgtacgacgaaagaacccccggtcgtggagacgaccgggggttctcggtggtgcgcgatactgggattgaaccagtgacctcttccgtgtcagggaagcgctctcccgctgagctaatcgcgcggggtgatcctgtgtgcactgcgtgcgcgatactgggattgaaccagtgacctcttccgtgtcagggaagcgctctcccgctgagctaatcgcgcggggatccttgcggaccgatgatccttgcggaccagtggacgatactgggattgaaccagtgacctcttccgtgtcagggaagcgctctcccgctgagctaatcgtccttggaggtggagacgggatttgaacccgtgtagacggctttgcaggccgttgcctcgcctctcggccactccaccaggggcgggggcccgggaagaatcccccaccttctgcgagcggacgaccaggttcgaactggcgacctcaaccttggcaaggttgcgctctaccaactgagctacgtccgcttgtctttcccggcccgcttgcgcgtcccggcgacgtgttgaactctagcggattcctgggccagtacaaaaacgcgtttgtgcagcgtgctgcggtgacctcgccccgacgcaggtcaccgcacaccgtcctagactcattcgcgtgtccgacctcgcccccttggcccgtttcgacggcctcatcgcctccggtctgcaggatgtgacccacgatcccgcggctctcgactcatccggcttctgggcggtatgcgccgatttcgaaggacgcgtcgtctgcgcccgcttctccgacgtgcgcagggaggcggtgcccccgcccgtgcccggagcgtggcgggggcccgccaccggggactgggcctcctcgctggaccgtgacgcctacacggcgggcgtgcggcggatccgtgaacacatcgcggcgggcgacgtctaccaggccaacctctgccgagtgctgtccgcaccgctccccgacggcggggccggggccgacgtcgatgccctgacctccctgctcgcacgcggcaaccccgccccgtacgcgggaacgatccggctgcccggccacggtgtggaggtcgccacggcgtcccccgaactcttcctccggcgcgacgggcggatcgtggagtccgggccgatcaagggcaccggccggaccgaggccgacctgctggcgaaggaccacgcggagaacgtgatgatcgtggacctggtccgcaacgacctgggccgggtctgtgccaccggaagcgtgagcgtgcccgatctctgcgtcgtcgagaagcacccgggcctcgtccacctcgtctccaccgtccggggccggctggccgacggagcgggctggcccgagctgttcgcggcgtccttcccgcccggctcggtcaccggggcgccgaagtccagtgcgctgcggatcatcgacgagctggagcggtctccgcgcgggccgtactgcggtgcggtcggctgggtcgacgccgaccggggtaccgcctccctcgcggtggggatacggacgttctggatcgaccggaccggggccgcgccgctgctgcggttcgggaccggggccgggatcacctggggatccgacccggagcgcgaatgggacgagaccgaactcaaggcctcccggctgctcgctgtagcgtcgggtgcgtatcaggagacaggaaggaccgcgatatgaggatctgggtcaacggcggactgcgggacgccgacgacgcccggctgtcggtgctcgaccacggcctgaccgtgggcgacggcatcttcgagacggtgcgtacgagcgaggggcgccccttcgcgctgacccggcacctcgaccgcctcacccggtccgcccggggcctgggcctgcccgacccggaccacgacgaggtccgtcgcgccgccgccgcggtcatcgacgccaatcccgtcgccctgggacgcctgcggatcacctacaccggcgggctgtccccgctcggctcggaccggggaaccgacgggccgagcctcgtcgtcgccctcgacggggtgaaccgccgcccggacagcacggcggtgatcaccgtcccctggacacgcaacgaacgcggcgcgctcgccggcctgaagaccacctcgtacgccgagaacgtcgtcgccctggcacgggcacgggaacggggcgcgtccgaggcgctgttccccaacaccgccgaccgcctctgcgaaggcaccggctccaacgtgttcgtcgtcctggacggccgtatccacacgccgccggtggcctccggctgccttgccgggatcacccgcgcgctggccgtggagtggaccggggccgaggagaccgatcttccgatgggcatcctcgccgaggccgacgaggtcttcctgacctcgacgctccgcgacgtccaggcggtgcgtcgcgtggacgaccgcgagctgaccgcggagatcggaccggtgacggcgaaggccatgcggatcttcgccgagcggtccggcgacgacctcgacccgtagcggtccccggtcccgcccgaaaagcgcgtgacggggcgttgcacaggggatacaaacctttgatgaccacgacactccggccgtccgggccgcttcagcagggcgccgacggcgcacgggcccgcgactacgacgtgtgcgacaacgggcggcccgtcggcaccgtcgcgatcagtaccgacgacgcgttcggcgcgaccgccggggtgctgcgctcgctcggcgtcgaggagtcccggcgcagacgcggccgggggaccatcgccgcactcgccgccgaagaggtgctgcggggatggggctgcacccgggtgcgggtggaggtccccgccgacaacgaaccggcccgccgcctcgctgccgccctcggttacaccgaacgcagccgcaacatggtcaaggatctcggcccggacagcgccccgctccccgatgggctcacctcgcgtgcgatgggcgaggaggagttcgccgtctggcgacaggacgcggtacgggcgtacgcgcaggactggatcgatcgcgcggtgccgcccgagcaggcccggctcaagtccgaggccgatcacgccgccctcctgccggacggactggcgaccgagggggtgaccttccgggtgctggtgcacgggggcgagaccgtcggccatgtgtgggtggcccagcgggagctgccgcccggcggcccggccggattcgtcttcgacgtcgaggtgcgcgaggagcaccggggccggggccacggccggaccctgatgctgctcgccgaggacgtcacccgggcctggggcgcggaccggctcggcctgcacgtcttcgcctccaacaccccggccctgcggctgtacgagtccctcggctacacgacgacgcggtacaacctggccaaggcgctgtagcggccttcccggccgccaccggtccacagaccgcagccggtctactgctcccgtgcggccaggacgcggtcgacgatctcctcgatccgctcgcgcagaccgtcctggctcctgccgccgtccagccgctcgtcgccgatcacataggtgggcgtgccggtgacgccgatcgccttgccctccgcctggtcggcgtcgacgatcagcagatgccggccgtcgatcagcgccgtgtcgaactcctcggcgtccaggtccagttcccgtgccacgtcgaggagcaccggttcgcccgtgcggccgagatcggcggtgcgggacagcagggcctcgatgtacggccatcccttgccctgctccgtcgcctcctcggcggcctgggccgcggcgtaggcgtgtttgtgcttgtccagcgggaagtgccgcagccggatctcgacgcggtccccgtaccgggcgcgcagggcgcgcacatcgtcgagggctcggtggcagtcggggcattcgagatcgcaccagaggtcgaggacgaccggtgccgcgggggaggaatcgctcatgcgcccagtcttccaggccgggagggcgcgtcccaaccgggaccgggccaccccctggggaggagtccggccctgaaatgtccctgaggtggacgaccgccgtggcctcgacggcggtcgtcggtgcaggatggaagggacgtatcttctgcgcctggaggccccgatgcttgccgagaccatctgttccgcggcatcggcggccggcctgggcatcgccgcggtgaccgcgtaccgcaaacggttcctcacggcgacgaggatcgccgcctactccctcgtcccggtcgggctcgtgctgaccggggtcgtcgagtgggtcgccgggatcgccttcaagccgagcgtctggctcggcttcggggtgctcggcctctcctggctgctgttcatgaccacccgcgccgtcgagcgccgcagcggcaccacccgcgcggaacgcagggcggcgcgggcggccggacggaacgaggcggtccgcccccgccgccaccgccccctcgctcggcgcgggcggtacggcgggaccgggggccgcgaagccgcaggcacagccgaagccgaagaagaagcaggaggccgccgcgcccggcgacgacttcagcgacatcgaggcgatcctcaagaagcacggcatctgagacagcggccggccccgccgacgcgggtgctcgggccaccggcccgaatgcctgacggcgacccgtacgccggagcgattatcgatggccacgggacggtgaactcccgggggaatgaccccggttgatcgccaaccggctgtgggtgcgtcatgatcactccgagatggtggacacttcccggggcgatgcccccgcaccccccgccgaagagccccgcggctgtctcttcgcgctttcccagccgcccctgatgatcttcctgacggtgatcgggggtctgctgctgatggccgccctgcacgatctcttcgtgctgtgacgcgtcgcgccaccgtgcggggcggcgtgggcgtcagcccgcggcttccttgcgccgggcccggtacgccgcgacgtggagccggtttccgcacgtacggctggagcagtagcggcgggagcggttgcgcgacaggtcgacgaacgcgtgcccgcagtccggcgcctcgcagcgccgcagccgttcctgctcgcccgccacgatgatgaaggccagcgccatgccgcagtcggcggcgagatggtcggcgatcgaggcgtccggggcgaagtagtgcacgtgccagtcgtagccgtcgtggtcggtgagctgcggagtggtcccggcggccgcgacgaggcggttgaccaggtcggcggcggcgcgggggtcgggcgccgcgaagacctcggcgaaacgggcccggacatcgcgcacggcggtcaggtccttctcgccgagcgtgccgactccgctgatgagatgccgctccgcgaaggcgtacagcgcggcgacatcggcgagaccgtcctcggatccgcccagcggtccgtccgagggctcgtcccgcggcagctcgttctccggcgcggtgttcaccagatcgaccaccgtgtcgagggcgatccgggtgtcgtgagggatcagcacgcttcgctccctggccttccggcgggcgggcgcctgccgatggcggctgactctactggctcggcccgccggcgccaggtccgcgcgggcccggccgggagcggaacgaatccctccggctcctggaaggaggagccgcgaggggtgggcgcaccggcgccgccgtcgcggtggattccgcgacgacggcgccggtgtctgccctatgcggttgtcggcacgacgccgtcgccccgagttcggacggcgtcgagcggctctctgcctggctcagctctcggccaggatgtgggagagctccgtgtcgagatcgaagtgacgatgctcggtgccgggcggaaccgcggcgtcggtcctcttcaggaacgactccagggcccgcgccggggcttcgagcagggcttctccctctggggagctcagggcgatgcatacgacgccttgaccgtgactacgagatggccagacgcggacgtctccggtgccggtgggccggtgcagcccctcggcaaggaggtcgcgggcgaatacccattcgaccgtctcctccgctccggtgtggaaggtggcgtgcacggcatagggatcggccgtgtcataccgcaggcccgcgggtacaggcagtgaggactcgctcgacacaacgaggcgcaggtgcagctcgcagctgaccgtggtgttcataagcgccagggcctttcgctcagtgtgcgctcggggattcgcacgtcggcgaaatcgacatgccacctacggtggcgttgtaaacccctctgacccatttgtgatgcttcgggtccctcgctcagcggcgtgtaactttgagttatgcgcccattccagtgacgaagacgggtcgggtaagttgagcttcatgaacgcggagagtgacgagcggagcgaggtcgccgagcaggcggccccggcgtccgccacgggggaatcggaccggggggaacgcgagctgggctcgcgggcgccgggcttcatcaaggcgtcgaaagcgctccatctgagctggcaggtcggcgtcttcatcgtcggtctcggcgtggtggtcgcgggtgtgctcatgctggtgctgccgggccccggctggctggtgatcttcggaggcatggcgatctgggcgaccgagttcgtctgggcccagttggtgctgcgctggaccaagcgcaaggtcaccgaggcggcccagcgggccctcgatcccaaggtccggcgacgcaacatcattctcaccacgctggggctcgtgatcatggcggtgctggccgggatctacgtctggaagttcgggctcaccatgccgtggaagatcagcgagtagcccgggggacggtccaggagcaccgctgacatggggtaatgtttgcggtgcgcccgggcgattagctcagtgggagagcgcttcgttcacaccgaagaggtcactggttcgaacccagtatcgcccacccggacaaagggcccgggagacggaatccgtctcccgggccctttgcgttgttcacaccgggcaccggcccgggagccgctgtggccggcgtgccccgggccgggcgtggctcaccgcattcgccccagcgcgtccttcagccggcgggcgtcgcgcagtcgctgctcg

SEQ ID NO: 2918 - DNA, 8179 bp, Unknown
  Kingdom: Bacteria, Phylum: Actinobacteria, Class: Actinobacteria, Order: Streptomycetales, Family: Streptomycetaceae, Genus: Streptomyces
ggcaccccgggaagctgggacacctgccccagctcgaccgggagtccgaacgggagagcgagggcacatgagcgggggaaggaacgggccccggcccggcggcgcacgccggccccgggagacgatgatcatcatcggggccggtctcggcgggctctccaccggctgctacgcccagatgaacggctaccgcacccgcatcctggagatgcacgagatccccggcaccaccttcaccacctgggccggcggccccgagatccacaccgccctgtccaacccccacaccccgtggaagatcgagatcctcgacgggatcctcttcgacgacggcaaaccactcgacgactggtccaggaaactcaaggaagcctggtcctccctcaccgcccaggccgacctgaacggcgaccccggccagcgcaccgcagcccacctcgccgcccgcgccgtccgcgccctcctcctctacggcatcggcgccttcgcccaacgcccccgcaccgtcaccggcaccaccccccgcaccatggaacgcgacgtccccccggacgccgagatcatcggcttcgacgacctaaccatcacctggcaacgccccaccggcttcacccgcgaccccaacgcccaccccgaatgggccgcccacatctggtcctccgcccgcgccgccctgctcacccagcgccaccgcgacgacaacacctacgccggagccctccacgccccgcccggcacgatcgtcgccttccgcaccgacgccgtctacctcacccagccccaaccatggccccaccacggccagccgggcgactacctcaacaaaggccacctccccggccccctcaccgctcccaccaccgaagacgaactcctcaccctccgcgacaggggccgcgccgcccaccacaccgcgcccacccctgagggagcctgatgccaccgcgccgcacgcgccccccggcaccgcaccgtaacgaagcagcccgcctcgccgaccaactccaacaaggcggctacaccaaacgcgacatcgcccgcatcatcaaccgcgacgcctccctcgtctcccagttctacacaaagaacaagggcgcagccttcgtccccgccctcacccaggtcctcaccgccatccacaccgcaggcatcagcgacgtcaccgaactcgctgcgatcgccgccccccacatcacccgccgcaccaccgccggcggcacccgagcccgcgtccgcaccaaagccgtcctcatcacccccaccggcacgggtaccgggcgagccggagcacaggccatcgcctccggcgcgtcccggctgcgccccctgatcgccgaagccgcccgccaaagcctgcgcctggccttcaccgtgcgcctcgccaagtccggatacgtccacgcttcaggaagccgcaccgactcgcccggcatccgccgcgacgtcatccagcgcgccgaccacaccgaggaacgctcctacgggtccgccacaacgggtggtttcgcggcagccgatatcgcccgccgtgtcgacgcggcgggcggcgatgtcaccacggccctccaccggtggctggccgaaaccggccgcatccaccccgacgcgcacatcacccacctggaaatccgtacctggcggcagcgttgacctcgccaggagcagcacagccaacccaacagccggccgggaacgatgcctacacatccccggctgctcttcctcctcgaggcccccggggacgatcgaggcgcacttggaacggtcgcgcggattctgccagcagccactcgccaggacccgggccccgcccccggaccgatcgcccgcatggcgcgataccacgactacccacccaggtcctggaacgcgtcgcgtatgccgacgaagaccatgcccgacgcctcgcccgggcgaggcccgtcgaggaattccccttctgccgcacagccctgaaggatctggtccgccacggcgcacacgtcctggcgggcgagctactgagacagctcggcgaacaggaaccaagagggcctggaacctgatcaactggcccattcaagacgggaccatcgaggcagcacgcgccgacctcgaggcctgcgcaccccatcaagacatgaagggccgccgcaacaggcatccttccgaaaccgtcgccaacggcccggaccagagtcacgacgacgaacgggccgtccggggccggccgttcatactggaggggtgccgaatcctctcctgcgcctggccacgccggacgactgccaacccgtgatcgacctcctgacccaggtatgggaggaggaacgcagaccggcccggtggcaagcggatctgcgggagcagacggagtgcggagacggcgcgcggcgaggagtgtgggtgctggaggacgctggcgcggtggtgtcggtggctgtggtccatcggcagagcccgaaggagatcgcaggccgtacctggcccgtctacctcgcgtacctgatcaccgacaaggaacaccgcggccgcggatacagcgcactgctggaaggccacgtcatggcggagctggcccgccagggccgctcgggggcctacctgaaggttcacaaagaggacgcggacggggagaaggcacaggggttctgggagcaccagggctgggagcaggcagccggatccccgaacacgcacgtgctgatgaccaaagatacggctctgccgtcggcgccggggctgccctgatcaacccgcaggtccgcccaggcagcgcctttgccgctcccgccgttcttcctgcacttgctacggggcccgaccgccggcgacccagagggccggcccccggctccggagggtttccacccccacctctcactgagggcttcgacgatgagcagtccgcggtggccctccgccaggggagccgacggtgtgagacggggcccgcgtcggctgggatcgcaaccctcccctttgccgtgtccggtcgtccgtcgacgcgcgcacggagcgcgtagtcgtgatgcccttgccgggcagccacatgggaggaatccggcgtacaggccgccgccggcgtgacgttggccatcgccgatcgccgatgctgccccgtcgacgcgctgtccctggaaacgccgtgggggccacctcaaacgaccctgacgactcgtcgggcggcccagccgtttgcccggcggatgtccgacccgttcccttggcctgcccgcaggggaacttttcttcatctacctgttcacttcagagccaagggcgtttatcggtaaagccgcccgaaacaaccgccctggtggttacggtctgcctttatgcggatcttgcacacttcggactggcacctgggccgtcaactgcaccgggagccgctcctcgcggagcagcgcaccttcctcgagcacctgctgagcacggtgcgccaggagcatgtcgaggcggtggtcgtagcgggcgacgtcttcgaccgggccatcccgcccctcgacgcgatcgacttgttcaactgggtcctcggggaactcgccgaccttcaggtaccgctcgtcatgatcagcgggaatcacgactcaccacgccgcctaggcgtcaactcccggctgatcgagcgcgcgggcatccacctgcgcaccagcgtggaagactgcgcccgccccgccgtactgcacgacgagcacggaccggtcgccttctacggactgccctacctcgaacccggcctggtccatacgcagctcggggccgagaagcccagccaccaggctgtgctcaccgcggcgatggacagggtccgctccgatctcgcgacccgccccggcaacaccaggtctgtcgttctggcccacgccttcgtgaccggggcggacatcagcgacagcgagcgcgacatcaccgcgggcggtgttccctcagtcagcgcctcagtcttcaccggcgccgactacgtcgcgctgggacacctgcaccgctgccaaaagatcagcgaacgcatccgctacagcggatccccgctggcctactccttctccgaggccgaccaccccaaagccacgtggctgatcgacctggacgccggctccgacgtcacagcccgcaagatcctctgtcccgtgccccgccgcctgcgtcagctgaccggccccctgaacgacctgctcacccagcccgagcacgccgagtacgaggactgctggctgcacatcacgctcaccgacaccaaccgcccccacatggccatggaacgcctgaaacagcgcttcccccatgcgttgaaactgagcttctcccaccagcacaccgcctcgcaggagtcctaccgctcccgggtcaacggccgcagcgaccacgagatcaccctcggcttcctcgaccacgtcaccggcgctcccgccaccaccccagagcagaacctgctgcgagaaggactcgaaagcgtccgcacggcagccgccgcacgagaggccagctgatgtacctccaccacctgacggtccaggcattcggccccttcgcccgcacagaatccgttgacttcgacgccctggccagcaacggcctgttcctgctgcgcggtgacaccggagccgggaaaaccagcatcctggacgccgtctgcttcgccctctacggcactgtgcccggcatccgccccacccaccgcctgcgcagcgaccacgcccccaccggaacgcgcacccagatcatcctggagttcagcgcagccggacgacgtctcaggatcacgcgaaagcccaggcagtcctaccccagcacacgtgccaaaaccggcaccgccaccgccgaggccaccgtcgagctccaccagcagaccagcaccacagacggtcctgcgaagtgggaaccggtcagcgccaaccaccaggacaccgccagagagatcgaagcggccctgggcctgtccaaggaacagttctgccaggtcgtcctcctgccgcaaggcgacttcgccaccttcctgcggtccgacgccaaggaccgcgccgtgctgctgcgccgcctctttgacaccggacgcttccaggaactgcaggcctggctcaccaaccggagcaaagctgcccaggaggatctccacgaggtcacttccaccctccagcagctcggcgaacgcctccaccaggaagcaggccccctccttcaccaggagggcaccagcgccgaagagctatcccgtcccgaccctcagcacccggccggcctcttgccctgggcccagcacctgggcgcccgggctcagagcgcccacgccacagccgtggccgacgagcaacgcagcgacaccgagcaccagcacgccaagaccgaacaccagcgcaccatcgagctcgccaaccaccagacccagcacgcacaggcccaggcacgccgtgcggctctggacgacaaggccgccggccacccccggctccgctcacaacgggacgccggacggcgcgcagaacaactgcgccccctcctggacaccgtcaagcgcacagcactcaccctggacacggccacccacaccgaggacgacgcccgcctgctgctgcccgacgagcaccgggacacgccaattccccagctgcgggctgcccttgaacagcaccacgccgagaaggggcgagccgaagggctgctgccggacgaacagcagcacacacagctcggcgtccagatcaccgacctcaacgccaaggaagagcaggcaagagccgatctcgaggaagacgagcaatggctgaccgcatggcctgcactggaggcagaacacaccggccgcctcgccgacatgaccaaggcagccgaccaggtaccgcaacacgagcaggacatccagacactcaacgcccacctcaaggccgcacgcctccgcgacaccctcaccggcaaactcctctcagccgcgaaaacggaaaccgaccgcgccgctgaagccctcgaaaccaaaaaactatggctggacctgcgcgaacgccgcctggacggcatggccggagaactcgcccacgaactcaccgacgggaccccgtgctcggtctgcggctcgcccgaccacccgcagcccgcccaacgccaacccggccagcccacacgcgaggacgaggaaaaggcccgcacccttcacgagcaggccgacacgctccacgcccaggccggcagccaccgccacgacctcgccacccagcacgccgaagcatccggagcagcaggccccacccccagcgacgagctcaaggcacagctcaccaaggccaagaaggcccaccggagcgcatgcgaggccgccgccgcactgccctcggcccaggaaaacctgacccgcctgcgcacagaacacgacacccgcacccagcagtgccaggcagctcaggcccgtgtgaccgaatgccaggcacgcaccaaaaccctggcccagcagcaaaccgccctcgcccacaccctggccgccgcacgcggcaccgccaccaccctcgacgagcgcatcacccaactcagccgcacggccaaaagcctgtccgacgccatcgacgccgcccagaaggcagccgaagcagccgcccgccacctggacgcgagggccatcgccaccaccacagcccacgacgccgggttcctgacgctcgacgaagcaaccgccgccctccaggacccagcactcctggaacagtggagccaggaactcgaccagtggggcaaggacgacgccgtcgtcaccgacctcctgaaaaccccggccctcctggaagccggcctccagccccccgccgacccacaagccgcagccaaagccctgaccgaggccgaagaacaagccaagaagaccgcagccgaccgccagcaagccgatcatcgcgtcaccgccctcaccgacctgatctccaccctcaaagcccgcctcagcgacctggaacccctgcaggcccgccacgccctcgccgaccgcctggccggcatcgcctgcgccaccaccaccgccaacaccctcagcatggaactcgaggcctacgtcctggccgcccgtctcgaagagatcgccgacgcagccaacatccggctccaggccatgacctccgagcgctacctcctccagcacacagccgacaaggacgcaggccgacgcggacgcctcaagtccggcctgggactgagaatcctcgacacctggaccggcaccgaacgcgaaacctccaccctctccggcggcgaaaccttcaccgcctccctcgcccttgccctcggcctggccgacgtcgtcacccaggaagccagcggccgcccactgggaaccctgttcatcgacgaaggcttcggcaccctcgacgaacagaacctccaagaagtcatggacgtcctggaccaactccgcgccggaaaccgggcagtgggcatcgtcagccacgtcgccgaactcagccgccgcatccccagccagctcaacgtgatgaaacaccgcaacggctccacactgcgcccgttgatcaacaccgatctgtaacgtcagagccaccaggcagaggagaacaccaaccagcacctgtcctcaccgacctcagcaaccaccgcatccgcgcagcacaccacgacaccccgtcccgaccaggaaccggccaggagagcatgccgaccgccgcgatcgagctccgcccccaccagaaagaagccgtcaccgccgcagtcagaaccctgcgcacccacccacgggccagtgtcatcgcggcctgcgggaccgggaaaaccctcatcgccgcccgcaccaccacccgaatcgcaccccgcggacgggtcctcgtcctcgtcccgaccctggacctgctctcccagaccgcccgctcctggcacacagccggccacaaagccccggcagtggccgtctgctccacccgccaagccatggaccacccctccgccggcaacctccccatgaccacgaaacccgacgagctcaccgaactcaccccacccaccggcccggtcaccgtctacgccacctacgcctccctgcccaccgtcatcaacgcccaccgagaccaccacctgccgccctgggacctcgtcgtcgtcgacgaggtcccaccgcaccgccggccgcctcggaaaagcctgggcaggcatccaccacgacgaccaggtccccgccgcccgccgcctctacctcaccgcgaccccccgcatc

SEQ ID NO: 2919 - DNA, 11720 bp, Unknown
  Kingdom: Bacteria, Phylum: Actinobacteria, Class: Actinobacteria, Order: Streptomycetales, Family: Streptomycetaceae, Genus: Streptomyces
gtcccgtcccgtcccccggaggagaacagatgcccacgcccgccgcaccgcgcagcaacccgaccgccgtgacgcacgaggtgacgaaccagccgcctccgctcaccggtcacgacgccgccgacgacgcggtgctgctcgaagggatacgccgcgagggcgccgcatggcacctggacgagctccaccgcttcggccgctatgtcggcagcgaggaggcccagcactgggccgaccaggccaaccgccacgagccggagctgcgtacccacgaccgcttcggccaccgggtcgacgaggtcgagttccaccccgcctaccactccctgatggacgcctcggtgcgtgcgggtctggcgggcgccgcctgggccgacgggcgccccggcgcccatgtcgcacgcgccggcggcttcatgctggccacgatgctggagcagggccacctgtgcccggtctcgatgacgtacgccgtcgtcccggcgctgcgccgctcccccgacctcgccaagacgtacgaaccactgttgaccagccgtgtgtacgagcccggtctcagcgcccccgcagccaagcgcggcctgctcgccggtatggggatgacggagaagcagggcggtaccgacgtgcgcgccaacaccacggccgccgtcgaacaggccgacggcacctggcggctgcgcgggcacaagtggttcaccagcgcgccgatgaacgatctgttcctggtgctcgcccagtcgcccggcggcctgtcgtgcttcctggttccgcgcgtgctggcggacgggagccggaacaccttccgcatccagcggctcaaggacaagctcggcaaccgttccaacgcgtccagcgagcccgagttcgacgacaccgtggcctggctcgtcggtgacgagggcaagggcgtgcgcaccatcatcgacatggtgacgatgacccggctcgactgcgtgctcggttccgccgccggcacccgtgccgcgctcgcgcaggcggcccaccacgcgcgccaccgcacggtgttcggcgccgagctgatcgaccagcccctgatgcgcaatgtcctggcggacctgtccctggagtccgaggccgccacgaccctggccctgcgcctggcgggggccgccgaccgtgcccaccggggtgacgacggggaacgcgcgttcctccgcctggccacggccatcggcaagtactgggtgtgcaagcgccagcccgccgcggtcgccgaggccctggagtgcctcggcggcaacggatacgacgaggcttcaggcatgccgcggctgtaccgcgaggctccgctcaacggcatctgggaggggtccggcaatgtcaacgccctcgatatgctccgggcgttgacgcgggagcccgcgtcgctggaggcctttcacgccgagatcgaggcggcgaccgggacggacgcgcgcctcgacgcggcctggcgggagctgcgggccgagctggcgcgcacggaggacgcgcagctccgggcccgccgggtcgtcgaacgggccgctctcgtgctccagggatcgctcctggtgcgccacgcgccggcggcggtggccgacgccttctgcgcgtcccgcctcgccggggaccgggggctcgctttcggcactctccccgcggacacggacttcacggcgctgctggggcggctgcccgcctgacggggacatgggcgagggcggcgggaaacctcgccgccgctgggtggaccccgtgtcgccggtccgctgttgttccgtcagtggccgtcgtgtgcatggcggaggtaggcgtccagctcggcggccccggccagcatcgccctcccccgggcggccagccgggcgtgccagtcgcgcagggcggccgccaacggctccagaccgccggccgcccgcacctgggcgatcaacggtgcgatctgctccagacggtagccgccccgcctgagctggtgggccagtccggcgtcccgtacatcggtctcggcgtacacccggtagccggttcgcgggtcgcggcgcggggtcacgagaccggcgcgctcccacttccgcagcgtggcgggtctgatccccagctttcccgccagcggtcccacgaacatcccgccggggctcgacgcgtcgccgggtgcgggtccggcgccgggccccagatcgcggagggccctctcgactgcttgcagcgtccgccggtcctccaggagctgggcgtggctctcgtcgacgatgcggaacgcctcctccggatcgtcgcggttcaccgcccgcatgatcgatgtcgcggtcgcgtgcccatgaccggggaccagcgcgaggaacgccgcaagagcgtgcgcgtgcagcggcgcgtaggtgcggtagccgtgcggggtgcggtcggcggccgggaggatccccgccgcctcgtagtttctgacggcctgcgtcgacaatccgtgccgacgggccagatcgatgggtcggagtcggcctgctgtttgagggttctgcctcatgagtcccaagatatcgcgcaaaagtttgcaccgggggttcaacgatacggttgaagccatggccaacgacatcaagaacttcgcccacgccgtcgacgcggcttccgtcatgaggctgttcgcctccccgcccagggtgctggctctgggcgagcccacccacggggtggacgccccccttctgctgcgcaacgcgctcttccgccagctcgtcgagcgggagggctaccggaccatcgccatcgagagcgactgcgtggcgggactgctggtggacgactacgtgacgacgggtgcgggaacgctcgacgaggtgatggagcgggggttcggccacggcctcggggagtcgacggccaatcgtcaactggtctgctggatgcgcgcgttcaacgacggccggcccgcgtccgaccgggtccgcttcgccggcttcgacggcccgctggagatggcgtacgccgcgagcccgcgcgaggccctcacctcgctccaccgcgttctcgccgaccacgtggacacggacctgctcccctgcaccgcggggacgctcgaccgcctcctcggcgccgacgagcggtggaccgaccctgcggcgatgctggatccgtccgcgtccttcgggcggtcggccgaggccgggcaactgcgcctgttcgccgacgatctgggtgctctgctcaacgcgtggacgccgcacctgatcgcggtgacctcgcgggacgcgttcgaccgggctctcctgtacgcacgggccgcctcggggctgctgcgataccacttctggatggccgacacctcaccgaaccgtctgtcacggctgacgggcctgcgggatcagatgatggccggaaacctcctcgcgctcgccgagcgggcgccggttctggtgcacgcccacaacagccatctccagcgggacatgagctcgatgcggatggggggccgacggctggagtggtggagcgcgggcgccgtcgtcaacgcccgcctgggcgagcggtacggcttcctggccaccgccttcggcacgatgcggcaccgaggggtcgacgttccgccgccggacaccctcgaaggaaccctgtacgcactcccggaggagccctgcctggtgaacgcctccgaactgaccgccgccctcggcgccacgggcttcgcccggcggacgtccccgtacttcggctacgctccgctcgacccggcacacctggcccgtatcgatggagtcgtgttcatgaaggacatcccggaggacgttccgggggacgttccgggggacgttccgggggtttgaagacgctcgtgtacacgcgccgggggcggcgtcatctcctacgccgaacgtccggacgggtgaatccccgtcaggtcaggaatacgtgggcccggccatggttgatcacaccatgacttctgagatttccgggacgggcagggcatcgggcagggcattcggacgtgtggggatctggagcggtgccctgcacgcctcacgggtggacgacgcgggcaggaaggcgatcgcggaggcgctcgccgagctcgaagagctggggtacggcaccgtctggatcgggggcagtccgacgcccgaggacgccgcagccgtcgtggccgcgacccggtcgatcacggtggccaccggcatcctgagcatctggaaccacacggccgaggaggcggcggccgcgatctcggcgatcgatcccggggcgcgccgtcgcttcgtcctcggtctgggcgtcagccacggaccgatggtgccgcagtacgcgaagccgtacagcgcgatggtgtcctacctcgacgcgctcgacgccgccgaaccgtccgtgggctccggccatcgggtcctggccgccctcggtccgaagatgctgaagctcgcggccgtccggtcgctgggggcgcacccctatctcgtcaccaccgagcacaccgcggaggcccgcgaggcgctcggccccgacgcgctgctcgccccggagctgacggtggtgctggacaccgacctcgaccgggcccgcaccaccgcgcggacgatgctggggatgtatctgcagttgcccaactacaccgacaatctgctgcgcctggggttcacggaaggcgacttcgacggcggcggcagcgtccgcctcctcgacgccctcttcgcgctgggcgacgccgagaaggtgaggcgtcggacccgggagtacctcgacgccggcgccgaccatgtcgcgttgcaggtgctcaccgccgacgagggcggtgcaggcctgccgcgtgccgcctggcgcgagctggccggggctttcggcgaagaactctgacggacccggaaccgacctgtcaacacgtcgcactcatcgtcccgttcgagtgatgtgcggcgtgtcgggaggatcccggggcggctctgggcagcctccgtgcgaccgatcgtggagggggagtcgtgggagtggcacgtcagtacgggcgcaccatcagtgaggggccgacaccggccgatgcggcgggagcgcccgccctgccctatccgagcggctggtccgccctggccttctcgcacgagctgcggccgggcaccgtgctcacccggccgctcgcggggcgcgacgtcgtcctgtaccgcaccggcacgggagcgctccgcgccgtccgtccgtactgcccgcacctgggcgcccacctcggtctggcgaaggtcgagggggaggatctcacgtgtcccttccacttcttctcgttcggccccgacggcacgtgtgtgcgcacggggtacggcacaccgccgccgcgttccccgctgacgcagttgcccgtccacgaggtgaacgggggcgtcttcgtctggcggcaccacgacggccgggatccggactggtccgtcccgcagtggcacgagatcggccacaggcccgcgcgtacggccgcctgggagctggccggcaacgtccaggaggtcatcgagaactcggtcgacctcgggcacttcgccaccctgcacggctgggcgaaggccgagatcgacggccctgtggcgtatgacgacgcggcgttccatgtcgccatgcgggcccacgagtcggcaccgctcatgggcgacttcaccgtcgacgtgaaggtggacggctatggactcggctgcctgcacgccgacgtccacaccccccgcttcgggctgcggatgtgcacgatggtgatgccgacggccatcgggcccaaccggatgcagttccggcagctgaaccgcatcgccttcgacgaaccgggccggctgccgcccggactggcccggatcgtcagccgtaccgcggccaggctcctggaccgccccgtcttccggtccagttgcgagttcaccgccgccgatttcccgatctggcaccacaagcagtatcagcagccgccccggctggcctccggtgacggaccgatcggcccgttcaggcgctgggccaagcggttctacccggagacgccgggccgtggcacggtgacccgcccccaccgcagcgagggcgaggacagcgcccttctctcctgaccgacctgagctgacccgaccggctccgcccacacccctggtcacgtccttcccgagcccttgctccggcgctcccgcccctggcgccggcgctcccgcgccctttgccccggccttcgcgtgcccccttcccggcacggcggacgccggggctccgcacttcgggcgccattcgggcggtgatcacggtcaaacgggcagcccggtcgaccggctcgcggccgtatcgagcgtgaccagcacggttacaccgaggaaacgggcacgttcgggctgaggggatctggtgaagcggctggtcgtcgccccgggactgcttgtacaaacgacacatgagcccgaacggacatgcgggctccgcccgcaacgggcccagcagcgaccagggaagtgcgccgtggacaccgaggaacgccgtcggggaattctggacacggcccggcgggagggggcggtcggtgtgaacgccctcgcggacctgttcaaggtggccaaggagaccgtccgccgcgatctgcatgtgctggaggagcacgggctggtccgccggacccacggcggtgcctacccggtggagtcggccggcttcgagaccacgctcgccgtccgcaccacgcgcaacgttccgcagaagtcgcggatcgcgaccgccgccgccgatctgctcggcgacgccgagacggtcttcgtcgacgagggcttcaccccgcagctcatcgccgaggcgcttccccaggaccggccgctgaccgtggtcaccgcttccctgaccgtcgccacctccctcgccggggccgagaagacctcggtgctgctgctgggcggacgcgtgcgcggctcgacgatggcgaccgtcgaccactgggcctcccggatgctcgccgacttcgtcatcgacctcgcgtatctcggagccaacggcatctcccgggagtacggcctcaccaccccggatcccgccgtcgccgaggtgaaggcgcaggcgctgcgcagctcccggcgcaggatcttcgccgggatccacagcaagttcggtgcggtgagcttctgccggttcgccggggtcggcgacttcgaagcgatcgtcaccgacgcggggctctcctcggccgaggcccagcgctactccctgctgggcccccaggtcatccgcgtctgaccggccccgaccgtcccgacccgtctgtccgacctctgtccgacctccgtccgaccggactgcccgtccccgtaccgccgaccgcacggctcccgcacccgcgtcaccgctccaccctcaccgccgggggcgtggtccgccgtgcccgcaacgacccgatcaccgagccgctacgactgatcaggagccctcatgccccatccaggacgccgccgccgaccacggacacacggtcggacctgcgccgtgaccgccgcactggccctgctcgccaccggctgcgccggagcgggcgggacctccttcggcggcggcgacgcgctgaacgtactgatggtgaacaacccgcagatggtcgaactgcagaagctcaccgcgaagcacttcacgaaggagacgggcatcaaggtccacttcacggtgctgcccgagaacgacgtacgcgacaagatcagccaggacttctccaaccaggccggtcagtacgacgtcgccaccatcagcaacttcgagctgcccttcttcgcgaagaacggctggctgcaccccctcgacgactacgcgaaggccgacaccgccttcgaccaggaggacatcctccagcccctgcgggattcgctgaccgccgaggacggcaagctctacgcccagcccttctacggcgagtcgtccttcctcatgtaccgcaaggacgtcttcgaggagcagggcctcacgatgcccgagaagccgacctgggagcaggtggcgaagctcgccgagcggacggacggggcggagcgcgggatgaagggcatctgcctgcgcgggctgccgggctggggcgaggtcatcgccccgctcaccacggtcgtcaacacgatgggtgggacctggttcaccgaggactgggaaccgcgcctgaccgcaccggagttcaagaaggcgacgaagttctacgtcgatctcgtgcggaagcacggagagctcggcgctccgcagtccggctacgccgagtgtctgaacaacatgacccagggcaagaccgccatgtggtacgacgccacggcgggcgccggatccctggaggcgaagggctccccggtgaaggggaagatcggctacgtcccggcccccgtcgagcggaccaagagctccggctggctctacacctgggcctggggtctgcagaaggcttccaagaagtccgacgacgcctggaagttcgtgtcctgggcgtcgggcaaggagtacgaggagctcgtcggggccaccagtggctggtccaacgtgcctgcgggcaaacgggcgtccacctacgccaaccccgactaccgggcggaggcgggcgcgttcgcggacgtcaccgagcgggccatctccgaggccgatccgaagaatccgggcacccagccccgcccgacggcgggcatccagttcgtcggcgtacccgagttcaccgacctgggcacccgcgtggcgcaggagatcagcgccgccatcgcgggccggcagtcggtggacgccgcactcgccgcctcccagaagctggccgagaaggtcgcggaggagtaccgatgaccgtcaccgcaaccagagagaccgcgtccccgccggccccggcgcagaagccgggcggtggcagtcgacggcgtgcctgggcgacccgcgcccccctgctgcccgcgctcgtgttcctgatcgccgtcacgcaactgccgttcgtggcgaccctggtgatctcgttcttcgactggaactccctgaagccggagaagcgtcacttcaccgggctctccaactacgcgtccgtcttcaccgacgaggcgttgcgcgaatcggtcgtgacgaccgtcgtcctcaccgcgtccgtcgtgatcgtcagcgtcgtgctgggcctcgtcttcgccctgctgctggaccgcgcgttcttcggccgggggttcgtgcgcaccctgctgatcaccccgttcctgctggtgccggtctccgccgcgctgctgtggaagcacgcgctctacaaccccgagtacggtctgttcaacggggcgctcacctggttcggcgagctgttcggcatcgagagcgtcgcacagcccgagtggacgtcggagatgccgctgatcgccgtcgaggcgtccctcgtctggcagtggacaccgttcatgatgctgatcctgctggccgggctgcagagccggccggccgagatcatggaggccgcccggctggacggggccggaccctggcagatgttccgctacctgaccctgccgcatctgcgccgttatctcgaactcggcatcctgctcgggtcggtgtacatcgtgcagaacttcgacgcggtgttcacgatcacctccggcggtctcggcaccgccaatctcccgtacaccgtctacgagaccttctaccgggcccatgagtacgggttggcgtcggcagcgggcgtggtcgtggtgatcggcacgatcgtcatcgccaccttcgcgctccggacggtctcctccctcttccgtgaggaggcgagccgctcatgagcgcctcgaccgcgacatccgcatcagcatccgcatccgtcaacgccttcacgcgcagggcccgtcggcgctcggccgccctgggcgtggccgcctgggtcgtggggatcggtttctgtctgcccgccctgtggatggtgctgacgtccttccacgcggaggccgacgcggcgaccaacccgccgtcgctcgccgccgcgctgacgctggacggctaccgcaccttcttcggcggcgggggcggcccgacgccgtggccgccgctggtcaactcgctggcggcctcgttcttctcgaccgtactggtgctgctgctcgcgcttccggccgcgtacgcgctgtccatccggcgggtgcgcaagtggacggacgtgatgttcttcttcctgtccaccaagatgctgccggtggtcgccgggctgctgccggtgtacctgttcgcgaagaacacgggactgctggacaacatctggctgctcgtcctgctctacacctcgatgaacctgccgatcgcggtgtggatgatgcagtccttcctcgcggacgtccccgtctccatcatcgaggcggcgcaggtcgacggcgcccggctgccgacggtgctgcgccgggtcgtcgccccggtggccggtcccggcatcgccgcgacggccctgatctgcttcatcttcagctggaacgagctgttgttcgcccgggtgctgaccggcgtcgtcgccgggaccgcacccgtccatctgaccaccttcgtcaccagccagggcctcttcctcgcccagctgtgcgcggcgtccgtggtcgtgtccctgccggtgctcgtcgccggctacgccgcccaggacaaactcgtccagggcctctccctgggagcagtcaaatgagggcagccatcgtcgaagcccccggcaaggtctccgtgaccaccgtccccgaccccacgcccggcccccgcgacgtggtcgtcaaggtggcgtcctgcgggctgtgcggcaccgatctccacatcctccagggcgagttcgctccgacgctgccgatcgtgcccgggcacgagttcgccggggagatcgtcggcctcggtgcggacgtcaccgagctgtccgtcggcgacaaggtggcggtggatccatcgctgcactgccacgagtgccgctactgccgttcgggccggggcaacctctgcgacaactgggcggcgatcggcgtcaccgtgcccgggggcgccgccgagttcgcggtggcgcccgtcgccaactgcgtacgtctgccggagcacatcgacgtccgggacgcggcgctgatcgagccgctgtcctgcgcggtgcggggctacgacgtcctcaacggcaacctcggggcccaggtgctgatctacgggtccgggaccatggggctgatgatgctggagctggccaagcgcaccggcgcagcgtcggtggacatgctggacgtcaacgcccagcggctggccaccgcgacgaccctgggctgcacgggtgcggcatcccgtgccgaggagctggaccgtccgggcggctgggacgtcgtcatcgacgcaaccggcaacgccggggccatccaggacggtctggggagggtcgccaagggaggcacgttcctccagttcggggtctccgactacgccaccaccgcggtgatcgagccgtacaggatctacaaccaggagatcaccatcaccggttcgatggcggtcctgcacagttacgagcgggccgcggcgctcttcgcgagcggggtgctggacgcgtcggtgttcatcagcgaccggctgccgctggaacagtacccgcaggcgatcgagcgctttcaggcggggatcggccgcaagatcgtggtggagccgtgacggactcctcggtcccccgccccggctccgttctcgtgctcggcgaggcgctggtggatctggtgccggccgacggtgacaccggggtccgggcggcccagccgggcggggcgcccgcccggctgggc

SEQ ID NO: 2920 - DNA, 4172 bp, Unknown
  Kingdom: Bacteria, Phylum: Actinobacteria, Class: Actinobacteria, Order: Streptomycetales, Family: Streptomycetaceae, Genus: Streptomyces
gtccacggccagcgaggacggcgccgaaaccgcggcgagcaccgggatccccgccatcacggccttctgcgccagctcgaacgaggcccgccccgacaccagcaggacggcccgggacaggggcagccggtggtccgtcagcgcccgccccaccagcttgtcgaccgcgttgtgccggccgacgtcctcgcggacgtccagcaggtcgccctcctcggagaacagcgcggctccatgcaggccgcctgtccggtcgaacacccgctgcgcggcccgcagccggtccgggagggcggacagcagctccggggtgacccgcaccgggggtgcgtcggccacggggtgccgggtcgtggtgcgtaccgcgtccaggctggccttgccgcacaggccgcacgaggaggtggtgtagacgttccgctccagcgtgatgtcggggacccggaccccgggcgccagcctcacgtccaccacgttgtagctgttcaccccgtccgccgtcgccccggcgcagtagacgatcgactgcacctcgtccccctcggcgatcaccccttcgctgaccaggaagcccgccgccagcgcgaaatcgtcgcccggcgtacgcatggtgatggccagcggacggccgttcaggcggatctccaggggttcctccaccaccagggtgtccgcgcgggaggagacggcaccgtcccggatgcggagggtgcggcggcgttcggtggcccgtcccatggatgtgaaccccgattctgtccgtgtgcgatggcttctgtccgtacgggcggaagccggaacctgaccccgtcattgtccggcacccgcaccggcgtgtcgcagccgcggccacagcacgctgcccaggctgttgtcaatgctccaacgtgtgggccggattcctgtgggatcacgtgcccccgtacccgacggtagcgaccaagactggatgtttcctgccccacccgacgatgggaacccgtatgaccggctcacgtgtcgtggcgctcggccactaccagcccgccaaggtgctcaccaacgacgatctggcggccatggtcgacacgagcgacgagtggatcaccagccgggtcggtatcaagacccgccatgtgggtggcccggacgagccggtggacgagatggccgcgcacgcgggagccaaggcgctggccacggccgggctgacgccctcggacatcgatctggtcctcgtcgccacctccaccgcgatcgaccggtccccgagcacggcggcacgggtcgcggcacggctgggcatgggctcgcccgccgtcatggacatcaacgtggtgtgctccggcttcacgcacgcgctggccaccgccgaccacacgatccgggcgggtgcggcgagccgggccctggtcatcggcgccgacaagatggccgacatcgcggactggaccgaccgcagcacctgcgtcctgctcggcgacggcgcgggcgccgcggtcgtcaccgccgacccgacggcccccgacaccccggacgggcccggcatcggaccggtgctgtggggctccgtgccggagatgggcaacgcggtccggatcgagggcacgccgccgcgcttcgcgcaggagggccagtccgtctaccgctgggccaccacccagctccccccgatcgcccgccgggtctgcgagaaggcgggtatcgccccggaggacctggccgccgtcgtcctgcaccaggccaatctccggatcatcgagccggtcgcccgtaagatcggcgcggtcaacgccgtcatcgcccgggacgtggtggactccggcaacacctcggccgcctccatcccgatggccctgtccaagctggtcgagcgcggcgaggtggcctcaggcgcgcccgtcctgctcttcggattcggcggaaacctctcctacgcgggtcaggtcatccgctgcccctgaccgcctcccggacatccgggtgacctctgaccgaggacctttgtcctgggtgtggagaaagttggggcggattcctgcgcaacttcttcccactccgggaaagcgctgctacgttcccctcgaaagcccgacggactggccgatgtggcggggagggacgcgtgagacgcatgacggcacgacccgcgaacgcgcatcaggcgcggctgctcaggctgctgcgcgacgggggccccaactcccgtgcgcaactgggtgatcaggtggagctctcgcgctcgaagctcgccgtcgaggtggaccggctgctggagaccggcctggtggtggccgacggactcgccgcatcgcgcggcgggcgccgctcgcacaacatccggctcgctcccgaactgcggttcctcggggtcgacatcggcgccacctcgatcgacgtggccgtcatcaacgcggagctggaggtactgggacacctcaaccacccgatggacgtgcgcgagggccccgtcgccgtcttcgagcaggtcctgtcgctggccgccaaactgcgggcctccgggctcgccgagggcttcgacggcgcgggcatcggggtccccggccccgtccgcttccccgagggcgtgccggtcgcgccgccgatcatgcccggctgggacggtttcccggtccgcgaggcgctcagccaggagctgggctgccccgtcatggtcgacaacgacgccaacaccgcggcctgggcggaatggcgcttcggagcgggccgcggcgaggaccacctcgtcatgatcaccctcggtacgggcatcggcggcgcgatcctggaggacggccaggtcaagcgcggcaagtacggcgtggccggtgagttcggccacatgcaggtcgtgccttccggccatcgctgcccctgcggcaaccggggctgctgggagcagtacagctccggcaacgccctggtccgcgaggccagggaactggccgccgccgactccccggtcgcgcactacctgctggaccgggtgaagggccacatccccgacatcaccggcccgctcatcaccgaactggcccgcgagggcgatgcgatgtgcatcgagctcctccaggacatcggccagtggctcggcgtcggcatcgccaatctggccgccgcgctcgacccctcctgcttcgtcatcggaggcggtgtcagcgccgccgacgaccttctgatcaaccccgccagggacgccttcaagcgtcacctcaccggccgcggctaccgccccgaggcccggatcgcgaaggcgcagctcggccccgaggcgggtatggtcggcgccgcggacctggcccggctggtcgcccgccgattccgccgggccaaccggcggcgcgtcgagcggtacgagcggtacgcccagatctacgaccaggcggcgagcaccatccgcaacacgcggtccacccgtaccgctgagtgaaccgcagccgccctttccggcgtccacccttcagtacgccgtcaccgcagcagcttgaggaccacctgatcatgatcgcagccgagcaccccgtggtgccgcaccagtcggagtctccgggcgacggcgggggcaagccacccgaggacccgaggcatgtgttcaagcggcgtttcatcaccgcgacgatcatcgtgctgctgatcggcatcccggccggctacctgctgatctcggccggtcagagccgacgctcgggccaggacaaggaggccgaggcggctgcccaggggctccgcgagggctggccctccaagatgcagcgccggatcttcgagatcccgatccccggcaacgggatcggcgtccagtactacgagacgaacaactggaaagccagccggatgtacgcgaagttccggacgacctccgccggtctcgaccgcttcctgaccggagtgggcaccggacgcgcggcgctggagcccggcaagaacgacatcagcccccgggacatcaagatcaccggctggaccttcggcccgggcgagcactgggccggcaccacgcacaagaacaagaagccgcgccccacccagaacatcacggtcaacatgaccgatccggccagccctgtcgtgtatgtcgtatcggcggcgaccccctgaccggggggccggaggggcgctcagtaacctggagcgagtgagcgaagtgagcgagacgaccccgcagcccgtgcaggccccccaccccggtgggc

SEQ ID NO: 2921 - DNA, 8644 bp, Unknown
  Kingdom: Bacteria, Phylum: Actinobacteria, Class: Actinobacteria, Order: Streptomycetales, Family: Streptomycetaceae, Genus: Streptomyces
ggccaggtcggtgaccgtccccgaaggcacccgcctcgacgacatccggcgcgccgcgaacgccctcgtggccgcacacccggccctgcgcctgcggctgcgcgtcgatcacggcgtgtgggccctgcgcaccgaacccgcccgcgaggtcggcgtcggtaccccggacaccaccgacgccaccgccgcggcgaacgaggccgcaggccggctcgacccggagaccggggacgtcgtcgcgttctcctggctcgcggcgagccgcaccctggtcgtcaccgtccaccacttcgccgtggacacggtgtcctggctgatcctcctggacgacctggccaccgccctgaccggagcggacctgccgccgccgaccacctcctacgccgcgtacgccgaagcgctcgccgtgcgggccgccgagcagaccgacgacctcggccactggatcaccgccctccaggccccggccctgctgcccacggtccagggcctccgcgcaaggacggccgtcctcccgtccggcgcgagcgaccgggtgacccgcggcgcacccggcgcgctcggtatcgagctcaccgagctgctggtcggggccctgcgcaccgcgctgacccgggtccagaccgtgcccaccgacctcgccgtcgagctggagcgacacggccgggtcccggccgcggagcaccacgactactcccgtacggtcggctggttcacctccatcgcccccgtacgcctcaccgcccacaccgaccccgtcgcctccgcccgcgagatcgccgaacgccggcccgacgaggacgggcacgtcgcctacggccgtctccggtacctcaacccgcagacggccccgctcctcaccgcgcagccgcaggtcctgttcaactacctcggccggggcaacgagtcggacgccctgcggatcaccacgggcgatgtgaacagcccgtacgccgtcgaggtcaacgcctggaccgacgaggccaccggctgcctccacgcggccttcaccctcgccgagggcataccggacgcgatcaccgagcactggctcgccgcactggaacagatcgcgaacgcgtccgggagcgccgagcgcaccgcaccggtcaccccgctccagcggggcctgtacttccaggcccagatggcgggcgcggcggggcactacgtcgcgcagagctacttcgccttcgaccggcgcctggacaccgacgcgctggccgaggcgatggcgtacgtgatcgggcgccaccccgtcgtcggcgcgggtttcaccaccgacgacgacggaagtccggtccaggtcctcaaggcgggccgacgggtcgccgtccgcaccgtcgcgctgacgacggaggcggaggtcgaggacctgcgcacccgggaccgcgcgcagggcttcgacccgggggagccgccgctcgtccggatgaccgtcgtgcggatgcccgacgaccgcgacggcctgctgctcagctaccacctgctgctctgggacggctggtcccgcgagatcctgctgcgcgatctgttcgacgcgtacgaggccgtggtggcgggccggccgtgggacgcgacaccggccgtgccgggattcgaggagtacgcccggacactcgccgcgaaggacccggccgtctcggagcgcttctggatcgagcacctggcagggctgccgggaccgacgctgctcgccggaccggccccgcacctcatcgaggagctgccgcggccgctcgtgcacaccctgtccgccgaactgtcggagctgctgcgcgaagcggcgcggacccgaggcgtcaccctcaactcggtgctgaccggcgccttcggcctcttcctcggagcccgtacgggccgcggcgacgccgtcttcggcgtgaccgtctcgggccgggagggcgagggacacggcgacatcgtcggggtcctgctcaacaccgtccccctgtggacccgcgcccggcccgacgattcggtcgacgcgttcctcgcgtccgtgcaggcggcacgcgtggcggcgatggaccacgaacacctgggcctcggcgagatccagcgggccggcgggcacgacaccctgttcgacaacctgttcgtgctccagaacttcctggacctggacgccttcgccgcgatgaacgcccgccacggcatcacctccgtccgggccgacgactccacgcactacccgtacacctgggtcgtcacgcccggcgaccggctcacggtcaagctggagcaccgccacggagaccccgacagcgcccgccgtctcctggaggactacctgcgcgtcctggaggacgtggcgcgggccaccggaccggtgggcgcgctgcgcggcctgggaccggaccccgaacccgcagggcgcaccgaggtcggcaccgacaccgtcgtcgaccggttcgacctggcggccgaccgcgatccggagcgcatcgcgctcgtcgccgacggcgccacgatgaccttcgccgaactcagggagcgcagccgggccgtggcgggcgtcctcgcccggcgcggtatcggacccgagacgaccgtgggcctggcgatcccgcgctccctcgactggatcgcggccctgttcgccgtgctgcgcgtcggagccgcgtacgtgccgctggagctggaccacccggacgagcggatcgcggcgatcatcgaggacgcccagcccgaggtgatcctcaccgtgagcgcggtgtcgccccggctgaacggcgaactgatcgaactggaccgtccgttgccggaggccgaaccgtacacgacgttcgcgccggacgacccggaccggctgcgccaccccgcgtacacgatctacacctccggctcgaccgggaagcccaagggggtggtgaccgaatacgcgggtctcaccaacatgctgatcaaccatcagcggcggatcttcgagcccgtcctcgccgaccacgatcaccgggtcttccggatcgcgcacaccgtgtcgttcgcgttcgacatgtcgtgggaggagctgctgtggctcgccgacggacacgaagtccacatctgtgacgaggagttgcgacgcgacgcaccccgcctggtcgcgtactgcgtcgagcacggcatcgacgtcgtcaacgtgacgcccacctacgcccagcagttggtctccgagggcctcttggacgacccggagaggcggcccgcactggtgctgctgggcggcgaggccgtctccccgacgctgtggcaacggctcgcggagaccgagggcacggtcggctacaacctgtacgggcccaccgagtacaccatcaacaccctcggcgtcggcaccttcgagtgccaggacccggtggtcggcgtggccatcgacaacaccgaggtgtacgtcctggacccgtggctgcgtccgctgcccgacggagtgcccggcgagctgtacgtggcgggcatcggcatcgcccgcggttatctgggccggagcgcccagaccgcacaccgcttcgtcgcctgccccttcggccgtccgggggagcgcatgtaccgcaccggggacctggtgatccgccggcccgacggaaacatctcctacctgggccgcaccgaccagcaggtcaagatccgcgggcaccgggtcgaaccgggcgaggtcgaggccgtgttcgcggcacatccggcggtgcgcttcgtcgcggcggtcgcgcagcccgacccgcaggtggacggcgcccaccgcctggccgcctacctggtcctcgccgactcggcggacctggcccaggtcgccggcgaggcgggtgccggcctgccggacttcctgcgtcccacgcactacgcccaggtggacagcatcccgctgaccgtgaacgggaaggcggacaccaaggcgctgccggaggccaggcccctgggcgcgctgaccacggcgggggagcgcggcccggagaccgggacggagagcaccgtctgcgagttcttcgccgaggcgctcgacctcgacgacgacgaggtcagcgcggtgagcgacttcgtctccctcggtggccactccatgctggcggtgcggctgatcgggctcctccgccgcgagtacggtcctgtcatcaccatccgcgacctgttcaccctgcgaaccccggaagcgatcgcccgccacctcgatgagactcctgaccctgatgaaatctcctgacaccgagcggccccgcccgggggccgccatcctgcggacggcgctccgccgcaacatcggcgccatgatcgcgggcaccgtcctcatgggcctgtaccaggcggccgagaccgcgttccccatcgctctcggactgatcgtcgagcacacgatgcaggaccgcagcctcggctcgctcggcgtctcgatcggctcgctggccgtgatcatcacgacggtgtccctgtcgtggcggttcggcatgcgcgtgctgcagaaggccaacaccaccgaggcgcaccgctggcgggtgcgggtggccgcctgcggactccagccggtggccagggacgtggacctcaaatccggcgagatcctgaccatcgccaccgaggacgccgaccagaccgccgacatcatcgaggtggtgcctctgctgatcagctccctggtcgccgtcgcggtcgcggcggtcgccctgagcctggccgacctccggctgggcctgctggtgatcgtggggaccgtcgcgatcctgtcggtcctcgccgtgatgtccaagcggatcggagccagtacgcaggaacagcaggcccgggtggcccgggcgggcgccaaggtcgccgacctcatcatcgggctgcgcccgctgcacggattcggcggcaaccacgccgccttcggctcctaccgcagggtcagtacggacgcgaagcgccaggcgatcaccgtcgcccgggtgaacggcgtctacgccggcaccgcgctcgctctcaacgcggtcctcgccgcggccgtctccctgactgcgggctggctggccttcgagggccggatcaccatcggggaactcgtcatggccgtgggcctcgcgcagttcatcatggaaccgctcaagatgttctccgagatgcccaagtacgtgatgatcgcccgcgcttcggccgagcgcatggctctggtgctgaccgcgcttcccgtgacgacaccgggcccggagcgcccggagtccggcggagagctggaggtcgacggagtgcgccacgggaccctgcaggggaccaaattcaccgtcacggcaggagagttcgtggcgatcgcggcatatcagccgcgcgcggcggccgacctggccgccgtcctcgcggtgaacgtcgccccccacgcgtacgagggagtggtgcgggtcgggggccgggagatcgctgacctgtccatcgagtcggtccgcgagcacctgctggtgaatccctacgacggggagatcttcgccggcacgctccggacgaacatcgacccgtcgggcaccggtcggacgatcgaggcggccgtcgaggcctccatgctcaccgacgtcgtcgccctccaccgcgaggggctcgactacgcgatccgcgaccggggcgcgaacctctccggggggcagcggcaacggctctcgctggcccgcgcgttggccgccgacgccgaagtgctggtcctgcacgatccgacgacggccgtcgacgcggtgaccgaacagctcatcgcgcgcaacgtcgcgaagctgcgcaggggccggaccacgctcgtgctcaccagcagtccggcgctcctggacgccgcggaccgggtgctcgtcctcgacgagggcgtcatcaccgccgaggacacccaccgcaacctcctcgccggggacgaggcctactgccgggccgtggccaggtgaaccccagggcggtcccggggtgcgcccgcgcaccccgggaacctctcagccgagagcccaggcgacgtccctgagcagggcgtgccgccagcccgcccggtcgtgcccggacgccgaacgcgacacccggaccgtggcgccggcctgctcggtcagcgtctcggtcagctcgcagtgcggcagcatcgggcgctcgtgctcgcccacgtcgaacgcgcaccgcagccgcgacagatcggcgccccggcgcagtcgctcggcgaggaccccgccgacaggccctcccagcggatcgggcaacgcctccgtgccgggcgcccaccagaaggaccccgactggcaggcgacccgcgagaccaactccgggaactccagcgccgcgtacagcgcgctcagaccgcccaggctctgcccggcgaccaccagccgctccgggtcggccggcacgcccgactcggccaccagcggcagcagttcgtcccggaccgcctcccacagctcggatcggcaggtgaactcggcctcgcggtccttggccggcaggaacacgagggtcaccgggggcatgtcacccgcggcgacggccgcgtcgaaggcggtcacggccgggtgcagatacagccagtcgtccccgtcgagcaggagcacgaccggaccgcctcctcccgccgggtggacgcgcacggtgcgccgaccgccgagccggtcgctgctccagcggatccgggtgcgggggagggggagcacgtcgtccgcgccgagggcgggccagtgaggctgagcaggggcgtccggcgtcgcgacgacggaacggtccgccccggcgccgaccgggttgaacggatcggcgtgcgccgcgtcccccgcgaggacgcggtaggtcacccgcagccgcgcgggcatccgcacttcggcgtaccagcaatccgtgccgccccagcggcgcaacgggacgggcgccgaccagctctcgaagtcgagcacggcctcggaaccgcgccacaggaagagggtccgccaaccgtcgtcggcggggatcgagacgggcgcgcgagccgccgcccagaacgtgtcgccgccgggacggcccgggagaccgaaggcggcgaacggattctcgtcggtcaccggaggcatgagcgtctccttgtgagagaggaagaggcgaggctggagctccccctggatgaggtgagcctaacccagcggtcctgaaggggggttggcggtccggtccccgaagactgccggtcggcccggggaggccgcgcgcaacatccggagctgcccgatctccgccacgttcttcatcagctcggcgttcacccacgcggcggtgtgggcgacggtgtggtccggcccctgcgcccagggagacggggaggcggcgtcgagtgccgcgtcgtccaggccgtccagcacccccagccactcctcccggagctcacgcagccggccgatggctccctcggcgtcacccgaccacgcgatgtcctcccggtcccggggctgccggcccaggcagtgctcgaccgtcgtgctccaccaccagtcgatgtgccagctgagccaggcgatcgtcggcaccggaacgggatcgggctccgtctccgcccagtccggcatccaccgcccgtcggcccgtaggcgcaccgtccagcacaacggcgtcggctgccagaggaagtcctcggtgtcgagccgctccaggtggtactcgaacagcgaccaggtcagatcgaactggcggcgcagaaggtcacatcgcgaggcgttcaccgggcgaccctgacacacccgtgcgcccccgacaacgcgctttcccgcggtccggggcctgcggccgggcggcggtccgtgttctagtacgcggcgagccgttccatcagggcggcaccgcgcgcgagcgtctcctgctcgtcctcgtcgagttcgaggtcgatggcccgggagagccagtcggcacggcggtcgcgctccgcctccagcgcggcccgtcccacgtcggagaggtcgacgagggacttgcggccgtccgtcgggtgcgcccggcggacgacgaggccctggtccatgaggagtccgaccgcgcgggccatcgactgggggcgcacacgctggtccgccgcgagatcgctggtggtcatggccccgtcccggtcgagggcgcccagaacggcgacctgaccgtgcgggatccggtcctcctgcttcacgcgtcgcgcgagtttgcccatggcgacgcgcagatcggcggcgacggtggcgggctccggggtgggcatagggcactttaacccgtgatcgtcagcgggtctccgcaggcggcctgcggagcaaatagacagcacaactgaacagcaaggctaagcagccatgctgaacagcagatctgaacagctttgctgtagagttgcgtcgtcgcggctcgcgccggcgttgtcgcaagactgccgcgacgtgtgacttcggaaggacctcgcatggcccccaaggcagttgagcccaccgtcatccagtccgtcaccgctcgccggatcatcgacagccggggcaaccccaccgtcgaggccgacgtccgcctcaccgacggttccctcggtcgtgcggcggtcccctccggggcctccaccggcgcccgggaggccgtggaactgcgcgacggggaccacgggcagtggcacggcaagggggtcgaccgcgcggtcgcccacgtcaacggcgagatcgcggccgcggtcacgggccgcgacgcgggcgaccaggcgggcctggac

SEQ ID NO: 2922 - DNA, 9588 bp, Unknown
  Kingdom: Bacteria, Phylum: Actinobacteria, Class: Actinobacteria, Order: Streptomycetales, Family: Streptomycetaceae, Genus: Streptomyces
gtgctcgcgcaggcgcagtgcgccggggcggccggcgatgtcgtgggcgtgttcggcggcgccggggacggcgtgggtgctccaggcgctgccgagggcgtacacgagggtgtcgtacgacaaggtctccggctcgccggttccttccgggtccgtgacggacaccgtacggcggtcgacgtcgatgcccgtgaccttcccgagccgcagccggacacccgtgccggcgaacatctcgtcgaagggccgggggcggaggtcctggcccaccgcgagctggtgcatccggacgcgctcgacgaagtccgcttcggcgttgacgagggtgatggagacgtcctcacggtgcagccgcctggcgaggcgtccggcggcagtcgctccggtgtagccggctccgatgacgatgacgcggtgctgctggatgttctgctgcatgtcctgcactcctgtctcgcgcggtttcgcctcttgaaccgggcagcccgtcgattcctgacaggtgggctatgtgacgcgcgtcacaggtggtcagtcgatgcggagggccggttctccgtggtccgtcgccgcccactgacgcgtcgcgcggtcgagcttgtcggggttggcctggttacggaacgcggcgatgccgtccgccgtgatctccagacacatgacgccgatgacccggccgtcgacggtgaccacgagcgcgggcagcccgttggcgtacgagacgtggatctccgcggtgccaccgaggaggttgcgagcggcctggttgggggtgaacaggctccgcatgaacttcgcgacggccacggccccctcgaacggcctggtgcgggccggtacctttccgccgccgtcgccgatcgcgacggcgtccgcggtgaggagccggacgagcggttcggtccggccgctggtggcggccgtgaggaactcgtcgacgatccgccgggcggcggcctcgtcgatctccgtacgggtcctgccctccgcgatgtgcttcttggcgcggtggaagatctgctggccggatgcctcggtgatgtcgaggatctccgcgatcctccggtgcgggtagccgaaggcctcccgcagcacgtacaccacccgctcgttgggggacaggcgctccatgagggcgaggacggcgaacgagaccgactcgcgctgttcgacggtgtcggcggggccgagcatcgggtccccggcgagcagcggttcgggcagccactggcccacataggtctcgcgccgggcgcgcgccgaggtgagctggttgaggcagaggttggtgaggaccttcgtcagccaggcctcggggacctcgatgcggtcgacgtcggcggactgccagcgcaggaacgtgtcctgaacggcgtcctcagcgtcgctcgcggagccgaggaggcggtaggcgatggccttcagccggggcatggacgcctcgaacaggtcgatctggttcccggtcagcaccatggctcggatcctaaggggaacggtgtgcgacggcgcaggcgcaccggtggtgcggtgggcacggtcgggcgcactggtggtgcggtgcgtgggccggctaggcggtggtgtccgccgcggcgaagtcggcctccagccgcgggatgtagtcggcgaacgcgggggcccagcagccgtagttgtggccgccgtcgcaggtgggcgacagcgaggagccgttgccgtagtcgaccaggcgggcgggcaggccgagctggtccaggcgggatttgaccgtcctggtggcgaccgcggtgacggagtcgatcatcccctggtcgccggtgtagagcgtgaccttcgcgccccgcagccgggcgaggttggccgaagcggccgggttgaccgcgttccagacgcggtcggcgccgaagaccgggtacggggagccgaagacggcgtcgctgtcgacgtagggcccgtagcccgtgcaggcgccggtgcccgacggggtggaggtgctcaccgcgcaccacgcgccggtgaggttcagttccgtggcgacgacggcggcgcgaatcgccggcatgccgaagtcgatgccgccggacagggcggccgtgtggccgaacaggtcgggacgggcctcggcgtagcggagggctccgtaaccgcccatcgacaggccgacgaccgcccggtggtccttgccgggcagggtacggaggttggcgtcgatgaaggggacgacctgttcgaggtggaaggtctgccagttggccgcgcccaccgcggtgttctgcatgacccagtcggcgtaccagcccttcagtccaccgtccggcacgacggtgatcatcttgttcgagcgcagcgcgggggccgcggcggcgtcgtccacggtgccgcccccgccgtgcaggaagtacgtcacgggccaccgtttgccggggtccgccgcgtagccctcggggaggaagacgcggatcttgtgggggccggacacctgcggggtggtcacggtgagggtgaagtccgtctccgagcgcacctccgtggcgtcgacgacccgggtcaggccgtggctgtcggtgaagtcggggatcacgggggtgtcggcgcgcgccgtcggcgctgcggcgaacgcggtcagcatcgtcatcgccacggtcacggcggccgcggccgcggctccggcgcgcaacccggcgagggctcgtacgccggacgtcagggggttcatgaggcggttctccttcggacggggcggttgctccggcgggtcgggctacgggttggtggtgacctggaatcccgcgccgtagacaccggggtgtgcggtgttccgggcgcgcaggtcggcgaggatgttcgcggagctggtgtagacgtacggcggcactcccagggcgatggccttggtgatgccggcccagggtccggcagcctggaagccgttcgcggaggagggataggcgctgccgggtacgtgccagatcgccgggcctcccgaatcgccgcccttgtgcggggcccaggactggtagacgccctgggcggcgttggtgacgcggccgtagttgacgccgagctggccggagaccaccagttcgttgttgttgaacagggccgcgccgagcaggcgttcgctgttcggcgccgggctgagggcgttggggctgggctgaccgccggggacctccagcacacccgtctgcttcaggtgcggaccctgcgaggagagcaccaccctcggctccagctcgatgatcatgtagtccttggtggcgtgccccaccatcgagccctcggggtccttgaagtaacgcaggtgaccgatcggtccggaggcggtgtcgttccggtcgtagacgggctggatgttctcggggatgtcgcggtcggcgtacttcttgtcgttcacgcagtgccccgcggagatggcgatcttccgctggtacgcgtcggtgccgaccgcgccgatcgtgcagaaggcgttgggcgtgtccggccggaagatgatctgcatgccgttgaagacgcgcttctccgctccggcgccggacgcggtggcggcagcggcggtggaggccgtgatgcccgtcaggaccaggaggaatcccaggactcctgcgagcagtacgggtattcgtcgtatccgctccgtccgctccgtccgctccgttcgttcgatgcgctccatctgctggttccgctgattcctttgttgtcggtgcatgtgtgttcctctcggtggtggggtcgggttccgttgggtttcggctatcggcggcacgaggccgcgatgaccagcagcacgatggtgatgcccaggaacggcaggcagcccaggccgccctgcggatttccgcgatggacttccacatggccaccgggaggaattccggggtgtttccgggcgtagtggtcgatctgttgccgctcggcccgggacgcgttgagccaaggcgtttttgaggtgcattcgccgcaccagtagcgataggccatgccggttcctcacccgtcgttcctctgctgctccgccgacgatcgcgtttccgcagctcggcggacaggccagggcaccggccatctatggccggtccggtcaccgcgctagactcgccgccgtccgggcgggctaggcgggggaccgaagtgacggatcggctcggcatattggtgcgccgcttgcgcacgcaggcgggactgacgcaggaacagatggcggagcggtccggggtgagcgtgcgcaccatccgccgactggagacgggaaaggccgccgatcaccggctgggaacggtgaatctcctggccgatgccctcgatctcggagccgaggaccgccggcagctcgcggccgtactcgcaccggcggacccctcgccgattcccttacagggaaaggcgaatggtgatagcgacgccgattcgcatgtcggtgtcgatccgggcggacctgtcggcggcgaatccgaacccgaaatcgaacccgaacccgaaatcgaagtcgaatccgaacccgaatccgaagtcgatcgcgtgctcgccggcgcggcccgggaattggcgcgggaggtcgggcgtcgttggcagaaggaagaggaacaacgccgggtccacgacccgtttccgttgccggtgcgctggaaccgggcgcccgcccggctgaccgaccacgcggagaacatccagcgccttccgccgggcgtccggccggagcccatggagccgacgggtgatctgcggagcgtggccgaggcctaccggaggattccgtccgggcggctggtgattctcggccgggccggttcgggcaagtccatcatggcgatccggctcgtcctggatctgctcggcggcccggaccgctcccgccgggtcccggtgatcttcggcgtcggagcctgggacgcgacggccgtggcgttacgggactggctcgtcgatctcctcctgcgcgactacccgcatctggcccgccggacccccggcggctccaccctggccgccgcgctggtcgacgccgggctcatcctgcccgtcctggacgggttcgacgagatcgccgaggggctgcggcaggaggcgctcgaagcgctgaacgcgacctcgttgccgctcgtgctgaccagcagggccggggagtacaccgaggccgtacgagcggcgcgtgcgccgctggtctgggccgccgggatcgaactcgccggtctcacccccgacgacctctcggcctacctgtcgaggaccgcccgcccggccgcccaggagggacgggtgtccggaggggaagggggcgagggcggcgaggcgctgtgggacctcgtcctggaggtgctgcggagcgggaaggaccgggcgggcggacgtctcgccgaggtgttgagcacccctttgatgatcgccctggcgcgcacgatgtacagcgaggcccccggccgggaccccgcggaactgctggacgccggacggtttcccaccacgagttccctggaggaccatctgctggctggcttcgtgcccacggtctaccggccccgcgtcgccgagcgggccgcgacgggggacccggaccgcgaccggcgacaggaccggcgggaccgggaccggcggcgtaactgggaccccgaccgtgccgggcactggctgggacacctcgcccatcatctggtccggctcgaccgcgaccggcacgatctcgcctggtggcagatcggcgaatcactgccccgctcgacgcgcgtcctgaccgtcgccctggtctccgcgctctgcgtcaccgtgtccgactgggccgtcgtcctgctcgtcgccccgatcacccccggcgaggcgctggtgcagggagccgtggtcggcccggtcggcggtctcgccttcgggtgcttctacgcggcgatggccgcgttcggcggcggctccttcgccccgagccaggtgcgcctgcggctgcgcggccggaccgacggcatcgggcgcagaccggtgcgcacgttcaccgaccggttcgcggccgtcgtgccgggcgggttcgtgatgggcatcgggtgcgcgtgcgccttcgccctccaacgggccctgtacgaggggcgttcgctcaccgaccccgcgctggtcgaggctctgctcatcaacatgctggtcctcgggctgatcttcagctcggccgccggactggtcttcgggctcctggccgcgctcgaaacacccctggacgtcgggtccgcggccaccccggccggtctgctgtccgagaaccgggcgaccgtgtaccggcaggtcctcgtcatcgtgcccgtgctcaccctggccatcgtgctcggcggtggcctcgtcgtccgtctgctcgccggcgttctcgggccgatgagctggaagctgccggaaggactcgtcatcggagccgtgggcgggctcggcgggggcctctcgtacgccctctgcttcaccgcctggggccagtggctgatcttctcccggctcctgctgccgctcaccggaaagctgccctggagcccggaggacttcctcgacgacgcctaccggcggggtgtgctgcgccgctccggggccgtctaccagttccgccacgtccgtctccagcaccacctcgggcacacgtaccgccggaggcagggcaactacacgccggccacgttctccggacagcccttagcatcgccgggccggtccgaccggtagatctggtgccgaggtgagcggggtccggggtgtccggtggatggtggtgcgacggggtgcggtggccggggcaggcgcccgagctggggtggcgcaggggcggtgaccggcgggtgagcgtgctcgcgtacggggccggcctcgggttccgggccctcggggagcggcactgcgtgggagcacgggggaacgtctgcccgctgggcgccgcggtgccggggcgctccaccggcgggcggtgcgccgaatgcgcgcggctggaccgggcgcactcggtggccgccgacacgatggcggacgacccccggacgtaccgcgtgtatctcgcctggttcgggcccgggatggtcaaggtcgggatcaccggggaggagcgcggggccgcccggctgcgggagcagggggccgtggtcttcagctggctggggcgcggacccctcatggcggcccggcggaccgaggaggtgctgcgggcggctctcggggtgcccgaccggatcccgtacgccaggaagcgggccgtgcgcgggcggctgccgggggccgaggagcgggccgtcgaggtggcggagctgtacgggcgggccgcgcggcccgaagggggcggctggcccgagtcgttggagcggctgccgctcgaagtcgtcgaccaggcccagctcttcgggatcgaccggacgccccctcccgtccggtcggtgcgggagctggtcgacgggggtgtcgtcgcggggcggctcgtcgcggcggccggacccgatctgcatctggcggtggaccgtgggggcgtggtcgtcctggacacgcggctgatcaccgggtgggacctcgcggccgtaccggacgtttccgtacgcgcgggggccggatccgacgcggtagcgggttcgaaggccgtgcgcgcggaggcggggagcgatgtacgtgtccccctcatcgacatcggcggcggtggtgtgcagggtgggttgttctgaccgtcgaccgagggagagcgtccgtggggccggagagcgatgacgtggtgcggttctgggagcggctcgggctgcccgggatcatcgacgtgcacacccacttcatgcccgagcaggtcctgcgcaaggtgtgggcctacttcgacgccgccgggccgctcaccggcctggagtggccgatcacctaccggtacgaggaggaggcgcggctgacggtgctgcgctcgttcggggtgctgcgcttcacctccatgctctacccgcacaaacccggcatggcccgctggctgaacggctgggccgccgacttcgccgcccggacccccgactgtctgcacaccgcgaccctcttcccggaggacggcgtggaggtgtacgtgaaggaggccgtcgaggcgggggcccgggtcttcaagtcgcacctccaggtcggcgcgtacgacgccaacgacccgctcctggaccccgtgtgggggctgctcgcggaggccgggatcccggtggtgacgcactgcgggtcgggtcccgcgccgggtgcgtacaccgggccggagccgatcgggcggctgctggcgcgccatccccggctgcggctggtcgtcgcgcacatggggatgccggagtacgcggagttcctggcgctggcggaggcgtatccggaggtcaggctcgacacgacgatggcgttcaccgacttcagcgaggggttcagccccttcccgacggcggagcgggggaggctcgcggacctcggggaccgcatcctgctggggaccgacttcccgaacatcccctacccgtacgtccatcagctccatgcgctggagcggctcgggctgggggacgagtggttgcgggcggtctgtcacgggaacgccgccgcgttgttccccgctcaggactcctagaacccccgccgctttctcaggaaattcacaggaacgggtcaggcttctctcacgggtgactcacagagtggtccccatgacgacgacgacctcgccccaggggcgtaccgaactgctcaggccggaccgtacccccgtccgggtcctggtcgtggacgacgaggctccgctcaccgagctgctgtcgatggccctgcggtacgaggggtgggaggtgcgcagcgccggggacggggccggggccgtccgggccgcgcgggacttccgcccggacgcggtggtcctggacgtgatgctcccggacatggacgggctgtccgtgctgggccggctgcgccgcgagtacgacgatgtgccggtcctcttcctgaccgcccgggactccgtcgaggaccggatcgccgggctcaccgcgggcggcgacgactacgtgaccaagccgttcagcctggaggaggtcgtggcccggctgcgcgggctcatccgccgctcgggctcggccgtcgccgccgggcgcggcgagtccacgctcgtcgtcggggacctggtgctcgacgaggacagccacgaggtgagccggggcggggacgcgatccacgtcacggccaccgagttcgagctgctgcgcttcctgatgcgcaatccgcgccgggtgctcagcaaggcgcagatcctcgaccgggtctggaactacgacttcggcggccaggccaacgtcgtcgagctctacatctcctacctccgcaagaagatcgacgccggccgcacgccgatgatccacacccggcgcggcgcggggtatctgatcaagcccggtgagtaggagaggggacgccggggtgctgcggcggccgtggacgctgcggacccggctcgtcgtggccgccgtctcgctcatcgcggtcgtcgcggccgtcatcgggaccgtcaccgccatcgccttccacagctacatgtacggcaggctcgacgaccagctgcactccgtcgccgagcgcgcccagcgccctcccggcccggggccggggccccaggcg

SEQ ID NO: 2923 - DNA, 17982 bp, Unknown
  Kingdom: Bacteria, Phylum: Actinobacteria, Class: Actinobacteria, Order: Streptomycetales, Family: Streptomycetaceae, Genus: Streptomyces
gtgcggcggccggcggcttcgtcgccgccgaggtcggcacccgcgccgtgttcggcgccggtgcggtcgtcatggccctggtcgcggtggggctcctcgtgggcgcccgccgccggtggatcacccgcgccgagccggctccgctgccgacgggaacggactgagcgggcagccgtccggcgtgccgcaggacgccggcaccgtatcgatcacaccgtccactccggaaggaacgtcccatgacgaccacgagtcctcccacgccgcccaggtcgcggttgggccacgcgtacggggagcagctcgcgcggaacgcgccgaagggccaccccgcggcggcagccctggagtccgccaccctgaagctggcgtaccaggaccggttcctgaacggacccgccttccttcgcgagagcgagctccgcaccctcgtgggagacctccacaccgtctacggcctgctgcgctcgctgccggagcgcgggttcgacgggagcatccccgcgctgaccgcggcggtcggcctggaccccctgcaatcggcgctgatcacgcggagcgcccggaccggctcactcctcccgctggggcgggccgacctctatcacgacggtacggggttcaaactcctcgaattcaatatcaccagcgcgctcggcggcttcgagaacgccgacatcaaccgggcgatgctggcgtatccaccgcttgaggagttcgtacggagccacggactccgctacgaggacaccctgggccacatggtgcggaccatgtacgccgagtgcgccgcgaacatccccgccgaccgggcacccgtcgtcgccgtggtggacacggtggagaacttcgccgtcgtgggacctcggctgcgggtgttcgccgagaagctggccgactacggggtcgaggggatcgcctgcgacctcggcgagatcacctacccgaacagccgtccgacggcctcgggccgtaccgtcgacgtcgtcttccggtacttcctgcccgaagacctcaccgacccgaccgcggcggcccagctggagccgctgctgaccgccgtcgagcagggcaggctgggcctgttcagccgactggacgccgagctgtacggcaacaagggcaccctggcgatgctctccgacgagcagcaccgcgaccggtacgacgccgccgaactggcgtgcctggaccggctcctgccgtggacgcgctatgtgcgcccgcgcaccacggaccccggcggcacccggatcgacctgctcccccacgccctgggtcaccagcacgagctgatcctgaagccgaccctgctgcacggcggcaacggcatcatcgccggctggcaggtggaccccgcagagtgggaaagccgggtcacctcgtcgatgaacggcccgttcgtgctccagcgccgggtgcgtcccgccgccgagccgtttcccgacggcgccggcggcgtgcgggaactcttcctcaactggggcctctacctgagcgcacgcggcaccgaggacgacgggtacgcgggaggtttcgtgcggggcagcgccgatcccgccgtgggagtggtcagcatgggcagcggcgccacggtcggctgcgtcttccacggcggcgaccgctgatccccctccgccgaaccgacgggtgccgggcagtgagcgcgccggtcccaccggtccgtccgtggcggcacgaggaagcgtgcgcggctgccgcccgacggcggcttcgacgccgcccggactcaaagatccgccgcgaggaacggccgcagcagggacagcagggcgtcgggacggtccagggggatgatgtggccgcagtcttcgatgacgtggccttccaagttatcggcgtaagggcgcagttggtgttctagagcgcggcccactgggtgagcgccgatcgtcatcgcgggaacggtcaaccgggccgagtccacggctgaccggatgtggcgggcggacgccggcagcgcccggtacgggccgaacgcggcgcgtagcgcatcgccggccgcgtaggcctggacgatcggcgcgcgcacgtcctgcggtaccccgcggccgagtgtgccgcggttgaggaaccactccacgtaccgctcctcgtgaccctccagcactgactccgccagaccgggctcgccgtggaagccgaaccaccacggcgggccgtcggcgaggaagccctcggccccgggcagccggcccagcagcgactccatgatcaccaatcgccgtacgaggtcgggcctgcgcatggccaggaggaaggcgggcggggtgccgacgtcgatgcccaccacggccgcggagggggcgccgaccacctccagcaggcattcggcgtcgtcggccagcgttccggcgtcgtagccgtccgcgggccgggcactgccgccgaagccccgcaggtccggtgcgatcacccggtagcgcgtggccagctcgccgatgacatggctccatacccgccaggtgtgcgggaagccgtgcagcagcaggaccgcgggcccctgccccgcggtcgccacgtcgagttcgacgccgttggccgtgactcggcgcaactcgacctcggagggaggctccgggcgagaggggtcggcgggcagggggacggtcctggtggtcatgtgcgctccagcggtatctattagttacaaggaaacattaggtaagtacactgacgtgtccaagacggcactttctcctcaggtggtgagctccaggtgacctcccaggtcagggacgattccggcgtgcgcggcgacctgttcgacccgcagtgcccgacacgtcggctgctcgaccggatcggcacgaagtggacatcgatggcggtcaaggtgctggcagaggcctccccgcaggaggtgcgcttcgcggaactgcagcgccggatgccgggggtctcacagaagatgctctcggtgacgctgcagaacctggtgcgcgacggcctggtcacgcgccgcgtcgagccgacagctccgccccgcgtgcactaccggatcaccgaactcggcctgtcactcgaggtcgcgctcgccggcctccgcgcctgggccgaagagcacatggccgaggtcgaccgggcaaacgagtagccacggggcggaagagccggcttgagcggctgcgttcgaatgcgccgggcctgcacggcgacgcggcctcacgatcgcctgtcggtgacatgtgccgccgggcggaccgacaggggaacagctccggagccgagccgctgccgatcctccgggccgagcatgtcgcgaatggcggtatcgatcccgttcggcacgctgtgcgcacccccgccggagccgggtgcgtccggagtcggcggcgcacgccacgcatcgctgagacgagctgctctctcggtcgacggccgccggggaatgccgcgcggcggccgaagccgaccgtggaaagtccgtgccccctatacagtgccgagatggtttcggagctgcagcgacttgtcgacgcgttcggcgcccgccttggtcggtcgatcgccatcgacgacacgcgactcaagctgctcgcgtacaacgcgcacaccggtgacgtggacgacgcccggatcgaatcggtcgtgcaccgtggtgtgtcgaccgcgctggtcgcgcacgtcggcgagcagggcgccgcccaggcttccgatgtcttcactcttccgccgtgcccccggatcggcatcacgatggaacgggtcggcatgccgatccgctatgacgatgccctgctcggctacgtatggctgatcggctccgacggcccggtcggcgaccgggccgtcggattgctgcgcgaggccgctgcgcaagccgccctggtcctgcaccgcggccaccttggcgtcgaagcgacgcgcagccacgccagggagctggtccgcgacctgatcgccccggaccaggcactccggacggaggcgggcgccgcgctcgtcgaggaggaacacgccgtggccggcccggtcgccgtgctggtagcgacggtgggggccgaggagggcgagcctctgtctgaagaacgccgtctggccctggagctcgccgtcgaccgctgtcgacggcggcttcctccctcacgcggattggccctcacgcgcccggatcacgcgctcctgctgacgatctggccgggggcacgttcccaggccatcgagcgccatgccgccgagcttgccgaggtgctgcgcgaaaagctggtagcggaactcggctcgggaggcgccgccctgtgctgggtgggcgtcggcgggccacgcccacgcctcacggagtccctctcctcctacgaggaagcccgccgcgctgccgaggtcgcccgtatcacgggcaccatgggtcacgtggtggctcacgcacagctgggggtgtacgcgctcttgggcaagctcactcccgaccagcttgccgaggccatccacccggggctgcgctccctgctttcgcaccccgcgcaccgtggactggtggaaactctgcgggtgtatctcgatcacgccggcgatgcccagcatgccgccaccgccctgcatatccaccgctccacactctacaaacggctgcatcgcgtcgagcagctcactggactgcgactggacgtcggcgatgaccgacttgccgcgcatctcggcctgaagacggcagagttgcacccccgcttgccggcgtcgatgaacgcgccggacgtgacgttctgagcacgggcagcagccgggcaagcacggttgccggccgggggtgccctcgcccgtcaggtggccgatgcgctgacggggcacgcggttcctcggccgacgtcagccgaggactgtgcccgtggatggggcaggccgacgacggcgggagaacgcaccgaggtcgatggtttggccggtgtgctcgcaggtgtgcgtgagcgcactttggtcgtggtcgtgcccgtcttcgacaccgtggatcagggtggtcatgaggcggcctaccagaggagcgttcttgaactgattgccgctggtgcctatggccacgtagaagccggcaagctcggttcggtcgtacacaggggtccagtcgtcggtcacgtcgtatacgcctgccacaccacgcggcttgttgggaacgcgcaggccgggcagtcggcgtgccgcccgcgtcacctgtgtcctgaactgcgacacggtcggcgtgggcctcccgtcgtccggatcgtcgagccattccagcgggtcgcactcgggttccgtgccgccgataagcaggaactccctgccctcgggccgtatgtacgtgccgaggtccatatcggccagcaccgatgggtgccggtcgccgtcggcgtcgtggtagcccgcgggcgccgccacgtggtgcacctcctggcgcagcggccgcagagcgacggtgaagtcgccgcccacttcggcgagccggttcagctgtcccgaccaagggccggccgcgttgacgaccaccccggcggacagttcggttccatccttgaggcgcaccccgcgcacgcgtcctccgctccgcatcaccgcggtgacgggggtcttccaccggaaggcggctccgtgccgctgggccgccgtagcaaggttgtgcgcggcgagttgcgggtcgtcgatgaagcccccgtcgggtgtgtggagagcaccgagccgagcggacgcgtcggcgaagaacgcgtcgtcatccacgggacggggtgggaagtaccggccggtgtccacggcgggcacccgcttggacagctctcgcgcatcccatttctcgtacgggacaccgaccttgtcgaagtgtcgcgtgaacatgccgcagggtgcgatgtccacgtccagcagggtgacgccgcagcggttgaacgctgcgaggggttcaccggcgggtgcctggagatggtcgcgccacgcgtcccagcagtgacgggactcccaagccgcgttgacgcccgcgatcgtggggtaggtgaagcggaccacggcgctcgatgcgctggtggagccgttgcctgcgccgccgaacttgtcgaccacgacgacccgcagcccgctccgcgccagttcgagagcgatggaggatccgatcaccccggcccccacgacgactacgtctgtgctctcagccatgttccaacccaccttctcgctgcgggaccagacagttcctccggcggcgcggaagggtcgccgctccgccgttgtccgaacattacgcaggtcggagtccctgcttccggcgacggttgtcgccacttgccgtccccgtacccgacagttgtcgcggctctgccagcgggaggacggagccgtcgggcgccgccccagggcgagcagcagccctctccacccggaccgaacatgcgtttggcgcacggacaagcgaagcgaccaagggtcgaggctgtttgtcagcgcgtccgcggacagggtccgagggatcaggtgaggcggcggcaagggccaagagcccgctcaacgctccggacgtgatcgcggaacggatcgaccctctctcatgcgcaggatcaaggtgaccgcgtcctccgagcgggttccgggagtcaggatctcctgcaggaggaggccgcgaatcgcggcagtggtgacggtggccacgtcccgcgcttccgtcgtgccgagcccttcgcgctccgcgagtgaggacagcatcacggtcaggtcgccgatcgactccacgaactcacggaagtcctcggggacgtacgcggccagtccggcgacgtagaagaagccgcgggcgcgcgacagctgctccggccgggtgtaagtacgccagatcgccacgacgaaatcgtcgaaggtgccctgctgggccgcctccaacagtgcctcgttgtcacgggatcgctgcgccgtgagcatggcggccaggacgcccgagagtgacccgaagtggtagcgcaacagggcgtggctggtctcgatccggccggcgacctcgcggagcgacatctccggcgggggaagagcctcgccgaaggcgtcgagaagccgtgccaggagtcgctcgcgcgcgctgcccttgcgttctgaggttgacaggatcactcccacagtttatccattggaaaagaaaggttggcggttccgtgttgcttcgcacatggtcgcagtcagcccgcaacggcggaggatcgaccatgggacctgtacatgtagtcggagcggcggtcatcgacggatcggggcgcgatcccagcaatatcgacatcacgatcgagaacggccgcatcacccgactcggcgcctccagcgcgcacggcgagcgtctcgatgccgaggggttgacgatgacgcccggcctgatcgacgctcacgtccacctgggcctttcgagcccgattcagccgcacttctcgtttcaggtgagcgccgccgagatcgcggcggacatcttcgccacggccggcgcaacgctcgacgccggcttcaccaccgttcgtgacaccggcgggatcgacggcggtgtcgtcaccgcgatcgcgaagggcaaggtcagagggccacgcgtcctgtcgtgcggacctgttcagtgccagatcggcgggcatggctactacggagccgcatgggaacccaccgagctgtggagcagccaccacataccgggcctgtgcgccctctccctgatggcgggcaacgcggacgagctgcgacacaacgtccgcgaagccttccgccgcggagcctccttcctgaagctctgcgtcaccggcggagtggtgggcgcacatgatcggctgaccgacacccagttcaccgtcgaagagatcgctgtcgctgttcaagaagctgcggcgcggaacacctacgtgaccgttcacgcccacaacaacgagggcatacgccatgcggtcgaggccggggtgcgctgtgtcgagcacggcaccagcctcgacgaatccacagcggccctgatggccgctcgcgaggttgccctcgtgcccacgttcgctgtcgtcgagcaactgctgcacgacgccgccggagccggtctcaccgagtcgacccgcgaccgagtcgaaggcgtacgcgagcagatgacgcaggcgctcgccatcgccaagcgcgcaggggtacggatcgggctgggatccgatctcatcggtccggcccaggaccgtcgcggcagagagctcagcctgcgcgcggccctcgggacgccgatggaagcgctcgtggcggcgacccggaccaacgccgagatcctcggcctgtccggccaggtgggtgtcatctctcccggcgcgcaggcggacctcattctttggaacggcaacccgctcgaagacccagaactgttctccgaccccaccaacgtcgtcctggtcatccaggccggccagatcgtgaaggacctcagatgagcaccatgtggcagggctgcctcgcccacaccgactatttcgagatgcgttccagcggggggcacgactacggcgtctgggtcaccacgccaccgaactacgaccctgccgcgacgcaggcaccggtcctgtacgtcctcgacggcaactggaccgtgggcatgaccgccccgctcatcgtcacgcaactggaccccatgcagtccattcagccctacgtccaagtcagcgtgggctacgcgggcgaggaagcggagcagtgggaacgcctgcgcaaccgcgacctcgtgccccccggcgaacccatcgcgaaggagtacatcgatgcggtggagatggggatcgaaacaggcacgatgacgcgcggacaagccgacgcctacctcgctgaactgagcgccagccgcggggacatgttcctgaacttcctcaccgacgacctgcacccgcggatcgaacgcgactaccgcacagccccgagcggtcacggtctcttcggttactcctacggcggactcttcagcctctacgcctggctcaccaacagcaccttcttccacagcatcggcgcgggcagccccggcatcatcaacggggacagccaggtcttcgcccttcttcaagccatgggtgacacgttgcccgcgaccaagcttcacgtgaccttcaacgaccgggagatcctcggagacctggcggtctaccagaacctcgcgaagaacgcggccacgttccttcaccggctcacctcacgcggcggatccgtcaccagcgcactcatgcacgaaacgcacgtgaccgggctgcaggcatcgttcctcagctacctcaggacctgccgtgcccagtaggcctggacgcctcgcctctgcctgaccgccgcgccgggcggcggcgctcctggtcagtgccgccgcccgagtgcctggcaccactcgccgcacggagggcatcctcgatctcgccgagtttcgctgaggacagggcgcccgcccgctcgatcaggtcgtcccggaacacggtggtgagccacgtgcaaggggtcaagcccggctgcgggaacgcgaaccgcagcacgccttcgaagggcagtccttccacggcgcccactgccacttcgacgcccagaccgctgatgtcgacgcctgccggagcgacgacctgcatcacccggatcccggacgcgtcgtctcccgacagcagtacgaccggtcgccgctcgtcgaactcgacccaccagacttcgccacgttgcacatgacctcctgacaggggacggcaggtggacgctgcgcgacccggacgcgctgcggagacgagtgcgccacggttgaccaccggtgtgtgaagaccgaagatcatgcggtggtcgcaggtcacagcgtagaccctgctcgctggctggacgccttcgagggctgatgagccggacagcggggcggttcgcgcggatcgaacaccggttcagggtgcggaggtcggtgctcgtactgctgtcggacctgccgcgcaggaactgctggaccatcagggcgaggaacctggcgtcctggatgccgctgtcttccggtcccgcgagggcgtagagcgtcgcgccgaccacagcgaggcgccgtttcccgcccggagccgtccgggtggtcagtccagggcggggcgcgtgcggcgtgcggtgggtgcgggccgtccgaccgcggcgtaccagaccagggccgcacatatgaaggccgtcgccgcggagaccaatgaccttgtgagggagtcgttccgtgcgccggaggcgagggcgacggccagtgccggcgtcagggtgatgacgggcagcgcacgggggatccgcgtcgcgcccggtacggggactggcggcagcagccaggttgcgaggccgtaacaggcacaggccagcagggtggctcccagcacttcgctgggccggtggccacccatggtcgaactggcggctgcgatacaggcgagccacagcacaccggccatggcgacgtaggggcggacgcggggggaaaccacgaggactgccgcgagggtcagcgcggcggggatggccgtgtgcccgctggggaaaccttgatcaaggagattctccggcgcgcccaccagatcggggcgcggcaggatggtcgatttgagcacctccttgcctccggtggtgagaatgacgaccccgagcgccgcgcatccctgccgccagcaccgccgcacgagggtgaggaccacgatgacggccaggcccaccatcagggtgggtttggcgctcaactccatcggcggcaggggcgtcgagccgtaggccgctcctgacagggggtagatccatgccacttcgctcccctgtgtactgagatgaaacagggcgttctcagctcgttgcccccacggggtgcagatggcgagcaggtagaccgtcaggaaccccagggtgtacagcagagccggcatccacggccgtgtcgtacgcgacgggccggagtcgtcgagggtctcggggtcctgcctcgaggcccccgggcggtgcgcaggcagggacagcgaatcgtgctgagtcatcactttcgtttcttccgtcgggggagtgcggtcacgcaccccttccggcacgacgtgggcctccgggctcggcgggcccaccggagggccgctcctattcggcgaatgcctgcccctgtcggcgttgcgcggcgatcgccagggcggggaggggtgcgatcagcaggatgaggacgaccaggtccggaaaggactgcgtgaacgcgtccggccggacgacgatcgcctgcatgcggacgaccgcgaacgccgcgacggggatcagccaccggcggtcgccggtggcggccgtcgccacccacgcggcgatcagcgcggtgacttcgaggacgaacagaccgcgttggaaagccggactgacggcgatgatgtgcaggtacccggccacgaacatggcgagcacgacgggggccagccagcggtacgagcggcgccgcagacggctgggacggtagagcgccagcacggcgcacgcggcgcacagcgcccccgaaagcaccaggtcacgggccgttatcggggcgccaagaccgtagtagcccaggcccgccttgccctcgtcgccgaagagggtgcggccgtggagcgtgccgccggcccagatcatggctgccgcggccggcagcgcgatccacggtctgccgcgcagcagggcgatcaggcagcccagcgggagcagtccgtagggcagcagccgtacccgcgtgggaccttcggcccacggataccagccggagaattggaaggcgatggcgtgctctccggggtcgatgcgcagggcccagtgccacacatcctgcaagtacggaaccagcgccagcgcggcgagggcgagggcggccagatggatgccgtccagccaccacggccgggccgtgtcgtcgacgacggcacgggcgcgggcctgaaccccggcgtgcaccagggcggcagcttcccgcggcgggggccaggagcggccgggatacgcctcggacaggcaggccagcacctcctctccctgccgggaacggtaggactcgggataggccgcaagcagcagacgattcatgccggggccgctccggcatcccttgaatgtccgatcacgacggccgccgcctgcttcatccgcagcgcctcccggccgagcgcctcggtgccgtcctcggtgagccggtagtagcgccgcgcccgcccgtccacgatctcctcatgcccggcggccaccagtccggcccgctccatccgctccagcgcgccgtagagagtgccgacagcgatccggagccgcccgtcggtggcctgttcggcagccttgatgatgccgtaaccgtgcaacggaccatccatgagtgcagcaaggatgaagtactgcggttccgtcaagggcggattctgtctggtcatacgccgagtatatatcgagctacgaagtatctctgcccggccctgggtgatcgccagtggccggcggacgcgcaccgcgagctggtccggaccgcgcggcatgtcattcccaccgggtcggccgccccggggcctgccggggggcggcgcgagcatcggcaagcggaccgtccgtgaccaccacatggtcctcgaacccgctgccgtcggctccatcacgtccgccttcgctgagcgggaagcccgtgtggccgcctcgtgtcctggacgacgtgcggcacggcgtcggccggcttccgggcccggcccgcggcggggacggagcagctcgcgaaagccgggccggccgcgcggtgcggcgggcccggcgttcggctaccagccggccttcacctcgttgtaggccgtacggcagtcggcgttggtggcctctgcggccagcttcgtcatggagttcgtccagaccttcttggcgagcttctccagctcccgcgtctcggcggggacgttcggggcgtacttcttgatcgtcgccaaggcggacctggcgaacttgttgcacaccggtccggcggcgttgcggtagcgggtgtccaggtccgtggcgacggcctgtccgttgtcggtcgcccaggtgttccaggccgcgcacgccacctcggtgagggcctcctgctcggcctcgctcagtccgagaacctcggccagcatggcgttcttggccttgtccgggaccgtgaagtccgtcacggggaacttgtcgagggtttcgagcagcgcctcctggcacgcgggaggcagcggagccgcctgcgcggtggacggggcggccaggacggaggcggagaggagcgccgcggtgagaacagcgcgctggacggtacgcgaaagagtcatgagggtagtactccttgcacggaagagcgtgtcggtccaagcaccgcgtcggtgcccggcggctcaagaacgaccgccctccgtctcaggtcacggctcctgtcagcgggacgttgatcagctgcgccgtacgtgtcgttccgccggcgggacgtgccgcgcgggggccggtggcccgccggtgctcccgccgctcgcgggcccggagggggccggcacggtccgtggcctccgtgccggcgccaacgcgttgcgggtgcgccggcgaaagaccaggaatcccgccgcggcggctccgacgagccagagcagctgggtcacgagaccctggaccgccgacgcgtcggagaaggccgcggacatgctggcctgcacggctccgtacgtcggcaggaagcgcacgaccgcgctgtccgagccggaactggacaggggattctggagggcgacatcgaggacgctgatcatcaggatggcgaacatgccttccacctcgcggcggagtaccgatccgaagaccacgccgagcgcgccgtaggtcagggcggcgcagaacagcccggccgcgagcaggaggggctgctggggcggccaggcgagctcgatcacggccgtggcgtacacggcgatggcgccgcacaccagcgtgagtgcgcagagcttggccaggacgaggtgataccgcgggtatccggccatggccaggcggcggtcgaaggcgcctcccgtgaaggtggccgcgaacatcatgaacccggcgatcagcgtgacggcgttcagcgctccggtgatctgggtgaggtggttgccgggcggggacaggatgtcgcctgtggcccggagccggaacggcgccggctggtcgggaatggtcagataggccagggcgatccatacggggatgtacacgaccacgagcagcatcgcgaaccggttgcgggcatgtccgatcagcgcgtaccgggacgcggtggccagcagtgaccagtgccgcctcatgccgccgcctccgtgcaccgttcctgcgggtggaggcgcccgccctccaggcgccagagcaggtccagccggtcgatgtcgtacgccaggtgggagacgaccagcaccgagcgccccgtgtcgcgcagcctcgtcgccagttcccagaagcacaggtacgtctcccagtcgaagccctggtagggctcgtccagcaggaggacgtccgggtcgtgcatgagcgccagggtcaggttcaacttctgtcgggagcctccgctgagcaggccggcccgctggtcgaggtaggcggtgaaggccagggcctccatcacttcctcggcgcgtccgaggtccgggaggccgaacgcgtacttgaagaagtcgaggtgctggcggacggtgaaggagtcgtccagcaccacggactgcgggcagtagccgaacctgctcctgtggctcaccgagccgcggtccggcctgagttcaccggagaggatcttcagcagggtcgtcttgcccgcgccgttctccccgacgatgccggcgagggtgccgggccgtagctggaggtcgacgccgcggagaacggcatgctgccggtaggagtggtgcacatctgtgacgtccatcgtgtcgctccgtcgtacaggtttccgagctgatggccgcgggaccggacccccgttcgccggccggccggccttccgggtggccgctctgcggcgatccggtccgctcgtgcccaacgagcggacccggcggcggatacggtgtcggccgccggtgcaccccctgccgtcaaccccgtgcagggcatgtcatccgtgcgacgggtgcaccgccgaaggcgggttcaaaggccgctggatgagtgagggtcgtcccgtggcgtgaccgggcccggccctcatgaccacgtccaggagaggttcgtgcccgcgctcgggcccactcccccagcggtcccggttccggcgcgcaccgggacatcacgcagcccagagaaggtcggtcagccatgagaacgtgcgtgatcggagcaggcccgtccggtctggccgcgagcaaggtccttgcctcgcggaacgtccccttcgactgtttcgaggccggttcgcggatcggcgggctctggcgctacggcaacgacaacggcatgtcgggggtgtacgcgtcgctgcacgcgaacatctcgaaggagagcatgtcgttctcctcgctggccatgccggacagctacccggtctttccccaccacagcaaggtcctcgcctatctggaggactacgccgcgtcgttcgctctgcaccgccacatcaccctcggcacggaggtcacctcggtgcggccgctggacgacggcggctgggaagtcgtccgccggccccgcggaagcgcggactcggaggtgacggcgcagcgctacaccgcggtggtggtggccaacgggcaccactgggctccccgcctcccggaccccgccgtgcccggggccgaggacttcgaggggtccgccgtccactcgcacgactaccgcgtcccggaaccgtacgccggacgccgggtgctggtcatcggcatgggcaactccgcgtgcgagatcgccgcggaggtctcccgctcggccgcacggacgtacctctccgcacgccacccggcgcacgtgttccccaagatgctgctcggccggccggcggaccacttggcggggagcccgctcgcgggcctcccccggttcctcaaaggcccggcgatggcacttctcctgcggctgacccgtggcaccccgggcctctacggacttccccgtcccgtccgcggtcccctcgccgcccatccctccacttcggacgaactcctcgtccaactggcccggggtgcgatcaccccgaagcccggcgtcagttcgttcggccgggacacggtggccttcacggacggcagccgagaagccgtggacgccgtggtgtacgccaccggttactccatcctcttcccgttcctggaccccgcggtcttcgccgccccggacggccgcacggagctctttctgcgcacggtgccgccccggctccccggcctctacttcatggggctcgctcagcccgccggtgccgccttccccttgctcgaaccacaggcggaatgggtcgccgacctgatcaccggagcggtcgctccgccgtcgccgcgggccatgaagcgggccatcgaccgtgagcgtctacgccagggcaggacctacgtgtccacctaccgtcatgggatcgagatcgacgtccgctcctaccggaaggccctgcgccaggaactccgcgcgggcagacgccgcgcgcgcggagcggtgccgccccggcccgccggggccggtcccgctccggcggccgacgccgtgtgatccggcccgcgcggccccgtcggcagcccgcgcgggacagccgacagcctcactccggggccgagctcttctccagctcgcccaccgcctgctcccacaactccggcagcagttccccctgcggcagagcgcggtcggcgacgaaggacacctcggcccagcccccgaagaacgacagccccaccccgaagaggtgccagggcacgagcggaggcagcagggcggcgcccgtcacctgcgtctcccccaggcttcccttgtccgcgagcggcatggaggtggtcatgacgttggtgacccgcgcggagagcatccttcggaggtaccactcggtggggcggcccggcatgaagcggaccaggtcctgaatcgcctgccgccaggtgtcgccccgtaccttccgggtcgtcgccatgacgtgctcaagccgtcgcagggacgcgtcgccgccaggcccgtccggctgttccgcgacggcccgcacgggcagttccagcggcagggcgaagcaccggtttccccacgtctggtcctcgtcggggcggcgtgcgtcgatgggcagcacagccgtcacccggggaagaggtacgcccgagcggtccgaccagaccgacaacgccccggccagcgccgccagatgtacgtcgtgggccgagccgccgcgtgcggcgccgatgccacgcagcgtgtccgtcggtacacggccccgccacagccgccgttccccggttggcacgaaggcggggcccgggcggtgaccgcgaacggtgagggagccggccatgaacttcgccgccagtccgacagccgcgcccacccgtcggggcaccccggaccgacggctccggcccggcaccgggcgcgccgacggctccccctcgcccagcatggtgcggaaggtcatggcggcggccgaaccgtcctgacaggcgtggtggaagcggtagcacacggcgtacgcatcgggggcatggccgtggatcagccagaccccccagaaggcgccgggggcgaagggggcgttgagggccgtgttcagagcggcctcccatccgtcggggccgtcggcggccacctcgtgcacatgccggtcgacggagaagtccgcgtccggttgccaccggggccgccggccgccttcgacccggctggtgagcagaggcagccggccgaggcggaagccgacgtacgcgcgaaagtcggccagggtcggaggcgggccgctgaggtaggcgacgccaccggcgtcccagcgcacgtcgggccgacgacgcgccagtctgaggaacgcgcggtcgatcgagtgggtggggtggctggggggagggacagccgcagcgggcggtccggacc

SEQ ID NO: 2924 - DNA, 4453 bp, Unknown
  Kingdom: Bacteria, Phylum: Actinobacteria, Class: Actinobacteria, Order: Streptomycetales, Family: Streptomycetaceae, Genus: Streptomyces
gtcgcggccgggccggctgccgccgtggattcgaccggacggtgatggtgatgtcggtggatccgtcgtgcaccgcccgttcggcctcgtccgcgtcggcgcccgcgaagaccaggatgtccgcggcgaccagccgtacgctctcccccaccgcgaccgggagggccgcacccgtgtccggagctccccggacgatgccgagggtcgcgcgtaccgcgtgccggaaaacggcacggtttccgggagcggctgccagcgcttccaagaccccggacagcccccgtaccgtgggggcgattgtctgtctgtgcaccgtgtcgagagccgcggcgccgcggatgagggtgaggcagctgttgccgagcaggtccaggtatctcgtggccgcgatctcctggtggacgggttcctgccggccgcgccaatggggggtacgccgggcaacggcgatggcgtcgctccgtgttccgccgagatcgttcagcagggtgtggacggggcgcgactcttcccacggctgagcttcccgctcctcggccgactcctccagcgcccgtgctgtcagctccagtgcacggcccagacccttcagtgtggcggtctcggcacgtctcagcagtgcgagcgggtgcggcgggaagagcagttggctgaacacgagtgctacgcccgctccgagcagggcgtcctggacgcggtcgatgcccgcctgcgctccggccgcgacggagatcaccgcgcccaccgcggcctgggccatcgtgatgcgctgcccgtcgaggagcagcgcgacgaggagcgcgcacagcacggcgacgccgaccgcggcgtcaccgtggccgaggaagtggaacgccagttgcccgacgatgacgcccgcgacgactccggacatgacccgcacagcgttggtgccgcgcccgccgacgggtgtgttgagcgcgaccagggtcgcgatcggggcgaagagggggacgtgatggtcgaagacgttcccggcgatcgaccaggagagtgcggccgccacggcctgctggagcacaggccacaggttgtccctgacgcgcagccacgcttcgtacatcgtcctcttcggccctcgtcgggacgccgggaagatcccgcgctgtcccccggagcctcgccgcttcgggcggccggtgcacccacagcgcgtccgggtgacgcaacgccttcacccggccggctcgatgccgaccgcgcggggcccgtccgactgaccgtcgtcgaacaggcgagagcccagctcgtgccagttccgcaggccggggagccgggcggctgcctccggtccccaggtccccggtgcgtacggcaggggcggctcggccgggtcgagcacgggctccacgatgcgccagcactccaggacggtggggaagaaggcgaagcactcgggatcgccgatgacggctccgtacaggatgttctcgtacgggagttcctgccgtcccagtacctgggcgaagtcgacgccgatcggcacggtcatcggcccggtggtgctgtcgggcttgctcagcatcaggtccgccctgatcccggtgtcgccgtcgacgcggaagcggatggtgttcggtggcgtccctgtgtcctggccgccgaagagctccaggggcggtttgcgcagctcgaccaccacctcggtggcggagacggccagcgccttgccgctgcgaaggtagaagggcacatccgcccagcgccagttgtcgacgaacatacgggtcgcgaagtacgtctcggtggtggagcccggcctgacgccctcgacgtcccgatagccttcgtactggccccgaacggtgtcggcggggtccatggtgcgggtcgcgtggagtgcccgccatttctccagcccctgcgcccgggcgttggtggcgctcggcggttccatcaccaggagggccaggacctggagcatgtggttctggaccacgtcgcgcagacagcccaccgcgtcgtagaaggagccgcggtcggcgacgtcgaagtcctcggcgagggtgatctggacgttgtccacataggagcggtgccagatcggtgcgagcagcgtgttggcgaaccgggagaccatcaggctctcgaccgcgcggttgcccaggaagtggtcgacgcgcagcagatggccgtcgtcgaagtgggcggagagttcgtcctgcagcttccgtgcggagtcgaggtcgtgtccgaacggcttctccaccaccaggcgggcgtcacggttgaggtcctcggcggccagcgaaccggcgaccttggtgaacagcgacggtgggatcgccaggtagtacgtcacgaagccgagtccggccacggctcggcgcagccgggcgaaggtcgcggcgtcggcgaagtccccggtgacgatggacaggcccgccgcgaaccgggcgaagaccgcctcgtcgatgtccgttcccgcggcggctaccgcctctcgcgcgtgtctgcgcagggcgtcgtcgtcccagtcggtggcggccaccccgatgacgggaacggtcagcttgccggactcggtgagccggtacagcgcgggcagcagcatcttcctggcgaggtcaccggagatgccgaagagcaccaaggcgtcggagtgttgctgatcgggagggctgaggagggtgtcgctcatgacgagcgccctttctgcggggaggccgccttcggggaactgtccggagggtcctgctcgtgccggaagcgggccttgagcgcctcttcgatctgttcggggtcgcgacccctggtctcgggcaggtagcggccgacgaagaagaacgcgagcacgcagatccctgcgaagatccagaaggtctcgccctgaccgatggcagcagccaggggcaggaaggccaggctgacgatgaagttggacacccagttgaccgccgtggccacactcgacccctccgcccggacggacggcgggaagatctcacccagcagcgtccagaacaccggtccgaggccgcccgcgtaggcggcgatgtagatgaccatgaacagcagtgtcagcaccgagttcatgccgaccacgaacgcgagtccgagcatgaagatcgagaccgccatgagggccagcgagacgagaaccatgacgcgacggccggcccggtcgaccagacggatcgcgatcagcgtcatgagcaggttgatcacaccgatgaacacggagtagaagatcgaattcgacgcgttcagacccgtctgctgaatgatggtcggcgcgtaatagatgatcgtgttgatgccgccgaactgctgcacgacggcaagcgtgagcccgacgacgagggcagggcgcaggtcgggggtgaggagcttcctgggtccctggccgggtgccccggcatgccgtttctgcttctcgcgctccgcggcgatccggtgctgggcccgtgcgaccagttcgtccgccgtggcctcgtcggtgaccgaggcgatccccctgcgcgccctgtccacctggccatgagagatgagccactggggcgactcgggaaggaaccacagggtcgccgccaccatgaggacggcaggaaccgcgccgacggcgaacatggcccgccacatctcactgctcgaaaaggcgaggttcaccaggtaggcgatcaggatgccgagcgtgatcatcaactggttcatcgtgagcagccgcccacggatcttcgtcggtgagatctcggacagatagaccggcaccgtcgccgacgccgctccgaccgcgaggccgaggatgacacggcccgccacgagcatcgcgtatccgttcgccgtggtcacgaccgccgtgccgatgatgaacaccacgccgaccgcgcccagggccttcctccggccgaggctctcggagagccggccggccgaggtggcgccgatcaccgcgccgacgagcagcacgctgaccacgctgccctgctcgaaggagctgagatggaagtcttccttgacgtagagcagggcaccggacacgacccccgtgtcgaagccgaagaggaaaccccccagagcgatcgcggccgcccagcgcgtgatcttccgctgtccctcggggggaacgtcggtgagcggcccgtgggtgcctggttctttggagaagccctgaaccatgtcacttcctcatgtcttcagcctcgttgcggccacaccatcacttttcatgacgaacggatacggaagcggagcaatcgagtggtccgagggtgacccgcactcccgcggcgccggcatcgacggcagggccacccgtggttgccccggccggcgtagtgctggtggcccgggcgggacgagcggtggaggctgctgagcaggcacagcgatgtggcgccgtcgccccagccgtccgggaggcgggaacgctcatggcggagaccggcagcgacgcaggcacgagcccggacgaggaggacgcggcccggtc

SEQ ID NO: 2925 - DNA, 2582 bp, Unknown
  Kingdom: Bacteria, Phylum: Actinobacteria, Class: Actinobacteria, Order: Streptomycetales, Family: Streptomycetaceae, Genus: Streptomyces
cggcgggaggggttacgagcgtacttcgaggagggggacgagctgttccacgggggtcagggagccgtgtacgcccaccatcgccgactcgtgcggctcgttgacggaggccgtgatgatcacgtcgtcgtgggcggcggcgaccacgtcgccgatccgtccgtacacccgctcgtcgatcgtcggcccgaaccatccggccgcgatggcctcgtcccggctcgcgacccagaactgctcgccgagcacctcgcgccagacggtcaggacgtcggcctccgcacccggcaccgcgtagacgtggcgggcgcgcccctcaccgccgaggagggcgacaccggcgcgcagctcccagtcctcgtcgaagtcgatccgggactgctcgtcgaacgggatgtcgatcatgccgtggtcggcggtgatgtagagagccgagcgcggcgggagctgctcggcgaggcgtcgggcgagcccgtcgacgtacatcagctgaccgcgccaggcgtcggagtcggtgccgaagcggtggcccttgccgtcgacctcgctgtagtacgtgtagacgagcgagcggtcgccggcggccaggcgctgggcggcgacgtccatccggtcctcgccggagagccggccgaggaaggagccgccgctgagcgcgaccttggtgaggggggtctgctcgaacgtcggcgcggagacctgcgcggtgtgcacgcccgcggcgtcggcgagctggaagaccgtggggtacggctgccagaccttcggcgcggtccacggcttccagcggagctggttcatcagctcgccggtctccgggttgcgcgcggtgtagccggggagcccgtgctcgccgggcggcagccccgtaccgaccgaggcgagcgaggtggcggtggtggaggggaagcccgcggtgagcggacggccggtgccgccgcgcgagctcgggagaagggagtgcaggaagggcgcctcgtccgggtgggccttgatctgctcccagccgaggccgtcgatcaggaagacgcagttgcggtcggccggggtcagctcggggatcgcggcggtgaagccgggcacttcctgtccggcggcgagggtcggcagcaggtcggcgagcgagccgctgccgtactcgggcacgggcgcggtgtcgaggggcagcagaacggggtcctgccaggcgggctgggccatcagcggccggtcgccgcggtggcggccgtggcctcggagagcgactgggcgaaggcgagggtctggcgcacggcgtcggggccgtcaccggcctcgctgacccgcaggctcaggtcgtcggcggtggagctgccggtgtaaccgtggtcggcctcgcagttggcgtcgccgcaggcggcgggctccagatcgatccgggagaccgcgccccagccgatggtgaggacgacctcgcggggcagtgtgcccgggacgtacttctccgggttggccacgacgcggctgaccacgacggaggagatccgctccagcttcaccgactcggtggaggtggtggcgtacggcgtcggggagctggtgtcggcggcctgctcgtcggtgtggctgacgatgaaccggtgctcggtcaggacgaggaccgtcacatgacggcgcacctcgttggagtcgaacgtggtctcctggtgcaccaggtacgaagcgaccggttccccgccgacggcggcctccaccgcctcggccacgagggccgggtagtagccgctgcgctcgatcgccgcgcgcagcccctgggtcgtcgtaccggtctttgccatgagcaccatcctacggcggaccggtgactgccggggacgccccggtgggcagacccaccggcaattggggggtgggtgaaggagcggggctgggggcgtgcaactgcgaggcggaggattgaggcagatggggtctcccctgctcgagcggagccgagagcttggggacggagccatggtgattgacgacgacgcggcggatgcgcgtgcccagccccgcgacgccgccgccccactcgtcggtgggtctcagtagttcggaaggcggcgggggccgaggtcgctgcgggcgggcggcggcgcgagccggacgctcgcaccgagcacgctcagtccgtgcggagcgacgacgaccggttcgagggcgacggagaccacctcggggtggtcgtcgaccagccgggacagccgcagcagcagctcttcgagcgcggccgtgtcgaccggggccgaaccccgccagccgaacagcaccggggccgccctgatggaccggatcagctcggcggcgtcgcggtcggtggcggggaccagccggtgcgcggtgtcgccgagcagttcggagggcgcgcccgcgaggccgaaggagaggacggccccggctgccgcgtcgatggaggcgcggacgacggtgtccacgccgcgcggggccatcgcctggacgacggggagcagttcggcgggcttgccgaggagatcggtcagctctccgtacgcccggcgcagcgcctcctcgtcggcgatgtcgaggcggaccccgccgaggtcggcgcggtggcgcaggtg

SEQ ID NO: 2926 - DNA, 697 bp, Unknown
  Kingdom: Bacteria, Phylum: Actinobacteria, Class: Actinobacteria, Order: Streptomycetales, Family: Streptomycetaceae, Genus: Streptomyces
tcggcgggctgcccgacgacgacgagcgtgcccgaccaggtggcgcgggccgcggccagcgcgtcggcggctccggcgagccacgtgacgtgcagatcgtgaccgcaggcgtgcatcacgccgtcgaccgtggaggcgtactccagaccggtggcctcctggaccgggagtgcgtccatgtcgccgcgcagccagacggtcggaccgtcgccgttggcgaggacacccaccaccccggtacggccgacgccctccgtcacggcgtagccggccgcccgcaaccgccgggcgagcttcgcggcggtgcggtgttcctggaaggccagctccgggtgtcggtggaggtcctggtagaagtcctccagggccacggacttcaagtcggcggtgatctcctgcgtgaggcgggcgacggcggtcggttcgctcatgccgcttcctccttctcttcgaatgtcggcacgctcgccagaagacggcgcgtataagggtgttgtgggtcgcggtagacgtcccgcaccgggccctgctccaccagttcgccctgacacaggacagcgacctcgtcgctgacatggcggacgacagccaggtcatgggaaatgaagatcatcgtgagggacagggaccgccgtagttcctcaaggaggttgagcacctcggcctgtacggaggcatccagcgccgaggtgatctc

SEQ ID NO: 2927 - DNA, 3701 bp, Unknown
  Kingdom: Bacteria, Phylum: Actinobacteria, Class: Actinobacteria, Order: Streptomycetales, Family: Streptomycetaceae, Genus: Streptomyces
ggcagggagggccggtgcggggtcggcagcaggggggaagggcggcccggtgggtcaggcccgtacggaagcgcccggcgtgctcgccgggggcttccgtacgcgccggaacctcagcaggcccttctggagcagcagcgtcagcgtgcccgcgagaatgatcccgccgaggttggcgagcagttgctgcccggagccgacggtctgctggtagtcggagtagctgaacgcgacggccgcgttggcggcggccgggacggtcgtcaccgagatcgccaccccgatcagcgctccggacttcgcggaggtgagcgagagcgtcccggcgacgcccgcgaggaacgccacgacgaacgacatccagtccgggtgccagatgaacccggtgttgggccggggcttgtcgatcatcccgctgttgaagaggccgaaggcgtccatcagccaggcgaatcccgcagtgatgatcatcgccagcgcgaagccgccgatcagcgcccacagcgagcgcgccaccaggcgcggggcgcgttgcaccagggccgtggagatcccggccagcggaccgaactccgggccgaccgccatcgcgcccacgatcagcaccgcgttgtcgagcatcacgccgcaggcggcgagcatcgtggcgagggcgaggaaggagacgtaggtgatggagaacgtcgactcctcgtgcgtcgcctccgtcagctcctcccacagcaccgcgtcggcgccgtcgcccggagcctcctcctccgcccggtcggcgtggtcggagagcgtcagctccatgttctccatggtgatcgacccggaccggtcgacgccgagtcggcgcagcgcaccgatcagctcgtcgcctgcctcgcgcgccacgtcgcacatgaccacgtcaccggcgggggagcgggcggcgcccggcaggaccaccagatgggcggtgccgacggtcgactccagcagggcgacgacctcgtccgtggtgtcggcgggcacgatcagacgcaggtgcagcacgtggcggccgcccttccggggcgcagtggtcggacgggtcaggggtcagagcttgcgcagggacagtctctggaccttgtggtccggccccttgcggagcaccagggtggcacggccgcgcgtcggagccacgttctccagcagattgggcttgttgatggtccgccacatggtgcgcgcgtagtccagcgactcctcctcggagacctgggtgtacttgcggaagtacgaggacgggtcctggaacgccgtggcccgcagcttgcggaagcggttcaggtaccaggtctcgatgtcctcggcgcgcgcgtccacgtacacgctgaagtcgaagtagtcggcgagcccgaccctggtgcggccgtcgctgccgggcagtgcgggctggaggacgttgaggccctcgacgatgaggatgtcgggacggcgcacggtgagccgctcgccggggacgatgtcgtagatcaggtgcgagtagacgggcgcggtcacctcgtccttgcccgccttgatgtcggcgacgaaccgggtcagggcgcgccggtcgtaggactcggggaaccctttgcgggaggtcagcccgcgcgccttgagctccttcatcggcagcaggaacccgtccgtggtcaccagctcgacgcgcgggtgctcgggccagcgggccagcagcgcctggaggatacgggcgctggtggacttgccgacggcgacactgcccgcgacccctatgacgaacggggtgccgcgctgggccccgtgcccgttcccggcgtccccgaggaaggtgttcagcgcgccgcgcagcccggaggtggcctggacgtacaggttgagcagccgggagagcggcagatagacgtcccgcacctcgtccaggtcgatgacgtccccgagcccccgcagccgctccacctcgtcggcggtcagcggcagcggcgtcttgtcccgcagcgcgctccactcgtcgcgcgagaggtcgacgtagggggtcggcgcgtgctcggtgcgacggtgggggctccgtgcgggtgaggtgatcacctgttcattgttgcgggagttttaacggagtggggggtgggctcggtcacgtgggtgcaagggcgcacgcgccaccgcagcccggatccgctacagatccgccatcttcttggcgaccgccttaccgggattcgtgagcaccaggcccagcttgtccaggcccacgagcggtttggccacgaacggcttgctctggaggaaggcgagcgcggcgtcgaaccgctcctccggcagacccagcctcgtgagcacctgctccttggtgcccgagatcctgaacttgtccgacgccgccgccttgagcgcggacatgatggcgcgcgcgtcctcgtgcccggcccacgccgggcccgcattctccggtgcggcgttcgccgggccggccgcgggcggtacggcgttgacgtcggacgaggcgaccgggccggccgacgaactctgcccgaactttcggtcctcctcgtccttccagtacttcgccgcctccgcctcctggttcgtacggaaccgctggagcgccttggcgatctccgcggagtagtccgcacccgtcgccgggttgcgtggcggccgatgggggtcgtaggtgacaccgaagttggccgccatgtccatcacgaagtgatagcggtggatgtcggtgaggtcgcgccggtactccgtgtaccacagggccagcagtgagtaggcgatggtctccttcacccgggggtcggcaccggtccggtcggccagtttcatcagcttgccggtcgtcctcgacggccccagcgacaccgggtagcccaggcgtccggcggcgcgcacctggccgttgttctggttgggcgtggccatggccccccggaaggtctggggtacggccgtccgctccaactggtcggtcccctgtcccggcgccccggccgggccggccagggcccaggcgggggagttccgttcccctccgagtccctgatcgtccttgaacacgtaccccttgaactcctcctcggagacctccacatgctcctggaggccgttcagggtgtagaggatctcggcgacgtcgtggatggcgctgatgagcgtcgcgaacttctgcgcctcgggctgggccaggatcgacgccagcgtcttctggccgtactcgacgtagggcaggtagagccggcccgtcgtggccagttcggaggtggtcttcgcgagctcggcctgcaacgcctgcgcctgactcttctgcttttcgagccagggcgagaggtgctgctcgacgaaaccggccagggtcttcaggatctcctggtcggccgcgaccgcctgggcgatctcccgctccacgtcggcgaccgggagggcgttggcgcggtccagcacggcggccgcggcctcgtccatcgtcccgtagaagcgggccagcgcgtccggggagcccgctgggcgatcctcgcccgtcgctttcggcgcggagggcgccggggcttcggtccactcccggagtacccgggcgatcgcgggccggttgtcgcgtttctcccaggctctgatcagctggtcgtccgtgagcccctggcggatcgtggtgtacgccgtgtcggcgtcgggcgcctggttcttcttcccgcccagggcgagatagcgctggaccggcgccggtccag

SEQ ID NO: 2928 - DNA, 2490 bp, Unknown
  Kingdom: Bacteria, Phylum: Actinobacteria, Class: Actinobacteria, Order: Streptomycetales, Family: Streptomycetaceae, Genus: Streptomyces
ggccggacggcttcgccgtgtgcgcgtgcgaggccgctactgcgcgccggggcgcaccagcccgctctcgtacgcgtacaccgcggcctgcacccggtcccgcaggcccaacttcgtgagcacatggcccacatgcgtcttgaccgtcgtctcgctgacgaacagatccgccgcgatctccgcgttcgacaggccccgcgccaccagcttcaggacctcgacctcacggtccgtcagcgtgtgcagggcgtccggcaccgggtcctcaccggacggcagatgatccgcgtacttgtccagcaaccgtcgcgtgatgctcggcgcgagcatcgcctcgcccgccgccaccacccggatcgcctgcaccagctcggccgccggagcgtccttcagcaggaagccgctcgcccccgcacgcagcgcctccaccacgtactcgtcgagatcgaaggtggtcagcaccagcaccttcgccggaccgtccttcccggggccggtgatctgacgggtcgcctccaccccgtccatccgcggcatccggatgtccatcagcaccacatcgggctgcagcgcccgcacctgatcgatggcctgcagaccgtcaccggcctcaccgaccaccgccagatcgccttcggcctccagaatcatccggaaaccggtgcgcagcagaggctggtcatcgaccagaaggacgcggatcgccacaggaactccttaagggccctcaagggccacggcacggccggcctcggcccggaccggtcccattctgccctggtcatcctcacccgaagccgcagggcggaccgacagcgggtataccgggggagtcccgccgaattccggacacaccgcctggtggtcgcaccagccgcacagcttcgtcggccggggccgccagtcaccggtctccgtcgccagcgagatcgcgtcccacagtgccagcagcttgcgctccacccgctccaggtccgccaccaccgggtcgtacgtcagcacgtccccgctgcccaggtagaccagctggaggcggcgcggcacgacgcccttcagccgccagatcaccagcgcgtagaacgtcatctggaacagcggcccctcggaatactccggccgcggcgccttccccgtcttgtagtccacgatccggacctcgccgctcggcgcgacgtccacccggtcgatcaccccgcgcagccgcagccccgactccagctccgtctcgacgaacagctcgcgctccgccggttcgagacgcgtcgggtcctccagcgagaaccaccggtccaccaaccgctccgcctcacccagccagcgcgtcaggcgctcgccctcggtgtccccggcgaacagcccggtcagctccggcttcgactccagcagccggtcccactggccgggaatcagcgcccgtgcccgcggcgccgtccggtcggccgccggggcgtcgaagagccgctccagcaccgcatggaccagcgtgccgcgggtagccgcctcgctgggcttctccggcagcttgtcgatgacccggaagcggtagagcaagggacactgcatgaaatcgctcgcccgcgacggcgacagggacgaaggcggctggggcggccgcggcacggaagtcatgtctccagaccctacggcccgccactgacagcgagcggcataccatcgacggcagaccctcgcacactgcatgatcgtggcaaacgccactcaccgaaccgaagggaccccgtggacgacagcggcgacagcgggcggccgcagcccggcgcagggggaacggcccccggcaccgatcccgacaacggcaagccgaagcgccccgccgagccgggcggcggcctgctcatgggccggcccttcggtgtgcccgtctacgtcgcccccagctggttcgtcgtcgccgcgctgatcacctgggtgttcggcggccagctcgaccgcgtgctgcccgagctgggcgccgcccgatacctggtcgccctgttcttcgccatcgccttctacgcctccgtgctcgtccacgaactggcccacacggtcgccgcactgcgctacaagctcccggtccgccgcatccagctccagttcttcggcggcgtctcggagatcgagaaggagagcgagacgcccggccgcgaattcgtcctcgccttcgtcggaccgctcctgtccctggtcctgggcggcgtcttctacggcgcgatgcagttcgtcgagcccggcacggtccccggcgtcctggtcgcgggcctgatgatctccaacctcatcgtggccgccttcaacctgctgcccggcctgcccctcgacggcggccggatgctccgcgccgtcgtctggaagatcaccggcaagcccatgagcggcaccatcgccgccgcctgggtcggccgcggcctcgccgtcgtcgtcctcgtcgggctgccgctgctcacccacaccggagcgctgggcggaaccgcccagcgctccggtgtg

SEQ ID NO: 2929 - DNA, 5982 bp, Unknown
  Kingdom: Bacteria, Phylum: Actinobacteria, Class: Actinobacteria, Order: Streptomycetales, Family: Streptomycetaceae, Genus: Streptomyces
ccggccggagcggcggggactggatcgcccgggtgccccatgtccgggtgcgggtgccgttcgtcacgacggtcggcttcgggaccgatccggtggcggaccggttcggggccgaggtgttcgacgcgggtgacggcggccacagcgactatctgctgtccggttcgcgttccttgacgaatctggcccggatcgcggcgggtgccgaaccgctgggagcctcccgatgaccggtctcgtcgcacggatcgaggccgccaccccgcccggccgggaccgggccgtcgacgccctacgggccctggcgatcctcggcgtggtgggcgggcactggctggtgaccgcgctggtcaccgacagcggcacggtgcgcggggtgagcccgctgacgtatctgccgcaactcaacccggtctcctgggtgttccagaccctcgcggtgttcttcctggtgggcggacaggtggcggcggggagttgggcctcggcccggcagcgcggcgtgccgtacgggcggtgggtggccggccggctggggcgcctgttccggccggtggcggcggtgctcgtggtgtggacgctcgcggcggcctcgatgctggtggccggggtgggcgattcgacggtccgcgcgctggtcaagttggtctggtccccgctgtggttcctgctggtcctcgccgcgctgaccgcgctgactccgctggtggcgcggctgcacccgctgtggccgctcgtggtggtgctgcacgtcgacctcgtacgcctgggtctcggcggccctcgcgagctggggtggatcaacgtggtcgcgggctggctggtgccctactgcctgggggcgttggtggcccggggcgggatgcgcggccggacgggtcgctgggcgctgctgctcggcggggcctcggcggccgtcgcgctcgtgctgtgggccgggtacccggccgccatggtcggcgttccgggtggccggatgtccaatctggatccgccgagcctggccgccgtggcgttcggcctggcgcagtgcggggcggcgctgctgctgctcgggcccctgcgccgggtgctgcggaggcccgcggtctggacggtggtggcggtggtgaacctgtcggcgatgaccgtcttcctgtggcaccagacagcgatgatcatcgtcacgacgggagcgtcgctgatcgcggacggcccgctgccgggactgcacaccgtgcccgacggcggcggctgggtgctcgcccggttgctctggctaccggtgttcgcgtcggccctgctggtgtgctgggccgcgttccggggttacgagcagggcgggcggctccccggcgggggctccctcctcgtacgggagtcctcccccgagcggaagggatacgcgcgtcgtgcctagtctgagcaggagtggagccgagggggcggtgggggcggtgacgtcatcgagggcggtacgtctgcgggcggcggtgcgccgcgcgccgcgtgtcctgtacgaggagttgtgggccgcgccctccgaccgggtgcctcgcatgggagagccgaacgcgccggtgtggcgcccggtgttcctggtgctgctggtgctcatcgcggtcggcgtcacggtgatccgtaccgtcgaactcaccccgtacggcgcctcggtcagcggcttggcggtactggtggccatcgcgcagtccgcggcgctggtagccggaatgatccgtccgctgggcgcctggtgggcggcgaccgcgctggcgttcgtggcggtgctgctgactgtggccgccgctcccacggagcacccgtatccgtggatgaacggcctccccgtgagtcccgagttcctgtatcccacccccttcgcgggagcggccctccagggcggcgccctgttcctgctggcgctgcgggtccggccgcgccgcgcggtggccgcgctggctctctccctggcgccgacgctgttcgtcgtcctgcgcacgccgtcgctgccgcatgtgaaccctggcatgacctcgctcgtgctcgtcaccgcgcttgctctcggtatcgcgctgcgcagcctgcgcctggcccgcaaggacctcgtcgtccaggcggagctgacggccgaggagcgggcccggcgcaccctgctggaggaacgcggccggatcgcccgcgagttgcacgacgtggtcgcccatcacatgtcggtgatctccatccaggctcaggtcgccccgcatctggtggagcaccccaccgaggaactgcgggagaatctgaccggcatccgcgagaacgccctcgaagccctcgccgaactccgcagggtgctgggcgtcctgcgctcggaggacgcccccgcgcagggtgcgcggcatgccccgcagcccggtctcgaccggctcgacgagctggtcgccaccgtgcgctccgccggtctcgccgtcaccgtctccaccaccggcgcaccccgcccgctgtcgccgggcgtcgagctgtcggcgtaccgcatcgtgcaggaggcgctgagcaatgtgatgcgccacgcgcccggtgcgagcgccggggtggcgatcggccaccggccctccggggtgaccgtccgggtcgtcaactccccgccggaccggccggccgcaccctcccccggggtgcgtcacggtctgctcgggatgcgtgaacgcaccgcgatgctcggcggcgaactggccaccgggcccacacccgacggcggctgggaagtcaccgcgatcctgcccaccggcaccgagacgaccgaggtcgccccatgacaccgcccatccgcgccgtgatcgccgacgaccagatgatggtccgccagggtttcaccgtcctgctgaacgccgagccggacatcgaggtcgtcgggcaggcggtcaacgggctcgacgcggtcgccaaggtcgccgaactcgcgccggacgtcgtcctgatggacatccggatgccggagctgggcggcatcgaggcgacccggcggatcacctcccccgagggctcgacggtgaaggtgctcgtgctgaccaccttcgatctcgacgagtacgtctacgaggcgctgcgcgcgggcgcttcgggcttcctgctgaaggacgcgtcggccgacgaactcgcccaagccgtacgggtggtggcggccggcgacgcactgctctcgccgaacatcaccaagcggctcatcgtggagttctcccggacggccggggccccgcgcccgccgctcaaggcgcgggtcggggacctgacggagcgcgagacggaggtgctgacgctgatcgcgggtggcctgtcgaacgcggagatctcccggcagctcatcgtggcggagcagacggtgaagacccatgtgggccggatcctggtcaagttgggcgtccgcgaccggacccaggcggcggtgttcgcgtacgagtcggggctggtgcgcccggccggtctctgacctcccccgggcctcccccggcgggccgccggaccccgttccgtaggatctcaccgtgactacggggaacggggcaggaacggagagcggccgagtggtggccgccgcgcacggcgggtacgggccggatccgtcgccgtacgcgcgaacagcgccgcacccaccggcgtacccgccgcccgcgccgcccacggagatcgagcgcgcactgtccgcggccgtcgcgggcggcagcgccggcgcggtcgtggagctgctcgcgcgcacccggctgtacgtgctcgtcgcccggctgcacgcggacatccccggctggacggccccgctgcccgcgatccgcgacgaggtctccgggcggacctgcgtcccggtcctgacccaggggatgctgccaccctggcacccggagtgggtgttccgcgaggtgagcctcggcgagctggcccggatctggccgtacgacgtgcgccggctcgcggtgaaccacggcaccccgtacgcggtgatggtcgacgcccggcccaagcacctgaagacctgggcgaaggccgacgaacacgccggcggggcccagcggggcatcctgctcaccgacgccggcggtccgctgcacggaccgctcgcccaagggctggcgctcggcgcccatctggccgtcaccaacggtctgatctggaaccggctcggcgccgcctacgagaactacgcgaccgaccgggcccggctgcgcagcccctggggcatcccgcaccgcgccgagtaccgcgaccgcctcgcgtccctgatgaagaaccagctggtcggacgcgtccaggaaggcgtcctacacacccggcacaccctggcgcaccggctggggcgcacgccgacgcgcgaggagtggtgcgacgcggtggcccgctccttcgccgcgcgcgacgccgaggaccgggcggtggccgaccgggcgctgcggcacgtcaccctgtacgaggagaagttccgggccgacggcgtgctcgccccggacagccgcgtggataccctggccgccttcgacctcggccgggcggtcaacgtcgtacggctcgcgctcggcgcccggtacggcgatccgcccgaggccgagcaggacgtgctgcggatcggcgaactcgcccgggccgcctactcctcgtgggcggacttctccctcggctacctcatggcccgggtggtcctccgggccgaggacgacggcccggaggcggcggagcccacgtaccggcagtcgctcgacgagcaccgcgtgctgacccaggaccccaccagcccctaccggaacatcccctggtcatgaacccgaatctccccaccgcacccccggccccctgggtcccgccgtccgagaccgagcagctcctccacgaggcggcgctgcgcggcgacgcacgggcccaactggcggcgctcgccggggccgagctgtacatcccggccccgcgcgccgaggtggacgcgaaaccggacaccatcacctggcgcgcgcaccacgacccggccggcttcgtctgccggccggcgctcacccggggcatgctgcccgcctggcatccggactgggtcttccacagcgtctcgctgcggtgggccgccgagttcggctggtccgacccgcacgtgttcctcggggtgaacgtggggacgcccggccaactgctgctgccgacggggccgacggacctggcgctgtggcagcgcgcgtacgcggagaacgaccggctcccggggaacaggctgctcgcgctgcggcacggcgcgctgcacgggccgctggcgtacgggctggcctgcggggcgcatctggcgatcgggaacgcggtgccgtggaacgagatcgggacggtctgccgcgactacaccaccgagcgcgatcagctgcgcgactcctggggcatcaccggccatgccgagtggcgcaagcaggtggacgccctgctggacgcccgcaacagcccgccggaaccggacttcgtgctgcgcacccgcgaccaactggcgtccgggctgggcgaattgccctcggccgacctgtggcgggagaccgcggcgggccacgcccaggacctgggggcggactccggcacggtgaagggcattgaggagctggtgcgccggatcatgcgctacgaggcccggttccgcgcggacgggctgctgccgccggacggccgggtccgcacgacggtcgcgtacgactacgggcgggcggtgaacctggcgcgctgggggctggcggcgcgctactgcgccccggccgacgcggagcaggcgatcgtctacgccggggcgctgagcaagtcggcccaccgctcctgggaggagttctcggcgggctactcgctggggcgggtgctgcggttcgacgaggaggagtacgggccgttctacgagcagaacgtcctggcccaccgcctgctggcggagagcgagggcagtccgtggcgccatatcccgtggcgctgagcgcggcatgacccgcgggagccgagcggtccgcgccggccgggccgccg

SEQ ID NO: 2930 - DNA, 12648 bp, Unknown
  Kingdom: Bacteria, Phylum: Actinobacteria, Class: Actinobacteria, Order: Streptomycetales, Family: Streptomycetaceae, Genus: Streptomyces
ctcggtgacctgcccggcggggaccgccgggcaggtcaccgagctggtcaacacggagcgggccaaggagggctgtggtccggtgaccgtgaacgatcaactcaacacggccgcgcaacggcactccgccgacatggaggccgaggactacttctcgcacacctcgcaggacggcagggaccccggcgaccggatcaccgccgccgggtatcggtggtccacctacggcgagaacatcgccaagggccagcggaccccggccgacgtgatgcggtcctggatggacagtccggggcaccgcgcgaacatcctcaactgctccttcaaggagatcggcgtggggaagcaggattccggcggcggtccggtgtggacgcaggtgttcggggcccgctgagtccacgcggggcggtgtaccgggccaggaccggcgggcctcccccagggagtgtccgcaaagtatcgtcgtccgccctctggacgcagcgggccaggcgagactttgcggacacgacctaggatgcggccatgatcgctgaactggagtgcgtggtcctggactgcccgggcccgggggaactggccgtcttctacgcgtcgctgctcggtggcgaggtcgaccgccccgaccggcgctgggagtgcgacgcggactggtccacactgcacacgcccggtggactcgtcctcgcctttcagcgggtggccgaccaccggccgcctcgctggcccggccaggacccgccccagcagttccacctggacttcggcgtcaccgaccaggaacgggcgcacgacgaagttctggcgcacggggcgtccctgctcgacgccggggacggggagcgcagctggcgtgtgtacgccgatcccgccggacaccccttctgcctggtacggcactgaccgttccggcttcgttcgcgcgccccaccggggtcagcgcaggacccacgtcagcgcagcgccgaggcaggccgccgcgcccaccgcaccggccgagacggcgacgcagcgggtccggagccggacgtagcgcccggtgtactcctcacgcagttcgtccgcgcggtcgcggatgcgggtgagcgactcccgggaggcggcgacgcgttcggcgatgaacacctgctcgacgtcctcacgctgcgccgtggtcaaccagggcagcctgtcggtgaatcgtcgcgcctgtcgtcgcgcccgctcgacctcggcgttccacagcagaaagccctccagttgcgccaggccccgggcgcagtccttgtcgggtttcaccccgtcctcctctccgtcgcgtcgtcatggccgggccgacttcactcgtgcttgtcccccggggcgacgacggtcgagttctgggggcggttggtggcttcctccagggagcggaccgccgggtggtgcaggtcgaatgccggtgactcggaacggatccgcggcagggtgacgaagttgtgccggggcggcgggcaggaggtggcccattccagcgaacggccgtagccccacgggtcgtcgacctcgatcttcttgccgtacttggcggtcttccagatgttgtagaagaacggcaggatcgacaggccgagcaggaaggaggaaagggtggagatcgtgttcagcgcggtgaagccgtcggcgtcgagatagtccgcgtaacggcgcggcatgccctcggcgccgagccagtgctgcacgaggaacgtcccgtggaatccgacgaagagcgtccagaacgtcatcttcccgagccgttcgtccaacatcttcccggtgaacttcggccaccagaaatggaatccggcgaacatcgcgaacaccacggtgccgaataccacgtaatggaagtgggcgacgacgaagtacgagtcggagacatggaagtccaggggcggtgaggcgaggatgatcccggtcagaccgccgaacaggaaggtgaccagaaacccgacggcccacagcatcggggtctccagagagagcgaccccttccacatcgtgccgatccagttgaagaacttcacgccggtcggcacagcgatgaggaatgtcatgaacgagaagaacggcagcaggaccccgcccgtgacgaacatatggtgcgcccatacggtcgcggacaggcccgcgatggcgatggtggccgcgatcaggccgatatagccgaagaccggcttgcggctgaagaccgggaagatctcggtgacgatgccgaagaacggcagggcgatgatgtagacctcggggtggccgaagaaccagaacaggtgctgccacagcagggcgccgccgttggccgcgtcgaagacgtgcgcgccgaacttgcggtcggcttccagcgccagcagggccgcggcgaggaccgggaaggccagcaggaccagaacgccggtcagcaggacgttccagacgaagatcggcatgcggaacatcgtcatgccgggtgcgcgcatgcagatgatcgtggtgatgaagttgaccgagccgaggatcgtgccgaagccggagaacgcgaggcccatgatccacatgtcggcgccgatacccggcgagcggaccgcgtcgttgagcggcgcgtaggcgaaccagccgaagtccgcggcgccctgcggggtgaggaagcccgccacggcgatgagcgagccgaagaggtacagccagtacgcgaacatgttcagccggggaaacgccacatcgggcgcgccgatctgcagcggcatgatccagttcgcgaatccggcgaacagcggcgtcgcgaacatcagcagcatgatcgtgccgtgcatcgtgaacgcctggttgaactgctcgttcgagatcagctggataccgggccgggccaactccgcccgcatcaccagtgccaggagtcctcccacgcagaagaacgcgaaggaggtgacgaggtagagcgtgccgatcgtcttgtggtccgtcgtggtcatccacttgatgaccacgttgccgggttcgccgcaccgtaccggcatttcgtcctcgtcggcggtatcggtctccaccggttgcgagatgcctctcgtcgtcactacgacgctccttcggtcgacggtccgtgtggactcggcgaccagaatggacccgcggagaccggtgcggtgggacatccttccccgtccggcgcgagcggccgacaaggacactcaaatggcctacatcgaacgctccgcttccggtcggctcaaccgaaagagggagtcaacgtccgggaaccgatcgaatattccctcgctgcgatcggaatagcttctccggcaccggagttggtgaaccgacagaactcattcctctccactcggcaagcttcggaaggtcggatccatgaagatcggcatcatcggcgcgggcaacatcggcggcaacctgacgcggcgcctgaccgccctcgggcacgaggtcgcggtcgccaactcccgtggcccgcacacgctcaccgccctcgccgaggagaccggggcgaagccggttcccgcgtcggaggccgcgcggggcgctcaggtggtcgtcgtcaccgtgccgctgaaggccgtgcccgacctgcccgccggattcctcgacggtgcggcggagggcgccgccgtcatcgacacgggcaactactacccgcagcagcgtgacggccgcatcaccgccatcgaggacggactgcccgagagccggtggacggagcagcagatcggccaccccgtgatcaaggcgttcaacggcacgtacgcccaggacatcctggaccggggccgtccgcagggcactccgggccgacaggcgctcccggtggccggggacgacccgacggccaagcagacggtgcgcgacctcatcgacgagttgggcttcgacacggtcgacagcggcggcctggacgattcatggcgtcagcagcccggtacgccggtgtacggcagccagggcgacgtcgacgccatcgtgaaggcgctctcggaagcatcgcaggagcgcacggcggagtggcgcgcctgacaccgggcgtcacgcgggaggaacgaccgggcgacgattccggccgggtgggaaacggggaacccgcccggccggagcgtcagccgccctcggaccgcacccgtcacgtgatccccaccggcgccaccggttccccgatgctccggaccttcgtccacccgcttccccctcgaatctactcgcgagtaaggtatggggtccgggatgtcggcccacggcccgtacggcgcccgggcgtggtccgtcgacggccgtggacaagggagacgcgccatgtcccgcaccatgtccgtagcggacaccatcgtcatcgacgccaccccggcacaggtctacgaacggctcagcgacccgacagcgatggggcgttggagtcccgagaaccgtggcgcgaccgtgcgcggcgatcggcgtggtgcgtacgtcggcatggtcttcgacggtcggaacaagcgcggtgctgcgcgctggacgacacggtgcacggtgacggcggccgaccccggcgagcgcttcgccttccgggttcatgcgatcggtctgcggcgccctctgctgccggggccgatcgccacgtgggactaccgcttcgagccggtggacggcgcgacgagggtcaccgagacctggaccgacgaccggcgtcgctggcccgacttcctcgccaacgccttcgaccgcgtcgcgacgggcgggaagaccttcgcgcagttccagggcggcaacatccgcacgacgctccaacgtctcaaggcggcgctggaggaggacgtccggggcgccggaaagtaggcggtccggacggtcaggccgcccagtgcggagggcggctcagggaggtgggaagtgctgttttcgcgttgcccctggcggcgttgagctgggcctgggtgaggaacaggcttcccctgaggtcggcgcccgaaaggtcggcgtctcggaagtccgcaccgatgaggtcggccagccgcaggtcggcaccggtgagatcggcggcgatcagataggcccctcggaggtccgccgcacgcaggtcggcgccacgcaggcgggccccgatgaggtcggcgccgcggtggttgcgcttcttgcggcggggcgcggcggctcggacgagttcgctggtgcgttgaagcagcccggcgacccggtcacggtgaccggcgacgtccagttccgcgaagtcgacggccgggcgcgtggtgtgccgttccgtcgtttcgagggcccggcggatctcggcgtgcaggggacgcgcgtccggcagggtcagggcctcggtgagataccagagcagttcatggagctgacgcatgaccgggaacacctggaacatctgcgcggcgagatcgggtgacgaacgccagtcgcggcccccgtaggtctcctgggagaccttctgcccggcgccgaagcagtcgtacacggtgcagccggagaagcccttcgggcgcagccgggcgtggatgccgcagcggaagtcgtcctgaaggttggggcagggccggccggcgtccttgtcgatggcgaagtccgacgaggccgtcagcgtgagggcgacgcagcagagagcgaagcagttcgcgcagtccgcacgcagggcctcccgtccgtcgccgggcacggtggtcggttcgttgtcgggcacgggcggtgggtcctcgcgtggatggtgctgcggaaaagtacgggtacagagcacacgagtctaccgacggccggagagcgacgctcctgtcggccctgtcggcctctgtcggctcttgtcgaccaccgcggctcctgtcgggagctaccggccccggccggtgcacactgggcacggtacggatcacgagggggacttatgggcaccgaggagagcaccggattcgagccggcgaccggcgacggcccaccggccgccgagcccgcggcagcacgggccgcttcggtgcggaccgcgttcgaggggctgctgcagatccgtcggctcaccggcgccgggcggcccgaccccgtggccgcacccgctccgtgggaagtgaaccgcccggtcagggcggtggcgttggcgttggagaggtcgggggccataccgtcggccgtcgacccgtcgggacgccgcgtatcggccgggtaccgggtgagcagcggggagtcggcaggttcggtacgggtcgagtggaccggaccggccggcagtggagccgcccacgacgaggaggaggcgctggccggctgcgcttcggccttgcgggaactgggctggacggtgctgctctaccgggggccgcgcagacggcgctacctggaggtggagccgccgagcggattgccgggcgggcacggccgggcctgaggcggcgttgtcagacccatgggggatgcttgacggtccgacagctctgaggaggagatgctgagatggacaacgacgagctcgccgcggcgcaggcgtacgtccgcctgctggaagccacccgggcagcgctcgcggaccccgacgacgcaccggtctacctgccgctgctcacctccccgatgcgggaggccgaccatgccctgcgcagcgctgggctgacgggcaacgaggaccggctgttcgctctcgtacgggcactgcagccgagcctttccggcagcgacagataggtagggcggagggacgcgcgccggtccgtccgaacgagatgctccagggacatgacctagccggtctgcccctcgtcgatggtgtgcgtgggccccggagcgagtccgagctcctgctcgccggggccgagcggtgcgaagaaccgggcgacctcctggtcgtcgacctcggcgagggagcccggcttccactgcggttcgttgtccttgtcgatgatccgggctcgcacgccttccacgaaatcagggtgctcgaacgcccggctggagacgcggaactcctggtccagaacggcctccaggctgtcgagccgggctgcccggcggaccgcggcgagcgtgaccttgagcgcgagcggcgacttggtcaggagttcgtcccccaccgtctccgcctcgggaacaccgctctcgcgcaactgtcggaggatctcctccacgctgtcagccgcgtagcacctgtcgatccagtcgcgttgcgctgcgagctctccggcaggcggctccgtggcgaaccgctggacgatgcccgccacggacgtgtccgggccggccggctcgcccagcgcttcggtcagggcgggcaggtggcgggcagggacgtggtgatcggccagaccgcagagaacggcgtcggccgctccgacggaacggcccgtgagcgccagatgtgtgcccagttcgccgggggcggcggccagcagacgggttcccccgacatcgggcacgaagccgatcgcggtctcgggcatggcgacgcgcgagcgttcggtgacgacacggattccggagtgtgccgacactccgactcccccgcccatcacgatgccgtccatcagtgcgacgtacggcttggggaatcgggcgatacgggcgttgaggcggtattcgtcacgccagaactccaaggacgcccgtcccgaggcccgtgcgtcgtcgtgcagggcgcgaatgtcgccaccggcgcacaggccccggtcgccggccccggacaacagcaccgatccgatcgattcgtcctgctcggcgcgggacagggcttcgtcgagcagccgcaccatggtgtggctgagagcgttgagcgctcggggccggttcagtgtgaggtgcaggcatgtgcccctcgtctccaggaggaccggccggtcgtcgttcatgcgtgcgctccgctcactggactcgtgggacgcctccatggtcgcggacggtgctcggctgccgttccgcgccccccggatcggaccccggaaacggaggcatacgggagcacggggctcgggacgcgagggactgcggttgagccgctgtggcactccgatggatgcggctcgacaattgaggcctacgggtgcgccgacgcgcgccccgccggacgacctccggagcaggaatgaccgacgacgaacgggtgcaggacgccgaagcctctccgctccgccggatcgaccggaagaccaacggtgagatccggccgacggaacgcctcgccatgaaccggaccggcagcttcgactgggatctggacacccggacgctggacatcgacgaggccgggctcatggtgttcggcgtggatccggcgacgttcgacgcacgccccggcgcgctgctggagcacctggaaccggcggagcgggcccggctcgacgtcacgatcgacgaggccatcaccggcggcagcaattcctacagcgtccacttccgtgtgccgctggacgacgggaccacacagtggacccatgtccaggcccgcattctgcgatcgaaggacggcatggcccaccggatcgtgggggtcgtccgggacgcgacggcggaggtcacccattcggccttcgttctcgatctggaaaagcggcggcaacgccagaccaatatcgttgaacgaacaacgagtgccatgtcccgtgcggtgaccgtggacgacgtgacggccgccctcaccggacccggggggctggcccggctcggcgccgacggtctcgccctggggctcgtggagaattccgcgctgaacatcgtcgcgctgagcggcgagtcgctcgaggtgctcgacggtctcggctccggtggcctcgaccgcaacctccctctcgcggacaccatccgcagcggacgcccccggttcatcacctccctcgccgcgctggcccgtcgctacccggaactggagccgcatctggggaagctgaggttccgggctgcggcgtatcttcccctggtggcccaggcccggtcgctcggcgggctggccctcttctaccgcgagcgcacggtattcaacgcggacgagcgcattctgtgcctgggcctcgccgccatcgtggcccagtccctgcaacgggcgatgctcttcgacgaggagcgggaattcgccacccagctccagtccgcgatgctcccgccccggatacaggacgtcgagggcggcgagatcgcggtccgttaccacgccgcgtggagcggccggcaggtcggtggcgactggtacgacgtgatcgccctgcccaagaaccgttacgggctggtcgtgggggacgtccaggggcacgacacccacgcggccgcgatcatgggccagttgcgtatcgccctgcgcgcgtacgctgccgaagggcactcgccggccaccgtgctggcacgggcctcccgcttcctcgccgaactggacaccgaccgcttcgccacctgcacgtacgcccaggtcgacctggcttccggagcggtgcaggtggtacgggccgggcacctcggcccgttgatccgccacctcgacgggcgggtcggcagcccgcaggtgcgcggcgggctgccgctgggcacctccacggatctccaggacgaggagtatccggagacccggctggacctggtgcccggtgagacattcgtcctgtacacggacggactggtggaggagcccggagctgacctcgacaccgggatcgacgcgctgcgcaacgaggtgagcaccgggcccgccggggccgaggcgctggccgatcacctgtcggaacggctgtgggaacggtgggggtcgggggacgatgtggcactcctcgtcctgcgccggagcccggacgtggggtcgtcgcacgcgccgcggctgcaccagtacattcaccaggcggacccggaagggctctcggacgcccgcgccatcgtgcgccaggccctcgccgactgggacatggccgagttcgccgacgacgccgagctcgtcacgggcgagttgctggtgaacgtgctcctgcacaccgagggcggagccgtcctgacgctggaagtgctgcccgaaccggtacggcggatccggctgtcggtccaggaccggtccagcgcctggccccgacggcgtacgccgggggagacgtccacttccggccggggactgctcctgctcgacgcggtcgccacgcgctgggggatcgagccgcgaggagagggcaaggccgtctggtgcgagatcggccccgctcccccgcctgccaccctgccgccaccgacggtcgcggaagggtgacggacgaaagcggggtgtgccgcagcatcgagtacagcgacacacccctcgaccgcgggagcgtcagttctgggcggtacgccgcttacggacggcccagaggatgccgccaccggccagcagcaccgcgacggcggcgccgccgatgaccggagtcgacgacgacgagccggtctcggccaggtccggcgagctcgggctcggggcgggcacggcgggcgcggactccgaaggctgctcactgggcgtggcgctcggctcgggagtcccggtggacggcgtctccgacggggccggctcgctcggggtcggcgtgggcggcgtggggctgggctcctcgtcgcacacctccgccgtctccgacttgtcgatggagtgcttgccgtcgccgtcggcgtccttgacgaccagtcggacggtcaccggcttgtcgtgctcgggaagcgtcagcttcttgtggaactcacggccgaacgtctcggtggggagcaggtcctcgccgtccaccgtgacggtcaccgtgttggggacgtcgctcgtgtagttggtgaggtcaacagtcacctcggagcaggtcacggcccaggtgggggtgtgagccgcggccgcaccggcggagatgacgcctccggtcagaccgacgaccgcagcggccacgagtgctcccgcgccacgccacgatctgctgggtatggtcatggattcttcctccagatacgtctcatcgcccgaatggcgatggggcgcacagtactgccatcgtccgggagcggcgcagtcgccccatgcgtaacccgtcgcaccaactccgggcgcagacccgccacttccggccatgcgagcaggcctcacgtcgtactgtcctccggtgtgaccgaatgagagggtggactgtgcatctttctgcctccgcctgcgcccctgagcctggagcatgacccgttctatgcgattgctgctgatccgtcacggccagacaccgtccaacgtcggccacttcctggacaccgcgcggcccggccccgggctcaccgacctggggttgcggcaggcagccgccctcccgggggccctcgccggggaggacatcgccgcgttgtacgcctccactctgacccgtacgcaactcacggccgcccccctcgccgcagagcggggcatcgaggtccggatccgtgacgggatccgcgaactgtcggccggtgacctggagatgcgggccgacgaggatgccgtccggctgtacctgacgaccgccttcgcctggtcgtccggggacatcgcccgccggatgcccggcggcgagagcgggacggaggcgctggcccgcttcgacgccgtggtggccgaggcagcgggggccggggagcccgggaccgtggcgctcgtcagtcatggtgccgctatccgtgtgtggacagcggcccgcgcacagaacgtcaccgtagggttcgccgccgaacacggcctggacaatacgggcgtggtggtggtcgaaggctcaccggactcgggatggacggctctctcctgggccgggacggtcgtcccgggggtcaccgcgagcggcgcggcggacggtggaccggcagggcggacactgtcgggcccagaactgggaccgacagcggatcatcccttcggctgatcgccgcgctcgcatccgacgatggggacatggcgatgccaggacaccccgtcgtcacagggccttgtgcatgatgtgaagacccacatagccctgtgtcgggtggtcgaagccctccggaagggtgccgatcacgtcgaagccgatcgagcggtacagcttgacggcgtgggtgttggtctcgaccaccgcgttgaactgcatggcccgatacccctcggcacgcgcccagtcgaccgagtactcgcacagggcccgccccactccccggccggagtgagcggggtcgaccatgtacgtggcactggctatgtgcgacccgttgcccatgtggttgcggttcatcttcgccgtgccgagcacggtcccgtcatcgtccacggcaacgacgactcggctcggcgctgcgacgaaccaccattcctcggcgtcctcctcaccgagatcgagcggataggtgagcgtctcgcccgcagagacgatcgagtggaagaacggccagatggcggaccagtcctcggaggttgcttccctgatcaacatgcggacaggatggcccatccgaacgatcggcgcgaaaacttatccggcacccctcccccgccaccccagcctggcgagcagccccttccctgttggcacgcctgccgcgacggagcctgacaccccggggcggacggactgcggcgccggctccgcggcgaatgccggaaccgcggtcccggtgcggggccctgccgctgcccctgcccctgcccctgcccggaccgtcggcgccgcccgggctcctccgtcgtcccccgggcgcggcgcccgccggccctcgcgtgccccgtcc

SEQ ID NO: 2931 - DNA, 7974 bp, Unknown
  Kingdom: Bacteria, Phylum: Actinobacteria, Class: Actinobacteria, Order: Streptomycetales, Family: Streptomycetaceae, Genus: Streptomyces
  misc_feature (391)..(392): n is a, c, g, or t
atcggccgccgccgggccgacggaaccgctcggacactcttcccgcgcggctgcctcccgggacccgtccggcatgcctcaaccatatcgatcacttccgctcgaaacgatccgagcggggttttgccccggtgcgacgggcgcacgccggttcgcgccaggaccgggcatacacaccccgagaaacgatcgatacgatcaattcggccaaagtcattgagcgagtcgtctggtggctgctagaaagtgcccgcccgctcagaacagtcggatcccgggaacagttcagcgccctgcgcccagggttcccggcggagacacgtcaccgacccggagctccccatgacttctgcctggtcccgccgtaccttcctggccacctccgcggcgnncgcggcgctcaccgccgcgggcggcggagcgctgacgctcgccgcgcccggcgccgcctccgccgcccccgaggacgatccgtacgccacgctccgcaccacctggagcacgctgatcctcggcgaggggttcagcccgaccgccgaacccttcaagagccggctggccgatctcggcgtgaaggcctcgcgatggctggagaccatggccccggcggagggctcgctctggcccgacgcggtgttcgcggatccggacccggacacggacgccgagtcgtacgtcctctccggacggatggccgacagcttcatccgcctgaacaccatggcccaggcctaccgccagcagggcaccggcctcaccgggaacaccggactgcgcgatgcggtgctcaccggcttggaacacctcaacacccaggtctacaacgacggccaggcccggtacgggaactggtacagctggcagatcggtgcgccgcaggccctgctggacgtgtgcgtgctgatgtacgacgccatcgccccggaacggcgcacgcgctactgcgccgccgtcgaccatttcgtaccggactccgccgtcgcctcgtacaccgggaccagcaccggggcgaaccgggtcgacctgtgccgggtcctggccctgcgcggagtcgtcggagggagcgcggcgaagatcgcgctggcccgggacgccctctcccccgtcttcccgctggtgaccaggggcgacggcctgtacgccgacggatcgttcatccagcacaccaccgtgccgtacaccggcagctacggatcggtgatgctcggcgggctcggcctgctgttcgcgctgctgaaggggaccacctgggaggtcaccgacccgaagcggcaggtggtgttcgacgcggtggagaacgcctgggcgccgttcctcttcaacggcctcgtcatggatgccgtcgcgggccgtgccatcagccgcggcgaggtcgacgaccaccggcgcgggcaccccatcctcgcctccgtcgtgctgctcgggcgcggcgcgtcggccgccgagaacgcgcggtggcgggcgctcgtcaagggctgggcacagcgtgactactacagcccgccgctgagcaacccctcgctcgggctcaccgccctggcccggatcaagtccgtactggacgacacctcgctcactccggtccccgagccggagggccaccggctgttccccgacatggcgcgggccacccaccgccgacccggctgggcggcgtcgctgagcatggcggaccggcggatcacctattacgagaccggcaacggcgagaatctgcgcggctggcacaccgggtcggggatgctctactggtggggcgactccttcgccaacggccagtacagcgacgccttctggcccaccgtcgacccgcaccggctgcccggcaccaccgcctcgcgcaaggtcctcgccgacggggcgggcggcgactggggcacctcgctccccgatgtgaactgggtcggcggggtcaccgacaagaagcgggccgccgtcgggcagtacctcaagggactgtccagcacactgatggcgaagaagtcctggttcttcctcgacgacaccgtcgtctgcctgggcgcgggcatccacagccgcgacggcgcggccgtggagaccaccgtcgacaaccgcaacctcggacccaccggcaacgccccgttcaccgtcgacggctcgctcaaacccctcacgttcccctggtcggcgaccctgaccggagcatcctgggcgcatctcgccgggcacggcggttacgtcttcccgggcggggccaccgtgaaggcgctgcgggaggaccggacgggccgctggcgcgacatcaacagggcgggctccacggatccggtctcccggaaatacctcaccctctggttcgaccacggtcaggacccgtcggacgctgcgtacgcgtaccagctcctgcccggcgcgtccgaacagcgcacggcggcacgggcggctgacggcggctggctgcgggtgctcgccaatacgggcgaccagcagggggtggcggtggactcgctcgggctgaccgccgtcaacttctggttcggcgggagcgtcgggccgctggcggcggacgccccgtgctcggtgatggtcaccgagcacaccgacgggacggcgacggtgtgtgtcagcgacccgatgcggatgcggacgagcctgaccctcacgtggaaacgagccgtcgcctcggtcgtgtcgaaaccggcgacggtgacgtcggcgactacggggacgtcgctgcgcctcgtcttcggcgacctctccgggacacgcggggcgacgcagacgatcaaggtacgactgtcctgaaccgcgccggcgggccgcgcggcgcaagccgtacgcgacccgccggacgggccgttccggcagccgggcgtcatactgtcggccggcacacggactggggaacatcacatgacgaacgacgaacggatcgggcctccgctgctggggagcgagcgcgagacgctccgggcctttctcgactaccagcgggacaccctggccatgaagtgcgcggggctgggcgacgaggagttgcgcgagcggtcgatgcctccgtccaccttgtcgctgctggctctggtgcggcacctggccgaggtggaacgcacctggttccggcgggtgttcgaggacggggcggccccgatggtgtggtcggagaaggccttcgacttccaggcggcgtacgacgcgagcacctcgacccgggccgaggcgttcgccgcctgggaggcggaggtggagacctcgcgccggatcgaacgggaggcggcctcactggatctggtggggtatcagccgcgctgggagaaggaggtctcgctgcggatggtcatggtgcacgtcctgctggagtacggccgccacaacggtcacgcggacctgctgcgagaaggggtggacggcacggtgggggcctgagaccacgggtggcggccgcccccgcacttccttgaccaccgcggtcggaggcggccgtcccgtacgccctccgaccgcggccgacgcgctcgtagactcggcgccatgactcagcagccggcgtctcccgccctcgcccccacgttcgcgcccggcggcgccctgcgtgcctcgatcaacctcggcaatccgatcctggcccaccgggatccggcgagcggcgagccggccggagtctccgtcgacctcgcgcgggagttcgggcggtggctcggggtgcccgtcgagctggtggccttcgagagggccgcgctctcggtcgacgcggtccgggccgagcgtgcggacatcggtttcttcgcggtcgatcccgcccggggcgaagggctgcggttcaccgacccgtacgtcctcgtcgagggcgcgtatctggtgccggaggcctcctcggtctccgagaacggccaggtggaccgtgcgggcacccggatttcggtcggggcggggtccgcgtacgacctcttcctcacccgtgagatccacgaggccgagatcgtccggctggagggcgcccctcgcgcgctcgcggccctgcgggcgggtgaggtcgatgtggccgccggaatccggcagttgctggaggccgaggccgcgcgggccgtgggcgtacgggtgctgcccgggcggttcatggtgatccggcaggccatgggggtgccggccgggcgaggggtcgcggcacaggagctgctggcgtcgttcgtggaggagatgaaggcggtcggtttcgtcgccgacgccctgaagcgtcatggcgtcgagggtgcgatcgtggcgcccgcgggctgaacctcttccgggcggcagtcgatcgagggtgtggcgacggagaggccgacgccgggtcggccgggggcggacgccagacggttcggcgggtcgaccgggtgaagggagcgatcttcgcctcagcggcgacgggtcagcacgcgggtggtgctgccgtcgtcctcctcgatgtccctcacgtgctcgaagccgattccgcgcagcagggtcagcgaggcctcgttcgcggcggcgaccgtggcgtggacctcggtcagtccgagggtctcgaagccgtgcgcgatgacggcctgtgccagctcggtccccaggccggacccccaggccgcgggcgccagggcgtagatgatctcgtggccgtcgacggcgtcggtccgcttgatctcggcgtgcccgacgaggagtccgtcgcggcggacggcccagacggcgaacaggttctgggcgtagaccttggtgaagacccgaccgaacagagcccggtcctccgcctcggaggaagggccgtcgcccatccagcgggacacctcggtgtcctggaacagggcgacgaaggcctcttcgtcctcggggacatagggctccagcaggagcctctcggtgcgcagagtcggggtcacggcgcgtgacgctactcgggcgacgaccgcctgggcaatcgacatttccggttgaaaggtgagcgctccgtccacctggacgggaatgcgccactctaacggggtaatgcccgacagatcacgggatagtacattaggaatggcaacgaagaagacaagtgactgagcttcaggtctgcccagtagcggaatcgcgaagacgggccgacatggccactcccgcttcccaccccaaggacatgaccggctgcgggaacacgtagtcggatgacggtcggcgtcaggtcagacgcaccccggcgaacgttcgccggacggtcttcttccacttctcggctgcgcggccggcttcaggcccgccggcctccctcaacggacctgcctcagctcgattctcccctgctccgtccgacgagtcggcgcaccatcccctcgtggcccacccgcgcagaggcggcagggagcgtagcgacactgccaacatcccaccttcctaatggagttgaccatgagcggatgcggctgcgggcagtccccgatcaccatcggcggctgccagccctccaagccggcctgccctcccgccgcttgtcccggctccaagccgtgcgagcactgcgagacgacccccctgcgcgactccgcgccgtaccgggtcgaggcgaccgcgaccagcaccgacccgacgccgtactacaccatcgccaacacccgtgccgcactggaccctgtcgtcgcccagaccatcctgaacagcggcacaggcacgttcccggccgacgacgggacgcacaacggccagcacacctggctcgccggcgtcgtccacatcgatcccgcgtcgctgcgcggcaaccccacctgcgtcacgatcagcgcctcggtgcatgtccacaacgacggcaggagcacagcctgtcggctctacggccgcttcgctctgtggaacggcacgaccccggtccgtaccgatctcctgggcccgcccgaccttccggcgggaggagacgactacggcgtcgtcccaccgaccgccgtgcctctcgcggacgtcctcgcgggaaaggtcgtcgtcgagctcaacctggagacaggcaacgacgacacctgccgagtcggccccaagcagtggaccgtcgacagcttcgtcctcaccgtccaggcgtccgccccgggctgcggcaggccattcctccgtacgacctgccgcaactgcgacggcgcggtcacctgcacgaccgacaccctcgacggctcgatcccctacgctccggtccccccggtcatcccggtcgcctcctgccaggacggttgcgccaccgcccgccctccgtgcatctccaccgaccggggcaacgccatcgcccggggcagcgacgggtgcctgtacgcgcccgacacgcctgctcttgacccgtccccctgcaatgccgcgcggaacacgaccggtgggcttctcgtgccgcggatcgacctgacgggactcgctcctggcggcaacagcagcagcgaacggtcggtggacatcgatgtcgccggaacgcccggctgccccgagaggtgggagatcggcgcccgcctcacgccggtgagcgcgttcctcaacaccgagcggcagcacgccgacctcctggcccgggccggtaccgacgtgccgatccccgagtccgacatcgtgctcccggaagccggcgtctaccacatcgacagcgacgtacggtacgcgctcggttccgccaccggcggcagcggctacatcatcggctggctcagggacgagaccacggacaccctcctgacgagcttcacccagatcgcggcgatcaacgcaacgaggcaggagcagcaaggcggaaccacgcacatcatgaccgagtacgcggtcgcctccggcccccggacggtccgcctgcacctgatgttcgtcctcaccggcggcaaaatctccgacgccgaggccggcggcaccgacagcaatggcgcaacccggatgcgcttcctcaaagtcagggattaggacgtcaccaccgttcggacgcgaccacttcgacaggccctgagacttgtcccgtaaaggatcttcgagcgggtgcgcgcgaggccggccggtgttcggcccccttgtccatccgctgaggacgaggttgtgcaggcgagcgatgccgctcatcgcgtggtggacaccgtcgtccttcaatcggcagtcgcgaaggatcttccaggctttcatccgggcgaaggcgtgctcgacgcgggcacggacctggcggtgagaggcgttgtgctcttccttccaggcgggcggttcgtacggtccgcgctcgcgacggtgtgggatgagcagaccggtgccccggtagccgccgtcggcgaccacagtggtgcggccgacaacggctttggcgccggacagctcccatgccttgcagtcattgcggttgttctaccggaccgaccagtggcactccgctgctgcgtcgccccagggtcgcaagcacggcgcaagctcccagcagcaaaccggctgggaggcggctgcaagggttgccgtgtacgcgggcccggtcagtcatcgagggtgtcgccacctccgttcggccggaggaggcgatgcctgctcggaagttgctgcaggtggtggacgacacccctccgttcccggagctatgagcggtcattgcggaacggccctcaagggcgtgtatcgagtcgtgatcatgctgtgtgcagtgcgagggctggccgcctggtcacgggtgcaggtgtacgggcagggtggtcagtttccaggagttggggtgggcttcgcggatcagttcctcgggggcgacggcgagggtgaggtcggggaagcggtcccacaggagggtccaggcggtctgggcttcctggagggcgaggtggtctccgatgcagcggtgggggccgtggccgaagccgacctgcgggcaggtgcggcggttacgggtgcgggtgatgtcgaggcggtcggggtccgggtgggcgcgggggtcgcggtcggcggcggccatgaccggcaggaccgcctcccccgtacggatcaggcattctcccaggtgaaggtcctcggtggcgtagcggggcagggcgcgtgggg

SEQ ID NO: 2932 - DNA, 7276 bp, Unknown
  Kingdom: Bacteria, Phylum: Actinobacteria, Class: Actinobacteria, Order: Streptomycetales, Family: Streptomycetaceae, Genus: Streptomyces
tcggcgacccgcagccccgccgcccggtcccagctgcgcatcagatacgcgccggtgacggcggcggccgccacggcggccaccaggccgcgcaggaccaggggttcggccaggagccaggcgccggcggcaccgacgaccgacactcccgccaccacggaggggggcaggattctgtggaggggcggcgaatggcggtggcgtccacgtggcatggcctgaaatttaccgtgtgtacgggccacttggggggccgcccggcaatctgttccccgccggttacctcgcggccccccaaaggccctccacccggcccttttacctcgtgatcgagcgctacttcttgatcaggtccttcgactccagatactccttggccacatcggccggcttggcccgttcggcgtcgaccttccggttcaactcggcgagatcttccgtggtgagtgcggaagtgagcttgccgagggcctccgcgatctccggcgcacccgcgtccgcggcattcagaacgggaaggacgttgtccgcgttctggagcttcttgtcgtcctccaggaacaccagcccgtccagcaccgcgtccgtggtggtcgtcaggaccagctgcaccttgccgtcgcggacggcctgcttggactgcggggtgccgacgcccttggggtcgataccggtgacgtcgatgccgtacgtcttcttcagaccgggtgcgcagaacggccgcacctcgcactcgtcgcccgccgcgatcttgaccttgatcttcgacttccccagatcggaaagcgtcgtgaggttgttcttctcggcgaattccttcgagaccgcgaaggcgttctggtcgacggccttccccgccgggaggaccttgaggcccagcggcccggcgagcttctccagagcggcgaccgtggcggcggcgtccccggaggccacgggcgcggcctgggccttcttggccccgttgaccttggcgttgaggaattcggcgatggtggcggcgtactccggtacgacgtcgatctcgcccttctccagcgagggctcgtacagctcacggttcttcaccgtggtgatcgaggtgctgtatccggcgtcgcccaggatctgcgcgtacagctcggcgagcaccttggactcggtgaacgaggccgaaccgacgaccagggaacccttcttgccgtcaccggccgacgcacccgagccacccttctccttctccaggctgtcgccgccgcaggccgcgagcgacccggccagcgccaccatgccgacgaccgctccagctatccgcgaggtcctgctcatatgcgttgttctccgtccgaactgaagaaagtgaccagaagaaaagtgaccagctgaaggtgagccggaagaagggcgtgcgctcatgcgggccgacggcggcgcagcggtgacagcagccggtccaggcccacgagcaccccttccaccagcagggcgagtccggcgaccaggacggcgcccgcgaagacctgggcggtgtcgtaggtgttgaacccggcggtgatgatccggccaagaccgccgaggccgaccatcgcggcgatcgacgcggtggccacgacctggacggcggcggaccgcagcccggtcatgatcatcgggtaggcgagcggcagctcgacccggacgaagagctgcccgcccgacatccccatgccgcgcgcggcctccaccacggcccggtccacctcccgcatcccgacgtaggcgttggtcagcaacggcggcaccgcgaacagcaccagcgcgatgatggtgggccagtaacccgagttgcgcagcggtgtgaccatgaacagggccagcaccgcgaagaccgggacggcccgccccacgttggagatgttcaccgcgagcgcaccgcccctgccgatgtgccccagatacagggcgagcggcagggctatcgcgcaggccaccgcgagggcgaccccgctcacgtacagatgctcgccgagccggtgcgcggcaccgccgtcgcccgaccagttggccccggtggtcagccaggtccaggcatcgccgatgactcccacgggtcagcccgcctccaccttcgccggagcgggcaggcccgccggtccgcccggtccgtccgggtccgtgtgcctgcccccggccgtgccggccgtgccgaccgtccgggccgtgccggatatccgggtccagggcgtcagcagccgctggaggccgagcagcagcaggtccgccgccaccgcgagcaacacgcacaggaccgaggcggcgagcacctgggccttgaagaagctgggcagcgcgtcctcgatgagattaccgaggccccccttgccgacgagcgagccgaccgtggtcagcgcgaccgtcgacacggtggctatccgcagccccgccatcaccgcgggcagcgccagcgggagctccacctcccacagcagccgccccggtccgtatcccatgccgcgggcggcgtccctggcctcctgcggcaccgcttcgagcccggccaggatgttgcgtacgaggatggtcagcgaatagagcaccaggcccgtgacgacgagcgcggccgacagcccgaacacgggcagcagcagcgagaacatcgccagcgagggcacggtgtagagcacggtcgtcagcccgagcaccggcccggcgaacccccggccccggcgggcgagcagcgccagcggaaaggccaccgcgagcccgatcagcaccgagaccaccgtgatcccgatgtgctgcacggtcgcatcggtcaactcctggctgcgggagcgcagatactccccgcagatccagtcgttcgtcaccaggcagttctgctcggccatccgtcccccacctcctgctttcgctcgtcgtcccgcatcccgtcgtcccggatcgccccggaccgaactgatgactggcgagcctatcctcgaccactgacaatcgcggaggctgtcgcattccggcaacatgcccttcacagaacgccctccacaatggggaaccatgatccgtttcgagcacgtcaccaagcggtacgccgacggcaccaccgccgtcgacgacctttccttcgaggtcgccgagggtgaactggtcacgctcgtcggaccttccggttgcggcaagacgaccaccatgaagatggtgaaccggctgatcgaaccgaccgagggcgggatattcgtcgacggggacgacatatccgccatcgatccggtccggctccgccgccgaatcggctatgtgatccagcaggtgggactcttcccgcacaagacggtgctggagaacaccgcgaccgttccccatctgctgggctggaagcgcggaaagggacgcgaacgcgccgccgaactcctcgacctcgtcggactcgacccttccgtttatggcgaccgctatcccgaacagctttccggcggccagcgccaacgcgtgggcgtggcccgcgcattggccgccgatccccccgttctcctgatggacgagcctttcggagcggtcgatccggtcgtccgcgaacgcctccagaacgaattcctgaaactccaggcccaggtgcgcaagaccgtgctgttcgtcacgcacgacatcgaggaggccgtccgcctcggcgaccggatcgccgtctacggacagggccgcatcgagcagttcgactcccccgccaccgtgctcggagcccccgcgaccccgtacgtcgccgacttcgtcggcgcggaccgcgggctcaagcggctctcggtgacacccatcgaggagagcgacctcgaccagccgccggtcgtccacctcgacgacccgctggccacggccaccgaacggctcaggtcccagggagcgcgctgggcggtcgtcctggacagccgggacaacctccacggctggatccccgccgacgcgccggccgacgcgacggccgccggcgcatcggccaccgcccggggcgccgtccgcgaacacgcccgccggatggaggcctggctgccgctcggcgcacccctcaagcaggccttcgccaccatgctccagcacgacgcgggctggatcgccgtcatcgacaaggagagcgagggccgcttcctcggcgtgctgacccccgcccggctccacgaggccctgcgccgctccatcgacgcggacgcccaggacgtaccgcgcgccgaggtcgccgtggagacggtcgcgacgatcacccgggccacctgagtgctgtcccgaaccgtgccggggctcagctcgcgctgagacgggcgctcagccactccagggccggcgggatctcccgccgccaggtggtgaagttgtgcccgccgctgtcgagcacgatggaggacaccttcgcgggcgccttcaccttctcgatgaactccatcgtgctgccgagattgtcctcgccctcccgggacgtcgtcaccaggaacgaaccgccggacggcggccggttctccagggtccacatcaggtcggcgcggtcgcgcagttcctcgttcccctggaacagatcgcccgtcgtcgggtcctcggtcgccttgtagtacgcggagagcccggcgctcgccgcgtaccggtcggggtggtgcagcccgatcttcaacgcgcagtagccgccggtcgagttgccgatgatgccccagttgcgggccttctccccgacccggtaggaccccgcgatcgcctccgggaggtccttcgcgaagaacgtctcggtccgcgggcccccggggacgtccacgcactcggtgtcccggggcggcgcgaccgtcggccgcagcatcaccaggatcatcggccgggccttccccgccttcacccggtcgtgcgccgtctgcgggtagcgcaaccccttcagcaggttctccgccgtgcccgggtagcccgtgaggaccacggccgccgggaacgtccgcccggcgtacgccgcccggaagtattccggcggcagatagacgtacgccggggactcgatgcccgagatccgcccggagacgaccaccttgtcgatccgcccgccgaccgagggctcccggccgcccggcacgtccgggtgctgggtgccgatccgcgccatgtgccgcgagccggacccgttccccgcatggtcggtgaccacgccgagtccctgctgccggccgaagaggtcggcccacgacccgtagaagaggaacgcgttgttggccgccagacccaccgcggcgaacagcgtcaactgggtcgccagcagcagcccgacccggcccgacaccgcggccgccccgggccgggccaggcgcggccagagcccgaccgtggcggcgaacagcgcgacggcgaccgccgccacgaccgccaggactgcggtgctggtgagacccatgagcgtgctttctccgtgcttccttacgcgggccggatacgggaaatttccggaatgtgggtgaacccgcgctccgcaacccacgtcctagagggcgcacatcgtccgtggggctccggtcggcggactcaaggaatctctcgcgaagccacgggaagcgatgtctgtcacgctagatggggataattcggtgtcggttccgcagcgcgtccgccggttgctccgcgggccccgccccgcatccgtaccggcgctcgtcggcagcgcctgcaccgtcgtcgggctgatcgacgtcgccgccggggtctttccccgcttccggcacagccggatgcacaccctcgccgaggtgctccccggggcgctcggaccgttcgccgccgcgctctcgctcagcgcgggcatgctgctgctcctgctcgcacacgggctgaagcggcacaagcggcgggcctggcgcgcggcggtgatcctgctgcccgcgggggccgtggcccagttcgcgtaccgccactcgatcgtcggggtgctcgtcccgctggcgctctgctggctgctggtgcgccaccgggaccagttccgggcgctgcccgacccccgcagccgctggcgcgccctcgccaacttcgtcctgctcggagccggttcgctgggactcgggctgatcatcgtgagcgtccaccccggccgggtcgtcggcgacccgtccatcgccgaccggctccagcacgtgctgtacggcctgttcggcgtcgagggccccgtcgactacgccgggcgcaccagctggaccgtggcctactcgctgggcgcgctcggtctgctcaccgctgtcaccaccatctacctcgccctccgtcccgaacacccggccgcccgcctcaccgaggacgacgagagccggctgcgggccctgctggagcggcacggcggccgggactcgctcggccacttcgcgctccgccgcgacaagggcgtcgtcttctcccccagcggcaaggccgcagtctgctaccgggtcgtctccggagtgatgttggccggtggtgaccccatcggcgacgtggaggcctggccgggcgcgatcgaacggttcatggacgaggctcaggcgcactcctggacccccgccgtgatgggctgcagcgagaccggcggccaggtgtggacccgcgagaccggactcaccgccctcgaactgggcgacgaggcggtggtggacgcagcggatttctccctcgccggacgggccatgcggaacgtgcggcagatggtcaagcgcatcgaacggaacggctacgagacccgggtccggcgggcacgtgacatcggcgacaccgagctggaccggatccgccgcgccgccgccgactggcgcggaaccgacacagaacgcggcttctccatggcgctgggccggatcggcgacccggccgacggcgactgcgtgatcgccaccgcccacctgcccggctcgggtacggaggactcccctcacggcgacctgaaggcggtcctccacttcgtcccctgggggcacgacggcatgtcactggagctgatgcgccgcgaccgctcggccgaccccggcatgaacgagctcctgatcgtcgcctcgctccaggccgccgagaagctcggcgtcgcccgcgtctcgctgaacttcgccatgttccgctccgcgctggcccgcggcgagcggctgggcgcgggaccggtcctgcgctgctggcgcggactgctgatcttcctctcccgctggttccagatcgagtcgctgtacaagttcaacgccaagttcaagccccgctgggagccccgcttcgtggtcttccgcaccagccgcgacctgccccgcatcgggatcgcggcgatgcgggcggagggtttcgtgaacctgtcgctgcc

SEQ ID NO: 2933 - DNA, 18634 bp, Unknown
  Kingdom: Bacteria, Phylum: Actinobacteria, Class: Actinobacteria, Order: Streptomycetales, Family: Streptomycetaceae, Genus: Streptomyces
tccgggccccgcggggcccgccgcccgccgcccggccgtgtccgggccccacagggcccgggaaggccctgctccgcacacgccggagggcggccaccccgtggtgtacggggtgaccgccctccggtcgtctatgcgacgagcacgcgcctactggttgtacggaccgtagtcgtagtcctccagcgggacggcctggccggagccggtgccgaacggcgagtagtcgatgtcgtcgtagccgacggccgagtacatcgcggccttggcctcctcggtcggctcgacccggatgttgcggtagcgggacaggcccgtaccggccgggatgagcttaccgatgatgacgttctccttgaggccgatcagggagtccgacttggcgttgatcgccgcgtcggtgaggaccctggtcgtctcctggaaggacgccgccgacagccacgactcggtggcgagcgaggccttggtgatacccatcagctgcggacggccggaggcggggtgaccgccctcggtgaccacacgacggttctcggtctcgaacttcgaccgctcgaccagctcgcccggaagcagctccgcgtcgccggactcgatgatcgtcacgcggcggagcatctgccggatgatgatctcgatgtgcttgtcgtggatcgacacgccctgcgagttgtagaccttctggacttcgccgaccaggtggacctggaccgcacgctggccgaggatgcgcagcacgtcgtgcgggttggtcgcaccgacggtgagcttctggcccacctcgaccgggtcgccctcgcccacgagcagacgggcacgcttcgagatcgggaacgccgtctcgtcgctgccgtcgtccggggtgacgacgagcttcttggtcttctcggtctcctcgatccgcacgcggcccttggcctcggagatcggggcgacacccttgggcgtacgggcttcgaagagctcgacgactcggggcagaccctgggtgatgtcgtcaccggccacaccaccggtgtggaaggtacgcatcgtcagctgggtgccgggctcaccgatggactgggcggcgatgatgccgaccgcctcaccgatgtcgaccagcttgccggtggcgagcgagcgtccgtagcagaaggcacaggtgccgaccgcggactcacaggtcaggaccgagcgggtcttgacctcctcgacgccggcgcccaccagggcgtcgatcaggacgtcaccgaggtcgacgttggcaggcgcgatgaccttgccgtccaccacgacgtcctcggcgagcatgcgggcgtagaccgaggtctcgacgtcctccgtcttgcggagcacgccgtcggcgcccttgaccgcgatcttcagcttgaggccgcggtcggtgccgcagtcctcctcgcgaatgatcacgtcctgcgagacgtccaccagacgacgggtcaggtaacccgagtcggcggtacgcagggcggtgtccgccagacccttacgggcaccgtgcgtggagatgaagtactccagaacggtgaggccctcgcggaaggacgccttgatgggacgaggaatcgtctcgttcttggcgttcgacaccagaccacgcatacccgcgatctgacgcatctgcatcatgtttcctcgggcacccgagtcgaccatcatgaagatggggttcgtcttcgggaagttcgcgttcatcgcctcggcaacctcgttggtcgccttggtccagatcgcgatgagctcctgcgtgcgctcgtccttggtgatcagaccgcgctcgtactgcttctggaccttctcgtcctgctcctcgtagcccctgacgatggccttcttggcctcgggcacgacgatgtcggagacggccacggtgacgcccgaacgggtcgcccagtggaagcccgccgccttcaggttgtcgagcgtcgccgccacgatgaccttggggtagcgctcggccaggtcgttgacgatctcggagagctgcttcttgcccaccgagtagtcgacgaacgggtagtcctcgggcagcagctcgttgaagagcgcgcggcccaggctggtccgcagccggaaggtgtcgccgggctggtactccggctcaccctcctcggcgaccggaggcacccagccacgcggcggcatggtgccgaccgggaagcggatgtcgaccttcgcctgcagcgacagctcgcgggcgtcgaaggccatggtggcctcggccgtggagccgaacgcgcggtccgtgcccttgacgttgcggccctcttcgtccgtggtgaggaagaagaggcccagcaccatgtcctgggtcggcatggtgacgggacgaccgtcggccggcttcaggatgttgttcgaggacagcatcaggatgcgggcctcggcctgcgcctccgcggaaagcggcaggtgcacggccatctggtcaccgtcgaagtccgcgttgaacgcggtgcagacgagcgggtggatctggatggccttgccctcgaccagctgcggctcgaaggcctggatgcccaggcggtgcagggtgggcgcacggttcagcagcaccgggtgctcggcgatgacctcttcgaggacgtcgtacacgacggtgcggccacgctcgaccatgcgcttggccgacttgatgttctgcgcgtggttcaggtccaccaggcgcttcatcacgaacggcttgaagagctccagcgccatcgccttcggcagaccgcactggtgcagcttgagctgcggaccgacgacgatcacggaacgcgcggagtagtccacacgcttgccgaggaggttctgacggaaacggccctgcttgcccttgagcatgtcgctcagggacttcaggggacggttaccgggaccggtgaccgggcgaccgcggcggccgttgtcgaacagtgcgtcgacggcctcctgcagcatccgcttctcgttgttcacgatgatctcgggagcgccgaggtcaaggagacgcttgaggcggttgttgcggttgatcacacggcggtacaggtcgttcaggtcggaggtcgcgaaacggccaccgtccagctgcaccatcggacgcaggtccggcgggatgaccggcacgcagtcgagcaccatgcccttgggcttgttgctggtctgcaggaacgcggagacgaccttgaggcgcttgagcgcacgggtcttcttctggcccttgccggtgcggatgatctcgcggaggcgctcggcctcctcgtcgaggtcgaaggactccaggcgcttctggagcgccgcggcgcccatgcagccgtcgaagtacgtaccgaagcggtcacgcagctcgcggtagagcagctcgtcgccctccaggtcctggaccttgaggttcttgaagcggctccacacctcgtcgaggcggtcgatctcgcgctgcgcacggtcgcgcagctgcttcatctcacgctcggcgccttcgcgcaccttgcggcgcacgtccgccttggcgccctcggcctccagctcggccaggtcggtctcgagcttcttggcgcgggcctccaggtcggagtcgcggcggttctcggtctgctggcgctcgacggagacgtgagcctccagggacggcaggtcgcgggtacgacgctcctcgtccacgaacgtgatcatgtacgcggcgaagtagatgaccttttccaggtccttcggcgcgaggtccagcaggtagccgaggcgcgagggaacgcccttgaagtaccagatgtgggtgacgggagcggcaagctcgatgtggcccatccgctcacgacgcaccttggcgcgagtgacctcgacgccgcagcgctcacagatgatgcccttgaagcggacacgcttgtacttgccgcagtagcactcccagtcccgggtcggaccgaagatcttctcgcagaagagtccgtccttctcgggcttgagcgtgcggtagttgatggtctccggcttcttcacttcgccgtgcgaccaggtccggatgtcgtccgcggtggcaaggccgatccgcagctcgtcgaagaagttgacgtcgagcacttgtcgtcaatccctctttcggggtctcgtctcaatcaatggtctgaacgggtccggggagggccggccgcctcgggacgaggcggccggccggcccgtcagacctcttcgacgctgctcggctcgcgccgggacaggtcgataccgagttcctccgccgcgcggaagacgtcctcgtccgtgtcgcgcatctcgatggacatgccgtccgaggacagcacctccacgttgaggcagagcgactgcatttccttgatgagcaccttgaaggactcgggaatgccgggctcggggatgttctcgcccttgacgatggcctcgtagaccttcacgcggccggtcacgtcgtcggacttgatcgtcaggagctcctggagggcgtatgcggcgccgtaagcctcaagggcccacacctccatctcaccgaagcgctgaccaccgaactgtgccttaccacccagcggctgctgggtgatcatggagtacggaccggtcgaacgcgcgtgcagcttgtcgtcgaccaggtggtgcagcttgaggatgtacatgaacccgaccgagaccgggtccgggaacggctcgccggagcggccgtcgtagagctgggccttgccggagggctggaccaggcggtcgccgtcgcggttggggatcgtggcctggaagaggccggtgatctcgtcctcgcgcgcaccgtcgaagacgggcgtggcgacgttggtgccgggggcgacctggtcggcgccgatgagctgcaggcgctgggcccactcgtcaccgaggccggagacgtcccagccgcggctggcgagccagccgaggtggatctccaggacctgtcccgggttcattcgggacgggacacccagcgggttgaggatgatgtcgaccggggtgccgtcctccaggaacggcatgtcctcgatcggcaggatcttggagatgacgcccttgttgccgtgacggccggcgagcttgtcaccatcggtgatcttgcgcttctgcgcgacgtagacgcggaccagctggttcacgcccggcggcagctcgtcgccctcttcgcggtcgaagacgcggacgccgatgaccttgccgatctcgccgtgcggcaccttcagcgaggtgtcgcgcacctcgcgcgccttctcaccgaagatcgcgcggagcaggcgctcctcgggggtcagctcggtctcgcccttgggcgtgaccttgccgacgaggatgtcgccggcgacgacctcggcaccgatccggatgatgccgcgctcgtcgaggtcggccaggacctcttcggagacgttcgggatgtcccgggtgatctcctccgggccgagcttggtgtcacgggcgtcgacctcgtgctcctcgatgtggatcgaggagaggacgtcgtcctgcacgaggcgctgcgacaggatgatcgcgtcctcgtagttgtgaccctcccacggcatgaacgccacgagcaggttcttgccgagggccatctcaccgttctcggtggccggtccgtcggcgagcacctggtcggccacgatccggtcgccttcggagacgacgaccttctggttgaccgaggtgccctggttggagcgcatgaacttggcgatgcggtacgtggtgtacgtgccgtcgtcgttcgtgacggtgatgtagtccgcggagacctcctggaccacaccgtccttctccgccttgaggacgtcaccggcgtcggtggcgcagcggtactccatgccggtgccgacgagcggggcctccgacttgatgagcggcaccgcctgccgcatcatgttcgcgcccatgagggcacggttggcgtcgtcgtgctccaggaaggggatcatcgcggtggcgacggacaccatctggcgcggcgagacgtccatgtagtcgacgtccgtgccgggcacgtagtcgacctctccgccacgacggcggaccaggacgcggggctcggtgaagcgcagctcctcggagagcgtcgcgttcgcctgggcgatgacgaagcggtcctcctcgtcggccgtgatgtagtcgacgtcgtcggtgacctggccgtcgacgaccttgcggtacggcgtctcgatgaagccgaacgcgttgacgcggccgtacgaggcgagcgaaccgatcagaccgatgttcgggccttcgggggtctcgatcgggcacatgcgtccgtagtgggacgggtgcacgtctcggacctcgaagccggcccgctcacgggagagaccacccgggccaagagccgacaggcggcgcttgtgggtgagacccgacagcgggttgttctggtccatgaactgcgacagctggctggtgccgaagaactccttgatggaggcgacgaccggccggatgttgatcagggtctgcggcgtgatggcctcgacgtcctgagtggtcatgcgctcacgcacgacgcgctccatccgcgccaggcccgtacggacctggttctggatgagctcgccgacgttgcgcagacgacggttgccgaagtggtcgatgtcgtcggtctcgacgacgatctcgcgacccgactcaccggtcgtctcggtctcaccggcgtgcagcttgaccaggtacttgatggtcgcgatgacgtcgtcggtggtgagcaccccggcgtccagcggctcatcggcgccgagcttcttgttcaccttgtagcggccgaccttcgcgaggtcgtagcgcttcgggttgaagtagaggttctcgagcagcgtctgagcggcctcgcgcgtcggcggctcgcccggacgcagcttgcggtagatgtcgagcagtgcgtcgtcctggccctgggtgtggtccttctccagggtggcgcgcatcgactcgtactcgccgaactcctccaggatctgctcggtgctccagccgagagccttgaggaggacggtgacggactgcttgcgcttgcggtcgatgcggacaccgaccatgtcgcgcttgtcgatctccatctccagccaggcaccccgggacgggatgatcttggcggagaagatgtccttgtcggacgtcttgtcgatggaggagtcgaagtagacacccggcgagcggaccagctgcgacacgacgacacgctcggtgccgttgatgacgaaggtgcccttgttggtcatgagcgggaagtcgcccatgaagaccgtctgggacttgatctcgccggtctcgttgttggtgaactcggccgtgacgaagagcggcgcggcgaacgtgaagtcgcgctccttgcactcgtcgatcgagttcttcgggggctcgaagcggtggtcgcggaacgtaagcgacatcgacccggagaagtcctcgatcggtgagatctcctcgaagatctcctccaggccggacttggtggggacgtcttgtccactgtccagagcagcctcgacgcgagccttccaggcggcgttgccgaggagccagtcaaagctctcggtctgcagcgcgaggaggttcggaacctcgaggggctccttgatctttgcaaaagagatgcgcagcggggcggtgctggcaccgttgttcgtattcgcggtcgaggcgttgcgcgaggcggccaagagggggtccttccgagggctcggactcactacgcgcgtaccggtcccaccctggacacaaagacaggccgttccaaatcggtcgcaaaacgaccagatcggagggggtcggtcatcggtgcttcagcgtgggcatgcccctggtgacgggcaggaggcagctaacaggcagcgcaaagggtcagtgtagccaagcggcacactgatgtccagtcggggttctcagagacccacgttgctctcaacagctgttctcaacacctatgtctagccctagccctcgcgcggggtgcgctcttctttactgccctcttcactctcgatccatgcctcggatacggatcgaagtgatgacgcgtcctgagaattgcgcgccgcgtccggttcgtcaaggcccgccggtccgatcggacctccaggagccttggccggccacccccgggaagcccccgggacgcccctgaggggcccgcgagaggcgcacggcgaagatcaccctactcgtcgtcggcggaagagcaaggcaccctccacgggcacgccgaagggcgaccacccggatgggtgatcgcccttcggtgaggagatgtcatcgccttacggcgaggacggcctcgggagagtcaggagactctcgaagtcacttgacctcgacggaagcgccggcggccttgagggactcggcagccttctcggcggcctccttggcgaccttctcgaggaccggcttcggggtgccgtcgacgaggtccttggcctccttgagacccagcgaggtcagctcacgcacgaccttgatgacctggatcttcttctcgccggcaccggtgaggatgacgtcgaactcgtcctgctcctcagcggcctcggcaacggcgcccgggccggccggaccggcgacggcgacggccgcggcggcggtgacgtcgaacttctcctcgaaggccttcacgaactcggagagctcgatgagggtcatctcttcgaactgcgcgagcaggtcgtcctgggacagcttcgccatgataggcgtccttccactattcggcaggtgccggatgtatatgtcggcgggcgtacgtggagcccgctggaccgctgagcgaaattactcggcggcctcggcgggagccggagtaccggcaccgccctgctcttccttcttggcacgaagagcttccgcggtgcggacgaacttggagggcagggcctggaagacctgcgccgcctgcgtctgcttgcccttgaaagcaccggccagcttggagagcagaacctcgcgggactcgaggtccgcgagcttcttgatctcatcggcggacagcgccttaccgtcaaggacaccgcccttgatgatgaggttggggttgtccttggcgaagtcacgaagacccttcgccgactccaccgggtcaccggtgacgaaggcaaccgccgtcggacccgagaacaggtcgtccagcgtgtcgatcccggcctcgttggccgcaatcttggtcagcgtgttcttcaccacggcgtactgggcgttctcaccgagcgaacggcgcagctccttgagctgtgccacggtgagaccccggtactcggtcagcacggcggcgttcgagctgcggaactggtccgtcagctcggctaccgcggcagccttgtcgggccttgccatgagcgtcggcctccttccgggtgatgaggaccgctcagaaggggccgggaaagacgaaacgccccagcacaagtgccagggcgcggctcgaccgaacagagtccgggagcgttccacagtcacctgcgcaggtcgtccgatctagcggaaccttcggtcaccgtccctctgacgaggcacagcgacgaccagcggtctttggcttcttggtgagagtacgcgaccggatgcgggacgagcaaatccgtccccgttcgtccctcgcgggaggtgtcaggaggcgccgcccggggtatcgccctgctgcttcagcatctccttgaagtccacggtgtccgaggccgacggcttctcggaggggacctcggtgccgtagtcgctgtagaagagcgtcgagttgaacgtgccggtcttcatctcgccgcgctcggtcttcttcaccagcaggtcattcttgtcgacccagatgtcgacggtctgcgtggtcaccccggccagggcgagctgctccttgaacgcggccagctgcttcgcgtccaggttgctgttcttcgcggtcaggtcggccacgtcgaccgtgccggagtagtgcgtcgcggggaccccgcggacgtcctcctggccgaccttcttcacgtcgccggaggccaggagcgccttcacgccctgctcgggcgtgctgttctggatctggtccttcatgacgtcgccggaggccccgcccagctcggcgaggtccttgtaggaataccggatccagtgcttgccgccggtgttggccgccatggcgtcgcccatgttggcgtagtactcgtccttgaagtagcgcgcctggaccgatccgtcgccgccggcctgcttcagggcgtcgcccatggtgccgccggtgtacgtgatggtcagcgcgcccgagaggccgtcggcccagccgatggccccggactgcttcatggacatggtgctgcccatctcggtggtgccctcgaccttcgcggactgggcgcctccggtcttctgctgcacctgcttcagcgcggccacggggctcgccttgccgacggcgcccgccttgtccttgccggagccgccggcgccctccgagccgtcggagccactgcaggccgctatcgacgtcagtgccgccgcggcggccagagccgtgcccatgcgtcgtgccgtgctcgtcctcatgtaaccggtccacccctcgtatcgtccgtcgtcccccgaaccacagtgacacagggcactgacagccagagggccttacggatacgaggacgggccccgcacctcgaaaggttgcggggcccgttcacacagtgcacgcgtgcgacgcggctaccgggtgagcatggaagctcagacggaggccgggtcctcctcgacgaggaggttgcgggtgcggttggcgtccagcgggatgccggggcccatcgtggtggccagcgtggccttcttgatgtagcggcccttggcggcggacggcttcagacggaggatctcgtccagcgccgctgcgtagttctccaccagcttggtctcgtcgaacgaggtcttgccgatgatgaagtgcaggttcgagtgcttgtcgacgcggaactcgatcttgccgcccttgatgtcgttgacagccttcacgacgtcgggggtgacggtgccggtcttcgggttcggcatcagaccacgcggaccgagcacgcggcccaggcggccgaccttgcccatgaggtccggggtcgcgacgacggcgtcgaagtccagacggcccttcgccacctcgtcgatgagctcgtcggcgccgacgatgtcggctccagcggcttccgcggccgcagcacggtcaccggtcgcgaagaccaggacccgggcggtcttgccggtgccgtgcgggaggttcacggtgccacggaccatctggtcggccttgcgcgggtcgacacccagggcaaaggcgacctcgacggtgctgtcgaacttcgtggaggcggtgtccttggcgatacggacggcctcgagcggggcgtagttgcgctcccggtcgatcttggcgtccgcagcgcggaggttcttgctgcgcttcacttctactcctgtggtttcagagtgtggagtcgtggtgcggaccagcgcttggtcctaccactgggggctacggggctgaatcagccttcgaccgtgatgcccatggaacgggcggtgccggcaatgatcttcgacgcggcgtcgaggtcattggcgttcaggtcggggagcttcgtcgtggcgatctcgcggacctgggcggccgtcagcttggcaaccttggtcttgtgcggctcgccggagcccttgtccacacccgcggccttgaggatcagcttggcggccggcggagtcttcgtgatgaaggtgaaggagcggtcctcgtagaccgtgatctccaccggcacgaccatgccacgctgcgactcggtcgcggcgttgtaggccttgcagaactccatgatgttgacgccgtgctgaccgagcgcggggccgaccggcggggccgggttcgccgcaccggcgttgatctggagcttgataagccccgtgatcttcttcttcttgggaggcattgctctctccgggtcctagtgagagtgtttcgccgccaattccggtcatccggatggaggcataccgcacaacgataacgggtatagctgcgcgaccaaaaaccaagcaggtcagagcggctgcgaagcccctctgacctgctgggtaggcatgtgtccagaatccggcgggaagcgctagttcttctggatctggtcgaagctgagctcgaccggggtctcgcggccgaagatctcgacgaggcccttgaccttcttcgagtcggcgttgatctcgttgatcgtggcctgcagcgtggcgaacgggccgtccgtgacggtgaccgagtcgccgacctcgaagtccagcacctggacctcgaccttgcgggacggagccggcttgccctcggcctcggcggcctcgcgggcggccttctcctcggcctccggagcgagcatcttgacgatctcgtccagggtcagcgggtacgggtcgtaggcgttgcccacgaagccggtgacacccggcgtgttccgcacgacgccccaggactcgttcgtcaggtccatgcgcaccagcacgtagccggggagcttgttctgccggacgttcttgcgctcgccgttcttgatctggacgatttcctcttcaggcacctcggcctgatagatgaactcctccacgttcagcgagacggcgcgctgctccaggttggccttcacacgcttctcgtagccggcgtacgtgtggatgacgtaccactcgccggggagcgtgcggagctcttcgcgcagggcggcgacggggtcgacgggggcggccggctcggcctcttcctcgtcggcgctctcgtcgtcagcctcggcggcctcttcctcagcggcctcgtcctcgacggactcgactgcctcggcggcgtcgtcctcgtcggactcctccgcctcgacgttcacggcggcctgctcggcgggctcgcccgcggcgaggtctgcggcctcggcctggtccgggtccacggagtcagcagcctcaacgatgtcgagctcgtccttggcggactcgaaggcgccagcctcgggctcgacggcgtcgttcaggttcgggtcagacacgatggctgcttcttcctggatacaaagggtggaacgtgcgaaaggggcgccgggtcggacgccttccgcgagatcagccgaagacgtacttgatgacccgggcgaagcccatgtcgagaacggtaacaagaccgatcatgacgacgacgaacacgatcaccacggaggtgtacgtcgtcagctggctacgggtcggccagacaaccttacggagttcggcgacgatctggcggtagaacagcgcgagccgacccagagggcccttcttgccgcgcttgccgcccttccgagtcttcttcttcgactcgggagcttcatcctcagcatcaggcatgtcgatggagcccacggcgtccgtcacgctactcacctgattccgggtcgtggccgtgccgcgcccggtggagccgcacggctgtgcaatgaagtacgtacatgcgcacacatcctggcgaaggagtgtgtagcagggccggagggacttgaacccccaaccgctggttttggagaccagtgctctaccaattgagctacgaccctttgtggtttccaccaacctaccgcatctttcccggtgaccgggtgcaggaacggtgcggctggtgaaggccaacgacaggtgagtgtacgtgttcagggccgccgcgtcgaacagacaactaccgaccggtcctgtccgcatgctgtccgggtcctgtccggtccctgaaacccctgtgccgacggcttcagcggtctgggagcatggggccatgagcgctgcaacttcaccgtccgagcgccgggtttccgcccgcatcggtgcgatctccgagtccgcgaccctcgccgtcgacgccaaggccaaggccctcaaggccgccggacgtccggtgatcggcttcggggccggcgagcccgacttcccgacgcccgactacatcgtcgacgccgcggtcgaggcctgccgcaacccgaagtaccaccgctacacccccgcaggcgggctccccgagctcaaggccgccatcgcagagaagacgctgcgcgactccggctacgaggtggacgccagccagatcctggtgaccaacggcggcaagcaggccatctacgaggccttcgccgcgatcctcgacccgggcgacgaggtcatcgtccccgccccgtactggaccacctaccccgagtcgatccggctcgccggcggtgtcccggtcgaggtcgtggccgacgagaccaccggctaccgggtctccgtcgagcagttggaggccgcgcgcaccgagaagacgaaggtcgtcctgttcgtctcgccgtccaacccgaccggcgccgtctacagcgaggccgacgccgaggccatcggccgctgggccgtcgagcacggcctgtgggtgctcaccgacgagatctacgagcacctcgtctacggcgacgccacgttcacctcgctcccggcgatcgtccccgagctccgcgacaagtgcatcgtcgtcaacggcgtcgccaagacgtacgcgatgaccggctggcgggtgggctggatcatcggtccgcgggacgtggtgaaggccgcgaccaacctccagtcgcacgccacctccaacgtctccaacgtcgcccaggtcgccgcgctcgcggccgtctccggcccgctggacgccgtcgccgagatgcgcaccgcgttcgaccgccgccgggggatcgtcgtgcggatgctcaacgagatcgacggcgtgttctgccccgagcccgagggcgccttctacgcctacccggccgtcaaggacctgctcggcaaggagatccgcggcaagcgtccggccaccaccgtcgagctggccgcgctcatcctggacgaggccgaggtcgccgtcgtcccgggtgaggccttcggcaccccgggctacctgcgcctgtcctacgccctgggcgacgacgacctgatcgagggcgtctcgcggattcagaagctgctgggcgaggccaaggcctgaccggtcacggaccgctcgaacagaaagcgtccccggccgccggaatcctccaccggccgggggcgctttttgttcgagcggcacccctaaacgggaaagcggctaccgctccggcccgcccgtgcggcaggatcttccaatggagcgtgatgtacgtctgttgcccaaggcccacctgcacctgcacttcaccgggtcgatgcggccaaccaccctgctcgaactcgccgacaagtacggggtccatctccccgatgccctgaccggcggcgagccgcccaaactgcgggcgaccgacgagcgcggctggttccgtttccagcggctctacgacatcgcccggtcgtgtctgcggtccccggaggacattcaccggctggtgcgcgagagcgcccaggaggacgtcgcggacggctccggctggctggagatccaggtcgaccccacctcgtacgccccgctgctcggcgggctgatcccggccatcgagatcatcctcgacgccgtggacagcgccgcacgggacaccggcctggggatgcgcgtggtgatcgccgccaaccggatgaagcacccgctggacgcccgcaccctggcccggctcgccgtgcgctacgcggaccggggcgtcgtcggcttcgggctctccaacgacgagcggcgcggcatggcccgcgacttcgaccgggccttcgccatcgcccgcgaggggggcctgctggcggctccgcacggcggggagctcgccggaccctccagcgtgcgcgactgcctggacgacctggacgcctcgcgtatcggacacggcgtccgggccgccgaggacccccggctgctgcgcaagctcgccgagcgcggggtcacctgcgaggtctgcccgtcgtccaatgtggcgctcggcgtctacgagaagcccgccgacgtccccctgcgcactctgttcgacgcgggcgtgccgatggccctgggggcggacgacccgctgctgttcggttcgcggctggccgcccagtacgagctggtgcgccgccaccacggcttcaccgacgaggagctggccgagctggcccgccagtcggtgcgcggatcggcggctcccgtggacgtacgggagaagctgctctccggcatcgatgactggctggctagctgatcccgggctcccccgggccgatcccgcccagcagcgtccgggccagcgacgcggcgaagtcgtccagggactgcggaggcgtgccgccggggagcgcggcgtaggcgaaggcccgctgggcacaggcgcccagcagcagggaggcggcggcgtaggtgtccgcgcctgcccggatgcggccggcgcgctgttcggcgcgcagataggcgtcgagttgcaggatcggcaggtggggcccggcttcgagccctcccacgccctgctcgtggcggcgcttgagccggggttcggcgtacagggacgcggccatgggaaaggtctgctcgtagaacagggcggccactcgggcgatctcggtgagattgccctcgaccgtcccctcgccggcgctcagttcgccgagcaggtttccgagccggggcagtcgctccgcgagaacggtgacgaacagctcctccttgccggagaagtacttgtagagcgccgcctccgagcagccggccgcccgggcgatctccttggtggtggtccgggcgaggccgatggagagcatcagctcgtgcgccgcgtcgacgatccggacgcgggcgggcttctggtccatgtgtgctccaacagtccgtgacccggagatcttgacgtccggatggggagccactcaccctagaggttagtgaacactcacccacaaggggcgcgctatgagaatcaccgtgttcggagcgaccggcggcgtcggccaggagctcgccgggcaagccctcgcggcgggccacgaggtgacggtcgtggtccgcgacccggaccggctcccggcgcggctggatcgggcgtcgttgcacgctgtcgtccggctggaagatccgtcggcggtgcgggcggcggtggcggggcgggacgcggtgctctcggggctgggttcacgcggtcggaaggcgaacggcgtcgccgaacggctgacggggaagatcctgacggcgatggaggccgagggggtgcggcggctggtggtggtgagcgcggtgcccgtcgggccggagccggagggcgaccccctggtggaccggctgatgcgcaaggcgatcggggcggtcctggcggagctgtacgccgatctcgcccggatggaggcggcgttggccgacagcgcgacggactggaccgcggtgcggccgccgaaactgacggacgggccgcgtacgggtgtctaccggcaggtcgtgggcggtacgccgcgcagcagccggtccatctcccgggccgatgtggcacacgcgatgctcgcgtcgatcgacgacccggcgaccgtgaagcagggcgtgggcgtcgcgtactgacccgtacgccgccgagaggccctacaggctgacgccgaccgtcaccggttcgttgaccagggtgacaccgaaggcctcgtgcaccccggcgacgacctcgcgggccagggcgagcaggtcctcggtggtggccgcgccccggttggtgagggcgagggtgtgcttggtggagatccgggcggggccgctgccgtagcccttggcgaaaccggcccggtcgatcagccaggccgccgaggtcttggtgcgcccgtcctcggcggggaaggccgggggcgtcacgtccgggccgaggtgctcgccgacccgggtgaggaagtcctggaacgcggccggttcgaggatcgggttggtgaagaaggaccccgccgaccaggtgtcgtggtcctccgggtccagcaccatgcccttgccggcgcgcagccgcagcacggtctcgcgggcggccggcagcgggacgcggtcgccctgctcgacgcccatggccctggccgtttcggggtacttcaggggcgcggaaagcccggccgcctcttccagctcgaatcggacacgcagcaccacgaagcggtcgggttcggccttgaagcgactgtggcggtacgagaaggcgcactccgcgttcgaaatcgtcaccgtctcctcggtgcgccggtcgtaggcgacgacctccgtgatggtggtggacacctcctgtccgtacgcgccgacgttctgaatgggggtcgcgcccgccgatccggggatcccggccagacactcgacgcccgcgaggcccgcctcgacggtccgggcgacggcgtcggtccacacctcgccggccgccagctccagggacgtccccgagagcgcgaaacccttcgtggcgatccgcagggcggtgccgtcgaagcccttgtccccgatgaccaggttggatccgccgccgatcaccagcagcggggtgccgctcgcgtcggcctcgcgcacggcggcgatcacctcggcgtaggtcgtggcggtcagcagccgggcggcgggaccgccgagccggaaggtggtcagaggggcgaggggggcgtcgtggagttcctgcacggggacaagagtacggtccgcgcccccgccgctcgtgcggggccacggaccgcgggccgggaccggggcgggtccggcggacccggtcaggac

SEQ ID NO: 2934 - DNA, 1277 bp, Unknown
  Kingdom: Bacteria, Phylum: Actinobacteria, Class: Actinobacteria, Order: Streptomycetales, Family: Streptomycetaceae, Genus: Streptomyces
ccggtcgcggatccggtggacctgggcgtcccgaagcggaggttcggcgtcaggcgagggggacggccaggctgtgcagatagcgcatcagggtcatcagcacatcacggctggaggcccgcagccgggcgtcgcagtcgatcatcgggacctcgtccggcaggtcgagggctctgcgcagggcctcgaccgggtggtgcggcgcgtcggggaaggtgttcacggccacgacgaagggcactccgcgctcctccaggcggccgatgacgtcgaagctgacttcgagccgtctcgtgtcgatgaggacgaccgcgccgagggcgccctcgaagaggccgttccacaggaaccagaagcgttcctggccgggggtgccgaacagatagaggatcagttcctcgctgaggctgatccgtccgaagtccatggcgaccgtggtggcggtcttcgtctccaccccggcgttgtcgtccacgccgacaccggcctgggtcatggtctcttcggtcgtcagcggccggatctcgctcaccgagccgaccatggtcgtcttgccgacgccgaacccgccgacgatcacgaccttcaccgcggcggtggccgtggtgggaaggacgtcctcgctgcggggtccggtgatcgtgtcagagcttctgaagtccatgcatcaccgcttcgagaagggacctgtcggggagagtggcgcggacgatcggcgcacgcgactcgatgagttcggtcgcgaggagatcgctcaggagcgaggtgaccacgctgaacggcaggctgaggtaggccgagatctcggcgacggacaacggcgcctgacagagccgcaggatggccgcctgctcgggctggaaggtcggcgagggctccgcctgcgcgacgaccatcgtgaccaggtcgagcgcggaccgttcactgtcgtcgagatcgccggtgatcacgtacagccgttccggatcgtgcaggtccggatcggccttgcggcgctctcgtcgaggtccactcatccggactgcccgccgtggcggggcgggctggtcaggtgggctccgatccgcacgaccatgtcccgcatccgggctccgacgagtccggcgtcgacggtctcgccggccaggaccgcgagataggcaccggtcccggcggccatcaggtagaagaacccacccgtcacctcgatgaccacgagcttcatgaggccgtcgctgtacgggatctcggtggccaccgcggcggccaggctctgcagtccggcgcaggccgccgcg

SEQ ID NO: 2935 - DNA, 2066 bp, Unknown
  Kingdom: Bacteria, Phylum: Actinobacteria, Class: Actinobacteria, Order: Streptomycetales, Family: Streptomycetaceae, Genus: Streptomyces
gccccgaccgcggtcggggccttcgctgtgtgcggggacccggtgcggcaaggccggtcagcccacccagcagcgcgtcaccttgtcgtcctcgacctggaagttgatgcggccgtggcggaactccatggtgaggaacgtgcccgggggaacggcccggaccgtgtcccagccgcggttcctggcctgccgctcggcggcgtcggcggcgaggccgacgtacgaatcggcggcgtcgtccggctgtgacggaggggtcggtagagatgccatgtcttcaccgtaggcggccccggaccacggcggaaggccgggccgggacggcgtccggggagggatcctgggaggcgccctcctgcatccccacatgccgtggcggtcacgcttgtgtcacaggatccccacacgtgtatacgcggtgctattcactcgaacggctcgatcggaaccatcggcgcacattaacgggaaagctcgttcaccagcgcgagggggtgccggaatccttccggaatcatgggggtgacctgcttcttctcccatcggcggggggtgtcgccggaatggccgggacaccggaatttcccgcccccgtaaaccggcctttcctttccgcacgcttccccctcccaccggccgggcgcggtgaagcgggcggtcacccacacccgaagtctcacggtccgccgagcgcgcgcgtgagccggtccctcgccacccgcatgacctcggtcagctcgggcggctcgatcacctcgaattcgatccccatcatcagcacgtggatcaccagcacggtgaggtccggagcgcccgcggtcagccggcaggtgtccgcgtccatggcctccagcaccccggcggacggcgacacccgccgcgcggcctccgccaacggggccttcagcaggatcacggcccgggccgcgtacgccgagaccgcgacaccccgggagacgtaggccgccagatcgtccgccggcggagggcgcggcgtgaaacgggggccgtgcggcggggtcggggtgatccggtccacccggaaggtgcgccagtccgcccggtccggatcccaggccaccaggtaccagcggcgctcggtgcagacgagccggtacggctccacggtccggcgcgagacctccccgccgtgcgtccggtaggcgaaccggagccgctcggtgtcccggcaggcggccgccagctcagtgagcacggcggggtccacggcggagtcgtccgccccgtgcagcatcggcacggtgaacgcgccgagcgcgctcacccggcggcgcagccggtgcggcagcacctgttccagcttggccagcgcgcgtacggaggtctcgccgatgccctcgatgccgtgtccggcggccgtgcgcaggccgacggcgaccgcgacggcctcctcgtcgtccagcagcagcggcggcagctcggcgccggccccgagctggtagccgccgccggtgccccggctggcgttcaccgggtagcccaggtcgcgcagcttgtcgacgtcccggcgcacggtgcgcggggtgacgccgagccggtcggccagatcggcgccggaccagtcccggtgggcctggagcagtgagagcaggcgcagcagtcgtgccgaggtctccaacatgcgggcgagtctgccagggattgcggacagtctccgtccgcaattccctttcctcagcgacccgccggtccgggctccagccggaggcacaggtcgttgtcggcggtgtagcaaggagtggcgagcaccccgggggccgcctcgcgggtcgggtagacgaaggacttgtggcgggaccagacgtcgtcgaggatgcgggagatcctgaccccggccgcgcccgccgccgggacgagccacagctgccagagctgcccctggtgcaccggtccctcggccggcgggccgtaggacaaggtgcaggcgaagttgccggacggcccgtcggcgggagtgagcgggaagctgtgcgtccgggccgggtcccccggcagccgggcctccacggcggccccctcccccacggcgacgccgtacagcatgc

SEQ ID NO: 2936 - DNA, 4867 bp, Unknown
  Kingdom: Bacteria, Phylum: Actinobacteria, Class: Actinobacteria, Order: Streptomycetales, Family: Streptomycetaceae, Genus: Streptomyces
gcgtctcccctttacggagccgcgcgctccgtaaaggggagacgctccgcgtcctcctgggtccgtcggacggcccgtcagcacaggcattgacagaaggcccgggccaccacggacactgtgacgggccgggccttcgtcaatctctttttctgaccaaggtgtccggatatcgggggtcgctctccggaacatgtgttaacagtccgtttcgggcgtgtctgtctgggatcgctttgtccggatttcgggcacgcagagggtgctgatgttgtcaaaccgagaccctttaagtgtggtttacagcccggccgtactcaatagttggctccattgagctcgggtcaatgggtcacgcactgtggggagtgccgactcacgagcacactcggggcactgaacgatcaccgtcaggggtgtcggtgaatctctccagtgcccctcttgtagtcaaaagtggactcatgaggaggaaacccatgcgcggtgccaagagcgccaagtgggtcgcgggagcggccgtcatcgccctggccgcgactgcctgtggcggaagcgacagtagcgacgaaggcaagaagaacacgtcgggccagcccgccggttacgtctcgatcgacgtcggtgagccccagaagcctctgatgccggccgacacgaacgagagcaacggctcctacgtcatccagtcgctgttcacccagctgctggacttcgacgacaagggcgagatcgttctcacgaacgccgagtccgtcgagtccgaggactccaagacctggaccgtcaagctcaaggccggctggaagttccacaacggtgaggccgtgaccgcgcagtcgtacatcgacgcgtggaactggtacgccaacgtcgagaacaagcagcagaacgcgttctggttctccgacatcaagggctacgcggacgtccaccccgagaagggtgcgccgaagtccaaggagatgtcgggcctgaaggccgtggacgacaccacgttcacgatcgagctgtcggacaaggtcccgtacttcaactacaagctcggctacgcgacgttcgcgccgctgccgaaggtcttctacgacgacccgaaggcgttcggccagaagccgatcggcaacggcccgtacacgttcgagaagtggacccacaagaagctcatccaggtcaaggcctgggacgagtaccagggcccgaacaaggctgccaacaagggcatccagttcaagaactactcgaccgtcgaggccgcgtactcggacgtcatctccggcaacctggacatgatccgtcaggtcggcccgcgtgacctcccgaagtacaagacggacctcggtgacggcgcgatcgagcagccctacgccgcgatccagtcgctgaacccggcgttctactcgaagacgttcaaggacatcgaccccaaggtcctccagggtctgtccatggcgatcgaccgtgacaccatcacgaagaccgtcctgaacggcacccgcaccccggcgacgagcttcacgcccccgcaggtcaagggcaaccagacgctcgactccgacatcctgaagttcaacccggccaaggccaagcagctcatcaaggagggcggcggtgttccggagaacaagatctcgatccagtacaacgccgacggtgggcacaaggagtgggtgaccgctgtctgcgagtccatccgcaacgccaccggggtcgactgcgtcggcgacgccaagccggacttcccgaccgacctcgaagcgcgtgacaacaacgaggtcaagggcttctaccgcggtggctgggtggccgactaccccgtcaacgtgaacttcctcaaggagctctaccactccaaggctgagtcgaacaacggtcggttcgccgacaaggagatcgacgcgctgatggcgaagggtgacaaggccgactcgctcgaggcctccgtcgccgcctaccaggaggtcgagaaggccctggtggacaagatgcccgccatcccgctctggtactacgcgatcaacggcggccacggcaagaacgtcgacaacgtcaaggtcgacttccacggtgacctcgaactgaccggcgtcaccaccaagtaacgcctgcgggtcattccccaactggccgtcatccgcccgtgctgcccctcagcacggccggaggcgcgggggtcgtctctgcgaagaggcggcccccgcgccgcagttatccccacacggaggcacccatggggcgctatgtcgcacgacgactgctccagatgatcccggtcttcatcgggtcgaccttgctggtcttcctgatgatgtacgcactgcccggcgaccccgtcagagcacttgccggtgaacagcacgtagatgctacgcagatcgccgcactgaaggccgatctgggactggaccagccgatctggcagcagtatttgaactacctgggcaatctgttccagggcgacctcggcacgcagatcggaacgcagcgtccggtcgccgaagtcatcgccgatgcctacccgatcaccgtcagactggcgatcttcgccttcgtcttcacggtcgtcgccgggatctcgctcggcatcgtcgcgggcctcaaggccgagtccctccgggaccgcggtctgctcggcctgacactggtgctgatctccatgccgtccttcgtgctgggcttcctcgttcagtacttcttcgcgttccagctcggcatcgccaagcccaacgtgagcatcgagccgacgaacaccgaattgatcatgccggccatcgtgctggcgtccctgtcgctcgcctacgtggcccgcctcacccgtacctcggtcgccgagaacatgcgcgccgactacatgcgtacggctgtcgccaagggcctgccgcgccgccgcgtcatcggcgtccacctgatgcgcaactcgctcatcccggtcgtcaccttcctcggcaccgacatcggcgccctgatgggcggcgcgatcgtgaccgagggcatcttcaacatcaagggcgtcggatcgctcgtcttcgaggctctcgccaagcgtgagggcgccaccgtcgtcggcgtcgtgacgctgctcgtcgtcgtctatctcgtctgcagcctgctcgtcgacctgctctacgcggtcctggacccgaggatccggtatgcctgacaccaccgcactcaagggcaccgacgctccggccaccgccgtcgacgcgccgcccgccacggacgccgggcccgcgcccggcaagccgcgcagcctctggtcggacgcctggcacgacctgcgccgcaacccgctcttcatcatctcgatggtgctgatcctgctgctggccgtcatggcgatcttcccgagcctgttcaccagcgcctcgccgcgggacgccaacctggccgagcactacctccagcacccgaagtggggcaacttcttcgcccccgactggctcggatacgacgtccagggacgctcgatctacgcgcgtgtcgtctacggcgcccgcgcctcgatcaccgtcggcgtcgtggtgaccctcgcggtcaccgtcaccggcctggtgatcggcatgctggccggctacttcggcggctggatcgacacgatcctgtcgcggatcaccgacgtcttcttcggtgttcccttcatcgtcggcgccatggtcatcctgaccagcttcgaggagcgctccgtctgggtcgtcatcctgtcgatggccttcctcggctggacgtcgatcgcccgagtcgcccgtggctcggtcatcacgatcaagcaggccgactacgtggtcgccgccaaggcgctcggcgcctccaccacccggatcctgacgcggcacatcctgccgaacgccatcgctccggtgatcgtggtcgccaccatcgcgctcggcggctacatcgccgccgaggccaccctgtcgttcctcggcatcggcctcgccgagccgacggtctcgtggggcatcgatgtgtccgctgcgaaggaccagctccgcaacgcgccgtacgtcctggtcatcccctcggtgatggtctcgatcacggtgctgtccttcctgatgttcggcgatgcggtccgcaacgccctcgaccccaagatgcgctgagggaggcgttcgtgaccaccatcgacaagacggctcacgttcccgcaccgcgggagtccgtgagtggcgaaggtccactgctcgacgtccgtgacctgcacgtggagttccacacccgcgacggcatcgccaaggcggtcaacggtgtgaactacaccgtcagcgccggcgagacgctcgcggtgctcggcgagtccggttccggcaagtccgtgaccgcgcagacgatcatgggcatcctcgacatgccgccggggaagatcacgcagggcgagatcctcttccgcggccaggacatgctgaagatgtccaacgaggagcgccggaagatccgcggccagaagatcgcgatgatcttccaggacgcgctctcctcgctgaacccggtcctctccgtcggctaccagctcggcgagatgttccgcgtgcaccagggcctgtccaagaaggcggccaaggccaagtccatcgagctgatggaccaggtcaagatcccggcggcggcggcccgtatctcggactacccgcaccagttctccggcggtatgcgccagcgcatcatgatcgccatggcgctggccctggagccggacctgatcatcgcggacgagccgaccaccgcgctcgacgtgacggtgcaggcccaggtcatggacctgctggccgagctccagcgcgagtacaacatgggtctgatcctgatcacccacgacctcggcgtggtcgccgacgtcgcggacaagatcgccgtgatgtacgcgggc

SEQ ID NO: 2937 - DNA, 1793 bp, Unknown
  Kingdom: Bacteria, Phylum: Actinobacteria, Class: Actinobacteria, Order: Streptomycetales, Family: Streptomycetaceae, Genus: Streptomyces
gcgtgagaccgaggccggccccgggcgagacgcgctggccgacgagaacgagcgactgcgcgccgaactggccggcctcggtctcacgcccggggcgggcccgtgaggagagcgaggggtcgtgctcccaccagtcgatgcccatctccttggccttgtcgacggaggcgacgagcaggcggagcttgatggtgagcagctcgatgtcgagcaggttgatctggatgtcgccggcgatgacgatgcccttgtccagcaccctttccaggatgtcggcgaggttggccgacgagccctgctgcccgtatgccgggccggtcccccggggcgtggccggcatacggccggcgagtgaatcggacacggtgtctcacccctttccgtggggtctcggtgcggctctgtgcacgggcccggtcaccggacggcgggctgctgctccgactcgtccaccggcgcggcgtcctcgtcgtcctcgccgtcttcctcgtcgacgaactcctcgtcctgcggctcttcgtcgtcgtacacggcgtcgtcctcggggctgtcctcctcgtcgccgggctgctcgtcctcgtacgcgtcgtcgggcgcgccctcatcggtttcggcaccgtcgtcgctctgcgcctcctcctcgtccagcgcctcgtcatggctgaggatgacttctccgtcacggatctcgccgcgccagctgtcggtcgcctcgccgcgcatcatgatgaacttgcggtagagcttgaggtcgagccgggcccggcggccctgggcgcgccagatgttgccggtcttctcgaacagtcccttggggaagtattcgaggaccaggaggacacgggtgagatcgtcggtgatcgcgtggaaggtgaccactcccttgacggtgcccttggctccttcggtggtccaggtgatgcgttcgtcgggcacctgctcggtgacgttcgccttccagctgcgggtcgacttggcgaccttcaccttccagttgctggtggtgtcgtccgccttctccacgctcacgacgcccttggcgaacgagctgaactcctggaactgggtccactggtcgtacgcctcgcggaccggcacaccgacgtcgatgtcctcgacgatggtgacgctcttggacttgcccccaccggacttgcgccccttgccgaacaatcccttgaccttgtccttgacggtgtccttgaggtgggaggcgcccgcgctcagagcggcctgaccgggtgacttgccttccccgagggcttggcctcccttggccaggctcctgagggcgccgcctccgccgcccggctcggcgagtttggacaccgagtcgccgaggcggtgtcccagctgggtcaccgcgtgttcggcgcgggcccggaggtagttctgcagctcgtccttgaggcggtcggtggcggggttcttgaccacgtcgtccttgatgccgccgagtgcggagtcaggcatcgtcgcctccccgggccttgcgcgtgccggaggccgcgctcttgcgggcgcctccggtgcgctttcgggcgggggttgatttgcctccgctccccgaccggccgctgccggacgaggaccggctcctggaggcgggcttggagtcggaggcgccagcggtcctgcggggagtgcgcttgcgcttcccgtcggtgctctcgtccccgtccgtctcgacttcgtccccgtccgcatcggcttcgtcgtcgtcgacggcggctgtcctgggctcgtcgtcctcctcgtccagctcctcgtcgtcggccccggggccggtcccc

SEQ ID NO: 2938 - DNA, 11619 bp, Unknown
  Kingdom: Bacteria, Phylum: Actinobacteria, Class: Actinobacteria, Order: Streptomycetales, Family: Streptomycetaceae, Genus: Streptomyces
ccgtagatcccctcgccctcgtggctgacccggccgtccaccgcgaccagccgggccgcctcggccgaggcggcccgccgcgaagactccgaagggggccgcccgcatcgcgagcccgtcgctccaggcgtgccggtgctgggccgagatcggcgcggccaggccccggcgcaggttctccagcgtgccgcgctcgctgaacccggccccccggaacgggccctcgtccagatcggcgatccagtggtgccaggcccgctccacatgggagacgtcgagcgccgagccgtgccgggccagcagcagcccggagaagatggcgtactccgtgtcgtcggtgcccgccgggtcatcgctcacgaaaccctcgatccgtccccagcggcggcggatctcggagggccgcaggttctccgccggggcgccgagcgcgtccccgaccgccagtcccagcagcgcacccctggcccggtcattgccgacggccgtgttcatcgcgtcgcccttcgctcgtccggcggtgggaatccccatccgagtccgcagccgcatccgcatccgcatccgaatccgtttccgggccctgtccgcatctgtgccacgcggcgggcgaggagaggcggaaaacgtggggaaaggggccaggcggatgacggctcagatagctaaggctggcctttcttcgcaggtcagagggggtggtaagccaggcctggcttgctggcggaggtcgcccggacggcgtagtttggactctgtcgaaagttgtattcagtggggaacggcggggtgacggcccgccggagcaaaggggagaagcacgccgtggccatcatcgagaccgaagccgtcctgcacgaggcgcaccgggacaaccacacccaccgggatgtgaacggcggctggctgcgccccgccgtcttcggcgccatggacggtctggtctccaacctcgccctgatgaccggggtcgcgggcggcgcggtctcccagcagaccatcgtgatcaccggcctggcgggactcgcggccggggctttctccatggctgcgggtgaatacacctccgtcgcctcgcagcgcgagctggtcgaggccgagctcgacgtcgagcgccgcgagctcgtcaagcaccccaaggacgagatggccgagctggccgctctctacgagtcccgaggcgtggacgccccgctggcccgcgaggtcgcccggcagctgtcgcgcgacccggagcaggcgctggagatccacgcgcgcgaggagctcggcatcgacccgggcgacctgccctcgccgctggtggccgccgtctcgtcgttcggcgcgttcgcgctcggcgccctgctgcccgtcctgccctacctcctcggcgcgagcgccctgtggcccgcggtgctcctcgcgctgatcgggctcttcgcctgcggtgcggtggtggcccgggtgaccgcccgcagctggtggttcagcggagtgcgccagctcgccctgggtggtgcggcggccgcgatgacgtacggactcggcaccctgttcggcgtcgccgtcggatgacacgggtgacgcgggtgatgcgggcgcgtgggtgggtggcgtaaccgcgccgtccgaacggcgcaacgacgcggcaacccgtgtgacgtacgtcttggcgccgcccactgggcggcacgggcactgcggccgtaaaatgagactctatgcagggctacacataagtagccgttactcggtggtttcgtttcctttgccaccgggcatgagccgtaggcaccgcaggcaacgacgcctgctctctgcgggtccccgggcgccgatcgttccgacagcgacccaccccctggtcagtccggtcacctctggtcacccagtcacttccggtcaccacggtgtccgcatgttggaacacgtcttccgcttcttgagaagcgccccatcatgtaacctgcacgaaatttcgcagagggccaacgtcgtccctcggcaccgcaaatgccacgacgacgacgggagagccgatgcgtatcgacgcctggtcgcccatggacggtcgccccgcccagcaggggatgtacgacccccgtaacgaacacgacgcctgtggtgtcgggttcgtggccactctgaccggtgtggccagccatgagctggtcgagcaggcgctgaccgtactgcgcaacctcgaacaccgcggcgccaccggctccgagcccgactccggcgacggcgccggcattctctgccaggtccccgacgccttcctccgcgccgagacccctttcgaacttcccgaggccggctcctacgccgtgggcatcgccttcctccccgcggacgaatccaccgaagccgtccggacgatcgagaagatcgccgcccaggagggcctgaaggtcctcggctggcgcgacgtcccggtcacccccgcacttctcggcaacggcgcccgcgccaccatgcccgagttccgccaggtcttcgtcgccgacggcgagagcaccggcatcgtcctggaccgcaaggccttcgtcctgcgcaagcgtgccgagcgtgaggccggggtgtacttcccctcgctctccgcccgcaccatcgtctacaagggcatgctcaccaccgggcagctggagccgttcttcccggacctctccgaccgccgcttcgcctccacggtcgcgctggtccactcccgcttctccaccaacaccttccccagctggccgctggcccacccgtaccgcttcgtcgcgcacaacggcgagatcaacacggtcaagggcaaccgcaactggatgaaggcccgcgagtcccagctcgcctccgaactcttcggccaggcgcagctcgaccggatcttccccgtctgcaccccggacgcctccgactcggcctccttcgacgaggtcctggagctgctccacctcggcggccgctcgctgccgcactcggtgctgatgatggtccccgaggcgtgggagaaccacgactcgatggacccggcccggcgcgcgttctaccagtaccacgccacgatgatggagccctgggacggcccggcctgcgtcaccttcaccgacggcgtccaggtcggcgcggtcctcgaccgcaacggtctgcgccccggccgctactgggtcaccgacgacggcctcgtcgtgctctcctccgaggtcggcgtcctggacatcgacccggcgaaggtcgtccgcaagggccgcctccagcccggcaagatgttcctcgtcgacaccgccgagcaccgcatcatcgaggacgacgagatcaaggcgtccctcgccgccgagcagccctaccaggagtggctggagaccggcgagatcgagctgagcgacctgcccgagcgtgagcacatcgtgcacacccacgcctcggtcacccgccgccagcagaccttcggctacaccgaggaagagctccgcgtcatcctcgcgccgatggcccgcaccgccggcgaaccgctcggctccatgggcaccgactcgccgatcgccgccctgtccgagcgcccccggctgctcttcgactacttcacccagctcttcgcccaggtcaccaacccgccgctggacgccatccgcgaggagctcgtcacctcgctgcgctcctcgctgggcccccagggcaacatcctggagccgaccgccgccgcgtgccgcagcgtcacgctgcccttcccggtgatcgacaacgacgagctcgccaagctgatacacatcaacgccgacggcgacatgccgggcatgaaggccgccaccctctccggtctctaccgggtcggcggcggcggcgaggcgctggccgcgcggatcgagcagatctgcgccgaggtcgacgccgccatagaggacggcgcccgcctggtcgtcctctccgaccggcactccgacgccgagcacgcgccgatcccctcgctgctgctcacctccgccgtccaccaccacctcatccgcaccaagcagcgcacccaggtgggtctgctggtcgaggccggggacgtccgcgaggtccaccacgtcgcgctgctcatcggctacggcgccgccgcggtcaacccgtacctggccatggagtccgtcgaggacctggtccgcgccggcaccttcatcgagaacatcgagtccgagcaggccatccggaacctgatctacgcgctcggcaagggcgtcctgaaggtcatgtccaagatgggcatctccaccgtcgcctcctaccgcggcgcgcaggtcttcgaggccgtcggcctcgacgaggccttcgtcgcgacgtacttcaacggcaccgccaccaagatcggcggcgccggtctggacgtcgtcgccaaggaggtcgccgcccggcacaccaaggcgtaccccgcctccggcatcgcggcctcgcaccgcgcgctggagatcggcggcgagtaccagtggcggcgcgagggcgagccgcacctgttcgacccggagacggtcttccgcctccagcacgccacccgcaaccggcgctacgacatcttcaagcagtacacggagcgggtgaacgagcagtccgagcgcctcatgacgctccgcggcctcttcggcttcgactccggccgcgagccgatctccctcgacgaggtcgagcccgcctccgagatcgtcaagcgtttctccaccggcgccatgtcctacggctccatctcccgcgaggcgcacgagacgctcgccatcgcgatgaaccagctcggcggcaagtccaacaccggcgagggcggcgaggactccgagcgcctgtacgacccggcgcgccgctcctccatcaagcaggtcgcctccggccgcttcggtgtgaccagcgaatacctggtcaacgcggacgacatccagatcaagatggcccagggcgccaagcccggcgagggcggccagctgcccggccacaaggtctacccgtgggtcgccaagacgcggcactcgacgcccggcgtcggcctcatctcgccgccgccgcaccacgacatctactccatcgaagacctcgcccagctgatccacgacctgaagaacgcgaacccgcaggcgcggatccacgtgaagctggtctccgaggtcggcgtcggcacggtcgccgcaggtgtctccaaggcccacgcggacgtcgtcctcatctccggccacgacggcggaacgggcgcctccccgctcacctcgctcaagcacgcgggcggcccgtgggagctcggcctcgccgagacccagcagaccctgctgctcaacggcctgcgcgaccgcatcgtggtgcagaccgacggccagctcaagaccggccgcgacgtcgtcatcgccgcactgctcggcgccgaggagttcggtttcgcgaccgcgccgctcgtcgtctccggctgcgtcatgatgcgcgtctgccacctggacacctgcccggtcggcatcgccacccagaacccggtgctccgcgaccggttctccggcaaggccgagtacatcgtcaacttcttcgagttcatcgccgaagaggtccgcgagatcctcgccgagctgggcttccgcaccatcgaggaggccgtcggccacgccgaactcctcgacaccgaccgggcgatcacccactggaaggcgcagggcctggacctggctccgctcttcttcgtccccgaactgcccgagggcgcggtccgccaccgcatcgtcgagcaggaccacggtctgacgaaggccctcgacaaccagctgatcaagctggccgccgacgcgctcggggccgagacccccgaggccgcccagccggtccgcgcccaggtcgcgatccgcaacatcaaccggaccgtcggcaccatgctcggccacgaggtgaccaagaagttcggcggtcagggcctgcccgagaacaccatcgacatcaccttcaccggctcggccggccagtccttcggcgcgttcctgccgcgcggcgtgaccctgcgcctggagggcgacgccaacgactacgtcggcaagggcctctccggcggccgggtcgtcgtccgcccggaccggggtgccgaccacctcgccgagtactccaccatcgccggcaacaccatcggctacggcgcgaccggcggcgaggtcttcctgcgcggccgtaccggcgaacgcttctgcgtccgcaactccggtgcgctcgtcgtctccgaaggcgtcggcgaccacggctgcgagtacatgaccggcggccaggccgtcgtcctcggcgagaccggccgcaacttcgccgccggcatgtcgggcggcgtcgcgtacgtcatcgacctgaaccgcgacaacgtcaacgtcggcaacctcggcgcggtcgaggaaccggacgacaccgacaggcagtggctgcacgacgtcgtgcgccgccaccaggaggagaccggctccacggtcgccgagaagctcctcgccgagtgggacaccgccgtgacccgcttcagcaagatcatcccgtccacgtacaaggcagtgctcgccgccaaggacgccgctgagctcgccggtctctccgagcaggagaccaccgagaagatgatggaggcggcgacccatggctgaccccaagggcttcctgaccaccggacgcgaggtcgcccagacccgccccgtggccgagcgcgtcaaggactggaacgaggtctacgttccgggctcgctgctcccgatcatcagcaagcaggccggccgctgcatggactgcggcatcccgttctgccacaacggctgtcccctcggaaacctcatccccgagtggaacgactacgcctaccgcgaggactggaccgccgcctccgagcggctgcacgccacgaacaacttcccggagttcaccgggcggctgtgcccggccccctgcgagtcggcgtgcgtgctcggcatcaaccagcccgccgtcaccatcaagaacgtcgaagtctccatcatcgacaaggcgtgggacagcggcgacgtcaccccgcagccgccggagcgcctctccggcaagaccgtcgcggtcatcggctcgggcccggcgggactcgccgccgcccagcagctgacccgggccggccacaccgtcgccgtctacgagcgcgcggaccgcatcgggggcctcctccgctacggcatccccgagttcaagatggagaagtcgcacatcaaccgccgcatcgagcagatgcgcctggaaggcaccaagttccgtacggaggtggagatcggcaaggacatcgacgccgcgaagctccgccgccgctacgacgcggtcgtcatcgcggccggtgccaccgtctcccgcgacctgcccgttcccggccgtgagctgggcggcatccacttcgcgatggagtacctgccgctcgccaacaaggtgcaggagggcgacctgacggtctccccgatccacgccggcggcaagcacgtcgtcgtcatcggcggcggcgacaccggagccgactgcgtcggcaccgcccaccgccagggcgcggcatccgtcacccagctggagatcatgccgaagccgggcgaggagcggaacccgggacagccgtggccgaccttcccgatgctctacaaggtcacctccgcgcacgaggagggcggcgagcgggtctactccgtctccaccacccacttcgagggagacgaggacggcaacgtcgcggccctccacctggtggaggtcgagttcaaggacggtaagctggagcagaagcccggcacggagcggcgcatccccgcgcagctcgtcaccctcgccatgggcttcaccggaaccgaccagtccaacggtctggtccagcagttcggcctggagctcgaccagcgcggcaacgtcgcccgcgacgagcactacgcgaccaacgtcgacggcgtctacgtcgccggtgacgcgggacgcggccagtcgctgatcgtctgggcgatcgccgagggccgctccgccgcccgcggagtggaccgcttcctgaccgggaccagcgccctgccggcgccgatccgcccgacggaccgctccctgctggtctgagcaccacccgggttccccctgggccacgcggcccgggggagcccccacaagacgtcccgtacaacggcgtacggaactgaacgcggcgcctgcctgtccccgaccggactccagcgggcgccgtggcgcgtccggggccgggttccttccgaggaaccggcctcagcgctcacccgcctcagcgctcacccgcctcagccgcccgtcagagccgaggtcttcagcaccaccgccaccgcgaacaggcccgccagcaccagcccgcccgcgagctggaccggccacacccgcagcttcgccggtgcgaaggcgagcccgtacgtcaccagcgccccggtcagcaggccgcccaggtgcccctgccacgaggtgaacgcggccgagatcagcatccagagcaggaatccggccatgaagcggttgaccgccgccatgtcacggccgagccgccggtggatgacccagtacgcggccgccagcccgaagaccgcgccggaggcgccgaccgtcgaggtgtccggcgccagcaggtacaccaggaccgaaccgcccaccgccgacagcagatacagcgccgcatagcgggcccgcccgagctggccctccaccgcccggccgatgttccacagcgcgaacatgttgaacaccaggtgcatcaccccgaacgaggcgtccggaggaaggtgcaggaaggccccggtcaccagccgataccactcgccgtccgcgatgcccgtcagctcgtacccggcgtacgtgtcaccccggtagtagtactgctcgccgtccggcccggtgagcgccgccccgagcaccgcgaaccggtccacgatctccggcctgaccacctcgccgatgtagaccaggacgttgagcgccatcaggacgtacgtcacgatcggcgccgtcgcccgggacaccgcaccgccgaagaccgtacgggcccggcgcaccgagcgttgtccctccttgacgcactccacgcagtggtggccgacagcggcctcccgcatgcaatccgggcagatgtagcggtcgcaacgggtgcagcggacatacgtctcgtaggacggatggcggtaacacgcggtggcggcggcctccatggccggctccttcactggggaggtgcaacagggccggtgggggcggcggcgatcaagatagcgaaccggtgtgaccggcgttcagcccggggccggtcgtggcctacgctcaaggtccgcggagcacggaacggggaggccgtcatgaacagcgcgaacacggccgtgggcaccggcccggccatcagcctcaccaaggtgcaggagacggccccggccctggtcggccactacagaagcgccggcatctcgctggagaagcacggactgggcggtcaccgcgcggccgtctacctcgtcctcgaccactcaggctcgatgaagccctattaccacgacggcagcgtccaggcgctggccgaccgggtgctgggcctgtcggccaacctcgacgacgacggcacggtgcccgtcgtcttcttctccaccgacgtcgacgcggtcaccgacatcgccctcgacaaccaccacggccggatcgacgagatcgtggcgggcctcgggcacatggggaagaccagctaccacctcgcgatggacgcggtcatcgaccactacctcgacagcggctccaccgcgcccgccctggtcgtcttccagacggacggcgggccgatcaacaagctcgccgccgagcgctatctctgcaaggcagcgacgctccccctgttctggcagttcgtcggcttcggcaacacccgcagcagtcagttcgacttcctgcgcaagctcgacgagctggccgtccccgccaggcggaccgtcgacaacgccggatacttccacgccggccaggacccccggaaggtcccggactccgagctgtacgaccggctcgtcgccgagttcccgctctggctggcagccgcccgggagcaggggatcgtccggtgacggtacggatcctgcgcgccgccgaccgcgcgtccgtcccctggaagaacggcggcgggaccgtccgcgagatcgccaccggccccgagggcgcggggacggacgccttcgactggcgggtgagcctggcggacgtcaccgccgacgggccgttctccgccttccccggtgtcgagcgcgtcctgaccgtggtcgagggtgcgggcatggacctcgtcgtcggcggcgagcaccacatcgtcgacgagccgctgtggccgcacgccttccccggcgacctgcccacggaggggttcctgctgggaggccccgtcgtcaatctcaacgtcatgtaccgcagggcccgcacgcgggcggagaccgccgtcgtctgcggcacggtccgcctgctgccaccggagggcggcgcggtgctggccgtctccctggacgacggcgcggagctggagggcgggagcgtccggctggaccgctacgacgcggtgctggcggcgggggcgtcgcccggggtcctgcggacgatgggccaggcggtgctgatcacgttctcggacgggtgaccggccgaccgcctcccctgcggaccctgccgcccccgggcgggcgggaaactcggctgccgatctccccgccgcgggatacggtcgcgcgcatgcccgaaaaagtatccggaagcaccgtgatccgccgctatgccgccgctgacgagaacgcggcggtggacgtctggtcccgtgccggcagtctggcccaccccttcatccccggcgagggcgagggcgagcgcgcccgcaagatgcgcgagatctatctcgtccacgccgagaactgggtcgccgagacggacggccgtgtggtggccctcctgggcctcctggacgccgagatcggcggcctcttcgtggctccggaggcacagggcaccggggtgggccgacgcctggtcgaacacgcggcggcgctgcacggggcgttgacccttgaggtgtacgagaagaacacgggggcccggagcttctacgcccggctgggcttcgtggaggagagccgccgcgtcgacgaggagtacgacgaggtcatgctgaggctcacccggccggctccggagaaccgcgcctgaggcggcgacggcggtgcggcggtgcgggggtgacggtgttcggctctgtcggaactcgcccgcctgtcgcgcgcaaataccgacaggagatgtcgggtatccggtgttccatggcacccatgacgtcttcatcgcccgcgcacgcgcccgtgtcctggggcggcttcgccgccgccgagcccgaattcgccgacaccgtgcgagaccgcttccggctctacaagcaccacgtcctggccaccctgcggaaggacggctcgccccgggtcaccggcctggaggccgacttccgcttcggtgagctgctgctcggcatgatgccgaactcccgcaaggccctggacctgcggcgtgatccgcgtttcgcgctccaggccaaccccgggcccgacgccgagctgaaggacggggacgtccgcgtcagcggccgggccgtggagatcacggacccggaggtgatcgccc

SEQ ID NO: 2939 - DNA, 1438 bp, Unknown
  Kingdom: Bacteria, Phylum: Actinobacteria, Class: Actinobacteria, Order: Streptomycetales, Family: Streptomycetaceae, Genus: Streptomyces
cggttcaccatcccggaactgcccgagcccgcgggcggcgggctcctgggcccggtgggcgagccaggcgcgcagcggggcgacggcggtggtggggagcagtccgctgccgccgcccgcggactcgggcagttccgggatggtgaaccggggtacgtccccgagtccggcccgggtcagcagcgccgcgtactgccgggacacctcggcgatcacctggtggggcacccggtcgaggacggtgacgagcgccgcgtcgtactccttcgcggtacgcagcaggtgccagggcacggcgtcggcgtagcgcgaggcggtggtgaccatgacccagacgtcggcggcgcagatgagttcggcggcgaggacccggttgcggacgacgagcgagtcgatgtcgggggcgtccaggagggcgagcccgcggggcaggctcacggccgtctccacccgcagcgccgtctccccgtcctccccccgggcggcgaggtcgtccagcccgtccgggtcgggcgtctgccccggcggcagccagatccgggtcagctgaggcagtacccgcaccccggcgaaccagtggtggtcgtccgggtggcagaccaggaccggggtccgcgtggtgggccgcagcaccccggcctcgctgacccggcatcccaccagcgagttgaccagggtggacttcccggcgccggtggatcctccgatcacggcgagcaggggggcctcgggatccttgaggcgtggcaggaggtagtcgtcgagctgggcgaggagttcgaccctggtctgccgggcgcgttccgcccccggcaggggcagtggaagacgcacggcggcgacacggtcgcgcagggcggaaagtgcgtcgatgagctgaggccgtacgtccatggtcaccacatgcgaagaatgcccaattttgaagcctttttgaagcgtatagccccctctgcgcggcggttccaccctctggacagagtcaggacagaggggacgagtggggcgggggcataacgagtgcacaacacccggcgcgaggggagcgaaaaccgatgcaggaatcgcacctacctgcgattatcggttcgcttcaccgaacctccacatcgtgccacgcaggtgaagcaaccgggtccaggggatcggagccctatccttgtcccggcacggccacggaaccaccgatcaggactcccggcccccgtagctcagtggatagagcaggcgccttctaagcgcttggccgcaggttcgagtcctgccgggggcgcaccgaccgcaccatcgaggggccctccgcaccggagggcctcttcgtcggtcaggggcacgttagcgagcacggcgtcacgtcggcataagcagtccctcgtgcatccactcaggccgcctgccgcacacgtcccgcccggcgcccccgctcctccccctcacg

SEQ ID NO: 2940 - DNA, 2941 bp, Unknown
  Kingdom: Bacteria, Phylum: Actinobacteria, Class: Actinobacteria, Order: Streptomycetales, Family: Streptomycetaceae, Genus: Streptomyces
caccgcgccccttcccccttggcgacgggcgcggtgcgcatggcgcgcagcgggcacggaccggcggtgcgccggccctcgggcgtgcggctcgcctgagcctccgtcagaacggagacgatcaaaccgtcatagttcgtgacgatacgggcgaactgtccgtgatcagccctcagggccaggcacagaccgcagagatgggccatccactcgaccctgagaccttcggagagccgatgggtacagggcctgacgattccgaacacgacgatcccccgggagccgttcagccggtgcgcgacgctcgcgcaccgaagcgtcgtgcatcgtatcgagtgacccgttcacccgtacgtcccccggatcacccgtacggccggagcatcatattttccttctacaagcccccttatgcaggaggaaccctgacgaatcgccacatcttctgcaccagtaacgtcacgaatcgcctgcgagccgactatccacttggcgcggtatccgcatcatggacgaccatagggatacgaaagagatgcggaacaccaaggaaccgcggtgagaggaggcgtccatgggatcggtgcgcaaggcgagtgcctggctgggcctcgtagaggacaacgacgagcggtactacgacgacgagtacgccgagggtgcggagaccggtacgggcaaccaggcctgggtcactgacccgcgggtgcaggtggccgccgagacggccgaggagcaggaccgccggatcgcgacggtgaccccggacagcttccgggacgcacgtgccatcggcgagctcttccgggacggcgtcccggtgatcgtcaacctcacggccatggaccccgccgacgccaagcgcgtggtggacttcgccgccgggctgatcttcggtctgcgcggctcgatcgaccgggtggccacccgggtcttcctgctgtcccccgccgacacgcaggtggtggcgggcgaaaccgccggccgcaaggccgacggcttcttcaaccagagctgagcagggcgctcgccggaaagatccggtcaacgcatccggccggcacgcgcgtaccggcgtgtcccgctcaccggaaggcgtcgagaccggtgagcgccttgcccagtaccagctggtgcatctccacggttccctcgtaggtgagcaccgactccaggttcgtggcgtgccgcatcaccggatactccagcgagatcccgttggcccccaggatcgtgcgcgaggtgcggcagatctcgatcgcctcccgcacattgttcagcttgccgaaactgacctgctccggccggagcctgccgacgtccatgcggcggcccaggtggtgagcgagcaggatgcccttgtggagctccagggccatgtccgccagcttggcctgggtgagctggaagccgccgatcggccggccgaactgttcccggctcctcgcgtagtcgagggccgactcgaagctggcccgcgccgcgcccatggcgccccagacgatgccgtagcgcgcgtgactcagacagctgagcggcccgcgcagcccgctcgcgtccggaagcaccgcgtcggcgggcagccgcacctcgtccatgaccagctcgctggtgaccgaggcgcgcagcgaccacttgtgcttgatctccggggccgagaagccgggagcgtcggccggcacgacgaatccccggatgccccgcccgtcctcgccctcgtcggtctgcgcccagacgacggcgactccggcgaccgagccgttggtgatccacatcttgcggccggtgaggacccagtccgcaccgtcgcgcctggcgtatgtccgcatcccggccgggtcggagccgtggtcgggctccgtcaggccgaagcagccgatgatctcgccggacgccatgccgggcagccaccgctgcttctgctcctcggatccgaagcggtggatcgcgtacatggcgagcgatccctgtacggagacgagcgagcggatcccggagtcggcggcctccagctccagacaggcgagcccgtactggacggcgctcgccccggcgcagccgtacccgtccagggacatgccgagcgcgcccagcgcgccgagttcccgggccagctcccggattccgggcagctcgcccttctcgtaccactcggcgatgtgcggcaggacgcggtcggtggcccaggtgcggacggtgtcgcggatcgcgaggtcctcggggccgagcagatcgtcgatgccgaggggatccgacgcgtcgaacggcgggagcttcgacggtttcggtgactcggtgctggacatgagggtgcctccggcggctcgcacggtgctcggagggaccgggagacgcccgccctccgaaaactagcagtggtagtcagggcgtcgtgctgacgttacggctcagtgtgccgctcgtccagagccggtcacctcggccggctcgcgccgcgcgggcagcatcgggcgcggcgccggccgggctggaccgggcacccggtgctcgtccgccccgaaggaggaagccgtggacgcggaagtcgtggacgcaggagtcgcggacggggaggtcgtggacggggaggtcgtggacggggaggtcgtggacgcggcgtcgtcggcctcggcccggcggcatgcctccttcggcgggcagtccatgaccttcggcagccgcagggcggccagcgccccgaggagcagcagcccagcgctgacgaacagcgtgatgtggagtccgccgatgaaggcgtgccgggccgtggagcgcagcaggtcacccgtcggcccgcccagctgcgcggccacctgataggcctcgcccagtgagtgggaggcctccgcgccggcgcgggcggggacgcccttctcgcgcagaccggcgaggccgggagcgtaggcggcgttcatgacactgccgagcagggcgatgccga

SEQ ID NO: 2941 - DNA, 7730 bp, Unknown
  Kingdom: Bacteria, Phylum: Actinobacteria, Class: Actinobacteria, Order: Streptomycetales, Family: Streptomycetaceae, Genus: Streptomyces
cggcggcgacgagttcgccgcgctcatcatcggcgacggcacccgcgaccagggcgcccgggagtaccaggtccacgagatcgccgaccggctgcgcctcactctctcccagccctaccggatcggccccagcgaggtccgggtggccgcctccatcggcgtggccttcgccgagcccgccatcagccccaccgacctcatgcgcaacgcggacctcgcgatgtaccgcgccaaggccggcggcaaggaccgggtcgagctgtacgccccgcagatgcaggccgacgtcgtacgccgctccgagctggccacccggctgcgcaccgccctgcgcgagggcgagttcgccctgctccaccagcccgtcgtccacctcgccagcggctccgtcgcggccgtggccgcccaggcccgctggcgttccgcccagggcatcctgttcacccccgcggagttcctccgggtctccggcgacgacgaccgcaccgccgagctcggccgctggctcctggaggaggcggtggcccaggccgccgaccgggccagggccggacatcccgtcgccgtctccgtccggctctccgccgcccggctgctggacgcggcctcgccccccggctccatcgaggcgctgctgacccgtcacggcctgccctcgggcgccctgatgatcgaggtcgccgacagtgacccgcgcgtctccttcgacgccctggagcagcgcctcgtggccttgcgccgactcggcgtacgcatcgcgctcgacggcttcggcagcggcttcgcggcgatcaacgccctgcgccgcctccccatcgacgtactgaagctcgaccggaacctggtcgagggggtggtcgaatcggccaggctgcacaagatcaccagcggtctcctgcggatcgcctgcgacctcggcctccagtccgtcgccgacggggtcgacgtccccgagcaggtcctcgccctgcgcgccatggggtgcacccacggccaggggatggccttctccggcccgctcgacgagtaccggctgcgacgcgccctggtccggggggagttccccgtgccgggcattccgagcccccggccggtgatggcgggcggctcgattcccctgctcaccggatcacatgctgagacgcccgtcccacccacttgacacgtcatgcgtgccggagagagggtcaatgccatgcgcacccgaattctcgtacttggaaagcgcgtcggctgaagcagagtcactccacgacactctgcggaccgcacccggcgcgctcccctcgcttgcctcacggcacgaggggttttttgttgcactgacaccgctcaaaccgctgcaaaacacccgcgaaaaccctcagcttcgagaagagaatgccgatgaccgagcaggccaccggggcccaccacccgcagccgcgcgcccgtaacggcggacagccgtccgtcaccgttgagcacgtcacgggcgcgcagtccctcatccgttctctcgaggaagtcggcgccgacacggtattcggcattcccggcggcgcgatcctccccgcctacgacccgatgatggactccacccgggtccgccacgtcctggtccgccacgagcagggcgccggccacgccgccaccgggtacgcgcaggccaccggcaaggtcggcgtctgcatggccacctcgggccccggcgccaccaacctggtcaccccgatcgccgacgcgcacatggactccgtgccgctcgtcgcgatcaccggccaggtcgcctccaaggcgatcggcaccgacgccttccaggaagccgacatctgcggcatcacgatgccgatcaccaagcacaacttcctggtcaccaaggccgaggacatcccgcacaccatcgccgaggccttccacatcgcctccaccggccgccccggaccggtcctcgtcgacatcgccaaggacgccctccaggcgaagaccaccttcagctggccgcccacccaggacctgcccggctaccgcccggtgaccaagccgcacgccaagcagatccgcgaggccgcgaagctgatcacccaggccaagcgccccgtgctgtacgtcggcggcggcgtcctgaaggccggggccaccgccgagctgaaggtcctcgcggagctgaccggagcgcccgtcaccaccaccctgatggcgctcggcgccttccccgacagccacccgctgcacgtgggaatgccgggcatgcacggtgcggtcaccgccgtcaccgcgctgcagaaggccgacttgatcgtcgccctcggagcccgcttcgacgaccgcgtcaccggcaagctggacagcttcgccccctacgccaagatcgtccacgccgacatcgacccggccgagatcggcaagaaccgcaccgccgacgtgcccatcgtcggtgatgcccgcgaggtcctggccgacctggtccaggccgtccaggccgagcacaccgagggccacaccggcgactacaccgcatggtggaaggacctcaaccgctggcgcgagacctacccgctcggctacgacctgcccgaggacggcagcctctccccgcagcaggtcatccagcgcatcggcaagctcgcccccgagggcacgatcttcgcggcgggtgtcggacagcaccagatgtgggcctcccacttcatcgactacgagcagcccgccacctggctcaacagcggcggcgccggaaccatgggctacgcggtcccggccgcgatgggtgcgaaggccggcatgcccgaccgcacggtctgggcgatcgacggcgacggctgcttccagatgaccaaccaggaactgaccacctgcgcgctcaacaacatcccgatcaaggtcgccgtcatcaacaacggcgcgctcgggatggtccgccagtggcagaccctcttctacaaccagcgctactccaacaccgtgctgcactccggcgcggacacggacggcgtcccggccaagggcacccgcgtcccggacttcgtcaaactgtccgaggccatgggctgctacgccatccgctgcgaggacccggccgacctggacaaggtcatcgaagaggccaactccatcaacgaccgtcccgtcgtgatcgacttcatcgtccacgaggacgccatggtctggccgatggtcgccgccggcacctccaacgacgaggtccaggccgcccgcggcgtccgccccgacttcggcgacaacgaagacgactgagagacagagagagaccgactccatgtccgaaaagcacacgctctccgtcctggtcgagaacaagcccggtgtcctcgcccggatcaccgccctgttctcccgacgcggtttcaacatcgactcgctcgcggtcggtaccaccgagcaccccgacatctcccgcatcaccatcgtcgtgaatgtcgagggcctgcccctggagcaggtgaccaagcagctcaacaagctggtcaacgtcctgaagatcgtcgaactcgagcccgccgctgcgatccagcgggagctcgtcctggtgaaggtccgcgccgacagcgagacccgctcccagatcgtcgagatcgtccagctgttccgcgccaagaccgtcgacgtctccccggaggccgtcacgatcgaggcgaccggaggggccgacaagctggaggcgatgctcaagatgctggagcagtacggcatcaaggagctcgtccagtccggcaccatcgccatagggcgcggtgcgcgctcgatcaccgaccggtccctgcgcgccctcgaccgatccgcctagggtctttcgttcggatcaggccggatcagggcgcgtgccggggcccgcgagcccggcacgatccgaacgagaggccctagcggcaccgcgagcggcgccggcgccgctcgcatggcgagacccgacaacgtatacgacgcaccccgccgtacggtgggacgcaacacctgcacaccaaggagaagacccagtggccgagctgttctacgacgacgatgccgacctgtccatcatccagggccgcaaggtcgcggttctcggttacggcagccagggccacgcccacgcgctgtcgctccgtgactccggcgtcgacgtccgcgtcggtctgcacgagggctcgaagtccaaggccaaggccgaggagcagggcctgcgcgtggtgaccccggccgaggccgccgccgaggccgacgtcatcatgatcctcgtcccggacccgatccaggcccaggtctacgaggagtccgtcaaggacaacctcaaggacggcgacgcgctgttcttcggccacggcctgaacatccgcttcggcttcatcaagccgccggccggcgtcgacgtctgcatggtcgcccccaagggccccggccacctggtccgccgccagtacgaggagggccgcggcgttccctgcatcgtggccgtcgagcaggacgcctcgggcaagggcctggagctcgccctctcgtacgccaagggcatcggcggcacccgcgccggcgtcatcaagacgaccttcaccgaggagaccgagaccgacctgttcggtgagcaggccgttctctgcggtggcaccgccgccctggtcaaggccggtttcgagacgctgaccgaggccggttaccagcccgagatcgcgtacttcgagtgcctgcacgagctgaagctcatcgtcgacctcatgtacgagggcggcctggagaagatgcgctggtccatctcggagaccgccgagtggggcgactacgtcaccggcccgcgtatcatcacggccgacacgaaggccgagatgaagaaggtcctcaccgagatccaggacggcaccttcgccaatgcctggatggcggagtaccacaacggtctgcccaagtacaacgagtacaagaaggccgacagcgaccacctgctggagaccaccggccgtgagctgcgcaagctcatgagctgggtgaacgacgaagaggcctaggcctcgggggagcggggcgggtccttcacggaaccgccccgctccgcggtaaccggagaagccgctccgtacgggggtaccggaggggcagttccgtacgggtgtacacgacgtccaccctcgtgcgggtgatccttccaccggggcgcagtacgaggcgcgtcgcatgactacacttctcaacagatacacgcgtcagggcccacagtgtcgtgcgtcttccacgcggctagcccctccaccgcctgcggccgtcgggacggccgtccgcactggacttgtgaggactcacgtgagctcgaaacctgtcgtactcatcgctgaagagctgtcgcccgccacggtcgacgccctgggtccggatttcgagatccggacctgcaacggcgcggaccgcgccgagcttctccccgcgatcgtcgacgtcgacgccatcctggtgcgctccgccaccaaggtcgacgccgaggccatcgccgccgccaagaagctccgggtcgtggcccgcgcgggcgtaggcctggacaacgtcgacgtctcctcggccaccaaggccggcgtgatggtcgtcaacgccccgacctccaacatcgtcaccgcggccgagctggcctgcggtctgctggtggccaccgcgcgcaacatcccgcaggccaacaccgcgctcaagaacggcgagtggaagcgctccaagtacaccggggtggagctcagcgagaaggtcctcggcgtcgtcggcctcggccgcatcggtgtcctggtggcccagcgcatgtcggccttcggcatgaagatcgtcgcctacgacccctacgtccagccggcccgcgccgcgcagatgggcgtcaagctcctcagcctggacgagctgctggaggtcgccgacttcatcacggtgcacctgccgaagacccctgagaccctcggtctcatcggtgacgaggcgctgcacaaggtgaagccctcggtgcgcatcgtcaacgccgcgcgcggcgggatcgtcgacgaggaggccctggcctccgcgctcaaggagggccgcgtcgcgggcgccggcctcgatgtgtacgcgaaggagccctgcacggactccccgctgttccagttcgaccaggtcgtctgcaccccgcacctcggcgcctccaccgacgaggcgcaggagaaggcgggcatcgcggtcgccaagtccgtccgtctcgcgctggccggcgagctggtcccggacgcggtcaacgtccagggcggcgtcatcgccgaggacgtacgccccggtctgccgctcgccgagaagctcggccggatcttcaccgccctcgcgggcgaggtcgcggcccggctcgacgtcgaggtgtacggcgagatcacccagcacgacgtcaaggtgctggagctctccgcgctcaagggcgtcttcgaggacgtcgtcgacgagaccgtcagctacgtcaacgccccgctgttcgcgcaggagcgcggtgtcgaggtccgcctcaccaccagctccgagtcgcccgaccaccgcaacgtggtcaccgtgcgcggcaccctctccgacggtcaggaggtcgcggtctccggcacgctggcgggtccgaagaacctccagaagatcgttgccatcggtgagcacgacgtcgatctggcgctcgccgaccacatggtcgtcctgcgttaccaggaccgtcccggcgtggtgggcgcggtcggcaagatcctcggcgaggccgggctgaacatcgcgggcatgcaggtgtcccgggccgccgtgggaggcgaggcgctcgtcgtcctcaccgtcgacgacaccgtcccgcagccggtgctgaccgagatcgccgaggagatcggcgcgtcctcggcccgctcggtgaacctcaccgactgacgtccacacgtcggtgaacctcatcgtctgacgcagtcgtcggacgcagaagcacagcagtacgaccccgctccgtacccggtagcaggcccgctcgtcccgtacgagcggtcccgccgccgggtacgttgcgtttccgggtgcccggcgcgttgtcgcgttctccgggcgtcggggttgaacaacccgccgcagtgggcccggggttgggtcctggggcccacgacgtgagagggcccccgaccctagggtgatcggttgtcatgtcactcatgggtgccgggggtcggatcacgtatgtctgctgtcggtggcatacccgtagcgggaggcccggctccggccgtcgcccggtggcgtgaacttccgcgcccgctcgtcctggtccgcgtgctgctcctcgtcctgttcggggcgacggtgctgggggcggtcggtctgtccggctcggccctcgccgcggacgcgatgggtgccgaggtgctcggcatcctgctgtacgcctccgcgcccggggtgctcgcggcgctgctggcccggcatgtcaggaccggtggcgcgcgtgtgcgatggggcatcgtcgccgtccaggtctggctgatcctcggcggcctcgccaacctcggggacgggtcgccggacggactgtcccagctggtcctgccgatcctgatcatcgtcctgatcagccgcgcggggagccgggcgtggttccgtctgccgcccggcgaacgggggcagccgccgaagttctcgctcccgcacatgatcacctggaagcgggaccgggggcagaccgccctggagtacctgggcctggtcctgatcgtcgtcgcgctgatcgcggccatgaccgtgggcggtct

SEQ ID NO: 2942 - DNA, 8015 bp, Unknown
  Kingdom: Bacteria, Phylum: Actinobacteria, Class: Actinobacteria, Order: Streptomycetales, Family: Streptomycetaceae, Genus: Streptomyces
cgccgtcgcggtggtgaccggctcgatggacctggacttctcgctgccgctgttcaccgagccgctggttcccacgctcgtggtgaccggtgccggggcgccctccgaccggatcgcggcggcccggaaggcgggcgccgaggtggtgatcgcgggcgagggcggccgggtggacccggcccgtgtcgtgcgcgagctggccgaccggggtctgacccggcagctcaccgagggcgggccccggctcctcggccagttcgtggcggccggcgtgctggacgagctgtgcctgacgctttccccgatgctcacagcgggtgacgctcagcgcatcgcagggggtcccggggtcgccgtgccggaacgttttttcctggcatcgctgctggaagaggccgggttcctcttcactcggtaccgtcggaccgacagatagcggaatttaccgttccgcttagcttcggctgggcacacttacccctgcagtccccgtggaagcacggggaaggatggtttcagcaaacgaccgtggacggccgcgccggccgtccacgagacgaagaagcggaagggcgcctgtcgtgttcacaagcgttttgatgatcgagaagccgctcactcccgaggacgtggacttcgtcaccaccctccacggcgaggagcggatctcgttcgtcgttctgttgcagccgcgcggtgaccaggccgatgtcctgctgcgtgcgatcgacgacgtggcgatgggggaattgaaggaagcggtccgggaaggggaggagccggagggcaacgaggcccgcgaacccgccgagatcggcctggagtactccctacgggccttgcgggaggcgggctccgaagcggtcggacaggtgatcgaggaccaccccctcgacaagctcaagtccgtggtcgaggacgcgggggccgacgaggtcatcgtcctgaccgccccgcactacgtggaggagttcttccaccgcgactgggcctcccgcgcccggcacaaggtcggcgtcccggtgctcaagctcttcgcgcacagcgaataggctgggcgcgcggtccggggtggcaccggtccgcgacccgagaacgcacccgaatcgcaggagcacaaatggcacccggcattcccgccgccatggaacgaccgcacttcatcggcatcggcggcgccggaatgtcgggcatcgcgaagatcctcgcccagcgcggagcgaaggtggcgggcagcgacgcgaaggagtccgccaccgccgagtccctgcgggcgctgggggcgaccgtgcacatcgggcacgcggcgggccacctggccgacgacgcgtcctgcgtggtcgtctccagcgccatccgcgccgacaacccggagctgctccgggcgaacgagctgtcgatccccgtggtgcaccgctcggacgcgctggcctccctgatgaacggcctgcgcgccatcgcggtcgccggcacccacggcaagacgaccacgacgtcgatgctggccgtcgccctctcctcgctgagcctgtcgccctcgtacgccatcggcggcgacctggagggccccggcaccaacgccacgcacggtgagggggacatcttcgtcgcggaggcggacgagagcgaccgcagcttccagaagtacgaccccgaggtcgcgatcgtcctcaacgtcgagctggaccaccacgcgaactacgcctcgatggacgagatctacgactccttcgagacgttcgtcggcaaggtcgtccccggcggcaccctggtcatctccgccgaccaggccggcgcggtcgaactgacccgccgggtccgcgacctctccgacctgaaggtcgtcacctacggctccgccgagaacgccgacgtacgcgtccacaaggtcaccccgcgcggcctgaccagcgaggtcacggtcctcctcaacggcaggttcctgaccttcaccgtctcggtccccggcagccactacgcccacaacgcggtcgccgctctcgccgccggggtcgccctcggcattccggcgcacaacctggcctccgcgatcggcagctacaccggggtcaagcgccgcctccagctcaagggcgaggcggcgggcgtgcaggtcatcgactcgtacgcgcaccaccccaccgagatgaccgccgacctggaggccatgcgcggcgcggccgccgacgcccgcatcctggtcgtcttccagccgcacctgttctcccgtacgcaggagctgggcaccgagatgggccaggccctcgccctggccgacgcctccctggtcctggacatctacccggcccgcgaggacccggtcccgggcatcaccagcgccctgatcatcgacgcggcgaaggaggccggagccgaggtcaccgccgtccacgaccaggccgacgtccccgccgccgtcgcgggaatggcgaagcccggcgatctcgttctcaccatgggagcgggcgatgtcaccgacctcggcccgcgcatcctggaccacctgtccagcgatcacctgtcgagctgaggagcgggacgtgtcgtacgacgtcgagaagccggacgagcagtggcgggaagagctgacccccgccgagtacgcggtgctgcgccaggccggcaccgaacccgccttcgtgggtgagtacaccgacaccaagacggcaggtgtctactcctgccgtgcctgcggggcggagctgttccgctccgacaccaagttcgagtcgcactgcggctggccgtcgttctacgacccgaaggacaccgacgcggtcgagctggtcgaggaccgcgcgcacgggatggtccgcaccgaggtgcgctgctcccgctgcggctcgcacctgggccatgtcttcgagggcgagggctacccgacccccacggaccagcgctactgcatcaactcgatctcgctgaccctggcgcccgacgagagctgagccgcacggctcacgtgtgcccccgctccccgcgcaagccgggggacgggggttcctcgccgctaagcggcccggggatacccgatggcggcgacggcgtcgccgagccgctccggcgtcagcgccgggttgaggaccccgaccacgtcggacgtgagcggccgcagctcgtagacgtcctgtacggcatcgaggtcgaccggggcgtcgaagtagtacgccgcccagtcggcgtaggtcttcggcgtcccgtcggtcagcatcccgaacagccagtccgccccgtcgtcgccgaggtccgggtccacgtcgcccgtgtgccagaccgtgtcaccggtctcccgccacaggcacgcggtcaccatggggatgtcgtcgaggcggaacgacggctcctccacacaggaccggaacacctcgggaacggagtccaggaccccggggaacggcacctcgtcgtcgctcgcgtacgggttcagcggcgaggtgtggtcgaagccgatcacgtacgcgcccgctgcggagaagacgatggagtaggtgtccccgcccccgttgtccatggaggccagctcgcggcccggggaccagtgcgcgtcgaagctgtggcggcgcagatagggcttgtccggctgcatgatcgcgtccagcatcgccatcgaacggcagcggtcgcgaagggtgggtatgtccggcagtgtgcgggcgacgtcctgagcggtcatggggccgattccaccacaggggtgcgcccccgacgatcactcctcgtcgtcgctcccgcccgcctcggccgcttccgaccgcagcagtgggtggatcacgccggggaagacccgggcccgcacgacctcctcggccgacccgccctggacgacggtctcggcgacgccccagggccgcccggccaggtggatggtcagggtgtacgaggaggagcagccggtgcactcgtagcggtcggcccaggtctcgacctcggtggtggagcccgggtagcgcttcacgtgccggtggcgggcgtggcagtggtcgcaggtctcgcccggctcgcaggtcccgccgcacggacacggcacgtcgaagctgtcggcgggcgtccagcgctgcacgaggacggcctcgcgggtcgcgcccatgtccttcatggccttgaggttgcgggcggcgacgttgtacgactcgccggtggcggccatccggtcacggatgacgtccttgcgtccacggttggtcgtcatgttgctcctcctgggttcacgcagcccgccaggaggcccatgagtcaatcagtcagtacctctttacgttacccgcccggcaaggacgcacggaccgcttccgcgccgtcccgccgccaacccgtcactgccgtccaggtggtcgatcggcggactcctgcgcccgggtcagttcggccgtcgatcggcgcaggatctcgaccgtgccggagagccagcgggtgaccgtcgcgcgctccgcgtcgtccatgccgtccaccagcccgttcatcgcctcggccatgggcgcgaagagccgggccagctctcgccggtgctccgccgtcacgctcagcgcgtacctgcgtccgtccgagccgtccttgcgccggtccacgtgcccgagcgcggccagccggtggacgatcttggtgatggccgcgttggacagcccggtgtggtccaccagctgccccgggccgaccccgggctccgccgcgatcagggagagaaccttgtgctcggtggcgttgagcccgaaatgcgcggcgacggcctcgtggaagaggatcacgcgcaggctcagctcctgccccatcgaccggccgtcgggttcgccgctctcctgccctctcatgaccacctcctcgacaaactacttcactttggtgaaatgctatggctaggctgtgcccatgacagccacctctgcggcgcgcacgtctcctccgtacggctctctccccgactccagcgttctggcccgcaccttcgcggcctgcctggcggtgaacgtaccgctcctggcgctgctgctgatcccgcagctgatgcgcagccgagcgggctccgaggtgctcctcatggtgggcacgggcctgctgctcgccctggtcgtgggcgcggtggtgttcgcacccgaggtgagcgcgaaggtggcgccggccgggtgccactggcgcccgggaagggcccgcgcccgggtccgggctctgcggcgcgagaaccgccgcacctacctgtggcgccttggcgagttcgtggcgctgtacatcgtggcgcagggcgtcggcggcctcgtcgcgtggctgctgccgcatgtcgcggacaacccggcccacgccgccgaccccacggccggcgcctggaccatcgactacccgaactacgcggcccaggccgtggcgatgtacgcctgcatctgcttcgccctggcctggtacgcgacgcggctgcgcgccgatgcggtgcgatccgccgtcgcacgcggctgaccgggctcaggggtcggctcagccctgggtcgcgtaagcgaggaactgcgtccaagcggccggagcgagggagagctgggggccctcgtcgagcttggagtagcggacgcggacggtggaggggcaggcggcgacctcgacgcaggggtcgccggacccgctgctgtagctcgacttgtgccactccagggcgacctcgacgcacgagtcgccttcggcgctgctgtagctgctcttgaaccaggccaggatcgcgttcgccctccgcgagatcattcccgggacggctctcgcatcggtggcccggcccggcatcggggtcgcgatctggctccacgccaccgacgtccaggccatccacgacgcgctcgccgccgccggtcacaccatcgtctcggcccccatcgacggccccttcggccggacgttcaccttcgccgacccggacggctaccacgtcacgctgcacgaccgagcctgaccggccggttgagcggacgcgcggatggcggagggctaccgcggaccggagggtttccggcgcgtggctcgggacgggcccggatcgtccggccgcgggtcaggcgggctggtccttgtcggacgggagccaaaccgccatggtcgccgggtcgacgggaatcgagatgtgttcgtgggtgatcgaccacgttccgtcggaccgctggaggcagacgctctcccgtacccatatcgatgcctggagcccgcccttccgctctccggagtcccgttggagcatgtgggcgaaagcggtgtcctcgccggctgtgagggtgatgtcgtgcgtctccaggctgatcggaccgacgtatccgtcgaaccaacgcaggaagttgcgccggatctcctcggttcccctgaaccgcagaggggggacggcgtcgtagtagacggcgtcggcggcgtagaacgacatgagccggtcgatgttcttggtctgcgcggcgtcggcgcggcccgccagaagcgcccggacctcggtctcatgggtggtcatctcgtactcctcggtcgtggtgtgccgcggcacgggttggacggcgcggccggcatcgagcacggcggcgtgcgtccggctccgtcgcgtgccgttgtcgggagtaggacgagacggcccggcggaatgtgaggcggggcgccgttctcacatttcgcggtgctgtctcgtcatagaggtgacgaaaggtccgaccgagggagcctgacgaccatgacgcccagttcgaccgcgccgcaggacggccgacgcgacccgatgccgagcgggctcacgggtgaacaccgtcggctgatcaacctcgcctaccggatgctgggttccctcgccgaggccgaggacgtcgcccaggagacgtacgcccgctggtacgcgatgccccggcaacagcaggaggcggtggcgtcccccagaggatggctgaccaaggtcgccggccgtatctgcctcgacgtgctccgctcggcgcgggtgcggcgcgagcgctacgtgggggagtgggtccccgagccgctgcccacacggacagagtggccagacggcgcgacggacgaaagcacggctgatccggccgatcgtgtcacgctcgacgagtcggtcagtatggccttcctcgtcgtgctggaggcgatgaccccggcggagcgtgtggtgttcgtcctccacgacgtcttccgttaccccttctccgaagtggccggcatcgtcggtcgcaccccggctgcctgccgtcagttggcgacctcggcccgccgccgcgtcgacgtctcaccgcctcccgcgtcgccgacgggccagcgggcccgggtcgtcagggatttcaagctggcgtggcaggccaaggacatcaacgcccttgtcggcctgctcgaccccgccgccacggccgtaggggacggcggcgggctcgtcacggcgctgctccacccgatcgaaggcgccgaacagatcgcccgcttcttcgcggaccggtcccggccgggtcgactgacactccgggagtgcacggtcaacggtcagcccggcctggcggcccacatggacggcgtcgtcctggcggtctactcgttcgacatcgcggacggccggattcgacggatctgggccgtgctcaacccggagaagctccggccctggaagaggggatgacgccgccgtacccgccctgcgatccggcggcccagggtcctcgaccggttcccgtcgcggaaggcgtccgcccggctgagctgctgcccgtgcggcccaccgtcgcctcgggaggctccgacgacacccgtgatgaccgtgtccgggggaaccgccaccgcggggcgggccgacttcccggacttggcccttgccgggtcgcgctccacgacggactgccccgtcgactcgcggatcacctcccgaccagtcgtcctcgatcttgacgctcggcgcggtgtcggcgaggcggatacggtcgcgggtcgtcggcccgaaacggtccgcataggccggtcgcgtcaatacccggcggcgagcgtgaggagcgcaccgtccaccaggcgcacccacgtaccggccg

SEQ ID NO: 2943 - DNA, 3909 bp, Unknown
  Kingdom: Bacteria, Phylum: Actinobacteria, Class: Actinobacteria, Order: Streptomycetales, Family: Streptomycetaceae, Genus: Streptomyces
  misc_feature (468)..(490): n is a, c, g, or t
ccgccgaagacctcctccgccccgccgcccagcgagaagccgggcccttcccccaccgacgcctcggcgcgcaccgaggtgctggccctggtgaaccaggagcgcgcgaaggtcggctgctccccgctgaccacgagtgccccgttgtcctcgctcgcccagaacttcagtgaggacatggcggcccgcggcttcttcgaccacacggacccggacggcgacactccctgggaccgggccgcgcaggccggcgtgcaggggctcggcgcggagaacatcgcccgcggccagggggacgcccaggccgtgatggaggcctggatgaacagcgaaggccaccgggcgaacattctcaactgcgactacaagaccatcggcatcggcgtccacgagggctccggcggtccctggtgggtccagaacttcggcttctgaccaacttccacgatccacttactcccgcacagnnnnnnnnnnnnnnnnnnnnnnnggggtcagcgagaagatgctctcccagaccctgcacgcactggagcgggacgggctcgtcctgcgggacgcccagccggtcaacccgccccgggtggactacgagctcacgccgttcggccgcgaggtcacggagaagctcctcgggctgatccggttcgtcgaggggcggatggatgacgtgctggccgcccgtgcgcgttacgacgaggtgcgcggcggccgctgacagcgcgggcagtagtagctggagcggttcatccaggcgcggcggcgcatcggggtgccgcaccggtggcagggctcgccctcccggccgtacgcgtcgagcgaccggtcgaagtagccggactcgccgttcacgttgacgtacaggctgtcgaaactggtgccgccctgggagagcgccgcgttcatgacgtcgcgggcgtggccgagcagctcggcggacttggggcgggtcagggtcgcggtcggccggtcgtagtgcagcttggcacgccagagcgcctcgtccgcgtagatgttgccgacgccgctgatcagcgactggtcgagcagggcgcgcttgaccgtcgtacgccgctgccgcagcgcggtgtggaacgcggcgtcgtcgaagagcgggtcgagggggtcccgggcgatgtgcgcgatggtgtccggcaggccttcgggggtgttgtcgtggagcgagagcccgccgaaggtgcgctggtcgacgaagcgcagctcggtgccgagcgcgtcgtcgaaccgcatccggatccgcaggtgcttctcgtcgggcgcgtccgccggctgcaccagcagctgtccgctcatgccgaggtgtcccagcagcgaggcggaggcctcgtcgatcggcacccagaggtacttgccgcggcgcatcgccgccccgaagcggacgccgcgcagccgggcggcgaagtcgacgccgcccgcgagatgccgacggaccgatcgcgggtgcaggacctcgacctcgctgacggtgcggccgctgacccagcgctcaaggcccctgcggacgacttcgacctcgggcagctcaggcacgatgcactactccagacacgacggtagtacgggagcgcgggaccggctccccgggacgtacggggaccccgtgcgcgggctcccccggacaggggaaaccccccggtgcgcatggcaccggggggttcccgtttcgcttcaggccggagcggcgtccgtgttcggcaacgaatcggcaggggtgtcggcggcccctccgtcggctgcggacttctccgcggccttccgtgcctctgcggcggcgctgatctcacgccaggcggactcggccgcctgctgctccgcttccttcttgctacggccggtgccggtgccgtacgagacaccaccgacgcgagcggcagcagtgaaggtcttctcgtgatccggaccggtctccgtgacgaggtactcggggactccgaggctctcgctcgcggtgagctcctggaggctggtcttccagtccaggccggcaccgaggttcgaggacctgtcgatcagcgggtcgaagagccggtggaccagctccgaggccgcgctgaggccctgatcgagatagaccgcgccgatcactgcttccagtgtgtcggcgaggatggaagccttgtcccggccacccgtgccctcttcaccgcggccgagccggatgaaggagccgagttcgaggccgcggcccacttccgcaagtgcacgcgagttgaccaccgcggcccgcaacttggccagctggccttcgggcaggtcggggtgggtgcggtacagcgtgtccgtgaccaccaggccgagcaccgaatccccgaggaattcgagccgctcgttggtgggcagaccgccgttctcgtatgcgtacgaacggtgggtcagcgcacgcaccagaagggcggactcgaggtgatacccgagccgcccttccagaagcgtgtgggacgaggctgtgttgacgttgtctgcctgcttcttggcgctggacaactcagacatcgggcctctcaccagccgctcagacctcgaggacctggcgcttgttgtaggtgccgcagctcgggcacgcaatgtgctggagcttgggctcctggcaacgctcgcacgaaaccagggtggggaccgcagccttccactgcgaccggcggtggcgcgtgttgctgcgcgacatcttccgcttcggaacagccacggctacttctcctgcttctcgtcgacgcccggttcggcgccgcccatgttgtccttctcgccgtcctgaacggtctcggcgagtccttgcagtgccgcccaacgaatgtcgagggcatcgtggtgatggtccggattctcgtccagcctgattccgcattcggaacacagaccggcgcaggtctccttgcacaccggctgcatgggcagtgcgagcactaccgcgtcacgcagcattgactcgaggtcgaacaaaccgtcctcgaggaagaacctgtcctcgtcgtcctcggcgtcgtcggccggttccgccgcactgctgcggccccggtcatcggcgtcagggtacgagaacatttcctggaaatccgcgtcgacctctacggtcagcggctccagacaccttacgcactccccctcggcggttgcacgggcggtgcctgtgacaagcaccccttccatgaccgattcgaggcggaggtccagctccacgggcgcgccttccggcactccgatgacgccgtcgatgcccaggaccggtgaaccgggtgcgtccaccgagcgggtcagccgcttcagggcaccgggacgccgacccagctcgtgcgtatcgaacacgagagggttgcggtggtcgaggtggccgttcagggcgtttcctgctttcgaatcatgggtgtcatacggcgaagggagggccgtctacggtccagggacgagccgtctccgttccgtggacgaaacgggcagccgagatcgcggacctatgtgcgaccgaggattcaggatactggacggaccgctcagcacccaatcggggcggcaggcccgggatcagcggccctgctcgtaccggcgcagctgctccaggtcgatcatgctggtgtcgaagaggctggtctcgtccagcgcccccccgccctgctggtcggccgcctggggttgctgcggctgagagtgaggctgctgaggctgctgctgccagccgtagtccggctggctccccggctggggcgggtacccgttcgggtcgtagcccccctgctgctggtacgccgcgtacgggtcgggctgctgctggtagccgtacgcgtcctggacgccctgctggagcggctgctcctggtagccgtacgccgcctgcgcgtagctcggctcaccctgcggcggcgcggggtacgggggcggctgaggcggctggga

SEQ ID NO: 2944 - DNA, 1305 bp, Unknown
  Kingdom: Bacteria, Phylum: Actinobacteria, Class: Actinobacteria, Order: Streptomycetales, Family: Streptomycetaceae, Genus: Streptomyces
acatgatggctcccactgcaccccttcacacggggtcaaggtcaagcctcgccggcgcggggtttctcggctgttccgtcagccgtgccgtttcgggtccagcagctgttcgcgcagagcggtcaactggccggcagcaccgcgtccgccaccaccccttccgaccgggacccctcccgctccggccgccggtcagcgacgcccagtcccgaccggggtgcgccggtgcccgcatgggtccaggcgcgtatccggtacgccgaggagtccgtcgccttcgagcgccgactggccgaacacctcgccgagaacaaggcggtgacggaggagttccggaagatggcgcgcgccgcgtgggaccgggcgcggcagcagtatccgcgcgccctcgacaccttcggcagcgagaacccgagcatgcccggaacggtcggaaccagcaggccggtcctccagcagatgctgcggaccggcaacctgagggagctgacgaccttcctgttccagggcatctccagcgacctggtgccggagatgctcgggggcagggaggacccgaacccggcgatcgaggaggagcggaccagccgccgccaggcggagggccgcgccgaactggagcggctggcagcggagttgaatctggacgacaccctctccgcaccggagaggcaggcggcgctcgcccgcgccacccgccggcacacggtccagaccgaccccgacgacgtacgcccgccgctgagccgggccgagcgccgctacgcggtgaacgagctcgggctcacctggatgcccgcctcctccgtgtacgacctcgcgatggcgtccggtctccaggggacgtccgaggacacggggggcctggtcctgaccggcacggcgggttcgacgtaccgcttcctggtgcacgccgcccggatgcgggaccagtgggggatcgacctggacctcggcctgatccgggcaggcatgatcgccacctcgctgtcggcgggccaccactcgttccacgaggtgatgcgcggcgcccagttggcgctcgacggcatccccggccacgacccggccctggactaccaggacaactggggccggtactggaacgtccacccgctcaccgagcaggagctgcgcgaccatgtggcccgggacgggctcttccccgacgagcacgcccgggccctgctcgacacccctgcctcggtccgccccccgctcccggcgaccgactccggggcggccgtcgccggcccgtcccccgggcccggatgacaggtcccgcgccgccgctgtcaccggtgt

SEQ ID NO: 2945 - DNA, 3161 bp, Unknown
  Kingdom: Bacteria, Phylum: Actinobacteria, Class: Actinobacteria, Order: Streptomycetales, Family: Streptomycetaceae, Genus: Streptomyces
tacgtcgcggggacccggcgtccggacacctggctgatgcgcgaggtgccggggacgctctccaagatgggcgccgaggcggtccaggcggtggcgctggccgacggccgggccctcgccttcaagatcgacgacgggtcggtacgggcgctcggcccggtgctggcccgcgccctggaagtgctgggcgtggacgccccggtggtcgcccggatcggacgctcgccgctgctcggcgggtccgcggaggtcggggaaattcgcgcgacattctgaggagcgcatgcctagcgtgggggaatgagccttgatgtccgcactgtcaccgcgtccgaataccccgactggctgagggcggtgcagaacggcttcctgaccgccggcaggccgggtgaggacgatgtcgcggaccggctcgtcggcacggatctctcccgggtccagggtgtgttcgacgccgggcgctgcgtggccacgttccgttcgttcgcccaggagctgaccgtggtgggcggggccaccgtggcggccgacgcgatcagcggggtcacggtggcgcccacgcaccgccggcgcggactgctcagccggatgatggcgacggacctggcggcggccaaggagcgcggcgagccggtcgcctcgctgatcgccgccgagtacccgatctacggacggtacggcttcggccccgccgcctggaccgccgagtgggaggtctccgtgcaccgggccggcctcgacccgcgtcgctccgggcagccggcgggcggcggccggatcgagatggtggacggcacggacgtccgcaaggcgggtcccgaggtgcatggagcgctggcggcccggcagcccggcgtcgtcacccggagcgaacgctggtggcggcggagcaccggggtcacgccccgctcggagcacgagaagtggagcgagcccttctacgtcgtgcaccgcgccgccgacggcacggtcgacggtctgatgacgtacagcacggacgacaagtggggcgacgccaagcagccgctgaacaccgcctcggtacgggacatgatcgcgctgaacccggcggccgagcgtgccctgtggcactacctctgctcggtcgactggatcaccacggtccgctcgggctaccgcgctcccgacgatctgctgccgctgctgctgcccgacccgcgcgcggcccggatgatcaccaactcggactggctgtggctgcggatgctggacgtgccgcgcgccctggaggcccggacctacggcgtcgaggcgtcgctcgtcctggaggtccgggacgacgcggggctggccgggggccgcttcctgctggacgcctcgacgtccggcgcccggtgcgtcccgaccacccggagcgccgatgtggccctggacgtggccgagttggcgacgctgtatctgggcgacgagtccgtgcggcggctggtggacctgggccgggccgaggagctgcgggcgggtgcggcgacgacggcggacgccgtgttccgtacgggcaggcggccgtggtgcccggacgtgttctgagcgggtcggggagcgctgaccggtccgggcggtcaggcgtcatcggcgcaggtggccggggcgtccccggtgcgcgcggtcagcgtgtccggagccggaacagcgtccccgaggcgccgaccgccacggcgagcatgcccgcggcccaggccagcgcgatccagggggtgctgcccatctcctggccgagcagcagtccgcgcagggactcgatgcccggggtgatcggctggtggtcggcgaagccgtgcagccagccgggcatcgagtcggtcgggacgaacgcgctgctcgggtagggcaggaacgacatgaagaacgtgaagccgctcgccgcctccggggtccgggccagcaggccgatcgccgcggagatccaggacagggccacgatgtaggccaccagtacgacgcccaccaggagccagccgctccaggaggcggcgggacggaatccgatcagcagcgcgacgccgaagaccagggcggtggcgcagaggttgcggaccgtgctggccgccacatgcccggccagcaccggcgtaccgcccacgtccagggagcggaaccggtcgatgatgccgcccttcatgtcctcgctgacggcggtggcggtggtcgcggcgccgaacccggcggacaggagcaggacgcccgggacgacgtacatgacgtacgagtcgtagtccgtcccggtgtcgatggcgccgccgaagaagtagacgaagatcagcatcagcatgatcggcagggccagggacgtgatcagcgcgtcggtgttgcggctgctgatgcgcagggcacgtgcggtcatgacggcggtgcgggtgagcggaccgggtccgggaccggtccgccgcgcggccccttcggtgtgccgggccggggttccgcgccgaacggcggtgtcagacatgggtggatgcctccggggtcgtggtcgccttcgaggtcaggtccaggaagacgtcgtcgagagtcgcgctgtgcaggccgaagcggtcgatctcgtggcccgtcgggtcgatctcgtcgagcagggcgcgtacctgtgccgccgagccgtcggtggggatgccgagcgtcagggtgtcgggggagtggtggacggcccgcccggccagccggaggtacgcctcgctgctggtgaggaccaggtcgagacggtgtccgccgacacgggacttgaggtcggcggcggtgccctcggcggcgatccggccctggttcagcagggcgatccggccggcgaggcggtcggcctcctccaggtactgggtggtgaggaggatggtcgctccgcgtgcggccagctcccggacgacctcccagagttcctggcggctgcgcgggtcgaggccggtggtcggctcgtccaggaagaacaccccgggctccggtgagccgacgagcccggcggccaggtcgaggcggcggcgcatgcctccggagtaggtccggacgggacggcgggccgacgcggtgaggtcgaagcgctccagcagctccccggcgcggcgtcgggcatcggcccgggagagaccggtgagccgggccatcatccgcaggttctcctcgctggtctgggtctcgtcgaccgcggcgaactg

SEQ ID NO: 2946 - DNA, 7243 bp, Unknown
  Kingdom: Bacteria, Phylum: Actinobacteria, Class: Actinobacteria, Order: Streptomycetales, Family: Streptomycetaceae, Genus: Streptomyces
gacggggcgatcgccccgtcccctcccgagcagcggcggccctcccggctgctcgccccgctccgcgagaccgggaagctgttcgcgctcgccgtcgcggtggcccgggcgatcttccgcaggccgttccaggtgcgcgagttcatcgagcagttctggttcgtcgcgagcgtcacgatcctgcccgccgccctcgtctccatcccgttcggcgcggtcatcgccctccaggtcgggtccctcacccagcagctcggcgcccagtccttcaccggcggcgccagcgtgctggccgtgatccagcaggccagcccgatcatcgtggcgctgctgatctccggagccgccggatccgcgatctgcgccgacctcggctcccgcaagatccgcgaggaactggacgcgatggaggtcatgggcgtctcgcccatccagcgcctcgtcgtcccccgggtgctcgccaccatgctcgtcgccgtcctgctcaacgggctgatctccgtggtcggcaccctcggcggctacttcttcaacgtgatcatgcaggacggcaccccgggcgcgtacctcgcgagcttctccgctctcgcccagctgcccgacctctacatcagcgagttcaaggccctgatcttcggcttcatcgcgggcatcgtcgccgcctaccggggcctcaacccgcgcggcggtcccaagggcgtcggcgacgcggtcaaccagtccgtcgtcatcaccttcatgctgctgttcttcgtgaacatggtcctcacggcgatctacctccagatcgtccccgcgaaggggagctgaccgatggcgatgctcagctggctcgaccgatcgggcgaccaactcaccttctacgtcaaggcactcgtctggatcccgcgcaccctgcgccgttatctgcgagaggtgcagcggctgctggccgaggtcgccttcggcagcggcggactcggcgtcatcggcggcacgatcggcgtgatggtcgccatgaccctgttcaccggcaccgtcgtcggactccagggctacgcggccctcaaccagatcggcacctcggcgttcaccgggttcatctccgcctacttcaacacccgggagatcgctcccctggtcgccggactcgccctctccgccaccgtcggcgcgggcttcaccgcccagctcggcgcgatgcggatcaacgaggaggtcgacgccctggaggcgatgggcgtccgctccatgccctacctcgtcaccacccggatcatcgccggagtcgtcgcgatcatcccgctgtacgcgatcgggctgctctcctcgtacgtcgcctcccgctggatcaccatcttcttcaacggtcagtcggcgggcacctacgaccactacttcaatctcttcctctcccccgaggacgtgctgctgtcggtgctcaaggtgctgatcttcagcgtgctggtgatcctcgcccactgctactacggcttccacgccaccggcggaccggccggtgtgggcgtggcggtcggccggtcggtgcgcaacgccatcgtcctcatcagcgtcaccgacttcttcctctcactcgccatctggggcgccacgacgacggtgaaggtggccggctgatgcgcacatccagcacacgcacggtccgccggcggctggccggagtcaccttcctgctggtgcccgccgtcctggtgtgggtctcggtctcggtgtacgagaaggacttcaccgacgacgccaccgtcaccgtccgcaccggagcggtcggcaacgagatgcacgacaacgccgacgtgaagctgcgcggcgtcgtcatcgggcaggtccgctccatcgccaccgacggtgacggcgcccgcctcaccctggccatcgaccgggacaagctcgatcaggtccccgcggacgtcaccgcccagatgctgcccaccaccctcttcggcgcacggttcgtcgcgctcgtcccgccccgcatccccacgggttccaccctgcgggccggggcggtcatcccgcaggaccgctccagcaacgccatcgagctggaacaggtcctggacaacgtcctgccgctgctgaccgccgtgaagcccgagaagctctccgccaccctcaacgccgtttcccaggcgctggagggacgaggtgaacgcctcggcgagacgctgaccacgctggacggccacctgaagaagttcaacccccaactccccaccctcaacgccgacatcaaggaactcgtcaaggtgagcacgctgtacgcggacgccgcgccggacgttctcgacgcgctgaccgacgccacggtcaccagctccaccctcgccgaccaggaagcgcggctcgccgggctctacggcaccagcacggccgccgcacaggacatgacgtccttcctgcgggagaacaaggacaacctcatccggctctccgccgccggccggccctccctcgaactcctcgccgaatacgccgattcgttcccctgcaccctgcgcaccatggccggtttcgtgcccgccatggacaaggccctcggcaagggaaccgacgaaccggggctgcatgtgtcgatcaagtccgttccctccaaaggtaaatacgtccccggcaaggacaccccggtctacaacgcgagcggcgggcccgcctgctactcggtgccgtacgtcggcaagcacgccccgaccgccgacacccgccgggccaccgacgtcaccgcgcccccggcggactcgggcgacgacgcagacaccggtctcggactgcccaactcgccccaggagtcccggctcgtcaacgaactggtcgccccctcgctgaaggcccggccgggagacctggccgactggagcagcgtgctcatcgggccggccttccgcggtgcggaggtgaagctcaagtgaaacgccgctcgctcgcgggaccggtcaccaagtccctcgtcttcatcgtcgtcaccgtgctggccaccaccgtcctcggcctctccatcgccaacacgggcgtcggggacaccaccacgtacaaggcccggttcaccgacgccaccggactcatcccgggcgacagcgtccggatcgccggagtgaaggtcggccaggtcgaatccgtgaaggtcgccgaccggcgggtcgccgaggtcgccttcgccgtacgcaaggggcgcagccttcccgcctcggtgacggcgtccatcaaatacctcaacatggtcggccagcggtacgtcgacctcgaccgtggccccggacccgtcggccgggccttcgcgcccggcgacaccatcccgctctcgcgcaccaccccggcgctcgacctcactcagctcttcaacggcttccagcctctcttcgaagggctgtccccgcccgacgtcaaccagctcgccggctccatcgtccaggtcctccagggcgagggcggcaccgtcgacagcatcctgcgacacgtcggatcgctcaccaccacggtcgccgcgaaggacaaggtgatcggcgaggtgatcaagaacctcaacaccgtcctgaagacggtcaacgaccgggaggcgggcttcgacgacctcgtcgtcaccctccagaagctcgtcaccggattctccggcgaccgcgaacccctcggcgaggccatcaccgcgatgggcgcgctcaccaccgtcaccgccgacctcttccaggacggcagaaagccgctcaaggacgacatccgccaactcggacgcctcagcggacagttggacaagggcaccccgcagatcgagaacttcctgaagaagaccccggccaagatggcggccatcagccggctgacgtcctacggatcgtggctcaacctctacctctgcgaagcgaaggtcagcggcgtcacccacgacgacggcagcaagccgccgggcggcatcgcgatcacccaaccgaggtgcctggcatgagaatcacccccatccgggaacgcaacccggtcgccgtcgccgtcgtcgggctcctcgtcctgaccctgatcggtctcgccgcctggcgcgccgactccctgcccttcgtccagggtggcacctcctacagcgccgacttcaccgaatccgccggcctcaccgacggcgacgaggtacggatcgccggagtgaaggtcggcgaggtcaccggcgtctccctcgacggcgcgaaggtccgggtcgacttccgggtgaagaacgcctggatcggcgactcctccaccgtgggcatcgccgtcaagaccctcctcggcgacaagtacctcgccgtcgaccccctcggcgacgccccgcaggaccccggctcccgcatcaccgcgagccgcaccacctccccgtacgacgtcacccaggcgttcaacggactcggggagaccatcggggagatcgacaccgcgcagctcgccaagagcttcgagacgatctccgccaccttcaaggactccccgccccacgtccgcagcgccgccgacgggctctccgccctctcccgtacggtctccgaacgcgacgcccagctcgccaccctgctccgcaacagcaaacagctcaccaagaccctcgccgggaagaagagcagcttcgaaacgctgctggaggacgggaacctgctgctcggggagatccgggcccgccgcgactccatccacctgctgctcaccggaacccgcgacctcggcacccagctcaccggactcgtccgggacaacgacaagcagctcgggccgaccctccagtcgctcggccgggtcaccgccgtgctggtcaagaaccgcaagagcctcgacaaggtcctcgccatgaccggctcctacagccggctcatcggcaacaccctcggcagcgggcgctggttcgacaactacgtctgcggagtcgtgcccaagaactacctccccgccggcacacccccggcgaccggatgcatgccaccccggcagcaagggggccgctgacatgagacgcacccgcatcaccggcatcaccaccggactcgccctcgtcgccgtcgcggccgccaccggtgtgagcgccctggaggaggacgggaagaccaccgtcaccgcctacttcgaacgcgccaccggcgtctacgccggatccgacctgcgaatcctcggcgtcaaggtcggaaccgtcacctccgtcgagccacgcggcgaggaggttaaggtcgtgctgcgcctcgaccggggcatcgacgtccccaaggacgcccacgccgtcgtcgtcgctcccagcctcgtcgccgaccgctacatccagctcgccccggcctacgacggcggcccccggctcgccgacgacgcggtcctgcccgccgcccgcaacgccacccccgtcgaggtcgacgagctgtacgcctccatcaccgaactctccaccgcgctcggcccgaacggggccaacgccgacggggcgctcgcccggctcctggacaccggggcgaagaacctcgacggcaacggcaaggccatcggggactccatcgagcagttcggcaaggccaccaagacgctggacaagagcagcggcgacctgttcgacaccctggcccacctccagaccttcaccaccatgctcaaggagaacgacggcaacgtccgcagcgccgagcagcaactgaacacggtcacctccttcctggccgacgacaagaagaacctcagcgcggccctcaaggaactcggcaccgccctcggccaggtcaaggccttcatcgccaagaaccgcggcgcgctcaagaagaacgtcgaggcgctggtgcccgtcacccaggcgctcgtcgaccagcgtgcctcgctcgccgaggcgatggacaccctcccgctcgccgcggggaacgtcctcaacgcctacgaccccgccaaccgcaccctcaacgggcgcgccaacctcaacgaactgtccatggggggaccgctcgtcgaccccggggccgcctccgccgccggccggctcaccggcctcgcccccgtcgacgcgacccgccgcaaggccctgcccgtcctgccgctcccggaggtcggcacggtctacggcacccccgagaagcagcccggcaagcagcccggcacgcagaagggggcgcgacgatgaacgacgacgaccggcgcagacccgtcgtacgggccgccgtcggagccgtggcgctgctcgccaccggcgcgctgatcgccctggtcgtggtccgccccgacggtcccaccttcaccggcatcgaacagatccccctgcccggcggcgcggacctcggcgaccggccgtacgaggtcaccgccgagttcggcgacgtcctcagcctcgcgccgcagtcctcggtcaaggtcaacgacgtggccgtggggcgcgtcacgaggatcgcgctggccccggacggctggcgggcccgggtcaccatgcaggtcaacgggaagatcaagctccccgcgaacgcctacgcccgcctggaacagtccagcctgctgggtgagaagttcatccagctcgccccaccccccgaaggcaccgcacgcggatcgctcgccgccggcggccgcatcccgcactcccgcaccaaccggaacccggaggtcgaagaggtcttcggcgccctctccctgctcctcaacgggggtggcgtcaaccagctcaagaccatcaccaccgaactcaacaaggcgctcgccgggcaggagccgcagatccggtccatgctcaaccgggtcgacaccctcgtgaccaacctggacgagaacaaggccgacatcaccaaggcgctggacggcgtcaaccgcctcgccgccaccctcgccacccgcaagcaggacgtcggcacggtcctcaccggactcagtcccggtctcaaggtcctggagaaacagcgcggctcgctgctcaccatgctgcgctccctcgacaccctctccaccgtggccgtcgacacgatcaaccggagcaaagccgacatgatcgccgacctcaaggcgctcgccccgaccctcaaggcgcttgccgactccggccaggacctccccgactccctccaggtgctgctgacctaccccttcacggacgaggtgctgcgcggcgtcaagggcgactacctcaacgtctacctggacgtggcggcggtgcccggtacgcagatcatccccgcgctcaccccggatcctcccgggatcccgctgcccccggccgagggcgcgggcgcggctgcccagggtgcgctgccgctgccgctgcccgtcgtgtcgggaacgccgaaga

SEQ ID NO: 2947 - DNA, 5709 bp, Unknown
  Kingdom: Bacteria, Phylum: Actinobacteria, Class: Actinobacteria, Order: Streptomycetales, Family: Streptomycetaceae, Genus: Streptomyces
caaccggggccgcaccgcacccgccgtcgccgccgtgatggcggccgtcgcgggcagcgtcgccatcgccacgtacaccagcagcaacgccgccgagcaggtgtacgactactcgcccaacctgaccccgggcaccgtcgcgctgatggccgccgacatcggcgacaacgccgaactgccccgctcccgggccgccgtcgagcagagctacccggtcagcggcgggcgtgccgacatcggacgggtctgggccggcagcgactgctcggtctactacgaggaggagaacggctgcggcaccctcgaactcgtcaagcccaccggcaagggccactcctgcccgctgaagggcaagggcgccaaggagctcgccctgcggatctcggccgacgagcacaagcggctgatgaactccccggcctgcatggacgagaactacacgatggtcgcgttcggcaccggcaccgacaagatcgtcgtcgggggcgcggacgtgctcgactcgtacgtgaagctggaggacccggcggcggcgaaggccctggcggagggcacccccgtcctgctgaactcggcgtacgcgaagaacggcgaggtcaccctcaaggccatccatgcctacaacgaccgcgacaagaagaaccgggccctgcaccccggcaaggcccgcataaccaccgaccggctgaaggtctacgtcgcgccggaccgctacgcggcgacgccgggcatccggatggtcatgccgaagaagaccgcggaacgactcggcctgcacgtcgaggactacggcagcttctacacgctcaaccgcgaccccacggatgccgagagccaggcggcccacgccgcactcgatcaggccgggaaccgcgcgtacctgatgacgtcggacgagaggctccggacgggcgacgacacgatcctgctgatcctcgccctcttcgccggagtggtgaccctgggcgcggcggccatcacgaccggtctgtccaaggccgacgcggaggccgacctcaccacgctcagcgcggtgggcgcgcccccgggcgtacggcgctcgctgtccggcttccagtgcctggtcgtcgccctgaccggggtgctcctgggaacggcggcgggactcgtgcccgcggtggccctgcggctgaccgacctgcgcgcggcgctggcggacatgcgggaggatccgatggagtcggcctacacgcccatcgtgatgccgtgggagaccatcgggctgctggccctggtcgtcccggtgctcgccggactgctggccgccgggctcaccagctcccggttgaccctggcgcggcgcgcgggatgacagggccttccggcgctcccggaaggcttccggtgcccccgaaagcggtggatcttccgttttcgggggcaccaccatggggtacggcacgtgtgcgagacaatggcggcatggaaatgccgaggaatgaccggtcgcaggagcacccgcaggtccttgtcgtgggccaggacggaatggctatcggcggcggtgccagtgacgacgagtcgcgcgaggtcccggtgacggagatggtggaacagcccgcgaaggtcatgcgcatcggcagcatgatcaagcagctcctggaggaggtcagggcggctcctctcgacgaggcgagccgggtccggctcaaggagatccacgccagctccgtgaaggagctggaggacggtctggcgcccgagctggtcgaggagctggagcggctctcgctgccgttcaccgaggagtcggtgccctccgaggccgagctgcggatcgcccaggcacagctcgtgggctggctggagggactcttccacggcatccagacggcgctgttcgcccagcagatggcggcccgcgcccagctggagcagatgcgtcgcgccctgccgcccggcacggggcacgaggacgaggaaggcggcgcggacccgcacggcccgatccgttcgggcccgtatctgtaacccgaatccgccctggagaccgaggaccgagtggggcccggcgcacatcacggtgtgcgccgggcccctcgtcgtgtgcgttgcggccgaccgtgtgcgttgccgccttgccgtaagcggtgcggtctacgggtcaggcgccggccgacggcgcgaccagcagcaccttcccgatgtgcgcgctggactccaggacccggtgcgcctcggcggcgtccgccatcggcagcgcccggtccaccaccggccggaccaccccgccgtcgatcaacggccacacgtgctcgcgaacggcggcgacgatggcggccttctcgtggagcggtcggccgcgcagggaggtcgcggtgacggcggcccgcttggtcagcagggcgccgagattcagctcacccttggcgcctccctggagcccgatgatcgcgaggcggccgttgacggcgagcgcctgtacgttccggtccagatacttggcgccgatgaggtccagaatgacgtcggcccccgccccggcggtgttctcccgcagctcctcgacgaagtcctgctcgcggtagttgatgagaatgtccgcccccagctcggcgcaccgggcgagcttctccgggctgcccgccgtgaccgcgacccgcgctccgaccgccttcgccagctggatcgccatcgtgccgatgccgctggagccgccgtgcaccaggaaggtctcgccggggcggaggtgggccaccatgaagacgttggaccacaccgtcgcggtgacttcggggagcgccgcggcctccaccaggtcgacgccctccggtacggggaggagctgccccgccggcacggcgaccttctccgcgtaaccgccgcccgccagcagcgcgcacacggcgtcgccgaccgcccagccggtcaccccgggaccgagtgcgaggatgcggcccgagcactccaggccggggtagggggacgcgccgggcggcgggttgtagaagccctgccgctggagcacgtcggcgcggttcaccgcgccggcgacgacctcgacgaggacctcgccgtcgccgggtacgggatcgggcacctcggcccacacgagcgcctcggggccgccgggttcgggaatcgtgatcgcatgcatggccgcgaggctactccggcgcggcctgccttcaggtgcgcggcggcatcgagttgttcggaacggaggcggagctggggctcttccgcacgatggtgatgacccggtccgtcagctgcaacgggctggccgccggatcgtcgtatccgagcagccggtgcccgcgcaggacgctgacgacaaggtcgtccgtctcccgtacgttcttgcccacctcggcctttatgaccggccgttccaccaggtcgaggccgctgccctgctggatcaggtcctccatgaccgtgcccgcgctgggactgagcacggacaggccgagcagccgccctgcggcactggcgctggtgatgacggcgtcggcgccggactgccgcaggaggggagcgttctcctcctcgcgcaccgccgccacgatcttcgcgccgcggttcagttgacgtgcggtcagggccaccaggacggcggtgtcgtcgcgctgggtggcgatgatgatctgacgcgctttctggagctcggcgcgcagcaggacatcgctgcgggtggcgtcgccgagcacgccggtgaagccctcggcgttggcggcctcgatcaccttggaggccggatcgacgacgacgatctggtccttccgcaggccggtggtgcagagggtcaggatcgccgagcggcccttcgtgccgaagccgacgacgacggtgtggtcacgcaagttggatctccaacgcttcagccggaagtcctcgcgggtccgttccgtgaggacttcgagggtggtaccgaccagaatgatcaggaagagcacgcgcagcggtgtcacgagcaccacgttgatcagcctggccccgtcgctgtacggggtgatgtccccgtacccggtggtggagagggtgaccgtcgcgtagtagaccgcgtcgagcagatcgacctcgccgtcggcgttgtcgttgtagccgccgcggtcgagccagacgatcagcacggtcgcggtcagcacgagcagcgccatcagcaggcgcttgccgacctggcgtgccgggccgtcgacgacccggcgggggagcatcacccgggtcggcacgaccagttcgtcggctcgcctggccatcgcatcgtggccgggaagtttcacgtgaaacacccttccgtccacggcgtcgccggggcccatgggagatccagaatctccacctcggtgccggaccgtaccccgcccggtggcaccacggccagcccgtccgccgcggcgatcccccgcagcatcgcgggcccgttgtagcgcagcggcgcgacatggtcccggccacccgcccggcccgcgcggtggaccacggggacgaggcgggtgtcatgcggatgtccgtgcacctcggcatggacgagagcccggtacgcgtcctgtgcgggtcggcccgcaaggcccgcgagcagcggctccgcgagcgtcagcagacccgatacggccgcgagcggattgccgggcagcccgaccagatacggcccgtccggccttccccgcgactgtcccggagccggcagccgcgccagcagcatggggtgcccggggcggaccgcggctccgtccaccagcagttcggccccgagagcgtcaaggaccgggtgcacatggtcgaccgggccggaggcggtgccgccggtggtgacgatcaggtcggcgccggagtcggtgagggcctcgcgcagcgctgctgcgtcgtccccgaggcggcggggcccggagacctcggcgcccagggcccgcagccacgggccgagcatgggtacgagggcgtcccggatgagcccgtcgtgcggcagcccggaggcgagcagttcgtcgccgaggacgaggatgtcgacccgcggacggggcacggcgggcagcgcgtcgtacccggcggccgcggcgagaccgagcacggccggggtcacgaccgtcccggccgggacgagttgctcgcccgaacggcactcctgaccccggggcctgatgtcctgcccggcgaccacgggccgccgggcgtgcagcagccccttggcctcgtcggcgtgcgcgtgctcgctgcggatgaccgccgtggtgtccggcgggacgcgggcgccggtggcgatccgtatggcggcgccgtcgggcagtgcggtggccgggccgcgtccggcgaggagccccgcaccggccccgaacacccagggccccggtccggcgaccgcccagccgtccatggccgaggtgtcgaaggacggcagatcggtgagcgcgcccagcgcctcggccagcacatggcccagcgctcggtcgagcggcaaccggatcatcgcgggcggaccggcccgcccggccctcgccgcgaccgcccgtgcccggtcccaggagaggggcgggggcgccggcggggcggaggaccggacacggctcccgggccggtccgccgggccgggggcttccggcagagcctccgtcaggtctcccgggtcgctgccggggtcgccgccctggcccccgccgggtgcgtcccacctgaggctcggacgtcggctcgacccgtcgaccagggcgagcgcctgctcgacggcccgctccgcctcctcgtgtg

SEQ ID NO: 2948 - DNA, 12066 bp, Unknown
  Kingdom: Bacteria, Phylum: Actinobacteria, Class: Actinobacteria, Order: Streptomycetales, Family: Streptomycetaceae, Genus: Streptomyces
cgacgtcgacctcgctgccgggtgagccggatcgcctcggcagcgaggtcgacgtcgccggaatagccctcgttgaagaccagatagaggacgcgcagcacggtggcgacatcgccgggctgatcgaacggcacgccggagacggtgcgcttcgcccggctgatgcgttgcgccatggtcgcctcgggcaccagataggcctgggcgatctggcgggtcgtgagcccgccgacggcgcgcagcgtgagcgcgacggcggacgacggcgtcagcgacgggtgggcgcacaggaagtagagctggagcgtgtcgtccgccgccggtacgggtccgggcgcgggctcctcgtcgacgaggtcctcccgccgccgccgggcggcctccgcccgggtcgcgtcgaggaaccgccgccaggccacggtgaccagccagcccttcgggtcccgcggttgctcgtccggccatacgcggaccgcctcgaccagggcgtcctgcacggcgtcctcggccgccgcgaagtctgctccgcggcggacgaggatcccgaggacgctcggcgtgaggctccgcaggagggcctcgttcatcgtggtgtcactccgtgacggtgggcggcgcggacaggaacgggcggacctccagccactcgtggatcggcttcccgcccgcccccggagcggccgacagctccccggccagctcgactgcgcggtcgtagccgtcgacgtcgatgatcatccagccggcgatgaggtccttggtctcggcgaacggcccgtcggtgaccggcgggcgaccctcgccgtcgtaccggacccacgcgccctcgggggcgagtgccgagccgtcgacgaactccccggacttctccagccggtcggcgaagtcctgcatgtactgcatgtgcgccgagatctcctcgggcgtccaccggtccatcggtacgtcgttgaccgctgccggggctccgcggtagtgcttgagcagaaggtacttggccatggtgctactcctcggtcctgtgcggcccattgtggccgccttcactacggggacggagccggacacgggttctcgacatcgtcgcccgagaacttcccgactttttcggcgggccggggacgagccggcggtcaccgctcgcgcacgcccgcaccgctccggccgccgtcggcccgtcggaggcgtcgatgcgcagagcggtgaacccggtctcctccccgccgggcgccgccaccgcggcctccgcacgggctccgcatggcggaccccgggaccacggcgcagactggccggagacggagaaggcgactgccccggagaggcctggaacgatgggtgagtacgcggatctgcccggtgtcaggacctggtacgagaccgaggggaccggtgacccgctggttctgctgcacggcggcttctgcaccaatgacacgtggggcgcacagcgcgccgacctcgccgccgcccaccgcgtgtatctgccggagcggcgcgcccacgggcacacggccgatgtcgcggggccgctgacgtaccaggacatggccgacgacacggtggccttcctggaggaggtcgtcggtggaccggctcatctggtgggctggagcgacgggggagtcgtcgcgctgatcgtcgcaggggaccggcccgacctcgtccggaaggccgtggtgatcggggccaacttccgtccgggacccgagtgtttcgtcgagccgtcgatgctcgacgcgatgacgccggccgatcccgatctggcgttcttccgggagatgtacgagcctgtctcaccggacggcgcgggccactggccggtggtggccgaaaaggtgatcgacatgtggcgtacgcagccggcgctgacggccgaggacctggcccgcgtcgaggcgcccaccctggtcatggccggcgatgacgacctgatgacgctggagcacacgaccgccctgtaccgcgcgatcccggacgccgagctggctgtcgttcccggtgcgtcccacctggtcccgctggagaagccggcgctcgtcaaccggttggtcctcgaccacctcgcacaggagacggtggagacgatgatgcccatccggcgggcggagaccgtgactccggagggcgccgagacctgaaccgagggcgtcgaggaccgcggggctcattcctcgcggcaggcgtcctcggcctcctgatcggcctcggtgtgccggtgatcggatcgcggacggcggcgcggtcggccgaaaacggtggatgtcagtaataggggagatgtgcgcatttatgctggcccgatgcgatctgctccctggtgggccttggtctcctccggatgcgcccccgtcctcctgatcggctcctggatgattgcgcagctgcgccaagggccggcgtacgaccccgcgcggcagaccctgagcgtgctggcctcctacggcgctgccagctactggctgatgacggggatgctgctggtgctggggacgtgctacgtggtgacggcgcacgcgctccggccggcagcgcccgccggacgggtcgccctggccggcggcggactgtgcgcactggccctgacactggtgcccgccccgagcagcggcggggcgttgggacatggggccgtgtccaccgtgggcctcgtgctgctggcggtatggcctcccctggccgcggtccgggaccggaggccggtgccgtgggggctgaggctcgatgtgtcgttcgccgcgagcgcgttgatgtgcgcgagcgctctgtggttcctggcggagctccagagcgcgagggcacccggcgtcgccgagcgcgtggtcacgttcgtccaggcgctgtggccgttcctggtggtcgtctcctgccggagaagcgcggcctgacggtgacggagcgaagcccgcggacgcgacgggtacgcgcctacgcgtcgctcgccacgtcccgcagccaggcgccgagagccgtgtagtcgcggtccaccaggccgcgccggggatccacccggtggagcagagcggggcccgggtggtggacggcgatccaggcccgatcggtgtcggtgatctcgtcgtcgacccagacgaaaggacggccggcggcccgagcgacgagggcgcgagtcttcccgtgcagcccgtcccgctcgtcccggtcctcctgtccgtcggtgtcgccggcctcggagggttccggccagtggacgacgggcaagcgcggcaggccgatgcggggggcgatccacgcgttcgcgtcctccatccacgtggtcgcccagacgagctcgcagggcagcgccgcgagccggggcccgtgctgagggttgaccctggtcaggagcggattccccccggtgtccggagtcccggggcccgtctcgtacgtcgggtgggggcgggacgtcgcgccgaaggggatgagcggcccgtcgacgtcgaggaacagcagcggacgctgcgcggtgcgagtcacgggagcacgatagcgaccggccccgccgggcacggccccggcgccagggccaggaccggcacagcgccgcggcgggagcgtcggtgcggacggctccgggacgacagccggccgctgccaccccggaaccggtgcgccggaccggcctaggtgagcggttcgacccacacgttgcggtaccggaccttgcttccgtggtcctggagcttgatcgccccggccgtcggaccctcggccgctccgccgccggtggtgccgtcgacggccacgtcgtcgtggacggtgacgccgttccacacgacggtgacccgggcgtcctccgtcttcgcgcccgaggcgtcgaagcgggcggcgcggaaagtgatgtcgtacgtctgccaggtctccggggccgtggcggcgttcacgtccggagccttcttggtgtagatcgccccggcctcgttgtcggcgagcgtggtgtcaccgtacgagtcgaggatctgcacctcgtagcgctcctggaggtacacgccgctgttggcgcggtcctggccggtcacgtccggcgggaggttcggcagccagaactcgacgtgggcacggaagtcctgaaagccctgtttggtgcgcaggtccccgccggcgacctccatctcacctccgctcaccggccattcgggagtgcggccgtccggatgctgccaggccgcctggtccgtgccgtcgaagagctggacgcgggcgcccttcggatggacggtgatcatgtccaggttcacatggccggtgtcaccgccgtcgaaggagtaggtgatcgtgttgcggcccttgcgcagctccagctgttccgtccccgtcgaccaggtcttccagtcggtggtcgacagcagcttgatctgccgcaccttctcgccgttgacgtggacgctcaccgtcttcgtgccgggtgccggatccggcccgttggagtagcgcagacccacgtcgtgcgtacccgccttcccggcctccacgtcgaaggcgaccgccgccccctcgttgccgaagttgtcgacgaagccgccgcccgaatagcccgcgtgctcggtgtcgaagcccgcacccccgctgagggtggcctcctccgcctcgtaccgggtggccggagtctggtcgccgggcagggagttgagggtgtaccaggcctccgtgctccacagctccgtgccgtcggcggagctgaaggggcgcggcgaacggacgtggaccacacggttcgccttgagcccggggatggtcagcgtgaccttcttgcggtcctcggagagggtggccgcaccgacgtcgagggactcctcgtcgatcttggggccgccgtaagcgggagtcggagcgtacgtccactgctcgacccggtagctctcggcgagcttcgcggccgtctcctcggagagcggctcggtgtactccaattcgaagccgcccggcttggcgcgcatcgccaggatgtcgaaggccttgtcaccgctgggggagagcttctggagcccatgggtcagcttgccctcctggccccagttgccgcccgcgccgagaccgccggcgtagatcgcgccgtcggggcccatgctgatccggttgacacccgcctccaggccctgggtgaagcggaagaccgccccctggtactcgccgtcgaccttctccaggtaggcgcgctggatgccgccgtacgtgacatcgccgaacagcatctgcccggcgaaccggccctcgtccaactgcagcggggtgctcggtgagttggctatctcgttctgcggcagccacagcaccggcttggtcaccggcttcgcgtcgaacgggcccggcgggttggtgtagtggttgaagaagcggtcctgcttgatgtggagcagcttcgaggagggcagccagccgccctggttgtcgagaacgaacatgtcgccctccgggccccagccgataccattgggcgtacgcaggcccccggcgacgtagtcgactttgccggtctccttgttcaccttgatcgtcgagccgcggttcggtgcgggctgcgggtcggtcgtcgcaccgcccaggtcgatcgccacggacaggttcaggtagaagtagccgtcccggtagagcaggccgaaggcgaactcgtggaagttcccgccgtacggccaggtcgccaccgtccggcgctcatcggtcacgtcgtcgccgtcgacgtcggtcagttcggtgagttcgtgcttctgcgacacgtacagcttgccgtcgacggccttgaggcccatcggctccttgagcccctcggccaccttcttggcggtcacctcgccgggaccggtgtcaccctggacgttgtcgaggaggtagacctctccggtcgtgttgtcggtgccgccccaggtggtcacggcgagccggccgtcgggcagccagtccatagcggtgacctgcggctcgaagcccgcagggcgcagatcggtgagcgcgtagtccgggtgcgtcccggccaggggcagtccgtcgccgggtgagtcgaggacgccctcgcactccttgcgtcccggcgccgtcacccgtacgacgtcggcgtcggtgctcagtacggaagtcggcacgacggcgaagtccccggcgccgggcggcttccattcgagcgtgacctgctggcccccggtgcggtcgaagtgatcgatgcgcaacggatggtgacctgccgtcagatcgacggagccgtccttcggctccgcgccgtgcaacccgtcgtgatcgatgacggtggagccgtcgatccgcagccgcgaaccgtcgtcactggtcaggcggaaggcgtacgcaccgtcctcgggaacggtgaggttggctgtgacctgggagacgaagtggtcgccgaagccgaagtcgtccggcgaactccagtcgatgccgggcatcaacctgtcgacgttcggggtctgtccggccttgatgtcgcacagctcgctgagggggacctgtacatcgaagacgcgcagggtgacgcccggttcctgcggcgggagttcgtcccgcggcaccggcgcggcggtggccggcgcggcggagaaggcgccgacgagaaacgcggagaccagcagaccggtgagatgtctgcggcaacggtggagcggccgtggatgcattcttcctcctggcccctcgcggcgaggggcacgtcgcggcggtgggtggggccacccggcgcccgggggtgaacgttcggctcgtgcggtggggcagcgcttcgtccggacagggctccggtggctgcgccgagaacagtaggaggcttctaccggcggcgtccatacttcgtcaccgcagtgttcaaagttcgcagatgttgatgcaaagtggccaaaccccttgttgtacaaggcatctggcgtcccgtcagtaccgaacgcggtccggacgcgcccgtcgtcggggggtgtgagggcgcacgtcgacgaagccgatgaagcgagcctgcgcggcccgcttcatcggtggcacccgcccgcgcctcatcggtggacccggctcaggcgcgccgcgcccggcatcgccggaaggagagccagggcaggacgaacgcgcgctactggccctcgcggcccgtggcggaggcgaatcccagccaggtatggcggttgccccaccagcaccagccgaccttgggggcgttgcgccgctcccggccgtcccgcccggtgccgttgctgatccagatcgccggggtgcgcgcgtccagggtgccgttcgccttccgcagccgggacccgatggtcatgaagcagaggttccgctcaagcaccgccggctgctgcagcacccagtggactccttcggtgagcaccaaagggctgcggccgtccttggtgagggccggcaacgcctcctccgggctccagttggtcatgtggtcgccccggtccggcccggcgacgaaatagagtggcgcgtcgggaagttcgaccgcatggggggtgaaccggtcgacgtcgggcatgtcgacgacgacgaagccgggcttgccgtcgcgcaggagcagtggcgcgagggcggaggcgggcgcgcggtccggatggacggcgaggagaacgtcgcggccccggtcggccgttcccgcgaacgcgcggatgtcctcggcgggaatccccgcgatctcgtgcaccccgagctcgatcaggcgctccgcctgagcggcgggcgacgggagcgggtgcacggcgtcggcagtggaagcatcgggcaagacaatccctcggattcatggtgagcggtagtggaccgcagaccgaacgagagagatcgccgaagcgttcccgacgcgaccgcgtccacgccgtgcggatccgcttccgcgctgcgtgaaagccctcttcgagatctgaccggtcactcgacgacggccggcttcatggatgaagaaccgccgcccgacctgtccgtgacgggacgtcagtccggcacggccctgagcgggtggctcctggtgggcggaccggacgaggatggagcggtgtagatgttgaaggcacatccgccttcaccgacgtcgcgtgaggtgcgagccacctggaactacggggcggacctgagctcccatcacccgccaggggacgacagctccgaccacccggcaccggacggcgcttccgccgcacgggtgttaccggcatgatcaccgctcccgtgccgagggccggggaactcctgtgcgccgatcatgggtgagttatcctgcgcgcatgcgcggacagttcaccggctggccggagcaggccatggacgtgttgtggcagctccagggcgaaccgacccatgccacccgcgagcgctgccgcgcggaccgcgaacgactggtccggcagccgatgatcgacctgctcaacgaggtggcggacaccgacccccggtacgaggacttctccgtctggcattaccgcaccgactcctggtggtggcagcaccagggcgcggtgatccggctcggccgcaagatcgagatcggtctccggttcgacctggacgggctgcggatccagggcgcctggtggtaccccgatcccggccaggtggacatgttccgcaaagccgtggcccgcgaggggagcggccgcgaactgtccgccatcgtcgaggctgtgcggaagaagggctacgagatctccggggacgtgatgaaacgccctccgcgtggctatccggcggaccactcccgtacgaacctgctgcgccaccgttcgctgatcgcagcccgctcgctcggctgcgaggagtggctgcacacccccgaggcggtcgaccaggtcctctcggccgccgccgacctggatgccctgctgaggtggttggtccgccacgtgaagcgcgccgcctgacatcacgagggtgccacgcggcacgggaggagccacacccgcaccgccggacggtgctcggaagatgatgccggcggcatgatcttggccgccatgccttcggctgtgcctgacgtgttgtctccggctaccaggatgcgggggacggccggcggtccagaaccgcgtggggaacgccctgctggtccgctacgcggggggattgtccgggtgttctgggaatctgcgccaagggcaacaggaccatagggcaacagggaaaaaacaaaggcagggagagagacctctccttgccactctcaacttatagctcaccggggggcttgcggcaagacccgggtgacggcgcagaatcctcgggtcggtgccaccacctgcgggacggtggcacgacgtgtgccggccggccgggaggatctgccggtccattcgtcagagggaagaaaaccaggaatgagtatgtgtccggcaagaggttcggcagagggcgaggcgccggtgatccgatcggccgccgcagtacaacggaagacgaccgccccggaggtgtcgcgatgacggaccagtacgtgctggacctcgaagaggtggacgagacgcgagtggcggctgtcggcggcaagggcgcacacctgggcggactgtcgcggatcgaaggcatccgcgtgccggacggcttctgcgtgacgacggacgcgttccggcgggccatggcggaagtcccgtcgctcgacgatcggctcgaagagctgtcgcgcctggatccggacgaccgggaggcgatgcgcacgctcagtgcgcacctgcgtcgcctcatcgaggagatcgccgtcccgggcgacgtcacgacggcgatcacccgcgcgctcggccggttcggtgagcatgtcgcgtatgccgtccggtccagtgcgacggcggaggacctgccgactgcttccttcgccggccagcaggacacgtatctgaacgtgctggggccgaccgcggtcctccagcacatcagccggtgctgggcctcgatgttcaccgagcgggctgtggtctatcggcagcggaacggcatcgatcaccggacggtcgacatggccgtggtcgtgcagcggatggtcttcccgcatgcgtccggcattctgttcacggccgatcccgttaccggcaaccggaaggtcgctaccgtggacgccggcttcggcctcggcgaggctctggtgtccggtctggtgaatccggacgtcttcacggtccgggacggtgaagtcgtctccagaagcatcgccgtcaaggagcgcgccgtgcacgcgttgcccgccggcggtacgcgggaagaggcggtcgacgcgggacagcgggaacggccggcgctgacggatgagcaggccgtccgcctcgtgggcctcggccgccggatcgaagcgcacttcggctgcccgcaggacatcgagtggtgtctggtcgacgacggcttccggatcgtccagagccggccgatcaccacgctcttccccctcccagtcctggcgaacggcggctcggagaatcacgtctacgtctccgtcggccaccagcagatgatgaccgacgccatgaagcccctcgggttctccatgtggcagctgacggccatggtgccgatgcacgaggcgggtgggcggctgttcgtcgacgtcaccgagcgactggcatcgcccgcgacccgtgacggcctcctggacgtcctggggaagggcgacccgctggtcagggatgccctggagaccgtcctcgaacagggcggcttcgtcccctcgctcccggacccggttcccggcgtgccgccgtccacccgtgcgcccgccccgatcgagaccgatccggcccttgtcaccgagctgatcgagcgcagccggacgtccgtcgccgctctggaacgggacatccggacgaaggagggtccggcgctgttcgagttcttgctggaggccttcgaggagcacaagcgggttctgggcgatccgctgagcatgcaggcaatcatggcggggatggacgccacatggtggctcaacgaaaagctgtgggagtggctgggggagaagagcgctgcggacacgctgacgctgtcggcccccgacaacgtcacgtcggagatggggctggcgctcctcgacgtggcggacgtgatccgcccgctgccggaggtgctggccttcctgcgggacgccgagcaccttgaggacgcgacgttcctggacgagctggcgaagaccgcgggcgggggcgaggcgcgtgatgccattgagggctacctcgaacggtacggcatgcgctgtgtcggcgagatcgacatcaccaggccacggtggcgcgagcgccccaccacgctcgttcccatgatcctcgacaacgtgcggagcttcgggccgggtgccgccgggcggcggttcgaggagggccggcggaaggcccggcagaaggaactggaggtgctgtcgcggctgagggagttgccggacggggagcggaaggccgacgagacccggcggatgatcgaccgcgtcaggacgttcatcggataccgggagtacccgaagtacggcatcgtcagccgctacttcgtctacaagcaggccctgctggcggaggcggagcggctcgtgcgggagcaggtgctttccgagaaggaggacgtcttctacctgacgttccaggaattccacgaggccgtacggtcgaaccgggtggacgagcggctcgtccagcggcgcaaggaggcgttccggtcctaccgtgcgctcaccccgccccgggttctcacgtcggacggcgaggcgctgaccggtgcgtaccggcgcgacgacgtgccggccggcgcgctgacgggtttgccggtgtccgccgggaccgtcgagggaagggctcgtgtcgttctcgacctggcggaggccgacctcgaagcgggcgacatcctggtcacgacgttcacggaccccagctggtcgccgctgttcgtcgggatcgcgggcctggtgacggaggtcggcggcctgatgacccatggcgcggtgatcgcccgggagtacggcctgccggcggtggtgggtgtggaccgggccacccggctgatccgggacgggcagcggatccgtgtgcacggaaccgacgggtacgtggagctcctgccctgaccccgcgcgccgaggacgcctgtcctcggcgcggcggccgccctgctcgccgc

SEQ ID NO: 2949 - DNA, 756 bp, Unknown
  Kingdom: Bacteria, Phylum: Actinobacteria, Class: Actinobacteria, Order: Streptomycetales, Family: Streptomycetaceae, Genus: Streptomyces
ggccgccgccgctgaccgggaatcaccccatcgggccggcgtcgggctcagccgtcggcccgtcgaccggatcgggtgctgctcccggcgtatgcggggagttcgacggcggactcctttcgccccggtccggtcggctgcttggcgatcagacgcaccaccagcgcacaggccgcgaagccggtcccgaggatgctggagcccgtccagccgtaggccgtgaagatcgcggtggtcgccgccgcaccgagggcggacccgagtgagtagaagaccatgtagccgccgatgacgctgctcaagcgatctggatacgtagcggtgagcacgtgctggttgctcacgtgtacggcctggaccgcgaagtcgagggcgacgatgccgatgatcaggaaccacagcgaccacggaagctgggcaatcgccgcccacgagaggatcaggagggcgagcgcgagcccgctgacccggttcgcgcgcccggcgtccgcccaccgtccggcgcgcgccgcgccgagtgcgccggccaggcccgcgatgccgaacagcccgatccgggtctcgctcagttgccagggagcactcgccagcgacatggacaatccgctccacagggttccgaacgaagcgaacaggaagaacgcgttgaggccgcgggacaggaaggcgccctgccccagcagcccgccgagcgaaccgaccacctcgcggtatttcggaggggaactgacgggcgtctccgagggcagtacggcg

SEQ ID NO: 2950 - DNA, 4225 bp, Unknown
  Kingdom: Bacteria, Phylum: Actinobacteria, Class: Actinobacteria, Order: Streptomycetales, Family: Streptomycetaceae, Genus: Streptomyces
gggcccaccgacgaccggggtgcgcgcaggtccccggccgaggcgggcgaaacggtgcgccggctgctggcggacgcggaggagccggggcgggtctacggggcgtcctaggtcgtgtccgcgaagtctcgtccggccccgcggccacgggccggaccacgtcaccctcgcagggagggccggtcgcgtcgtgcggctgcgcagcccggaagggctgacgttcctgacccaggccagggaccagggctcggacccggaccgcggacgcccgcgcaaatcgggtggcgcggcccggccgccgacggtgaggatcgccgtatgcgaaccttcctggagaccgaccggctcgtcctgcgcccggtcacggacgccgacgcccccgacctgctcgccctcgacaacgaccccgccgtcatgcggtacaccaacggcggccggccggcgagccccgaggacatccgggaccggaccctgccgaggctcctccacgaccacccgtgcaccggaacccgcggcttctgggccgcgcgggagaagggcaccggagcctttctgggctggttcgagctccggccgctggacgaccacgatcccgccgtcgccgagctcggctaccggctgaaccgggccgcctggggccgcggttacgccaccgagggcgcgcgggccctggtcgacaaggggttcaccgacctcggtatccagcgggtcaccgccaacaccatggcggtcaacacgggatcccggcgcgtgatggagaagacgggactgaccttcctgcgggcctacaccgaggactggccggaggtcatcgagggctccgagcacggcgaggtcgagtacgtactcacccgtgaggcctgggagcgtgaccggcaaggaccccggtagcgactacgacggcccgcccagcagggccgcgatctccccgtgccccgtgtgctggtccgtgcccgccgacggcaccccgtcccggagcagctccaccgccatcgtctcctcgccgtccctgcggtcgcggagcgtcaccgtctcgatgccggagccgtacgactcctccagccgccgccgcaactcccgttccggatcgagggcggcgatgcgccgcgcctcggccagcgcgagggcgaccacggactcctgccccgccgcacccgcgccgtgcgcgagcagcgcccgtaccgtccgcagggatccgcgctgcgcagccagaaccagcatcgcctcgccctgggggcccggcagcagcgggtccgcgccatgggcgaggagcgcttccaccgtcggggcgtgccccaggccgaccgcccaccgcagcgcggtgaaaccgaactcctcgcgcagatccggccgggccccggcggacagcagcgcctccaccacctcggtgtgcccgccgcacgccgccccgcacagcggcaggtcgctcgccccgggaccgctcgcccggttcgggtcggccccggcggcgagcagcaggcgcaccgcctccagccggtcctgcaccgacgccagatagagcgccgtcgtgccctcctcgtcgctcgactcggcccgcgcgcccgagcgcagcgcccgtacgatcgcgttctcgtcctcgtacagcgcgtcgaacaggcgtagttcgtccctgatcggctcgttcgtcatgcttcgatcctacggtggccgaaacagtgctcaggtgtcgcattccagggcggtcccgcacagcccgcagcgcgcggtgaaccggccccggacggggacccggatgcgctggtggcaggtggggcaggggaaggagacgcgcagtccccgatcgccggtctcgaaggcgtacgggacgttcgggtccgggctcgtgccggggtggtcctgggcgtaccgccggtccttggcgtagcggcggcggcccgcccagcccgccgcggtcagcggaggtctgcgcagatcgtgcagcgcccgctcccgtcccttggtgtacgcggtgtacgcctgggggctggtgaaccacggggaggggtcctcgtcgaaggcgaacgcccgcttggccaggacgtatccgaactcctccggggtgagatagccgagcttctgacgggacgtggcgtcctcccggaacgcgtccagcagcagccagccggcgccgaggtaggccgtcgtcgtgtcggtcaggatctcgttggcgcgggtgccggggaactccaggccgagccggtgcagcagcacatgggtgacctcgtgcgcgagcgccgccccgatgtccctgcgatgggtgcggaagcggtcgttgagctcgatgaagtactcggggcccgcggtgagttccacgctcgccgcgtgctccatcgcccggaagccgacgatcatgcgggcctcgggcagatggaggtgctggaccagggaacgcgccacgcgctgggctcccaggtgcaggtcgtcccggtccgcgaacgcggcgtcggcgggcgggaggctggcggagtaggtgtggacgccgtccgcggagagccgccggtagagcgcggtgatggcggagcggaccgtgtccagatgcggaaagccatggacgacgggtgcgcccggagggtcgttcgccacgtcggaacccccctccgtgacggtcgccggacctccactgtatgccgggccggggagggttccccgaaagcagcctgatgatcttggctgaaaagtgcaccttgtggcagcggtcacccggcaccgataatcggatcgttcttgtcgggtacatgactaattcggcttcggtgccggaggccgtcacccggccgggacacgcgtgccggaccgcgcgatcaccgcacttccgtacttccgtacacctgcaccaccgcaggaccccacgcggcaccgctgtgcggaaaccaccgcccagcgcttcgtaccgggactcctgcaccgcaacgcggtacggcaacctcccacagcaaccccccacacgaaatccccccacgaaagcaggcctccgtgaagcttctgagcgcgctgaaaaggtgttccgtcgccatagccgccgtcgccctcgcgaccgtcagcctccagcccgcctccgcggccccccagccgatcgtcggtggagaacgcgccgaacagggcgagttccccttcatggtccggctctccatgggctgcggcggtgcgctctacgcccaggacatcgtcctcaccgccgcccactgcgtggacggttcgggcgacgacacctcgatcaccgtcaccggcggcgtcgccgacctggagtcccccgacgccgtcgaggtccagtccaccaaggtcctccaggcccccggctacaacggcaccggcaaggactgggcgctgatcaagctcgcccagccgatcgaccagcccaccctgaagatcgccaccgacagcacctacgacgaaggcaccttcaccgtcgcgggctggggcgccgaccgcgagggcggcagccagcagcgccacctgctcaaggccgacgtcccgttcgtctccgacgccgactgccagagcgcctacagcgacctcgtccccggtgaggagctgtgcgccggcctcctcgacaccggcggcgtcgacagctgccagggcgactccggcggtccgatgttccgcaaggacgacgccgacgagtggatccaggtcggcatcgtcagctggggccagggctgcgcccgcccggactacccgggcgtctacaccgaggtctcgcacttcgcgggcgacatcgcctccgcggccgactcgctctgaccccggcccccgcccggaccccggtccgggcaggccaccggatcaccgcacgtccggccggtgatcacggttgaaccaccccgggggcgtccgcatcgacgggcgcccccggacccagctccacctgcggctcgcccgcgtcctccagctccagcacccacacctcgttggcgccctcgcggagcaccggacccggaacgtacagggtccgctgcgggcccaccgaccagtaccggcccagacagaagccgttcacccagacgaacccgcgtgtccaacccggcagttcgagtcccgcgtgatcgacgccgggaacgccggatacgccgggagcaccggaaacgctggaggcgcccgaagcgccggcggctccctcgacggtgaacgtcccccggaacagacccgtccgtcccgcgtcacccgccccggcggcggcctccaccggcccgaacgggacggcggccaccgcgtcctcggcctcgaa

SEQ ID NO: 2951 - DNA, 3105 bp, Unknown
  Kingdom: Bacteria, Phylum: Actinobacteria, Class: Actinobacteria, Order: Streptomycetales, Family: Streptomycetaceae, Genus: Streptomyces
gacgaaccaggaatccctcgtcccgcagctgcgcgaggcgcccgtcccgcgcgtcgaggacgagcacgccgtgcacgacccgggtctcatggcggccttccggcgcggcgtcgacctcgccgaggcccagaccgcccaggaggagggagccgacggcggatacggcagccggggtggcacgggggccaggggacagacagcgctcgacgccccgctggagtccctctcgccccttcccgtacgcggagccacccccgagcccgaccgctccgccccgcccgaggcgtcgcggccggaccacgcaccggccgcggcgggcctgtccgtaccggacagttacccgcccgacgcgtacccgcacgacagtcccgcgtaccggcgaggcacctacgccgagagcgcccacgaccgtgatccgggcgaacccggagcgttcgcggccgatcccttcctgccgggccgggctgtcccggaaccccggaaagacaccaccttcaaggagcagacaccatgacgagcgaaatgccgtccggtcaggtctcggacctggactggctgctgagcggactggtccagcgcgtgccctacacacgcagcgcggtcctgctctccgccgacgggctggtgaaatccgtgcacggcatggaccccgacagcgccgatcacatggcggccctggccgccggcctgtactccctcggccgcagtgccggagcccgcttcggcgacaacggggacgtacggcaggtggtcgtcgaactggactccacgctcctgttcgtctccaccgccggttccggcacctgtctcgccgtcctctcgggacgcgaggcggacgccgcggtgctcggctacgagatggcgatgctggtcaagagcgtccgcccctatctgacgaccccgctgcggcagtcggccggggcgccgttcaccccggggcactgaggatgccggccccgcaggacgggcccctgctcgacgacgcggccggccggctgatccgcccgtacacgatcagcaacggccgcacccggccgtccaccgcgttcgatctgctgtccctgatcatggccacgggcatcgaaccggacattccgctcggcccggagcacaccgtggccctcggcatgtgcgaagggccgatgtccgtcgccgagatcgccgcacacctccggctgcccgcggtcgtcgccaaggtcatcctctccgacctggtcgcctgcggcgcggtcaccgcgcacgctcccgctttccatgacatgcccaccgaccgatccctgctggaggcagtgctcgatggtttacgacgacagctctgaccgcacccgaacctccgagttcttccccgtggcgctcaaggtcctggtcgccggtggattcggtgtcggcaagacgacgttcgtgggcgcggtcagcgagatcgccccgctgagcaccgaggaactgctgacccaggtcagtgtggggacggacaatctggagggggtcgagtccaagacggccaccaccgtcgccatggacttcggccgcatcaccctctccgagcagcacgtgctctatctgttcggcacaccgggccaggaacgcttctggttcatgtgggacgaactctcccagggcgccctcggggccgtggtgctggccgacacccggcgcctcgccgagtgcttcgccgcggtggacttcttcgaacggcgcggcatcggattcatcgttgccgtcaacgagttcgacggcgcctaccgctacgagccggacgaggtccgcgccgcgctcgacctggggcccgaggtgcccgtcgtgctgtgcgacgcccggatcgccagctccggcacgggcgccctcgtcaccctcgtacaacacctcatcaacgccaccacggcgcccgccccactccagaccttcggagctcacacgtgacatccttcgccaccggccggatgctcctgacgcccaccgaccggcacggcccggctcgcgcacagcggctgcgcaagctggatctcggcgaacgccccgacgcctcctacgacaacttcgacgccttcgccgacaaggtggccgaagtcaccgccacgcccttctcgatggtcaacttcatcgacgagaaccggcagttcttcgcgggactgcacaccccgacgggcaaccgcggcggccaggacctcggttcggcagcggcgggcagcaaccgcagcagccggtacatggcccgcgaccacggctactgcccgcacgtcctcgtccggcgcaaggccctcgtcctggacgacgtctgcgactacccgcgcttcgcgggcaacccggtggtggacgacataggcatccgctcctacctcggggcgccgctgatcgaccgcacgggcatcgcgctgggcaccgtctgtgccgtcgacaccgtgccgcgcccctgggggcgggccgggctcgacaccatcaagtcgctcgctcatgaactcgtccgccagatcgacggccgggagggccatcaccccctctgacgccaccccctccgcagccggtgccgtgctcaactcccgggcggcgcaccggtgctgccccgcaggaccacgttcccctcgatccgcagcacccgggagcgccccgccgccgacggtgtccgcaaggcgagggcgatcacctgctcgcccatctccgtgagcggcagagccaccgtggtcagcggaggcgacacctcacgtacgacggggatgtcgtcgaaccccgcgagcgacatgtcctcggggacgcgtacgcccgcctcccgcagcgcggcgagcgcgccgacagccatcacatcggtcaccgcgaacacacaggtcggccgcggacccccggaggccagcagtcgccgtgccgcagcgtgtccaccctcccgggtgaacgcgccccgcaccacctgctccagggtgatgcccgccctggcgagcccctcgcggaaacccgccaaccggtcggccaccgtggtcagttccggaggtccgctcagcaccgcgaagtcccggtgtcccagcgccaccagcgaggccgcgagcgccgccgccccggcccggttctccggctgcacggtgtccacccgcatgctccggtgccggctgaccaccg

SEQ ID NO: 2952 - DNA, 25558 bp, Unknown
  Kingdom: Bacteria, Phylum: Actinobacteria, Class: Actinobacteria, Order: Streptomycetales, Family: Streptomycetaceae, Genus: Streptomyces
ggctgcgggtcgacgccaccttccggctcgccgcagcgcccgcccacaacaaccagctcaaggacgcggcgctctcgctggccgccgaggccgcgcgcaccgcacccggcccggggctgatgcgcctgcaggccgcgcacttcatgtgggagggcatgcaggccgtcgaggacgacggacccgcccgctcccggcggctcacccgcaacgccgaccacctgaagggccgcgacaacgccgagcgggcgctgctcacgctgcgggccttcgacgccatggtgcgcggagagaacgcccagctcatcgtggacctgtgcgaacgcgccctgatcgacggcagcccggccaggggcctcggctggaccgactccgagtggggcttcgaactccccaccatggtcggcatcacctacaccttcgtcgaccagctggaccgcgcggaaagcctcttcggcgaagcggtccgggccttcgagatctccggctggagcggggcccacctggcgttcgcgcacaccctgctcggcatggtccaccgccgtcgcggccgcctcgccgaggccgagggcttcctgcgagaagggctccgcctcgccgaccgcgtcggttccggactccccgtgcactgggacgcggcctgcctcctcatcgacaccctgctggcccgcggacgcaccgaggaggcccgccgcatcgccgaccgctacgacttcggtccgccctaccccagcgccatggtgctgcccgacggaccgtgcatgcggggccgcctgctgctggcggagggccgcaaggaggaggcgatcgccgagctcgaagcggccggcgccgctctggagtcgcgcgaacgcttcaacggcatctgggctccctgggccggcgacctggcgcgggccctggccgaggacgacccggcccgcgcggcccatctcgcagcccggaaccgggtgcacgccgaacggttcggcacgcccaccgccatgggtgaggcactgcgctgcgtcgccctcttcgcacccccggagcgggccgcgcagctgctcgccgaggcggtgggacacctggagaagtcctcctccgcctacgagcacgccctcgcccgggtcgactacggcatcgcgatcggctcgcaccgggagctcgcccgcgcccagaagcaggcgatggcctgcggagccgaagggctggccgcccgcgcccaacaggcacgggcgtcgatacggtcctctgagtgaggtaatgtttgtcctgcgcggtcacccggggaaaccggggagtacgcgacgggacgtggcgcagcttggtagcgcacttgactgggggtcaaggggtcgcaggttcaaatcctgtcgtcccgactggagacagtcgcagatcagggccggtttcggagcaatccgaaaccggcccttgatcatttttggggaccagttggggaccagctggaggtccggcgtccttgaccgggtctgcgggtcagcgggtcatgacgatcgggctcggcagcgagcgtggtgcgcgcagcacgttgaagtgggccgagagcgccgccccgccggccgtgatcttgtggacgtccgggtgcaggtagcgttgggtggtggtcagcgaaccgtggccggcgatcctgcggaggacgtgtacgtggaccccggcgtcggcgaaccagatgagtgcggtgtgccggaggtcgtggcggcgcagatgctcgtagccctgcttggtgaccacgtcgtcccagtgtgtggcgtcgcgcaggacggcggtggagatacgtccgccgcgtgggccggtgaacaggcgggcgtccggattggggccggcggagcaggatgcgctgggcgacgagggggcggatctcctcgacgatgggaaccttgcgggctcgcttgcccttggtgcccttgtcggtcagtccgccgggcgcgggcgtggtctgacgccgcacggtccagatccactgggtggtgtcgacgtctccgacgcggcagccggagatctcgcctaccgtgcggcggtgcacgcggcgaagatgaccacctctccccagccgcggtactcgtcgtgggaggcggccacgagtgcgtcggccagtgtgacgagtgtttcccagtcgggcagggcgagcgcacgcgggtcgaggagttcgtcctcggagcctgcttgtagagcttctgccagccggtcacccgggcggggttcaccttgatgatgccgtcgcggactgcctgctccatgacgcggaccaggacggcgatggtgttcttgaccgttgagcggctgagctcgtcggcgatccagttctgcacggtgcggtcaacagagccgttggtgatcatgcggaccgcgaggtggcccagggcgggcacgacgcgcatccgccagcctgacaggttgggatcgagtgttttcaactccaagcctcgcagggcgaggtccatgttcgcgttgccgtattcggcgagcttcatgggggcgagcgacggggacagccctgcctcagccgcttcgatgatggactggagccactcctgcgcttcgtcctcgtccgccttcccttccggcagggacaggcgccgcttcgtagccgggtcgagccagcggacccgcgctcggtacgggttgaggcgattaggccggtactcgatgtcggtcgtgagtcggacaccgaccggcacaacggccttctcggccatcatgcgtctctacgcgggacggtccggtggcgacgcagccattcctcaacgtcgaccgtgctgtacatgatgacgcgttccgaaacggaaacgaacggcgggccctggggtggccgagcggcgcgccaacggcgcagagtcgaggtgtttacacgcaggcaggcggcgaggtcgcgcgtcgaataccaggcattggccagaagaaatgactggttgtcatctcggacgaaaggggcacggccctcatccttcgtgtgtgtctgacggcctgtgtagtctgctatcggttcggtgggcaaaggcggtggatctccgggggtatggagcaccaggggatacagaaggcggtcggcgacaagcggcgcggcccgcaggtggagaaccgtggggttctggcatgcatagaagcggtgagtctcttctgttggaacggatccgcagtggtgctctgggtaaacggtggacaacaatcgtccctgagcgcatgattggcggtccagccgactcggcaggacggtcgatccggcctgcctccggcaggtcaggcgtaacagcggcagcagcaatgcggcgagcgcccaaaggtcaaggcccggatcgtctgttcggcgcggtcaggcaggctggtcaggacgagagtgggatggtcctcccctgtagtcagagctctggcactcgggtggggtcggggctgatgcgttcgccgcgttcatcgaagaagagcaggttgcgcaggtcgacgaggagggggatgtggtggccccttcgatgacgggcgcccggttcattgcgtatgacgagttctccgatgcctctgcgcgcaggggggactgtaaaacgttcggtgtaactcccgatcatggaagatgcatcgatgaccagcaacaacgtgaccgaggccgaggtcggcgaaccgtctgagaccgcgccggtgaagtctgtggacggccggctgatcgacgagttggtcgaccgggcccaggccgagggccttcagctcaccggcgagggcgggctgctccagcagctgacgaagcggctcctcgagtccgctctcgagggcgagatcaccgaccacctcggctatgacaagcacgatccggcagggaagaacagcggcagctcccgcaacggaacccgcgccaagaccgtactgaccgacgtgggcccggtggagataaccgtgccccgcgaccgcgagggctccttcgaaccgaagatcgtcaagaagcgccagaagcgtctgtccggcgtcgacgagatggtcatctcactcgcggagaagggcctgaccaccggcgaggtccaggcctgtccgaggtctatggcgccgacgtgtcgcgccagacgatctccacgatcaccggcaaggtcctcgaaggcatggctgaatggcagaaccggcctctcgatgccgtctatccggtggtcttcatcgacgccatccacgtgaagatccgcgacggcgcggtcgcgaacaggcccatctaccgggccctggccgtcaccgtcgagggccggcgggagatcctggggctgtgggccggcgacggcggcgagggcgccaaacactggatgcacatcctcaccgagatcaagaaccgtggcgtgaacgacgtcctcatgctcgtctgcgacgggctcaagggcctgcccgacgcggtcgagaccgtctggccgaagacgatcgtgcagacctgcgtggtccacctgctgcggaactccttccgctatgccgcccgccaggactgggacaagatcgccaaggtactcaagcccgtctacaccgcggcgaccgagaacgcggccctcgatcggttcgcggagttcgccgacgcgtggggcaagaagtatccggcgatcgtgcggctctgggagaacgcgtgggaggagttcaccccgttcctccgcttcgacaccgagatccgccgcatcgtctgcaccacgaacgcgatcgagtccgtgaacgcgcggatccgacgggcggtgaagcccgcggccacttcccgaatgagcaggccgccttgaagtgtgtctacatggcgatcatgtcgctggacccgaccggcaagggccaagcccgctggacgatgcgctggaagacagctttgaacgccttcgatatcacctttgacggccgactctctgcagtccgccagtagccctcaacaacccgagttacaccactcgtttgacagacccgaggcgtcagaccagcccgagaggtcagaccgcctttgaacgtgtgatgtctctgctggcgccgggcggctggccggtgacgcgtttgaaggcccggctgaaagcagcctgagagctgtagccgagacgttgggccacggactggatcggcaacgtgtcctgggccagccactggccggcaaggagcatccgcagctctgtggcatagcggaggggcggcatgccgatcatggtctggaagcggtctgcgaagacggaccgggagacgttggattccgctgccagctcggccacggtccagtgatgcccaggctgccggtgcagggccaggagggcgccagccaggcgaggatcgcgcaatgcggccacaaggccagaggtactgtcgcagccgcattcgatccagccccgcacgatcatggccgccgcaacttcggccagccgggcaaggatgccggcgaagcccacgcgtccggagcagacttcgcgcctcatggacgtgaggatcggcatgagcccggggtaacgctgcccctcggcatcgaccagcatgacatcgggcatcagctggctgaggccccccattcccccgaggtcgaactccatgaagccgttgaagaagatcgcgctgggagtcgggtcggcgctcgggcaggcatccacgtcacacaccgcgttgctgagggtgaccgcgtcgaaactgtctatgccttggaccggtacgtccggaccggaaaccaactggtgggttgtgccatggggcatgaacaccgcgttgccggccgacaactcgtggacagctccgtcctcggtgcggaggacggccgagccgacggcgaggaagtggaagtaagcacgttcgggctcggcatcgaaattgaggccgaactgcgggccgacctggacacgacgataccgaacaccgcgcagccgcatgctggtcaacagttcactgatgaggtcagacgacagggcgaactgcccgggagcacccccacccggagtctcggtcaaatattgcagactttctgtcatagctcatcctgaagttcgggtgcaggcttgacttaaacctctcacgagacttaagggaagtaaaaagttgagcagcgatgtacgcagcaccttgcccgattcccacactgacgaagcggccgatgcggaacaggtaccgcccgcaccggcctcatcgtcctgggcggcggtgttctcgctggcgatgggcgtgttcgggttgctgacggcggagtatctgccgaccagcctgttgactccgatggccgccgacctggggatatcggaagctttggcggggcaggcggtgactgtcacggcggtcgcagcgatggtttccgggctgttgactgcgagcctgacccggaagatcgaccgaaaggttgtgttgctcggcttcaccgtcctgatgatcgtatccaatctgctggtcgccgtagcccccaacatggaggtgctgttgctgatgcggctcctgctgggtgtcgcactcggtggcttttggagcatggcggcggcagtggcaatgcgcctggtgcctgcggctttggttccgcgcgcaatagcgatcatcttcagtggcattgcggtggcgaccatcgtggcggtgccgctcggcagttacctcggcgagctgtccggttggcgcagcaccttccttgcggcggccgcactcggggtggtgacgttggtgttccagctgttcacgctgccccggatggcgccccatggcacggcacggttgggcacgttgtggaaggtgctgcaacgcccgggcttcggggcgggcattgcaggaatgctgctggttcacattgggcactacgcgctgttcacctacatccggcctgctctggaaaacgtggtgaaagtcgacatcgatgagttggcgctgctgttgttcgtcttcggactggcgaacttcgtgggcacgctggtgtccggatggcttctggagatcagcctgcgcctgacattgacagtgacaccggcgctgatgggtgttgcggcactgggcttggcgctgcttcccgctggcaaaattgggtacgtagccctggtggtcctctggggtctggcctttggcggcgtatcggtggcgtggtcgaactgggcgactcgcatggtgccggaccaggcagagagtgcgggcgggctcgtggtggtaggcgtgcagtccgctatcgccggcggggccgccgcgggcggtgtgatgttcggtatcggcggcgccgtcaccgtattcaccatctctggcgtcgtattgctcgcctccgcgttgctgatcgtgctgcgggtcaaagcgccccgacagcttgcaacgaactgatgcttcgaggaggcgaaaccgcacggctccgtcgatccggcgaccttggatcgagtgagccagacactccgagcggtcctcgacctctaatgctctgaccgcataggttcgccggttcggatgcctcacaggttgtccacatagaagctggtgagtcgtgcgatggcagcgtcgacgtattcgggttcgtcgtacatctcgtagtggccggcgccgtcgatcgccgtgaggtcgactgggttgggggccaccttccacagctgcatgccggtgtcgtaggagccggtcttgccgatgcgtccggcgaggatgacctgcagcggttggggcgtgagctgatcggccaggtggaacgcgtcatagcccagcaggagggagtcgctgcgcaagaggcgccggttcgtggagtgttcgttccgccgcactcgggtgcggtagtaggtgacggcctgactggtgtcgatgtcagtcaggcccgctgccgcggggtcttgtcgcccttgtgggcggacaggttgtctaggatgacgtagatcggggcgccgtccgggcgcgcggcccggatcgaccacagtgcggccagagtgttcaccgcacccttcttgcggcggttgatgccccacagccggcgtcgccgacggagtagcagccgtggaagtaccgcacctcgtgggtgcggtggtaggtcgcgggatggcgctcgggcgaccggcgggagcccagccgactcctgcggtggggcggatgcggagtggtccgaactcgtcgaacgcgaacacgcggtccggaagcgttccaggatcttcgatgcggtccagcttggcgtcgcgctccgggtcgggcgcctccttccaggtcttggtgcgctggaaggtgacgcccccaggccgacagagcatgcagtcggcttcgagcgattcgcccgtccgggggcgtgcccggacgatcaggcgaacctcgtatgacggagcccgaccggtcaggactggtcgggctcctgagcagaccaggtcgccgtccttggggcaaccacgctgcggaccggtgagcccgtccgcgcccgtccgctcaagaactagacgattctcggccctggccagggactccttcgcccacggtgcccgcgggcatttcgcgcgtcctcctctgtcgaccacgtgttagagctattccgggcgagctacgcggcggcgtgatcgtctgctggctccgtcgccgggcttgcttagtggctgctccgtggtcgtggggtggcttctttcgacgtacgggaaggacgtggcggtggactaccaatggtgcagaggatcgccggtttggctaaccggcgatcccgcgctttgttccgcccggcgcgggaagcgcgccccttcgggtggcacatgccccggcgggagcggtagacccgaaggatgagcccggattgcctccgcccgccggtggagcccatgcttgcccaggcccgcgagaccatcccgagccccggggctctgcgcggtgggctggtcatggacctcaagtgggacgggcacagggcgattgccttcagccctgcccgaccgggcggtcccttcaggcactgccctcgatccgttgacgaagcagcgcgaggtgctgtccagcctcgtgatatcagccatgagcagaggaaccgcgcagagtgctgtcggctcttgatcctgctgagcctgcccgtacgcgccgacaccctccgctcgtatgttgtcgacgaagtgcacctcgacgaagtgcaccacggcctctgtcgccgcagtcaccaaacctcgatcaaatcgcgccgtcagtcgtaagcccaggaggtcgactgcatggcgtcaactcggccgaagctcacggtccgggtgatccatctgcgtcacacatggatccgttctggccaaaatcgcctggttgtccgctggtgggcgctggtggtcgttggtgcgggtgccaagtgatcacctactgaggagaagtcatggctgttttcaccgccgctctggtggcccgtcacagcgacaaggccgtgtccgtcaccgcctccggcatggacgacggtgtcgaggtcgttcagtggaccgacaagaacaagaccaaccagcactggaacctcgtcgcgacgaccggcggctactacaacgtgatcgccgtccacagcggcaaggcgctctccgtcaccgcctccgacctggaggacggcgggaccgtcgtgcagtggaccaacaagagcaagcccaaccaggagtggaagctcgtccagaaggacgacggctacttctcactggaggcccgccacagcggcaagctcctgtccgtcgtcggcgaggacaccgccgacggcgccaagctcgtccagtggaccgacaaggacaagcccaaccagcacttccgcctcggctgagcagtccccacacggctctccgagggtggctcccggcatccggccctgccgtcgtctgcctaccgaacacacgtcccgtgcgacacgggtgaggagcctcgccgggtccggcccgtcctgtctcggcccggcgcacaccgatcccgtggacgccgggccgcacgaccgatcccccacgtcgaacgccccgacggagcacgcggcaacgaaagatccaggttcatgagcaactcgcatgacgaggcgaagccgaccactgcggcggagctgaaccggcttgccaagcagggcatctacgattcgccgaaatccgtcgatccggctgtcgccggcctcgccgatgcgctggtctccactctgcagggagatgcggaaacggaactgctgccttccgacctccagcagctgacggaagaggtccggcagaaggccaccatcggccgcccgcggatcaccaccgctgacggagttcggctctccgcgcacaccatcaggctcaacacccaggactcacggccgctggtgatcgtgcccgccgcctggaccccccggctggggccagttcgaatacacctacctccgcctggcgctgcgcggctaccacatcctggcccacaccccgcgcggcctcggcgccacgaccgaactgccgggcggcggctatctcgacggccccttcacctccggcggaacgatcgactgcgccggccctgcggactggtccgacgcctccgcggcgatcgactacgcgcagcagtacttcaacctgagccgtatcgccttcctcggcgaaggctacggagcgagcatcagccaactcgtcgcggcgcacgacgcggacaagcgcgtgacggccgtggccgcgctgaacccgtggggcgatctcaccgcgggcgccaagcagaccggcgacgcatacgacgcgtacgtcaccgccctctccaccctgatcgaccttcccggcggccccctggacaggaagttcgacggacccacccagcaggtcatccacgacctgctgcgcgaagaggccggcgacgagaccctcgcgtgggggaaggagcggaccgcgttcacgtatgtcggggagaccaacacccgcggcatcccgacgttcctctccgcgagcgagaacgaagccctctaccctgccgcgcagctcaccgccgacttcaagcggctggccgggcccaagaggctgcggctgcgagccggtgagaacgccgcttccgcggccaccgccctgaccctcccgctcagccccacccagccccgcggtcgaggaagctttcgcctggctggaccaccacctcggcggagtcgacaacgacgtccccacctggacccccagcagcagctgaccaccccggcagccacttcccgaaaccctccgtctgccggcagcgtccagccccgagcctgaaccgacgtcgcgacgccttgctggcaaggcggaggcacgccgggagtgctgtggccgaccgaacaggccggccacaccactcccgtcacctcggtgacgtgttcagcaggcgctcgtcctgataccgccgcgggagacgggcgcggccttcaggggccgggatctcctcggtcaggcgtccggtccacgggcaccagcacaggccggggaggaaggcgccgcctgcctcggccaggtgatcctcgacgtaaggcaccgtggcgtcccagacctcgatggccgcctcggtgaactggatgtggcgggggcgacgtacgagctccagcgcggactggactcggcctcacgcttgacgatcctgccgacgacggtcctattgtccccggactcgttagtcttcctgctggcatcaagtgctgggctgacaaggtttcaggcgtcggccctgccatccgatcccgacccgtgccaaacgcctgcgcggctgacaccaccatcacaaccggtaccacacgaagatccgcggtttcggtgagcgcgacagggcgatcctcaagtcccggcggctccggtggagctccgctgaatcaccacccggatcacagccgtcgtcgccctggaacttgtcacctgatcaagatggaaaagactcactgacgtcggcgatggtcaacgattcgatcaacggctcccggcccggggtctcgtgctgccagcaccgtgtccggccctggggcgactcctcccgccaggacgggaaccggactggaggaaaggcaaattggcactgccgcggtcgggttcctacctctacgccttcaggaatccgcgaacccgcgtgcttcggcgttcgacaccctccaactcggcgggcagccgatcctcgccgagccgtacaagcagcgccgaattcggctggaggcactgttcgcaggacatgcgctgtccccgccgtggaacttctgcccgtcgacgagggacccggcggtggcccaggagtggctggagacgtggaagcggacgcccggggtcgagggcgtggtctgcaatttcctgttggatcggcgtgttgaagcggatcgagtagggggatgcgtgcgccgaggacacgggtgtggtccgcctagggcccccgtgtcccgcgtgttgacgtgcgggggtacccaaccttcgccacgcaggtgaacccgctccgcatgtgcgcccccggcgggcggctgtcctcgctcttcgcctcctcgcgcgctcggccacccggcccacgtgcgcatgtcgcccgcggggtcgcgcagcccgccgaaccatcctggtgatgccacgcacgtttcgagaacaaggaggcaaccatgacggcggtaggtttgtgggagctgagtgtcagggcgcgggcaaaggtggacgcggagtctccgacccgaaggaaagcactggtgatgctcgccggcgagtgcccgtcggggcccacgaagaacatggatgaagtgactcactggaggatcgtcttcaacgaggacattgctcccgtccctgacggtccccgcagtgaggagcccgagctgggttccttcgaggtcacgggccgaacgaacacgggcgaacttggcgaggtcgtcttccacgagaagcctctgctggagaacgcgcccctgacagaggcggtcaccatgaccccgacccagtcgtacaaggtcctgcgcgacaaggcgggagtgaccgacggctttcagtggatcttcctccaccatcctgtcgacgagcaccatgtccagtaccgcttcacctacgacagggccgcgcgccagggatggtcggtccatgtggacgaccacgaggtgaagccgctcagctgacgtcggcggcccactcaccaccgccggcctcatccacctccgcaccgccgggccctgcccgctcccgtctggtgaccaagcttcgggggacaccgaagccgtgatcttgaccatccggcacgtacggtctcgcccgcaccggtcacagccagtgcacctgtctggccgctggcgtggggagcccgcgtggttggggcggggggaagcatcgcaagcaacggaattcgctactgcgatggcctcaggactttccttgtgggtcctcgcagcctatgaagggagccgctcatggcggaagcagagttcgtggtcaacccggacgaccactgcatgttcctcgacgccaacgaaccccagtctccatcgtccgagaagtacgggtgctcccgcccggtgcagtacggcgcgctgaccgtcgcctgcggcgacactcaacccgacgggttcctcctgatggcccaggggtattccaaaatgcccaacggctggtgcatgacgtgggtcaagagcacggaccccgcaatggagatggtcaagccccaagagtcgtggcagcagttgggcaactcctcctggcggccggtcgctccccccggatatcgtgcctgcagcgacgcgatcggcggcatggccgcaccacccgacatctcaatcgcctgcatcaaggacagcgatgtggacgggttccggtacgtgcacctcgcgaccccgacagcagaacccatcctcggcacctcgttctgggccaaccgggcaccgaagtacgccaccggcgcgaacggagtgcgcgtggcccccagcatgggactcgctcacgtgtacagcggcgaacaacctgagggcgctcccacgcagtacgtgctgaatctgcccgtcaaccgccgccagggacccaaccccagcaagccggagatgaagaactacgacgaacccatcgccctgaccgagtacgcggaggacaaccggatcacagtgccgtttgtgtccgtgtacgaccagaaccacaccgtgcagtggcagatggccaacagtcctacatacactctgcggcgccgatgcgcgtaccgcctgatcacctacctgaacaacgagacgtccatcgaacagtccaagggaaaggacgtcaccgagggcatctccaagagccagaccgacaccttccgtgtctccgtcggatacagcatcagcgcggaggcgggggtcagcttcctgggcaccggcggcaaggtcagctcgaccacctccatcgaactcggctacgaacatcaatggaacgtcaccaccatggtcagcgagacccaccgggaagagctgaaggtcgcgcccaaacacgccggggccctgtacggcatcgcccacgaactcgctgtgcaccgcgaggacggcaccgtcgccgggaccggtgaaaagctcggcttcgacgcccgtcgcgcctacctcgtcctgcagtacccacccgccgtacagggcgaaccgccggccgccgtcaccgacaacggggagacctcgatccctacctcttgaatacggcgatgtcctcgtacagctacggcaaggtggcgtgcagcgctgagtaacttgagtgccgcggtcgggctgccggaaggcttcgaagtcggcgtgcgctcctcgggtgcctcgggtacgcctctgccttctcgttctcgggcacgttcgtgatccctgcgggggatctgtacagcgtcgccatagtgatgatgtgcctcacggctttgccttggcgcggccgggattaggatctggctgatcatctcaggtcaacaagctgaacttgccagagactccaccgcgtggggcaaccgcgacgtcctcgacacgacgctggtcgctccggaccgggtggcggaggtcagcgtcgacacggcccaggaccggtgtctggcggcaccctgtccgcctggcccgtctccgtgtcgatatgccggtggatgacgtaccggccgcctgagcggagacccgcagaggttgggtgtggacggaggggtcaccggcggcacgtccgcgtggcggcggttgagaacgggcgttccggtccggccgactgtggccgactgccgggagaacactgagagtgctgaggggagttggcgttggcccagagggacgctgcgacggtcctcctactggtggggcttaccggctcaggaaagaccacttatgcccagcgggtgctggagcctccgggggcggtgcggctgtcggtggatgaggtggtcttcgagcggcatggtcggtatggcatcgactacccggagaacacctacttcgagaaggaggctccggtcgtcgccgagttgcaccggcggctggccgaactggtcgcggagggccgggacgtggtctgggaccacgggctgtggccgcgtaaggatcgcgacgcgatgaaggagctggtcgaggcggccggggggcggtggcgactgctgtacttcccggtggagcgcggcgagctgctccgtcgtctggtggagcgcaacgagcgcggggacgcgaacgcgcttgtcgtgacgccggaagcgctggacgacttcgtcgcccggttcgaggagcctcatgacgagggcgaggagatcgtggagccggcctggctctgagacgacggcgggcgccaggcggtggtgatcctggctgcttcggcggcccagccgtcggggaggcggtcgagggtgacgcggcggaaggccaggtgcgggtcggtgacgtcgatccggccggtgtgacggtccgtatgctccagcaggcgggacgcctcgctgcggacggccggggtgtgctcggtccatgcgccggaggagaagtgctcgacccggcggcgcaggtcgtccaggacgctgccacgccacttgaagtggtgcacgcacgcgagcgtgtccgggtcgggccggtgacccggcgcgcggtggttgccggaggccacggtcacggaggagcgggcgcggacgatcttgcgcggatcatcgagaaggagccggtgggtgaggtgcccgccgagcgggaaggccagttccagccctggaccggggcgtcatggggccaggctcccgtcggcagcgacacggtcgagcatcagcccgccgaccacccaacgctcggcgtcctcggcttgggcgaccacgtcggtgagcggggccgggtaggtgtggaactcgtcggcgtcggcgatcagatgccagccgtccccggccctctcccgtagggcgtcgcgcagctcggtgttggtgtgttcgtgccatggtccggtgctgatctgggcggggatgatgccgaggtcgtggacggccgcgaggagctggtgccgctgggcgacgggcacatggtcgggaaagtggaaggcgaggaggaaccgctcgatgccgagcagccgatagtgggcggtccaggcggtcagcagcgcgggctcgaccggcccgatgaccgcgaccagggtgggagaacgaacgtcatcggcactccttgatcaggcaggcctaagtggctgtgaggaacgcggcctgctccggggccggatgcagtcccagcaccttgggcgccgacggccccggccgggcggaagcctcggccgagagcttgtcccacgcctgggcgagggcgtcggcatcgttggccgggaaggaccggacccacggctgggcggccggccgggcggtcagctccgggtcgtgctcggacaggagtagcgggacgcccaggcgggccgcgtccatgacgagccctgactccttgcccacgccagggtgccgggcgaggagggtcgcgtcgctggcgccgtggacgagccggaggacctggtcgccgaccgggccgggcaccgtgtggacactgggcatggggcagttggtgccagcgggcgaggacggcgtcgtccagcggcgtgccgcacaccaggacgtgcagcggggtggtgaggcgggcgagggcagcgtcgatggtggcgatgtccttgatgatgggttcggcagtgagcgcagttctgcatggtgcggtcgacagcaccgttggccgctccgaggctcagctgcggccggtcaggggagcgcggtggcggtacggccacctgtgacacgaagcagatcgagtttccccgcttcgatgctgccggccgctgccgtgtaggtcaccatgcgcaggtctgcgccggggacgatgagcacgtcgcagtcgagcaggatgtcgccgatctccggatgccggatcgtcttgcggtctgtcgtgtgctgggcgggagccgtttccgtggcccagtgatgagcgaagacatcggatacttctcgcaggtcccgcacgagacgatcgagctgggcgtccctgggatagcgggacacggcgtccttgaggtcggcgacgatcgactccgcgaaggcctccggtccgcgctcggactggacgggaagcatcgagtcatgtgcgggcccgtcgccgaagagtgcacgggcgaggttccgttcggcggtcgggagggaggcggggtcgccgtgcagggcgctccacgtggtgttccaccacaccagggtccagtcggcggcgaacaccccgatcgggacgtcgcccaggcgcgtggcgagccgttggatgctcgggggtacatgggtgctgactgtcccgtcctgcggcggcagatgtccggcgcttcggtacagctggtcacgctcggcacgggagagctgaagagcccgggagagtgcgccgacgacctgggccgaggggttcttggcgcgtccctgttccaggcgcaggacgtagtcgacggagagcccggccagctgtgcgagctcctcgcggcgcagccccggggcgcgacgaccggccgtcgaggcaaggccggcgtcggccggggacagccgatcgcgccgggcgcgcaggagtgcggcgaaatcggagcgggaggaagccatgggtccattgtcgccgctcggcgccggaagagcctgggtactgccagtcctggggacggggacggcactggtcggcggtggtgccaccggcgaacgtggaagggcgccccagccgggcgccatcggttgaccagtcgaggagccttccatgaaacacaccatcgtgatgacgggcgcgagccgagggatcggccgtatcgccgcggagcacatcctgcgccaagcgccggacgcgcacctcctggtcgtgacccgtggttccgccggcgcacagctcgccggtgacctcggctcgggcgggcacacggtctcgcacatcacggcggacctcggctcgctggccgacgtccgcgccgccgccgacgagatccgcgaccggctcgaccgcggtgacctgccgccgctgcgcggcttcgtgggcaacgccggcatgcagtacacgaacgcgctgaccgagggacccgacggattcgaggccaccttcgccgtcaacgtgctcgccaaccacctgttcgtccgactgctccaggaccgcttcaccgctcccgcccgcatcgtgatcaccgccagcgacacccacttcggcgacttcaagcacaacatgggcatggtgcccggtccggcctggaagtccccggacgtcatcgcccgcacaggcgccttccccaagccgggatccgcggcaggcgggcgtaccgcgtactcgacgagcaaactggccgcgatctatctggttcacgagtacgcgcgccggctgccggccggggtcgacgccgtcgcctacaacccggggttcgtccccggcaccggcctcgcccgcaacgcgggacccgtctcccggttcgcgatgcgccgcatcatgccggtgatgaccctcacaccgttcgccaccagccgcagtgccgcaggccgctgcctcgccgacgtcgtcctcggtacgacccatgcgccgaccggctcctatgtcgaccgcagccgtgcggaccgctcgtcgcgggagtcctacgacccgcggcgcgaaggcgagctctgggaggccgccgagcggttcaccgcggcgtacgcagccaggacggacacatctcaggcgacgtgacaagcagttcaccccgatacccaggtcgttggcctcgaagcatggggggagtggaggccggcggtggacggcccgacgacggaccgtgacagagcctgatccgggacccctggacgggccacgcggacgcgcggaacccgcgtccggtgcggtagcacgcacaccaccccgaggagagggtagtgaacgacggctcaccgccgttcgagcgaaagtgagttggtggagtgcggacgacgaggcggaggccgacctccgaaacgtgtttccggccacgggctctcttcgggagtccatcggcgtcgagacgcgcagggtcggcgcgaccatcgaggccctgagcgatgccgggcaccggtgttcgctccgcagtcacccggggacgctactatccctcgtgctcatcgccggactcgggcgatacaccggcacgcaaggggagaagtgaccggagaagaccggcgatcgcatgcccaagaccggttccggacaagcatcgacgaagctgcggaccgcgggcgtctgggtaaacggtccgcagcctatccggagctcagtcggatggcttccgcggctgcgccgtggctgctgtcgtcgtgctcggcgggctcggactcgtactggccctcacgaccgaaccgatcgtggcagtgcttcctggcggactgcttgcagcggttctgatcagcctctggttcgatcagcgcacatcgaagaagaaccagggttttcggctcgacctgtacgagcacggtctcaccgcagtcgtgaagggtcaggtccatgccgtccgctacgacagcacatcggtcctccaaaggagcatccggcacacaggtgccaccgggtacaccgagtactggtacacgctcaccgatatcgaccagcggaagatcgtgctgcgcggccggtcggacggggtggtgaagaagggtcagttcgccaaaccacgggagtgggggacggccatccagcaaggagtcacccgagagcagctccccagggccctcgccacgatcaactcgggggaatcgctcagcttcggcaagctgtgggtgtcccgggaggccgtgggttcggcgcgcgattccgcggagtgggctcagatcgaggaagtcagggtgatcggcggctacgtcaagataaagatggccgggaagtggcgctcgctgggcgccactgcggtgaccacccccgtagtggcagagatgccgaacttcttcgtcttcctggctttggccgaccaccttcgccggtcgtagtacggcccggcggtgggtgaccgcccgccgggtgtgcaggtgggcggtcacccgggaggcagccgacgccgtggacgcggcgacggtgtaggcggcgcgcggtcgacgagacgttgcccgggccggggagacggtgtgaaccgggtggagaacctggacgatcgtgtccccgacggtccacacagggcccgttgggtcacttgttgtccagccgccccagcgtgtgggcgccggcgaggacggatcgggccatctgccagtcggcgtggtcgatgccggtgatgtggcgtaggtaggcgagggtgacctgctggacgagggcgatgcggctggggtcctcgtcggtggtttccgccgcccggtagccggagatgccgccgaggaagtgctcgccgccgtagacggtgagcaggctcttgttgccgcggctgagggtgtaggggtcgcttgtccaggcgggtcctcgagtggtgagcgggagatcgtccttgtcgccggcgaccaccagtccgggggcggtgatgtgggagaaatcctggtcgcggagccaaggaaggttctcgtgggcgaaaggggtcagttcgtcgccgcccgcgccggccgtggccaactggatgctggccatgacccgggagtcggacaggtcttcggcggtgccggtctggggatcggtgacgcgcagacccaccagaatgccggcggtctggcctccgaaggagtggcccgctgcgacgatgcggctgtggtcgacccggccggacaggccgggcacggatgcctccagcggcttgagctcatccaggatgcgcttcatgtcctgcacgcggtagcgccacaggtggggcctgcgggggtcgtccgcggcgatggcgacgcgcttggagtcgaggtgcgtggcttgaatcaccacgaagccatgagaggcccagtggtcgaccagtggcgcgtagccgtccaggtcggacccgaatccgtgggcgaagagcacgaccggcaggcgtgtgccagtgagcggtgcggaaatgcgtacgtgcaggtcctggccgcgctgcgggtcgggcagcacgatcggtttgaccgtcgcggtcggggtgggagcgggggaggcgagaccggtcgtccggtgggtggtcacgtgtgtgcttctttccggtgtggtgcgcggggcgggtcaggtgatcttgaggtggaggacgcgtctggcgttgacccgtgacgtatcgggcgaaaacctcgggggtgatgtcagctacgctaaaacttgacgtcgacgtcaaaggcaagtcgtagtggcatagatcacatggagctcggaatgcgtattggggaactcgcccgtcgcacaggcgtcagcacccgggccctgcggtattacgaggagcagaatctgctcacggccgagcgcagcaactccggccagcgccactacccggaagccgcggtcgcccggattctcctggtccgagagctgttcaccgccggcctgtcgagcaggaccatcgccgagctcacgccatgcgtcatcgatggcaaggccacacccgaactcctcgaccgcctggctgtggagcgcggccacatcgaccagcacatcgtcgatctcacgcacacccgagacaggctcgactcggtcatcgccggcgcctccgcatccatggacaccggtacctcctgccggcccggcccggcatcggccgctccggcgggggtcggcgacgctaccccgccgtggtgatcaagaagctcgggcaggtgggggatgatgtcgtccagtccgcaacaaggtaagtgcccgttccagtctgctgacgctggggcttcacgagatgcccaaaaaatgttgtaggcgccgctgcccgcacgtctcgtaccatcggcccacctaccgacccgtcgagtaacaccaaggactttgtgactcactccgatctccgcgccaagtccccctcgctcgcgtccgggatggccgccgccgatcacagcccggacatccagctgtcccagactcgccaccgcgccacgctcgtggagagctggcaccttgagccaggctccactgtcctcgaattgggctgcggccagggcgacatgaccgccgtcctcgcggaggcggtggggcccaaagggcatgtggtggccgtcgatgtggccgaaccctcctacggggcgccggtgacgctcggagaatcggcggcccggctcacagcgggccctctcggcccgcgcatcgacttccgcttcggcaccgacgtcctcgacccgtcagtcgacttccccgacggtgcctttgaccacgtggtgctcgctcattgctcctggtacttcacgtcgctcggacaactgcaagacacactggcccgggtacggacgtgggcaaggcgcctatggttcacggagtgggacttgacgcccgcatccggtgaccagctggcgcacctcctcgccgtgctgatccaggggcagaccgaggccgcgggatcgcgtggccacggaaatgtccgtactcccttttcccgtgaggggctgctgcggctcctgcccgaggccggctggacggccgacggcagcaggtcggtcgataccgacgggcttcaggacggtgactgggaaatcgctgcttgcctcgacctggctgcagcagaggagcgtctggccgcgctgcccgagccggtgcgacagttcgtcctgagccaggccgacgttctccgggccgtcgccaagccctgcggcaacagtgcgctgggcgcttactcagtcgccgcacgctgacatgcgtcccgctcggtcaccggcaccggtcgccccccccggctcgacggagacgcggaggaagtgatgctccttcggctcctctgtggcgttgtacagctccgtcgcggcggcgttgagttggtgagcggcggggggtgttggtgtgttcctgctgaggcgggcgatgccaccaagcgtgatgccgtgaccggctacgccgtgccggtttccgaactggcccgcgccactcgttggcgtcggcgaagtcgtccccactgccgaccaggtggccgcgcgcctgggcagaggctcaggcgcgcggccacctgggtacaacgaagttgcggcgggtgacggtcaggtcgccgacggggtcggcgcagatcgcgtggcccacggcggtggccgtcgcccatccggtggtgccgagtgcccatggggtgggtggtagggcggtaccgctgaccggggtgggatgcgactggctcagccaggcgccggacccgttcgcctctccgcctccgccggggcgactttcccggccggacacgacaatgtggtcagcttgtcgttgggtgccggcacggtagccctccaacagggctaccgccggctcgccacagccttacctggcgggaactctcggtgaaccgccagcctcttgttcaggcgggaagctcggtgatgccgagggcgaagtccaggttccccaccccgtggttggccaggcctaccgtgaccacgcccgctccctccagccagtgcgccattttcaggccgccgacgtccagcgggcgcatcccgaggctcttgatgaacgcttccacgcttgccttggcctgcgtgctgtcgccggcgatgaagacgtcgggccgacccttctccaggacatgacggaagacggtgttgaacgccttcaccacgcccgcgccggccggggccgccttggcgacttgctgcgcgatggaggtctcctcgcggtgggtcagcccgtcgaacgtcgagttgaaggggttgctgatgtcgatgatgaccttgcccgcgagagcgtctccgtactgggtgacggccggcacgacgccgtcgtgcagcagggcgacgatgacgatgtccccggccggggtggtgccccattctcccgtcgtggtgccgctgccgagagttttggccaggtcggcggccttggactgatcgcggcccatgatctcgacggtatggccgcccgctatcgcccgtgcgccgatggtgcgggccatgttcccggtgccgatgatgctgatgttgctcatgagatgtcctgtcctggttgtggctgctcggttcacagggcggtggtgccgccgtcggcgacgagttccatgccgttgacgtagctggagtcgtcggaggcgaggaagagggcggcggtggcgatctcgtcggggtggcccatccggccgcgggggatgagggactcgaactggcgcttggtggcctcgtcgaagagctctgcctgcttggcggtggcgacctggccgggggtcaggacgttgacgcggatccggcggtccttgagttcgttgagccagacgcgggcccatgcctgctggacagccttgctgccggcgtagacgctccagccggggaaggcgccgagggaggcgttggagccggtcatgaggatggagccgccgtcgttgaagagcgggagggccttctggacggtgaacagggtgccgcgggcgttgagcccgaaccaggtgtcgaactgggcctcggtgatctcgccgagcggggcgggctcgccgccgccggcgctggcccacagcacgtcgaggcttcccttctcccgcttgacggtgtcgtacaggcggtccaggtcgtccaggttggcggcgtcgccctggacgccggtgacgttgcggccgatcagcttcacggcctcgtccagggcgtcctggcggcggccggagatgaagacgtgcgctccctcgtcgacgaacagcttcgcgccggcgagcgccatgccggtggtgccgcccgtgatgaccgcgaccttgccgtcgagctttcccatggttgttccctcgggtcggtggtgccgtgtgtgtctgggacgacggcgctaagtacaccgtgctgtgtgcttaacgtacgcggcgcgcggccggggcgcaaactatgtacaccggtcgttacccggctgcggtacgctgggcccatgacagagttggagaagggccccacgggccgccgccgcggccggggcgctcgtgagcgcatcatcggcgcggcccagcaactgttccgcgagcagggcatcaaccgcaccggcatggaccagctctgcgcggcggccgaggtgtccaagcgaacggcctaccagcacttcaccggcaaggacgaactcgtcgccgagtacctgcgccggttcgaccccgccgttctgtccggtgtgttcgaccgcaccgacctcacgccccgtgaacggctcctcgcagccttcgacatcccccccaccacccccctgtgtccctacatcgccgccgccgtcgaactccacgactcccagcaccccgcatcccagtacgcgcgcgactacaagaaggccgtcgccgcgcggctcgccgacaccgcccgc

SEQ ID NO: 2953 - DNA, 1563 bp, Unknown
  Kingdom: Bacteria, Phylum: Actinobacteria, Class: Actinobacteria, Order: Streptomycetales, Family: Streptomycetaceae, Genus: Streptomyces
gcgatgccgaagtcggtgagcatcgggtgcatctggccgtcgcgctcgtcgaccagcacgttggccggcttgaggtcgcggtggacgacgccgtcggcgtggctggcggcgagcgcgtccgcgatctgcgcggtgagcagggaggcggcgaccggggtgagcgggccgttctcgcggaggtagcggtgcaggtcggggccgtcgatcaggtccatcaccagggcgaggagatcaccctcgacgacgaggtcccgggtgcgcacgatgttggggtgcgtgagccgcagcaggacggagcgctcccgcaggaaccgcatcacgacatcggcgtcgttggccagctcctccttgaggaccttgatggccacggtctcgccgggctgacccgcgacggctgcctcggcgcccgcggtctcccgctggcgggctcgccagacggtgcccgtggcgccgcgtccgagcggctcctcgagcaggtacttgctgcctaccggccgcacgtcatgcgctccctgctgatcgtggtgcttgcggtcccccagggggtgtcttgccgccccctgggcccgcccgaatgttccggcccactgtagtgccgccgaacggggcaccggggctcacgtttcgggggaagacgcgcggaccgggcagagggttgccgcacagctgatcacaggcaggtcagacgttcggtcgcggaagcggaatcctgtccggcagctggcaggtagctgccgggaaacccttccgagcggcgggatccggacgcaagcaggcacttttgcgcccacagccgaccattcaagatcatttaaaggtgaccgccgggcgtgttgtcagtggcaggtgcgaggatgcctccagcacggatctgcgaggtcggagtctcgcggtgcgtgacgacctgtacggacgacgtgtccgtgccgggtggggggaatcacagggcgtttcccctgccgggcacccccgcgcagaagggaccgctgacggcgatgcagatccggctgaccgtcctcgcgccgcgcagcggccagaccccggcgcgcacctgcgacgtgctcgtcaccgcacccgccgggacggcactggccgccgtcgcctcccagctggcctccgccgtgtcggggcccgagagctccctgggcggcggggcgatcgtgttcttcgccggacgggagcggctggacgggcaccgcatcgcgctgggtgagcctcccctggtggacggcgcggtcctctcgctccaggtccccggcgacgacgaggcgacggacgacgccgttccggcccagctccacgtggtggcggggcctgacgcgggcggcgtccacctgctgcacggcgggcagatccggatcggccgctccgccgacgcggacgtcccgctcgacgacccggacgtctcccggctgcactgcgcggtgacggtctccgacgacggccgggtctcggtggccgacctcggttcgacgaacggcacctcgctggacggcgtcgaggtgcgcgagcggccggtccgcctcgcccccggcgcgctgctgcggctcggcgagtccgccc

SEQ ID NO: 2954 - DNA, 3571 bp, Unknown
  Kingdom: Bacteria, Phylum: Actinobacteria, Class: Actinobacteria, Order: Streptomycetales, Family: Streptomycetaceae, Genus: Streptomyces
gaccgccccggtcacccggatcgcaccgttcgcgcccttcctcgggtgcggcatgcccctgcccgccgccgtcccagcgggcacgccgcatgtcgatgcgcgggatgtgtccctccgaccgctgcgacgcctcacgcagcggggtgccctcggcccggtagtggtccagcgcccgcagctcgtgggcggggagcagcgacccgtcggagcggacgacgcgccaccacggcacagccgatccgtacagcgccatgacccggccgacctggcggggtcccccctcgcccagccactccgcgatgtcgccgtacgtcatcacccggccgggtgggatcaggtcggccacgtcgaggacgcgctccacgtactccggcagttcggcgccggtcggggcggtgccggacccgcccccgtccgtctggtcctggctcatccgtcccatcctgccgtacgccaccgacagcccggccgaaacggtgtccgtccgggcacacagcgtgcacacgggtggaaaggagcgtatgttgcgcttcccgcgcccgtgcaatgcaccctgatgccctcctctgtctacgggccgtgccaccatcatgcgggcggtgaccggtgataccagaacacgaagacgaaccagaggcgacgaaggagcagggcgtgcagccaccgaaggcggcggacgcctccgatgccggggagcgcccgcagggcgattccgagtcctccggatcgccccgtgccgacggccccacgacgtccaccaccggacatctggccggctcgacgctggcctcggccgaagccgctccgaccgaccgcgtctccggcgacgagccgctgctccccgcccgggtgcaccgaccctccgacctgatgcggctgctcatcggggtgctcgcgatcgcggtcctgttctcgatcgccgcgttcgcccagggcaccaccaccggtcttgaggacgacatcaccaagggcaccgagcaggcccccgatctgctgatcaagatcgccggtctggtgtccagcatcgccgtgctgctggtgccggtcgccttcgccatcgaacgcctcatcaaacgcgacgggctgcgcatcgcggacggcgtgctcgccgccgtgctcgcccacggagtgacgctcgccaccgacctctgggtctcgcggaccgcgcccggcaccatccaggacgcgctgacccagccgcagaccaccggcgggctgaccgacccggtgcacggctatctcgcaccggtcatcgcgtacatgacggcggtcgggatggcacggcggccacgctggcgcgtggtgctgtgggcggtgctgctgctcgacgcgttcgcgatgctcgtcggcgggtacaccaccccgttctcgatcatcctcaccgtgctgatcggctggaccgtggcgtacgggacgctgtacgcggtcggctcgccgaatgtccgccccaccggccagcacctgatggcgggtctgcggcacgtgggcttccgcccggtcgcggcgatgcgcaccgaggacgccccggaccacgccgaccagaacgaccggggtcggcgttatctggtcaccctggaggacggccccccgctggacgtcaccgtcgtcgaccgggaacagcaggcccaggggttcttctaccgggcctggcggcggctcacgctgcgcgggatcacccagcggcgctcgatccagtcgttgcgccaggcgctggagcaggaggcgctgctcgcgtacgcggccatcgccgccggggcgaacgcgcccaagctgatcgccacctcggagctgggcccggacgcggtgatgctcgtctacgagcacatcggcggccggacgctggactcgatggaggacgaggagatcaccgacgatctggtgcgcagcgcctggcgtcaggtgaaggccctccagtcacggcgcatcgcgcaccgcaggctgaccggtgacgcgctcctggtggaccgttccggcagggcgttcgtgacggatctgcgcggtggcgagatcgccgccggtgacctggtgctgcggatggacgtggcccagctgctgaccacgctgggactgcgggtgggggccgagcggtcggtcgccggggcactggccgtgctcggcccggacgcggtggcggactgtctgccgctgctccagccgatcgcgctgagccgctccacccgggcgacgctgcgccggatcgcccgcgagcgttcgcagcgcgaacgggaggcggtggtggaggcctcgcaggcggccaagcaggcgaaggcgcaggccgccgcggaatccgccgagggaccgctcccggatcacggcgcggaccggaacgccgaacagaggacggaccccaaggctgacgccaaggcggacctcaaggcggacctcaaggcggagcgcaagtcgctgcgcaccgagaagcaggccgagaagcgcgccatcgacgacgcgctggaggaggcccgcgaggaggatctgctcgcccagatccgccgtcaggtgctgctgatccgcccgcaggccccggtcgagccggtccgcctggagcgcatcaagccgcgcaccctgttcagcttcatcgccggggccatcgccgcgtacttcctgatctcccaggtcacccaggccgacttcggggcggtcgtggaacaggcggagtgggggtgggtggcggcggccctcggcttctcggcgctgagctacgtggcggcggcgatgagcctgctgggcttcgtaccggagcgggtgccgttcctgaagacggtgcaggcgcaggtggccgggtccttcgtgaagatcgtggcgcccgccgcggtcgggggcgtggcgctgaacacccgcttcctccagcgggccggtgtgcgccccggtctcgcggtggcgagcgtcggggcctcgcagctcttcggactcggcgcccacatcatgctgctggcgctgttcgggtacctcaccggtacggagaggacccctgactcggactcgctgaccccgtcccggacggtgatcgccggtctgctcacggtcgcggtgctggtgctggtggtgacggcggtcccgttcctgcggaagttcgtggtgacccgggtgcgctcgctgttcgccggggtcgtgccgcgcatgctggacgtggtgcagcggccacagaagctgctcaccggcatcggcggcatgctgctgctgaccggactgttcgtgctctgcctggatgcctccatccgggcgttcagcggcccggacgtcccgcagctgagctacgcgagcatcgcggtggtcttcctcgccgggaacgcgctcggctcggccgccccgacgccgggcggcatgggcgcggtcgagggagccctgacgctgggcctgatcgcggtcgggctgccgaaggaggtcgcggcgcccgcggtgctgctgtaccgcgtgatgacgctgtggctgccggtgctgccggggtggatcgccttcaaccagctgacccgcaagggcgagctgtagccggaggtccgggccccggccgacccgcgaggcggagcggggcctgcggccaggcgccggccgacccgccgccacccgcatggac

SEQ ID NO: 2955 - DNA, 3901 bp, Unknown
  Kingdom: Bacteria, Phylum: Actinobacteria, Class: Actinobacteria, Order: Streptomycetales, Family: Streptomycetaceae, Genus: Streptomyces
gctccacgttcaacgtcggacacgggccgtacccgccggccccggccgccctgccctgggcgctgaagaaggagtcgctccagcggcagtccttctcggccgccaaggtcggcgaccgcgccgggcagaccgacggctcgcgccgggcgccgggggtcaagcccaacgcgaagcggcccaccggcaaggcgaccgtgcccgccgtgcccaagccggacctgcgctcgctgcccgcgtacggcatcaccgtcagcgacgggtacgaggaagtgcccggcaaggactacctcgccttcagcgccaacgtgtggaacgcgggcccggccaagctcgtcgtggacggcttccgctccccgggcaagaagctgatggacgcctaccagtacttctacgacgccgccggcaagcaggtcggctacaccccgaccggcaccatggagtgggacccgcgccccggccacgagcactggcacttcaccgacttcgccagctaccggctgctgaaggccgaccagaaggagtcggtgcgcagcggcaaggaggcgttctgcctggccaacaccgacgccgtcgactacacggtgaagaacgccaactggcacccggacaacaccgacctgtccaccgcgtgcggccaggagaactcgatctccgtccgcgaggtgctcgacgtcggctccggtgacacctacacccaggacctgcccggccagtccttcgacatcacgggcctgccgaacggcacgtactacatccaggtcctcgccaacccggagaaccggctcaaggagaccaaccacaacaacaacagcgcgctgcgcaaggtcgtcctcggcgggaagaagggcgcccgcaccgtgaaggtccccgcccatcacctggtggacgccaactagtcattaccagaggcgcgttgagcgactccgcaccgtacgttccgtcggccccgggaaggtgttcccggggccggcggcatgccgggagccaaacccgagttctcgccaactcacccgttcacccgtaaccccggccccaccccgccgcgactccgccgcgacgctcgccaccccgtcacgactgcgccggtcagggacacggccaggcgcacacccggtgcccggggcgccacggagggctcccctccgccacacgggtacggaaaaggggtttccggcggacaccgccgccgaccaggcaacgcatcggttactcatgcgtagtgcaggtgtggcgcaattcactcccctcagggggtggttctggaagcatctacgccaacgagatcgggccatacataccgccgcggggggagtggccatggggctgctcggcgatgagctggctttcgggcgggctctgaccgccccggagtacgagagcgtcatggccctgggacaccgcaaggagtacccggccgacaccccgatcctgaccgagggcgaccggaccggccatgtggtgatcctgctgcgcggctgggtgaccgtctcccacgtcaccgaccgcggcgccacccggctcatactcgggttacggggccccggcgaactcctgggggaaatggccgcgttggaccagcacccgcgcagcgccaccgtacgggccctcgggaccgtcgaggcgaccgtcatcggcggcgacgcgttccgccggttcctcgccacccacccccgggtcagcggactggtgatccggcagctgaccttccggctgcgcagcgccgaccaggagcgctccgccctcgcctccctgaccgtcctccagcgcctggcgagccggctcaccgagctctcccgtaccgctcccgccggcccctacgcgccgtccgcgcccggccccggacccaccggcgccgtcgtccacctcgcccaggacgaactggccgccaccgtcggagcgacccgtgaagcggtcgccaaggcgctgcggctgctgcgcacccagaagatcgtgcgcaccggtacgcgcatggtggagatcctcgaccccgcgctcctcgctctcctcgcggaggggcaccgggactgaaagctcctccccgccgtgtgtaaacggctacagacggccttcgtcccgggccggaagctgtacgggacggcaagcgcagagagagcgggggcacgcggtggagcacgacgcgttggatgccggtgaggcacgttacgagctggtcatcagcgtggacgccagacgctccgggcagtacagcgacgcggagaagccgcggatgcgggagcggatctaccgcgtcctggagaccgcgttcgcccaggccggggtgggccgggacgccgtccacatggaggaccgcggggacggcgtgctggtgtcggtcccgggccggatcgccgtgacgcggctgctcggcctgtggatggtggaggtccacgagaacctgcgtgaggagaaccgctccctcctcgtgccgctcgggctgcgggtggccatgcacgtcggtcccgtacgccacgacagccggggcatcagcgggcgtgcggtcgacctgacctgccggctcgccgactcggccgtcgcccggcagctgctggaccgcgaacaggccgatctggtgctcgccgtctccgactccctctacgtcgacgtggtctccgccgggggcaagttcatcgagcccgcgcgcttctcgccggcgcggctcgctctgaaggagggggaggtctccgcctggttccacctgccgggacggcccgcgcccggcatcgggccgatcgtcccggaggagccgagcgctccggtcggcggtccgcctgccgcaccggtcggcggtccggaggccgccctggccgcgatggacgccgcactggccgcccgggccgccgcggcggccggcaagcgggtcgacgacaacgacggggacgacgaggacgggcccgaccggtacagggcccagggcgacctgtccgtccaccggaacaacgtctaccagcagcccgtgcacatcggccgcgtcaccggcgacagccaccggaaggactgagcatggccgacgaagcagtggccgaccggcccgccgagcccgccgtccccaaggcgaaggacgcccgctccccggagcccccgccacgcggtggggcgcggggggacgacaaggccaaggacgctccggacggcgcggacgcgcccggctcctccgacgcctccgactcggccgacgccgaggccgccgagcgggagaaggagcgcgaacgcgccgcggaccgcttcaaggaccggacccgcgacccgctcgccgaggagcagggggaggaggagccgaccgacgccgccgccgccacccgcgccaggcggtccggacagaagctcctcgccagcggccgggacctcatcggaatcgaccgttccgacgtcgaccggctccacatcggcgatatcaacatcggcctcgacgcccggcgttccggcctctcgatgcgcggcggcccggtccccgaggaggagttgctgcggatccgccggacccacatcgagccggaggggtacgtacggctgcgccgggcgctggaggcccgtcggctgctggtcctcggtggtgctcccggcaccggccgggccagcaccgcgctggcgctcctggaggaggtcacccgcgacggcgaaggcgggcagaacgccgagcgggtgcgccgcgccgatccggagcgaggggtccgcgagctggccacgcaggtggccgacggggagggcggccacctgcgcggcaccgggtatctgctggagcccgcgctggaccggccgggcaccctgccgcccgacgggatggacctggaccagctggcctcggcgctggccgagcagggctcgtacgcggtggtcgtggtgagcgtcggctcggcggccaacccgctgctggccgggcggtacggcgcgatctgcccgcccg

SEQ ID NO: 2956 - DNA, 6051 bp, Unknown
  Kingdom: Bacteria, Phylum: Actinobacteria, Class: Actinobacteria, Order: Streptomycetales, Family: Streptomycetaceae, Genus: Streptomyces
ctcgccgccgtgcggaccgatccggtatccgcgccccgcttcggcgggtacggaccggtgaccgccgccgcctcgccgggcgggccggtcctgctcggccgttccgcggagggccggatccagctgcgtaccgccgcgggcaccgctgtacggtcccgggggccggtcgccctggacggagtcgccctccacctcggcgcggtgggtgggcggcccgcggtcgtggggttcgggccggatgccgcgccctgggtgtggcgtccgtagcggcggacacgttcggcccaactgccgccctataacgccgtgttatacccaaacgctagtaccccggcctcgtcgcgctccggcaccctgttgcccaccatcccccacggacacgcccaccccagcgtgtcgcgcgaaacgaggaatcatgcgtatatccaggctcgtgcccgctgccgccgccgcagcggcctgtgtcctcgccctcttcgcaccgtccgcctcggccgctcccgaggctccgctccaggactccccgcccccgaccacccagatcatcggcggcggctatgcccagaacgcgccctgggccgcccgcctcttctcgaacggcagagagacctgttcggcgacgatcatcgcgccgacctggatcctcaccgccaagcactgtgtcaccggcggcggtctgtcgttccgcatcggcagcctcgaccagcacagcggcggtgtggtcgccaacggcgcccagacctacacccacagctcggacctggccctcgtccggctggaccgctcggtgcaggccacctactcccgcctcggccagcccggctcggtgagcgtcggtcagagcgtccaggtctggggctggggcgccacctcgcagtgcggctccgaggccaactgccagtcccgctacctgaaggtggccaacgtgacggtcaccggcggctgcggtgacgcgtacggcggctcggcgatctgcgcccggcgcggcaacggcatcaccgccggcggcgactccggcggcccgatgacggcgaacggcatccaggtcggcgtcgcctccaccagcgaccggcagaccacgaccgcgtacacgaacgtcaccgcgtaccggtcgtggatccagtcggtcgcgggcgtctgaccgaccccaccggccgggacggcgggcacctgaccgacccgccgtccccgtgaaccgtagggcccccatacctcaccgccctgaggtaccggggccctacacccatgtccggatctcccagggctccgcacatggcgaagggccccgcacctctttcgaggtgcggggcccttcttgcagctcagtgagccaccaggtccaaggaccaagcagaaactacttgatgatcttggtgacctggccggcgcccacggtccggccaccctcacggatggcgaacttcaggccctcttccatggcgacgggctggatcagcgagacgtccatgagggtgttgtcacccggcatgaccatctcggtgccctcgggaagggtcacaacgcccgtcacgtccgtggtacggaagtagaactgcgggcggtagttgttgaagaacggggtgtgacggccaccctcgtccttcgacaggatgtaggactgcgcctggaactcggtgtgcggcgtgaccgagccgggcttgatgatgacctggccgcgctcgacgtcctcgcgcttgatgccacggaggagcagaccgacgttctcaccggcctggccctcgtcgagcagcttgcggaacatctcgatgccggtgaccgtggtggtggtcttctcggtcttgataccgacgatgtcgacggtctcgttgaccttcaggacaccacgctcgatgcggccggtgacgaccgtaccgcgaccggtgatcgtgaagacgtcctcgatcggcatgaggaacggcttctcgacgtcacgctcgggctgcgggatggactcgtcgacggccttcatcaggtcgaggacggtctggccccactccttgtcgccctcaagggccttgagcgccgagaccttgacgaccggaaggtcgtcgcccgggaactcgtactcggagagcagctcgcgaacctcgagctcgacgagctccaggatctcctcgtcgtccaccatgtcggccttgttcagggcgacgacgatgtaggggacgccgacctggcgggccaggaggacgtgctccttcgtctgcggcatcgggccgtcggtggccgcgaccacgaggatggcgccgtccatctgcgccgcacccgtgatcatgttcttgatgtagtccgcgtgaccggggcagtcgacgtgcgcgtagtgacgcgactccgtctggtactcgacgtgcgcgatggagatggtgataccgcgctggcgctcttcgggagccttgtcgatctggtcgaaggccgaggcctcgttcaggtccgggtacgcgtcgtgcagcaccttggtaatggcggccgtgagggtcgtcttaccgtggtcgatgtgaccgatggtgccgatgttgacgtgcggcttagtccgctcgaactttgccttcgccactggggtcctcctgagtggttctgtacgccttgcttcatcggcgccaggtgatctttgctggggtgccggcgccgggggcattccgcacagtgctgacgcgctgtgcggaatgcccgcccggctccggtgacaagcctaaagcgtgagctcgggagagttactcgcccttggccttcgcgatgatctcctcggcgacgttccgcggaacctcggcgtaggagtcgaactgcatcgagtagcttgcgcgacccgaggtcttgctgcggaggtctccgacgtagccgaacatctccgagaggggcacgaggcccttcacgacgcgagcgccgctgcgctcctccatggcctgaatctggccacggcgggagttgaggtcgccgatgacatcgcccatgtagtcctcgggcgtggtgacctcgacggccatcatcggctcaaggagcacgggagaggccttgcgggcaccctccttgaacgcctgcgaaccggcgatcttgaaggcgagctccgaggagtcgacctcgtggtaaccaccgtcgagaagggtgacgcggacgccgaccatctcgtaaccggccaggatgccgaactgcatggcttcctgagcacccgcgtccaccgagggaatgtactcccgggggatgcggccaccggtgaccttgttgacgaactcgtaggaggcgtcgccaccctcgatgggctcaagggcgatctgcaccttcgcgaactggccggtaccaccagtctgcttcttgtgcgtgtagtcgatgcgctcgacggccttgcggatcgtctcgcggtacgcgacctggggcttgccgacgttcgcctcgacgcggaactcgcgcttcatgcggtcgacgagcacctcgaggtgaagctcgcccataccaccgatgatggtctggccggtctcctcgtcggagtgcacctggaaggaggggtcctcctccgagaggcgctggatggcgacacccagcttctcctggtcacccttggacttcggctcgatggcgacctgaatgaccggcgccgggaagtccatggactccaggatgaccgggttcttgtcgtcgcacagcgtctcaccggtggtggtctgcttgagacccatgacggcgatgatgtcgccggcgcccaccgatgcgatctcctcacgcttgttcgcgtgcatgcggtagatcttgccgatgcgctccttcttgcccttgacggagttcagcaccgcggtgccggcctccaggcgaccggagtagatccggacgaaggtgagcttgcccaggtgcgggtcgctcgcgatcttgaacgccaggccggagaacggctcgtcgtccgagggcttgcgggcgatgaccttctccgggtccttcacgtcgtggccctcgatggcctcgacgtccaggggggaaggcaggtagcgcacgaccgcgtcgagcaggggctggacgcccttgttcttgaacgcggtgccacagaacacgggggtgacggtgaccgagtcggccgtgcccttcgacgccagcgtgatgcggcggatcgcctcgtgcagctgctcctgggtgggctcggtgccctccaggtacagctccatcatggcgtcgtcgttctcggccacggcctcgaggagcttcccgcgccactcggcggcggactcctggaggttgtccgggatctcgacgatgttgtacatctcgcccttggcggcctcttcggggtacacgaaggccttcatcgacacgaggtcgacgacgccggtgaagtccgcttcggcgccaatggggagctgcatgacgatcggggtcgcgccgaggcggtcgatgatcatctggacgcaacggaagaagtcggcaccggtgcggtcgagcttgttgacgaagcagatacgcggaacgccgtagcggtccgcctgacgccagacggtctcggactgcggctcgacgccggccacaccgtcgaacacggtgacggcaccgtcgaggacgcggagcgaacgctccacctcgacggtgaagtcgacgtgacccggggtgtcgatgatgttgatggtgtggtcaacatcgttgagcggccagtgacaggtcgtcgcggcggacgtgatcgtgatgccgcgctcctgctcctgctccatccagtccatcgtggcagcgccgtcgtggacttcaccgatcttgtagctcacaccggtgtagaagaggatccgctcagtggtggtcgtcttccccgcgtcgatgtgggccatgatcccaatgttgcggaccttggccaggtcaagcgaagtggtggccataaggctcaatcttctctcggtctcgatgggggtagcgactaccagcggtagtgcgcgaaggccttgttggactcggccatcttgtgggtgtcctcacgcttcttgaccgcagcgccgaggccgttggaggcgtcgagcagctcgttcatgaggcgttcggtcatggtcttctcgcggcgggcgcgggagtaaccgacgagccagcgcagagcgagggtggaggcgcgaccgggcttgacctcgatcggcacctggtaggtggcgccaccgacacggcgggacttgacctcgagcgagggcttgacgttctcaagcgcgcgcttcagcgtgatgaccgggtcgttgccggtcttctcgcggaggccttccatggcgccgtacacgatccgctcggcggtggaacgcttgccgtcgaggaggatcttgttgatcagcgaggtgacaagaggagagctgtagaccgggtcgatgatgaccgggcgcttcggggcggggcccttacgaggcattcttacttctccttcttggcgccgtagcggctgcgggcctgcttgcggttcttgacaccctgggtgtcaagggagccgcggatgatcttgtaacgaacacccggcaggtccttcacacggccaccacgcacgagcacgatggagtgctcctgcaggttgtgtccctcacccgggatgtaggccgtgacctcgatgccggaggtcagacgcacacgcgcgaccttacggagcgccgagttcggcttcttcggggtggtcgtgaacacacgcgtgcagacaccgcgacgctggggcgaaccctcgagcgcgggcgtcttgttcttctcgaccttgtcctgccggcccttccggaccagctgctggatcgtaggcactacttctccggtttctgtgtgccgttcgtgaaactaacctggaacatcgccgacccacgcggtcgggtgtgtcgaatactgcggactcccgccccaagggcagaagggcgcagattgcggtggctactgacggactcgcgatgcggttgaggacacgcaccggagcccaggcacaccccaggcacaaggcttgagcgtacctacctcacggagctgggtcaaaacaaatgctgtccacgccgacacgccggggcgtcggcacccttcggccgaaggcgatagccacccccgtcggcctcgtacgcgcaggtccgggccccgcggggcccg

SEQ ID NO: 2957 - DNA, 6105 bp, Unknown
  Kingdom: Bacteria, Phylum: Actinobacteria, Class: Actinobacteria, Order: Streptomycetales, Family: Streptomycetaceae, Genus: Streptomyces
ggtcggggtcggggtcggggtcgggtcaggcgagttccagcgggaaggctccccgatggccggtgcccgccccgtcggccgggcgcacctcgaactcgaggcagctccacacctcctggacgaacccggaccgctggtcccacagatccagcacgtcgtcctcgcccaccgagccccgataggcgtccttggccccccggaagcaggcgagacccccggagaggccccggccgggggccgggaagtagtcggagaaggcgcaggcgatacaggtctggatccggacgccgtccgggaggatccgctggacggcggtcagtgcggcgttgaagtcgcgctcggcgcgggccgattcgtacaccgcgccgtccaggtggagggcgaggtgaaggtccgggtcgacgcggcgcagggagagcaggcagctgagcgtggcgtgacggagcgcgcccgcgacgaggacgggcagcggcaggtcccactccagtacgcagtcggtgagcgcgccgtccgcgagagcgaacatcccgctctccggcggcatgccggcgaccggccccaggtcgtcgaagctctcgccctcgaagtcgacccctctgatccggatccggagctgccgcccgtccgtggtgagaacgacggcgtcggaacccttggtgtcccggtaccagccggcccacgactcatctgtcatgagcagggactgtagcccctgtcccggacggcttccgtaccaccctccacaggagctcaacccgcctggggttcgcgccacatggggtacatcggcgggccgtccggcaggtcgacggtgcggccgaggaagcggaatccgaggcgctcgtacaacgcccggctccgggcgctgctcgcctccagataggtcggcaacccctcccggtcgcagcgctccagctccactccgatcagctccgccccgatgccctctccctggcggtcgggggagacgccgatcatcagcagataggcgtgcgcgcggtcgtgcgggtgaacggcaccggtgagcctgcccaccagttcgcagcgctcgttgtcggggtcggcggtccgtcgcatcagggcgggcgtggggtcctcctcctcgggagccccggcgggcaccggcagccagagggccaccgcggcgccgtcctcggcgatgtcgatacgtccctcggcgagggcgacgtcgacgaagacgccgaggaacctgccgtggaccgcgcgccggtgcgcctcgtcggggaacacccagctgctgaccggatcgtggtggaacgcctcctccatgaccgcgacgaccagctcccggtcacgctgctccgcctgctgaatccgtatgcccatgaccgactgccgcccttccgtgctgctttcgctcaaccaacctccggaatcctagagttgatgcggtggcgccggtcacgcgaggtgggtcagctggtcctgcgggtgacgaattcggccagcgccagcaggtctccggccgcgctcgggtcggggaccgcccgggagaggtggtggaccgcgcgggccatccggtcggccgcgcagacctgggcccagtcccggccgccggcccggtccaccgcgtcggccgcccggttcacctcgccggaggtggtcatgggcccccggtagagcgcggcgagctcggcggcggccggggtgcccgaagtgagtgcggcgaccacgggcagggacttcttgtgggcggccaggtcggcgccgacgggcttgccggtgtggtccgggtcgccccagatgccgatcaggtcgtcgatgagctggaacgagaggcccgcctcccgcccgaaaccgtccatcgcccggaccgcccggtcctccgccccggcgtagagggctccgagcgcacaggcgcagccgagcagcgcgccggtcttggcggtggccatggcgaggcattcgtcgagcgtgacctcgtcggggccgcgctcttcgaaggcgcagtccgcctgctggcccgcgcacaactcgatgacgcaggaggagaggcgggccgcggcgcgcgctgcggccggatgcgtgtcctcggccagcagccgttgggccagggcgagcatggcgtcgccggtgatgatggcgtccgggatgccgaagaccgcccaggcggtgggccggtgcctccgggtggtgtcctcgtcgatgacgtcgtcgtggagcagggtgaagttgtgggcgagttcgacggcgacggcggccctgacggcgcgttccggatcgccgcccagcgcacgggcggcggccagcacgagggccggcctgatggccttgcccgcctggccggcggcaggggttccgtcggcgttctcccagccgaagtggtacatcgcgatgcggcgtatgccgccgggcagcgaccccacggccgatcgcagatgcgggtcgacgacggcacgggtgcgctccaggagcgcggcggcctcgtgcccttccgtcgctgcgtccgtactggtcatggtcacggtcactccctggggcgaggcgatgggtggtgcgggacctgggggcccgggcggcggctgccgcccgggcccccaggggtgaaacggggtcagtgccagcggctgacctcgacgttctccagcaccccgagggcgtccggtaccaggatggcggcggagtagtacgccgtcacgaggtaggagatgatcgcctgctcgtcgatccccatgaagcggaccgagaggctcggctcgatctcgtccgggataccggtctgctggaggccgatgacgccctgctcggcctcgccggtcctcatgcagatgatggacgtggtgcgggcgtcggagacggggatcttgttggacgggaagatcggcaccccgcgccaggcgggcacgtggtggccgccgatgtcgacgctctccgggacgagtccgcgccggttgcactcgcggccgaaggcggcgatggccttcgggtgggcgaggaagagcttggatccgcggcggcgggagaggagctcgtccatgtcgtccgggctgggcgccccgtcgtgcggctggatccgctgcccgtagtcgcagttgttgagcagtccgaactccctgttgttgatcagctcgtgctcctggcgctcacgcagcgcctcgaccgtgagccgcaactgctgctcggtctggttcatcggctggttgtagagatcggcgaccctgctgtgcaccttcagcaccgtctgggcgacgctcagttcgtactcgcgcggcgccgcgtcgtagtcgacgaaggtgtgcgggacgaccgcctcccccacatggccggcggagaggtcgatcgccgcctcgccgtagtggttggtccgctgttgcgggatggagagcagaccggcgagatggtcctgcagtgatgcggcgcgctccgcgaggttgtacacgtcggcacggctcagggtgagcagcgtgcacggggtgaccgcgcgggcggtgtactcccagacggcgtcgccgtcgatcaggctctggtcgccgaagtacgcgccgtcggcgaggaccccgagctccgtctcgtccccgtaggggcccgatccgaccttcgccaccttgccgtgcgccagcaggaagacccggtccgccgcgtcccccgacgcggcgagcacctcccccgcggccacgtcccgctgctcgcacctgcgggcgagctcggcgagcacctcctcgtccccgaactcccgcagggcgggcagctcccccagctccgcggggatcacggccacccggtccccggtctggacgaaggtcacccggccgtcgccgaccgaatagctgagccgacggttcacccggtacgtaccgccctgtacctgcacccacggcagcatcttcagcagccaccgtgaggtgatctcctgcatctgcggcgcggatttggtggttgtcgcgaggttccgcgcagctgccgtccccagactctgctgcggcggcgcctgcgtgtcgcgaacctcttcaccaacggacatctgacgtcctctcgatcttgggctgacctgcgtgcaaaagcctttcagcaggaggaccgggtcgccattacacaaaagagtgcgactaatccaccttcggtcggggcacgttgctcctcgtcgcccggcggaccgcttaatttgcatcctctatgcaaattatctacggtgagcccatgcggttgacgagattcaccgacgtggcactccgcgtcctcatgcgactggcggtcgccgagggccgggagccgccgaccacccgcgaggtggcggccaccatgcgggtcccgtacacgcacaccgcgaaggtcgtcgccaggcttcagcacctcggcctcctcgacgcccgtcgcggccggggcggcgggctcaccctgacctcggccggccactccgcgtcgatcggctcgctggtgcgggagctggaggggccggaggaggtcgtcgagtgcgagggcgacaccccctgcccactccgctccgcctgccggctgcgcggcgccctgcgcgaggcccaggaggccttctacgccacgctggacccgatcaccgtcaccgacctcgtcacctcgcccaccggcccactgctgctgggcatcggcagccgccccccgtccgactgaacccgccccggccgcgcggacgaacccacgcgccgacagggccacccttcgccactaaatatgcatctcacattccaataaggagctccgtcatgctctccgaccggtccaccgccactgtccgcgccacccttcccgccgtcggcgcggccatcggggacatcgccgacctcttctacgagaagctcttcgccgcccaccccgagttgctgcggaacctgttcaaccggggcaaccaggcctccggcgaccagcggcgggcgctcgcgggctccatcgccgccttcgcgacccagctggtcgagcggcccggcacccggcccgacgtgatgctggaccggatcgcccacaagcacacctcgctcggagtgaccccggagcagtacgaggtggtgcacacccatctgttcgcggccatcgccgacgtcctgggcgacgccgtcaccccggaggtcgccgccgcctgggacgaggtctactggctgatggcgggctccctgatcgccgcggaggagcgcctctacgcgcagcagggcgtcctggcgggcgatgtgtggcacacctgggaggtgaccgcccgggtcgaggagaccgaggacgtcgccaccttcctgctgcgtcccgccgaggacacgtccccgcccgccttccggcccggccagtacgtctccgtccaggtcgaactcccggacggcgcccgccagatacgccagtacagcctctccagcgcccccggttcgcgactgcggtcgatcaccgtgaagcgcgtgcgcggccagggcacgcccgacggcgaggtctcccggcacctgcacgagcacacccgcgcgggcgacctgctgcgcgtctcggtcccctacggggacctggtgctcgaccatccggacgcgccgctgctgctggcctcggcgggcatcggctgcacccccatgctgtcgatgctggaacacctggcccaggagggccaccgcggtccggtcaccgtcgtgcacggcgaccgctcaccggccgaccacgccctgcgcaccgaccacgtccggctcacggagaagctccccgacgcggaggcgcacttctggtacgaggtcccggaggccggacagccggcgaaccgcaccggcctcgtcgacctggacggcatcgccgtacgaccggggacgcacgcctatctgtgcggcccgctcccgttcatgcgggccgtcagggcccagttgctggagtcgggggtccggccggccgacgtccactacgaggtgttcggcccggacctctggctggccccttcctgaaacgccggagaggcgacaatgggcgggtgaacagcccgccccgcctcgacgccctcctgcggccccgggtgccctccccgctgcgggaggtccgcgacgaacgcttcgcgcgccacggcgtgaggctgctcctcaaacgggacgatctgatccaccccgacctgccgggcaacaagtggcgcaaactcgtcctcaacctggaggccgccgc

SEQ ID NO: 2958 - DNA, 764 bp, Unknown
  Kingdom: Bacteria, Phylum: Actinobacteria, Class: Actinobacteria, Order: Streptomycetales, Family: Streptomycetaceae, Genus: Streptomyces
gggcggcacggcggcacggctacgccctgctgatcgccgcctcgctggacggcgggccggagagtctggtggcgaaggtcgccgggcgggtcgacgggttcgccgtactggcgcagaccgttccgaccgaggacctggaagtgatatcgcgccggttgcccgtggtgatgctcgcgggaccgcgcgagatcgaccacatggaccacatcgtggtggccaacgccgagggcgaacgcgaactgacccgccacctgatcgaggaccacgggctgcgcaggctggcgttcatcggcggcgaggagaactcaccggacgcacaggcccggttccggggcttccaggaggggtgccgggacgcgggccttccggtgccctcccggccggagctgcgtgccgggatgatgacgcaggccgagggcgcgctggcggcgggcaccctgctggaccggtcggagggtacgggggtggagcggccggaggcgatgctgttcgccaacgaccagatggcggtcggcgcactccaggcactggagcggcgcggggtgcgggtgccggacgacatcgccgtgaccgggttcgacgggatcccgctgagccggatcgtccgcccacccctgacgaccgtccggcagccgatccggcggctgggcgaacaggcggtggagctgctggtgcagcgcctggcggacccgagccgcgcgccggtctcgctggagctgccggtctccgtcacccgccgcgcgagctgcggctgcggctgagcc

SEQ ID NO: 2959 - DNA, 2106 bp, Unknown
  Kingdom: Bacteria, Phylum: Actinobacteria, Class: Actinobacteria, Order: Streptomycetales, Family: Streptomycetaceae, Genus: Streptomyces
ggcccggcgggtcgatgccggaccccggaggcagcggctccccggcctcgtacgcgccggtgaccacctccagccggctcagcgtcttgtcccgggcctgttcgaccgtctgccgggtgaccgccgtgtgcaccaggaagccgaggagggcggccagggtgcagcacatgacggtcaggaagaccgcggacttccaggtgaggctcgcggtccaggagggcgagcggaggacgcgccgcctcatcgcgtccccgcggaggacgcggtggatgccggggagggcttccgggccttccggtgctcgggcgtccgcaggatctcgtcccgggtgggcagcatcgcgcgctgccggtcgtcccaggaccacgcggtgcggtattcgtaccccgggatcaccgagggagcccgcatgatcaggtcccggccggccagctccacgctgatgacggcgtcgtaggtggacatgacccggatcagccggtccgcgtccggcatgtagacgcgcacggcgagctgccggtcgggcatccggatgccgagcaccagttcgtccctgccgtcgccggtcaggtcgcggtagtacggcgggaggaccgggcagtcgtccggggtggtccggcacgccccgatctgccggaccgtctcgtccggcagctcgtccaggccgctgtcccggtccgtcttcgccttcagtccggcctgcgccacggtcaccggatccagccgccgcacgtcgccgccggtcacccggatgccggggatgcgcgcggtctcgccctcgccgtagtcgtacggggcggaggaggcgggcggcagttccggccagaggctcttgggctcgacggccgacggcgcgtcccccgcgctcttcagcccgcctgccgcgccgcagccggacagcagggtgagcgcggcgagggcgaacacggcggtacgggtcgccgccgggacgcggtgcgggcgcaaggctcgcctcctcttcgacgacgacagcggtctcacaccctaatcggacgaccgcgcgcaatgccgacttcgtacccctgtgtgacgttacgcggccccgcggtcgcgggaccacggggccggggcggtcaggagggccgccggatcagcgctggtacgggttctgcccgggaggcgtgaagccgggctgcggggcctgcccgtgggcgttgccgtcctgcccggccgcggcctgggcgagcagccggtccgcctcctccgtgggtatctgccgctccccgccgcagaacgtgcactgcgtggcgtacttcgtcgagaacgggaacagcggcacgaagaacagcgtgaacttcgtgacccgcttacgcagggtgtgcgccgccggattgccgcaccagccgcacaccatcgtcaggatggccagctggtggaggtagcccttggtaccgaaaatgatcatgccgtggttcctttccccgtcccccggagtgcctgtcggcacagcgccaggagcttctcgtcctcgtggatgtcatgactgccgtacccgccgtccatcgcgttgtgacggcgtacggaggcgagctcgctccgcaggacgtgtgctgcggccgacccctccgggaccgaccccatccgtgctacgcattctgccacccggacccgcacatgacggctctgctcccacccggcgagcagtgcctcgacggtctcctgcgaccggccggacacctcccacagcgcgatcgccgcgtcgacccgcagccacagctcctcgtgcgccagcagcccgcgcagccggggcgcgaccaccgcggcgcgcgtcccgagggctcccagcgccaccgccgccgcccgccggtcgtggacatggtgcgactggaggccctcgatcagcaccggcagcaccgcgtcggcgtccccggagatcgcccacagcgcctcggccgcctccgtcgcggaggccgtccccgggcggcggatcagcgcccgcagctccgggacggcctcccgcgccgcgggtccgaacgaacccagcgcccgcaacgccgccgtacgcagccactcgccccggtagtccggcgcgccgcgcagcacccgcagcacctcgggggtcgcctcgcccgcccgcagcccggt

SEQ ID NO: 2960 - DNA, 4775 bp, Unknown
  Kingdom: Bacteria, Phylum: Actinobacteria, Class: Actinobacteria, Order: Streptomycetales, Family: Streptomycetaceae, Genus: Streptomyces
tcttcgtggcgtgcgcctcacccagcgcaccgccgaagatccggaagtcgtgcgcgtacacgaagaccgtccggccctcgaccgtcccccaccccgtgatcacaccatccgtgtacggcctcttcgcctccaggccgaaccccgtcgcccggtgccggcgcaactgctcgacctccttgaacgaacccggatccagcaacagctcgatacgctcccgcgcggtcagcttccccttggcatgctgcgcctcggtcgcccgctcactcggtccgcgccgcgcctgctcgcgcagggccagcagttcggccacccggcctcgggcgtcgttctgctcaccctgggtttcgtccacaacggtcatgtactgaccctacgaacaccgacccagaaatcgtgccgtcgactccgtacagtctcctgcccggtttcgtggtgggagtgaacagaaccgcggcaccgtgcacgcgatccaccagcgaaacgccgcgccgctctgtatgaactctacaaaggcgaggatgtgcgctgggccacaggcgagggaacggaacgtgaagccagtccgggggtcccggccctccccgcagtatgccgcagggctcgcgcaccgcacgggaggggcggccccggtcgcccggagccgcccctcccccgtatcggatctcctctgtcaacctccgcagtggaagcgggcgttgccccagtcggcgtggtcgttgccgttgccgtcgccgccgtcctgcacgaccagctcgacgtacttcgcgccgctgacgtcggccgtgagtttccaggcggggtcggccgcacccagcacgggagaggccaccttctccgtggagtcggcggtgaccgagaaccgcacagtgccccgggtggcctgggcgtcgtccacgcccacctcggcggtgaaggaggtgcacttcccgcccaggtagtagcggatcctcgccggggcgtgcgtgcccaggcccttggcgtaggtgacgccgccgatcttcagggggccgccgtcaccggccccggactccccgttggcccggtcgcgctcgaccgggccccagccgttctgcgaggcggtccagtcgaggtcgccggcccagctgtccgcggtgggcggcggcgggagcgtacggacggaggttcccgcgccgagcgcccgggcggcacccccgacggtgtacgtggcctccgcgtccagcgcgtacgtgccgtagggggcgtcgaccggcggggtgacccgccagctgccggtggccttcgcgcccggggcgaccgagtcgaaggcgaccgcacccacgggctcggcctgccagccctcggggacggtcagcgcgagcttcacaccggtggcggcggtcgtctcgtcgttgccgaaggtcgccttgaccgtgttcggggctcccggctccagggtctcggcatcggcggccacgtcgagcgtgccgcagacggcctcctgcccggcgggggccggtccgaggtcggtcacggtgaagccgtcgagcacgaagtccgcgccctcgggtgctccgggcagcttgcgcagcccggtccaggtgtcgccgcagcccgcggtgagcgtccggctgaactgcccggtggtgcgctgctgcccgatcggggtggcccgggtctcggtcgaggaggccgtgccgtcggcgacccggtcgtagccctccacccagctgtaggccccggcgtggctggactggtagtcgaagtcgacccggtagcggtggccgtccttcatcgggacggtccagggcgcggtgcggtagacgaggccggtgttctcctcgtgggccttcagggactccttgcccccgagcacgtcgtcgatcagctttccgttccagccggactgggtgtacggggcgtggagctgcgaaatgctggtgcgggggtcggtggagccgcccgcgtcgcccttgaggaagggtccccagccctggtcgacggcctcgaagtcctcgtacgccaccgtcccggtgcgggtcgcgggtgcgttctcgacgatccgtacgtcgtcggcgcggaccttcgccgtgctgcctcccgccgcctcgatgcggagggtggcgcggccgttcgcgggggcggtgaagttgaccttggcgcgctggaaggacgtaccgtgccagtcggacgcggcgacgaagtcctcggccgtggaacgctcgacggccaccgacgcacccccggcgctcagcaccgtacggcggctctcgccgggctccacctcgatcagggcggaggcggtgtagcgcttgccgggcttgagtccggtgacggtctgggagagcgcggccgggcccgagccggagagttcggcgctgttgcggccctgctcgtcggtgtcgcggacgacggtgccggtcctcgtccagcccttcaggtcacggtcgttgaagccggggtccttcagcccggtcccctttccccagtcggccgacgcctccttcggcgcccggtcggggtagaggacgtaggcctggccggcggtggcggtcagcgtgatcctcccggcctcgggccggacggtggtgaccttctcgcggccgttgtcggtcagcttgtagagggtgtacgcacccttgccgggcacctcccaggtgctggatccgccggtctcgctgtagtggtagagcttcttgccgccgtcccacggcagcaggtagtcggtgccgctgagcaccttgcggccctggtcgtagaaggtccgctcgccgttctcgaccgtgccgcgcaccccgccggtgaaggtgatgtcgttgccgtcccagcgggtgatccgctgctgctggaggtacttcgcgggcaggttcttctgccagatgttggcggtgaaggcgttccagtcggtctcgccggtccagccctcgaagtcctccagggcggtctggccgaggaccgggtggttgttccagatgtccttctcgccgttgcggatgaaccggatgatctgcgagttcaggcccttgttggtggccccgccgtagttcaggtcgttggcccagtgcgaccagagcgaggcgcgctcgaacttgtcggcccattcggtgccgacggtccagccctgcttctggacggcctggatcgtcttgtcggcgatccagccgtggctgtagtagacgtcgatgtagaggaagtcgaggttctcgtcggtctcgtcacgcagttgctggaagcgcttctccaggtcgccgctgttgatgtcgcggcgctggtcgatgtagtagctctggttgagccagttccagccgggcttggtcttgtcgacgagctgctcggagaaggcgttggcctccgggtaggactcggtggcgttcacgtggacgccgaagtcggcaccccacttctcgccgtccttgaggagggtgttgaggtccttcagcccgccggcccgcttgttgtagttgccgccgtagtccgggtgggcggagtcgtggccctcggagccgtaccccttgaggacggcgagctgaccgaggccgtcggtggtcttcgagatccgcttgacgtcgtcgagggtgcgcaggaacgggtgggtggcctggctggcgaagttgaacggaatgtgggtgacgacccgcttcgcggtgtcctcgctgcccggcgcggtgacgccgatggtgcggaaggcgatggccccgtcctgccagtcgacggctttgtcgccgttggcgtcgggggtgacgacgaccttggcccacggcaggttctcgccgctctcgggcttcggcgcgccctcgccccggtaggtccactggccggaccagacgccgacccggacaccgccgccctcctcggtgcgcgcctggtgccagaagcgggcgtcgtcgccaccggtggccccggcgggcttgtcgtacgaggagttggactcgacggcggcggcgagcgagccgttgttgaggatcgcgtagctggccccgacgggagcggtgtcgggcttcgtctccccggtgaccctgccgaagacgtcggcggtgcgggtggagtccgggtcgagcttcgtgaacgcggtggcggccccggcctcggtggagccgacggagatcaggtcgtgcccgggtatgtcgatggtcccgacccggaacgccgcggtgtcgcggacggcggtcaccttgaacatggtgacacgcccggagacggtgagcgaggcgtcgatctcgacgcccgggaggtcctcgaagacgagggtgtagcgggccgccgctcgggtgaccttcggcgagcccttgagcttcaccgggtgggcggtcccgttgagggtgacggcggtgaccggccgggtcgccgccgccgaacggggtgagacccggatcgccgaccgcgtcgtcgccaagatcgccgcccaggcggcgaaggaagcggtcgacgagccacccgcggacggggcgtcgccccgtgccacggtcaccgtgcaccgtgacgccgcccgggtacgcgtcagtctggagctcggctaccccagcgacatcggccgccagtgcggcgccgtacgccgccgggtcgtccagcgggtcaaggcgctggcaggaatggaggtgcccgaggtggccgtgcaggtcgaacggctccaccccgccggagccgcacaggggaggatccgatgaccgagcccggtgaaccgaccggttccacccggcggatgcccaccgcggaacagggcgacgacaccacgcgcacgccctacccggacgcttcggccgacgccctgttccagggtggggaccggttcgcgggcgtcggccgaagcgtccgggtag

SEQ ID NO: 2961 - DNA, 1799 bp, Unknown
  Kingdom: Bacteria, Phylum: Actinobacteria, Class: Actinobacteria, Order: Streptomycetales, Family: Streptomycetaceae, Genus: Streptomyces
gcgtagtaggggtgcatcagttcggccttgtactccttgaccatgtgcgtgcgcatggcttcggggtcgacggcgtcggcgatctggcggcggaagatgacgttggccgcgccctccgcgcccatcacggcgatctcgttggtgggccaggcgtaggtgagatcggccccgatggactgggagtccatgacgatgtaggcacccccgtaggccttgcggaggatgagcgagatcctgggcacggtggcgttgcagtaggcgtagagcagcttcgcgccgtggcggatgatcccgccgtgctcctggtcgacgcccggcaggaagccggggacgtcgaccagggtcaccagcggaatgttgaacgcgtcgcaggtctggacgaagcgtgcggccttctcggacgagtgaatgtccaggacccctgccagtgcgaggggttgactggcgacgatgccgacgacctggccgtcgaggcgggccatcgcgcagatgatgttgcgggcccagcgctcgtggatctccaggtagtcgccgtcgtcgacgagctcctcgatcaccttgtgcatgtcgtacgggcggttgccgtcggccgggaccaggtccagcaggacgtcgccgcgccggtccgcggggtcgtcactctcgaccgtcggcgggttctcacggttgttggagggcagcatcccgatgaggtagcggacctccgcgatgcacgtctcctcgtcgtcgtacgcgaagtgcgccacccctgacgtctcggcgtggacgtccgctccgccgagaccgttctgggtgatctcctcgccggtgaccgccttcaccacgtccggaccggtgatgaacatctgcgacgtctcacggaccatgaacacgaagtcggtcagcgccggactgtaggccgcgcctcccgcgcacgggccgagcatcacgctgatctgcgggatgacaccggacgcccgggtgttgcgctggaagatgccgccgtagccggcgagcgcggagacaccctcctggatacgggcgcccgcgccgtcgttcagcgacaccagcggggcaccggccgagatggccatgtccatgatcttgtggatcttcgtggcgtgcgcctcacccagcgcaccgccgaagatccggaagtcgtgcgcgtacacgaagaccgtccggccctcgaccgtcccccaacccgtgatcacaccatccgtgtacggcctcttcgcctccaggccgaaccccgtcgcccggtgccggcgcaactgctcgacctccttgaacgaacccggatccagcaacagctcgatacgctcccgcgcggtcagcttccccttggcatgctgcgcctcggtcgcccgctcactcggtccgcgcagtgcttcggcacggatcacggcgagttcggtgatcgcctcctgcgtcatggacggccccctcgtgttcaccggccgggtcagcacccggccgtgctgcttctggacacccgcgtgccgacgtagtcgcacagggcgtccagcgcccggcgtccggcgcacgcgggcaggtcgtgcagggcgctccgggccagggccaggcgctcccgcaggtgctgttcggcggcggcgggcgccgcggaggaacgaaacagctccagcgcgcgccgtcgccggtccaggtcgtccagcgggccggcttccagcaggtcccgcagctccgcgtcggccggtccggtgccggagacagccaggaggaccggcaggctgagcactccggcggccaggtccttgccctgttccttgccggtctgctcggccggcgcgaccaggtcg

SEQ ID NO: 2962 - DNA, 25136 bp, Unknown
  Kingdom: Bacteria, Phylum: Actinobacteria, Class: Actinobacteria, Order: Streptomycetales, Family: Streptomycetaceae, Genus: Streptomyces
cccctgcgcagcgttccaccgccccctaccccgccctggctcaccttcacgacctggagcacgccctcaccgaactcgtcagtccgctcaaccacgccccgtactcggcgtccgcaaacgcgtaagctcggagtcagccctgaccccgcgcgaactcagccgcaccctcaccgagtccacggacgcgtcggcggagcgaacgcgacgaactcgcgtcccccgccgttcaccggtagttgcgacggcgacttcggtacaggtgacaccaaggcacgcaaggcggcggcttcaccgctccttcattgctgacaggcactcgaccggcgggaagagccccttgcgcaggtcggacgctgacgtactccagcctccccccaggacggatatgcccgacgcggcccagacgcccttcatcgacccggactccgactacccgtgctgttggttctgcccagccctgcggttcccgcgtacagggttcctcgtcgccgaccgccccagccggctctggccgttcgacgcctcggacggctaccggtacacggtcgacgacccgatcccggtctgtgttcatccggggcggctgggcgtagcgccagagcggaccgccccgccctccgccgtcgaaccgacgactagcccagagttgaccgtgaagcaccgccgatggaagcgacgttgagcgccacggtgcacaccacacaccaactggcctacttcctccgccagtccggccgcctggcctgagaggggctgccgcgtcagggctttctggcgactgctccgtacatggcgatgtcgcggccgtcgatgccgttctgttcaggaccggggcgccaggagtgcacctgggtgacccccggctcctgcagttccaggccgtcgaagagcgaggtggcggtggcgcgatcgcgcaggacgaagggcatgccctgctggcggtactcctgggcgacccggttgacctcctcgggcgcgaagtccgcggtgccgatggtcatcgccaggtagcttccggacggcagtggatccagcagcctggcgatcagacgccggtcgtcgggcggcaggatgaagtgcatgatgccgatcaccatgaggccgacgggccggcccaggtcgatcagctcctggaactcggggctgtccaggatggcgtcggggtcgtgcatgttcgcgtccacgtaggcggtggcgccctcgggtgagctctgcaggagagcgcgggcgtgagcgaggacgatggggtcgttgtcgacgtagaccacgtgcgattccggggccgcctcctgcacgatctcgtgcaggttcggtgacgtcggaagaccggttccgacgtcgaggaactggcggatgccccgttcctctgccaggaagtgcgcggtgcggtgcatgaaccggcggttctccagcatgtgcacgggcagggccggccagtgcctggccatggcgtcgcccgcttccacatcaacggggtagtggtccttgccacccaggatgtagtcgtacacccgggcggagtgggcccgtggggtcgccagtccgctctgacggtcatggggcaggttcatgcggagcctttcgtccggggacgggcgttctcgacggtatagaggcgctgttccgggcgcaaacgatgaggttcgcgatgcgggtggtcatgagtccggccgggcttgcagggcgatgatggcgatgtcgtcccggcggtggtggaggggcggcagaaggccgcggatcacggagtgcagcggcaggttccggcgggccagggcgtcggcgcgtgtgcgcagccgttggaggttgtcgccgatgtcggtgtccggcgtctccaccagcccgtcggtgtagaacaccaggatgtcgcccgcgtgcaggtccgcgcggagggtggtgcgggtgaggtcgtcggtgacgcacaggggcgggtccggggccgtgaggccgtgcagataccgcgacggcgcgtccgccgggatcagcagcggcggcgggtgcccggcgttggacagggcgatgtgccagccgccgtacggccgccggcgcaggaccgcgtgcaccgccgtgaccatcgacgggctgtcgagggcctgcacgatgcggtcgagtcggctcagggtgaccgcagggctggcggccgggccgctgtcgtacgcgagcccccgcaggatgctgttgacccgtcccatcgccatggccgcgtcgaggtcgtgccccgcgatgtcaccgatggacagagcgagagcgtcggcggagagtcggacggcgtcgtaccagtccccaccgacctccgccgccgagtccgccggatgatagagcgcggtgatcgtgagaccgccgatggacggcggggccgccaggaagctctgctgcagcgcgagcgccttgccacggatgctctgcagctccatcgtccggcgcagcggtccgctcatctgctggaagacatcccgcagcagcgagaggtcggcctcgtccgggggagggttgccccggcaggtcgcaatcgtcgccagcgcgacggtccggccgtccaccaccacgggcaccaacgccacgccagtcgccccggactcccgcagccaccgcacggaaacatccgaaagcccgtccccgggaggcccggcaggggggaagaccaagagccgagcctcctggctgtcgatcgcccgctgggcgaccggacccagcacaaaatcggcgtccagccgggggagggaaggcagaccgggggcgagccccacacgctccggcgatgtggcggccggtgcgtcggcgggccgcacaccggcctcgacgccgtccacgacgcgaaagatggccacagcatcagcgagctcgggaacaacggccgccgccgtcgtcagaaaggcctccgaaagatcgcgggccgcgggcaccgccgccatacgcgccagcaacttctcccgcatacgggctcgccagtgctcctccgcgtcggtggccgtgccgacgaactccacctcaccgtcctcgtcgacgacgggcgcagcgatgatcttgacgtggcggaagcggtcgacggcgccttcgacccgcaccctgacgatcgtgtcgagagaagaccgctgctgcgtggccctgcgccacgcgcgctggaaccagtcccggtccttgggatgcacggcgtccatccacgaggaatcactaccgggagtccacagcttctcggcgatcccgcccccggacaacacggtgacgacaccgccgggcgacatcacccacaccgactgcggcacggctcccatgagcgcctggtaccgcctgaggagacgctcctcgttcacggccgtcccctccgccgggcagacgagcgcgacggccgggacagcggcacagcgtccccggccgccggccctgatctgctccgcccgccgcactctccacacggcgccagtggatcatcaccactcatgatccgatgatccctcgcatccgggacaaaagcacacccgggcgcttcgagcgaccaccgagcccccagcggccgacggcgctgcggagtgctccgtcggccgggctacgacggcctgccgattccggccccccgagctgcctgcaacgcagctgaaggcgcggggaagggtgcgctgagctggggttatcgaccgaactggccccagggggccggcttcggtgcgtcgagtcgggtcgttggagacgtgactgatccgtcacctgggcgtggaggtcaggtgccggggccgggtgagtgcctgcgccgacggtgcccggcgtggtggccccatgctctgcgggtcgcggaccggtttcatctgcggcagggcctcggctcggccgtggtcgacgagctgacagggcgttccctgacttccaaggatgaggagagcctcgatcaggaatctgccgcacgcgaccaaatgccctcggcgctgcccgggttgctccacgtcgtgccgcaacggacctgtgaccgtaacccgcttcgtcccgttgtgaccgcacctcgtcgccgggatcttcggtgtcctcccgtcagggtcttggcctcgcgggctcgcgtccctaccttgagagcagaatatgagcctggctcacattaaggagcacgcgatggtcatcgttcaacccttgcggcgcagactcggttcggtcacggtcgtgtcgctgctgttcgccgtgctggccctggtgctcgggccggtgcccagctccgcggcgcagtcgaactggtgggagccgtcggcgcggcccgcacccgactcgcagatcggtgtcacgggcgaacccttcaagggcgccgacgcccagggccgcgtccggggcttcgtcgacgcccacgaccacatcatgtccaacgagggcttcggcggccggctgatctgcggcaagccgtactcggagcagggcgtgaccgacgcgctcaaggactgccccgagcactaccccgacggttccctcgccgtcttcgacatgatcaccaagggtggcgacggcaggcacgaccccgtcggatggcccacgttcaaggactggccggcccacgactcgctgacccaccagcagaactactacgcctggatcgagcgggcctggcgcggcggtcagcgggtgttggtcaacgacctggtcaccaacggtgtgatctgctcggtgtacttcttcaaggaccgtggctgcgacgagatggacgccatccgtctggaggcgaagaagacgtacgagatgcaggactacatcgacaggatgtacggcggcccgggcaagggcttcttccgtatcgtcaccagcagtgcgcaggcccggcaggtcgtcgagcagggcaagttggccgtcgtcctgggcgtggagacctccgagccgttcggctgcaagcagatcctggacgtcgcgcagtgcagcagggaggacatcgacaagggcctggacgagctgaaggaactgggtgtcagcagcatgttcctgtgccacaagttcgacaacgccctgtgcggcgtgcgctacgactccggtgcgctcggcacggccatcaacgtgggccagttcctgtcgacgggcacgttctggaagacggagaactgccgaggaccgcagcacgacaaccccatcggcaacgcggcagcgccgcaggcggagaagcagctcccgcaaggcgtggacgtccccgcgtacgacacggacgcgcagtgcaacacccgcgggttgaccgacctgggcgcgtacgcggtgcgcggcatgatgaagcgcagcatgatgctggagctcgaccacatgagcgtcaaggccgcaggccgggccttcgacatcctggagtccgagtcgtactcgggcgtcatctcctcgcacagctggatggacctgggctggaccgaacgcctgtacaagctaggcgggttcgccgcgcagtacatgggcgcctccgaggggttcatcaaggaggccgagcgcacgcgggtgctgcgcgagaagtacaaggtgggctacggctacggcaccgacatgaacggcgtcggcggctggccggccccccgcggtgcggacgcgccgaacccggtgaagtaccccttccgcagtacggacggcggctcggtcgtcgacaagctgaccaccggatcgcgcacgtgggacttcaacaccgccggtggcgcccactacggcatggtcccggactggatcgaggacatccggagggtcggcggccaggaggtcgtcgacgaactgttcacgggtgccgagtcctacctgcgcacctgggccggttccgaaagccacaggcccggggagaacctcgccaagggggcatccgccacggcgtcctcctcggagtggtggaaccccttcgagaacttcaagcccgacagggcggtggacggcgacacgggcacccgctgggccagcgagtggaaggacgaccagtggctgcggatcgatctcggatcggcgaagcaggtcggacgcgtcaccgtcgactgggagggggcgtacgcggagtcctaccacgtcgaactgtcggaggacggctccaactggaaggcggtgtggtccaccgacgtcggtgacggcggtctggacacggctcgcttcgcgccggcccggacgcgctacgtacgcgtgaaagggctgacgcgcggtaccccgtggggctactcgctgcgcgaggtcggagtccacgccgccggctgagtcggtacagcacgggccggccggatcggcgctcctgcccgatccggcctgctgcggcgattcctgcctggtccgcccggtccgacccgccttcgaggaccggccggtcccctcaccttcaaggatgcgcgtgatcacctacgactccgcagcccgcctctggctgctgtgcacgcccggcacctcctacgccttccgcctcgacgccgacgacgtaccccggcacgtccactggggccgaccgctgagcctggagcaggccgtcgccgtcgcggccgacctgcccgccgaggaccccggcggcgacgacccggggggagaggagtacgcggtcgagggcggtctgcgcttcggggcgccgtcgctgaccgtccggttcgccgacggggtccgcggcttcgcgtggcggttcgtctcgcactcggtcgaggacggccggctcacgctgtccttcaccgaccgcgtccgctgcctctccctcgacctgaactaccggatccgggacggccacgaccagatcgagcgttgggccgtcctcaccgcgggcgagcaggtggacgtcctgcgccttgactccgccgcctggacgctgcccgcccgcgacgactacagggtcagccacgtggtgggggagtggggccgggagttccagctccggcgcgatcctgtgcccgtcggggagagcgtgttcaccagccgcctgggcatcacgggccagcacgcggggccctggctgatgctcgacgcccgagatgccgccgaggagcacggcgaggtgtggagcgcggctctcgcctggagcggcagtcgccgcatcactgtgcgccgcgatccgtacggccgtgcctcctggaccggcgggttcggccacgagggtctggtctggaagctggctgccggcgagcacctggagacccccgtcttcaccggcctctacgcccccgacggcttcggcggcaccagtcgccgctggcacgccttcgtcgaagaggaggtgctgcccgcccgcccggccgaacgcccgctgatcttcaactcgtgggaggcgaccgagttcgacatcagtgagatgcagcagagacaactggccggcctggccgcgggcctcggcgtcgaggtgttcgtcgtggacgacgcctggttcggcgctcgtaccagcgatgcggccgggctcggcgactggtggcccaaccccgaccggttcccccagggcctcggtccgctcgccgaccacgtacgcgccctgggcatgggcttcggtctgtgggtcgagcccgaggcggtcaaccccgacagcgacctcttccgcagccaccccgactggatcctgagccaggacggccgcacccgcacgcagcgtcgcaaccagcacgtactgaacttcgcccggcgcgacgtccgtgagtgggcggtcgaatggctggtcaggaccgtcaccgagctggacgtggccttcctgaaatgggacatgaaccggcctttcagcgaggcgggacagcccggcgccaccgaccccgatcgtgtgtggatcgagcacacacgtggggtctacgaggtgatggaccggctgcacgccgcccgcccgggcctgtatctggagtcctgcgcgggcggtggcggacgggccgacctcggtgtcctttcccgcgccgaccagatctgggcgtcggacaacacggacgctgccgaccgggtcgcgatccagcacggccatggacagctgctgcccgcccggaccatgggcgcctgggtcaccgacagcccgaacagccacaccgcccgcgcgacctcgatccgctaccgcttccacgtatcgatggccggggccctcggcatcggcggcgacctgcggaactggagcgaggaggacctggcgtgggcccgcatgctggtggggcagtacaagcggatccggcccgtggtgcacggcggcgtccagtaccgcctcgatcacgacgccgtgcagtacgtcaccagggacgaggtcgtcgtcttccagtaccagccgtccgcgctgacccgcaccactgcccggacccggctgaagggcctcgaccccgacgcccgctaccgggacgaggacaccggcgccgtccacgagggcgccgtcctgctgagccacggccttccgccgctgctgcccttcgactggacgagcgagctcgtccacctcaggagactgccccgatgagcctggcccccgagcagcgcgagcccgtcgagtcgccggagcgctccgaggccctcgccgagcccgtccgccgggtcggccctggctgggtcgccctgtatgtcctggccaacgtcggggtgttcatcccgatgcacgtgccgaccacgttcctgatgcccgagcagatcgcacagatcgacccggcgggcaaagtcggcagctatgcctgggtcagcatggtgggcgcgatctcgggcatcgtcatcgcacccctggccggcgcgctcagcgaccgcaccaccagccggttcggccgccgccgtccgtggctgctcgcgggctcgctggtctgcgtggcgacgctggtcttcaccggcctccagacgacggtcgccgggctcgcgctcggctccctcgtcctgtccgcctcattcatgatcatcggtgccgggctctccccggtggtgcccgaccaggtcccggtcacgcagcgcggcgcggtccttggctgggcgatggtcccgcaggccggtgccctgatcgcgggtggcctgctgatcggcatggtcacgggctttcccgcccagtacgtgctgatggccggactgccgctgctcatcctgctgttcgcgttcacgatgaaggacctgccgctgccccacgcgcaccgcgagccgttctcgccgcgcgccttcctggacggctaccggatcagcccgcgcgcccaccccgacttcgtctgggcgatgagctcccgcttcatcatgggtctcggctacggcatgggcaccctgtacctgccgtacttcctggacgacgtcctgcattacgagcgcctgttccccggtcagtccaccgaggacggcctgctcatcgtgatcggcatcaacagcctggccacgatctccacggtcgtcctcagcggctggctctccgaccggctcggcaaacgacgcatgctggtcttcctcggcggcctgacgatggccgtcgccgcggtgccgctcgccctgtcgcccacgtggaccatgacgctggtcgcggccgtcatcctgggcctcggctacggggtgtacctggccgtcgacaccgccctggtcaccgaagtgctcccggcgtcggcggaccgaggcaaggacatggccctcgccaacctgatgacgtccctgccgtacgtgctcgtccccccgatcgcctcgctcgtgctcggaggcccgggcggctacagctcgctgttcctgtgctcggcggccatgtcggcgctcggcgcggtactggtctggaaggtcaaggccgtccgttgacacacctattgacggctagtcaggctccggagtcggtcgttcaggtagctgttgaggacgcgcttgcactcggcgatcagctgcgggtcgccctgcgggtgggtgcggaaggccagttgcagcacgccgtccgcgcactccagcgccacccgcagggcgagctccagttcggcgtcgtcctcgacgccggtcagggaggcggtcagtgcgcgcagctgtccggcgaccgcggtgttgttgtcccggcccggctccagggtgtggtcctggcccgccgcgccgaagtcgaccacgccgaatccggtgatggtgcgccgcatggccacgaactcgtcgacggtcacctccaccatgcccgcgaccccgtcgggcgcctcccgctcgaggcgctcggtgacccgccccaggaaggactccaggttgcgggcggcgagcgcgccgaccagcccctcccggtcggagaagaactggtagagcgtgccgatcggtacctcggcccggcgcgccacctccttggtggtcagcgcggagtagccgacctcgtcgaggagttcggcgcaggcgtcaaggagccgttcgaagcgttcgaggctgcgcttttggaccggcagtcggcgcggcgtccctgtagtgcggtcttggttcacgcttccatcatcccatcgaaccggctaacgtgagctctactcatgttttaggggggttgtacgtgacactgaaccatctgcccgcggacttcgtctggggcgcgtcgacggcgtcgtaccaggtcgagggcgccacccgggaggacggccgcggaccatcggtctgggacaccttcactgcccgcccgggcacgatccgcgacgggcataccggcgaggtggcctgcgatcactaccaccggtacgagcaggacctcgacctgatggccgaggcgggcctcaccggctaccgcttctccatcgcctggccgcgcatccggcccaccggcaggggcgaggccaacatcaagggtctggacttctacgaccgcctggtcgacggcctgctgtcccgcggcatcgaacccgtcccgaccctcttccactgggacctcccgcaagccctcgaggacgagggaggctggctgaaccgcgacacggcgcaccgcttcgcggagtacgccgcgatcgcggccgaccggctcggcgaccgcgtccgtacctggatcacgctcaacgaaccgttcatccatatggtctggggctacggcctgggcacccacgcgccgggccgcaccctgtttctggactgcctgccggtcgcccaccaccagctgctcggccacggtctggcgctgcgggagctgcgcggccgcggcctgcaggtgatgatctccaacaactgcaccccggtctggcccgcctccaacacccctgccgaccaggccgccgcgcaggcctacgaccacctgcacaacggcctcttcaacgacccgatcctcaaaggcacgtaccccgacctgacggctttcggcgcggacaccaccctcgactcctggatccaggacggcgacctggacctcatctcggcccccctggacgccctgggcatcaactactacaaccccacccgcatccaggctccggcgactcctgggggcctccccttcgaggaggcccccatcgagggctaccgccgcacggccttcgactggccggtggtccccgacggcctgcgagaactcctcgtcaccctcaaggaccgctacccgaccgcccttccgcccctctacatcacagagaacggctgctcggccgaagacgtcctcaccccggacggaaaggtcctcgacctcgaccgcatcgactacctggaaacccacatccaggccgtcgacgcggcggtcgcccagggtgtggacgtgcgcggctacttcacctggaccctccttgacaacttcgaatgggccgagggataccaccagcgcttcggcctggtccacgtggaccacaagacgcaggtccgcaccccgaaggcatccttcgcctggtatcgcgacctcatccgcgcgcaacggggttgagtgagggctcccgcaaacgcgggagtgttccgatgtactgggcgtcgcagcggggcacggcgcggcgcgcagggacggcaacgcgtcgctgcagcgggcgtgggggaaggaggctgcgcgcaactacggccccgggggtgagggcacaggctcgatgatctggcggtgcggggtgctaccgcttcggactcggtcctcatccccggcaggctgatccagccgatgcgtgcgggtgacttcggccgcccgacgccccggtgttcgtcacccgccgcaaagggaaccgcgaccatcacctcaccgccgcccagacggaggcgatccgactggtcagcagcagcgagcgcgcggcgaacgcgcactgcttcacggacggagccgattacggcagtcggcatgggcagtacgatcccgcttcatggtcgtggatatggggcgcccgcacgtcaccacggcctgccgctcggcgaagccgcggtgaggtccggagttggagcgtctggcccggggggtaacgaacggggcgacgcgggaggtgacgcagggagtggcgtgggaggtcacaccgcgattcgtgggccgcgcctggctctgtccatgagaacgggttctggatcaggttctgtggttcggccacggtgagtcaaggccgacgagtaggacgctgcgggtctctgtgtcagaagggcgggtcttcgctgcagccgtctctgccgttgcttgcccaccagtagtcagggtcagccaggcgggcgcgcagttcgcgctctgcgatgtcgttcgcgttttcaagggcgctcgtgtcgtggccccaggtcgtgagagcggccagggcacggtcccgtttgtagcggtcggtactggtggccagcaggcggcgggcatggtcggcaagctcggcccgatgggtgatgaggacggggtgctctgcgatcgggatggcggcgacgagggccgcgtcgcgcacttcctcgtggtcatggccgaggaacggttggacagctgagaagatcgccggacgcaggtcccggaacgcacgcatcggccagtattcgcagaggaacccgtcgccgcaaaagcgttcgtgggtggcgacggtctcgtcatcggcgtcgaaggcggtggcgccgagccagtcgagcagccttgcacgtgttgggtgccgcggtggcaggccgttgtggtggtcgagctcccctgccgctgtggatgagtggttgaggatggctgagacgtacagcgccacgggcacagtggcttcgtagatggtgttctggtgagttacctcatcgagagcgtccttggcagcggtggacctgacgcccgggttgaggtcgagcaggcgcgtcagcctttccggcaaggattcggcggtcccgtagggagtggcgagcgatgcccagtctgtaccctccagtatctcttggtggtgagggagcgcgtcgggttccgggctggacgcccagctgaggtggttgatcacaggcggaggctacaagcgtcgccgagtcaccgcacggggtcatgtgtagagcaggacgcgctttcgtagcaggtcgaaccttccagttccgggcagtgggtcaggacggccttgagccggagctgttcgacctcggagagggagtcggggtgtcgcaggatccatccggcgacggtgcggggtgcggtgaccggatcgaacgaaaggcgtttgatgcgggagtaggcgcgaactcgctggtagctgcctttgtagccgagcggcacgatctcctcccatgccttccatgcgtgggtacagccttggctccagcggtcgtccaggtagggcttgtactcgtcgaggacggaggggcggccctgccactggccgtggaagagggcctccggggaggcggcctcgacgaggagcttgaccgtgcggtaggtcattccgagctggcgttggatcgcgcggccgctgtggccggccgacagcagggcgtggacggcggcatggttggactgggtcctgtcggcgaaccggtgtccggtgggccacggcgagccagcggggtcaggtggttcctctgattccttaacctgttgggatggctcgggcgcggtgcctcgcaggcacccccgacggtcggtgacacaccgttcggcggcttcgctcagtccgcaacctacgactgcgcaggacggagcgatcagtcccaccagtcgtcgccagtgtgccaacgcggtcaggtctgacccgcggcgcgcagggcccgcgccagccattccagctcctcggtcgcgtcgggcgacgatgcctgcccgcgtacacgggcgacgagcctgcggtaattctccgctcctgcctcgatcccggcctccaggctgcgcagcacggcggaccgatcggcctcaccgaacagctcggacagcacctcggccgctgccggaccgtcgggagcgaccccgccttttctggtttccgcgacggtctgcactatctgcctggcccaccagatggacgccccgcggggactgtcctgccccggtacgggcgtgttgagctccatccatgtgcgcatccgggcgcggaaaccggggtcccgcaccaattccgccaattcgatccaggcgtcgacctgctcaggtgtggggtcgtcgggcaattcgatgctgaaggtgcgcatgcggtcgcgcagacgcgggtcgtcgaggccgctgaacacctcctccttgaactcgtcgatgatctgcttgcgctcggcggcggaaagccgcgccaaccggttcatcagtgctgtctcctcaacggttgaaccccgtttcgccacggtggacaggacggcccggctcactttgagtgagcggatctgcgcgtcgagcgcggcgacatgcgcgtcggcggcctcggcgaccgtggtgcggccgctcaggacccggcacacgtcgtcgagcccgaggcccagctcccgtagggtgcggaccagctcgacccgggccacagactcggcgtcgtacaaccggtagccgcccgcggagcgggccacgggcggcaccgccccctcgtctgaccagaagcgcagggtacgcaccgaaagtccggtgcggtgcgcgagtcggccaatggtgagcacgtcggggcgttcgtcgtccatgagtaggatcctgaaccctccggcggctggagactcaagcgcctcagtgcgacgaatcccgaagccacctcactgaccggcagatcacgtgacgagagagaagccccaggccaggggtcagggttccggcgagaaccacgggaacccacggggtgccgtacagaaggggctgacagcccatcgcggccgcctcatcccggagctgcgacatcccaagctatgaatcgaacagagttggaggaaggtgcctcccgaagtgggttctggctcacattccgtgaagcgcacggtcgagttacggccaacgtgtagaaacgtgggcctctttgtccgaacggcgggtcttcggcgcagccggcgccggctccggcaccacgtccatctctcgcacccacgcgcgcagcgcctgaacgtcgtcggccgtgaggccggtggccgcgtcgaccgcgtacgggagcagcgggctcacggtgccgtacctccgttgcgccgtgctgcggacctcctgcgcgtggtgactccccgcccgcacccacgccaccggccggtcatgggtctgtgcccaggaggtgatttcctcggtccgccggcgcagttcgttctccgcctcgggggagcggccggggccgtccacccggaggtagtgcacggcggcggtgtcccgcagcggcaccatcggcgggaccgtgtcccagcccaggacgggtagcagcggttccagctcgcccggggcgttacgaggagaccaggaccagatccgcggggaggtccgcgagggcccggccgaccgccgggtcgagggcgaggcgcaggccgcgcgcgggcgcgggtagaccatcgccgcccactcctgccagacggccgaccccacgtcgtgcacggtgtccccgggcgggcggcggcccgcccgtacggggacagcaccccgtcgatctcaacagcaccatacgaacgcataccaggacgctaacgaagcaaccactgcgaaaaccatcaaacccactaccgtgcagggtagttgaggcgcagcgccgtgcggagagcacggcgctgcgtcgtgcctgaacggggcgcggcgaagaagtggccgtgagtcgcgggtgccgccgttcgagatgcggagaggtcttgccattggatcttgctggattacgagaggacggtacgtaggttgatgtctgtattgccctgccggttcgggaaggcaggggcaacacaggcatcaagcacacgtacccgccctctgagctagagcagatcgaacggctgctggcgcacttgtgatggtcgcgttcgtaaacgtcaactggcctatatcagaaagaagttggggtgctctggacgaccagctgaggacgcttcattatcgctgtatgccgcagactccttcagcacgacaagacgaagtgccggagcagaaccacgtctccgcgtcgtcccatgctcccggcatgaattcagccgagttggagaaacatgccgctcgacgccgcaacatgatcttcgtgctgtgtgtggcgtttgcggtgatcgcggcgatcgcagttcttgtccccatcctcaaagccctgtggaaccaggatccatggatcatggagcttcttgaggggcacttcgccgccctggtcggcctcccatcgatcgcgctactcgccttcgtcctggtggtcctcctggaggctcggtttgacaagatcgaaatggagttcttcggggttgtgaggttcaagggggcgtccggcccgatcattctgtgggggttcttgttcttcctcatggccaccgcgctcaagttcctgtggtgaagcatgcgctgaggacgtacacgcagtgatacgaacagtcagtggccactccgcaaggtcgtcgacgccggtcggatggttttgttcacccagccgcggccgtaaccgcccggcgacgccgctgccggcgcgctgcccctcccgagaccgcgaaacggacactcacacgtcgtcacgtgtgcggcggacgctgacgggatggccgagggctgggggtttgatgacgtcggtcccgtaccgccgtcgggcgcggtcctggacggcctcgatgagcggcgtcttgtcgatggtgtggtcgaaggtcagttggcgggtggcgtgtttgggaactcggtggtgcaggggccgtgcgacctggacactgaccggttatgtctcttacggcttcgactggcccgatgtgtacgcgtgattcgctcgcctcggacctgcgcgctctcggtctgaaccctggtgaaacgctcctggtgcactcttcactcagctcgcttggctgggtctgcggcggttccggcgttgtcgttatggcgctgctcgatgcccttggcgacgatgggaccttggtggtaccgacgcactccgggaacaattcggatccggcgtactggggaaaccggcccgttcccgagtcatggtgggcggatatacgtgccgcgatgccgcccttcgacgcacgtaccacgcccactctcggtgtcggtatcatcccggagactgtccgaacctggccgggcgccatccgcagccaccatccgcagacgtccttcgcggccgtgggcccgcgcgctgccaagatcgtggagggccatgcactcgactgccggctcggcgaacgcagccccctcgctcggcttgaagaggcgggggcacgggtccttctcctcggcacggacttcgcatcgtgcacggcgttccatctggccgaataccgagttcctgcgcggcaggtcgacaactccttcgccgtcatgactgcccagggccgccgttggagcacggtgcgcgacaccgcgatttccgacgaccgctttgacgagctgggtgcggccttcgagagggaaagcccgttgacgcgggggcgagttggcggtgcgaaaaccctttccgaggccgctgggagaagttgtccactggccagcaggccgtcaatcggtcccaggccgagatccgggcactggtcgaacaagccatcgccaccctcaagtcttggcggctcctcagcgaactccgcttttcaacgacccggatcacgaacatcgtccaggccgtcctcccctccaactggccggctcagactgaggcagtcaccgaactcgtatgatctggcggtgaggacctggacggagcaccctgccaaggcggacgtcgaagctgtcgttcgccgttacttcagcctgctccgagccggaaggttccctgaggccgaacagctcatcgaccacagcccgctccgtcatgtgctcaagtcgctgtggaccgggtccgtcgaagcaagcaccgatggggacgaggcgagcagaagccctgctgccgacgagtgggagcaggacctgtcctggctcggcgaactcaatctcgcagacttccactggggcgacaccggcagccatttctacgttgagatcacctaccgcgcacagataatcgaggtggcattgagcttctggatcaagcctgtcgacgccagctgggtcatcgcgggaccgggcaccctctggtaggacacacgaaagggcccggccagcccgagcaccccagcccgacccacgccagccccgtgacctgcatcaggttggaaaaggctccctgcaaaggcacttgcggacacgcatggcacaacttgcctcgccggtgatacgccgtggattactgaacgcggcaaccgcctgctcggcggccgcgcccgtcgccgtgcccgtggcgccactggccgcctcaggtgacacggaagaccggccagccgatctcggtgcgccacgcagcgggatcgcttgtgtcacgggggccgacaacgtagacctctcgtaccggtccggccaccgacatcgcgttccccaccacccaggtcccgagttcgccgtacgtgacctcgatgtcgtcgtgctcgccgatgtgggtcgtgacggccagttccgcggccggaagggtcgtggggtgcacgcgtccggtgcgaggtggtgcagcggtcggcaggtagacgagcgcgtggccgcgctcctgctcgaaaagggcgttgtcgtagttgccgcccggcggtccggtcacggcggcgccgacggctgcctccaattcggccatcgcgcctgcgtaccaggtctcgatgtcgcgatgcccgactacggcctccaccgccgcgaccgtccgggcgggctctgcacgcagttcgacgttgattggcgcggggtcgggccggaggaggcggcgcagcgacacgaccgcggcccgggtgcgatcgagtgcgtcctcgaggcgttgcaggtggtctgcgaccagcgccgcccggacaccggggtcgggagcccgcaggatctgctgcacatcgctcagggggacgtcgagctcgcggagccggtggatgacctgcgcggtcgggatttggtcgacgccgtagtagcggtaaccggtggtctcgtccaccacggcaggttccagcagggccgcctcgtgataccggcgcagggtccggacgctcaagtgggtcagccgcgagaactcgccaatggtcagcatcccgtcactctaaacactccccctgggggagagtccacggcttgaccctcccgcgccgcgaggtcacagagtgggctcatgacacagcacaccgatcttccgtccgatctgctcccgaccatcgtgcgcgggtacttcgccgcccacaccgtccgcgacgccgacaccgcctcgtcgttcttcgccgaggatgcggtgatcgtcgaccagggcgagaccttccgcgaccgagaggagacctacgcgttcctgcgggatgccgggtccgagttcgagtacacgaccgagcagatcggcgctcaccgcgtcgatgacacccactgggtggtaaccgtgcggctcgaaggcaccttcccgggaggcgtcgccgagctcgactaccggttcgcgctgcgggacggcctcatcgccggactcgtcatcgccaaccacccggcctgaccggacccgcaccccttcgatcttcagtggagagaaatgtctagttcagatcgcgatcgtctcaacggtcgccgggcgctggtcacgggcggttcgaagggctcgggcaaggccgtcgtaaagaggctgcgagagatgggtgccgacgtgtggaccacggcacgcactatgcccggcggctacgagctccccgaccggttcatcgaggcggacacttccacggtgggcggtgtagaggttgtggtgtccaagatctctgagggaggtgcgctggacatcctggtgcacgttgtcggagggtcgtcaaccccgcctggcgggttcgctgcagccattgaggagcactggctggcggaactcaacctgaacttcttgggagctgtccgactggatcgagcgctgctgccggcaatggtggaggccggatcaggagtagttgtccacgtcacgtcgatccagcgtcagatgcctttgcacgacgcgacgttgccgtacgcgtcagcgaagggtgccttgcgcacatacagcaagggtcttgccaacgaactggcgccacgtggagtgcgagtaaacgccgtcagccccggggggattcagaccggagcgtatgaaagcctcatcgaccggctcgccgagggcaacggactgacccgcgaggaggcgaagcagagcctgatggattccctcggagggattcccctcggaaggttcgcaacgacggaagaggtcgcggacctggtcggcttccttgtgtcggaccgagcctcacccattgtgggcgcggagtacgtcattgacggcggcactgttccaaccgtctgagccaggcaccggctccgagtagccactcgcgaacagctcgatccgacggcggaaccctttccttcacaaggaccacgcggtacgacccgatgagagtgcttcccctgtgcagccaacaggacgctagacaagtcccatcgttgcaggtcagaagcgctcgctggtcatttgatcaagccttggcgccccaactcgtgaaagcgcgaggccaggcgcgtccggtgcgggatggggcggtccggtcggcgaggactaggcacaggccggcggatcatgggcggggccataagcggactgccgctgcggtgacggtgccgtggaagacgtaggccctcttgtcgtaacgggtggcgaccgcgcgggagttcttgagtcggtcgatggtccgctcgacctcgttgcgtcgccggtagcgctcgcggtcgaagccggcgggtctgccgcccacgccgcctctgcgccggcggttggcccgccggtccttcggctcggggatcgtgtgtttgatgcggcgtcttcgcaggtagcggcgattgcggcgggagctgtaagccttgtcgccgctgacacgatcgggcctggtcctgggccgtccgcccagcgggcggggaactcgtatccggtccaggactccgatcatctgcggggcgttgccccactgatctgctgtgatcagaagagccatgggtcggcagccgtcttcaccggcgaggtgaatcttggaggtcagatcgccccgggaccgcccgagtcccccatcggggcggtggtgccggggcgtcgtccttttctcgggacccgcggcctggccttgcgggcgccgaccgcgtgctggtgggcccggcagaacgtcgagtcgacgccgaccatgtcccagtcggtccgcccggcgaggtcggcgtcggcctggaccgcctgcaggagccggtcccaggtgccgtccgccgaccaccgcaggtggcgtctgtgaaccgtctgccaagggccgaagcatgcgggcagctcgcgccactgacagccggtactgagccggtggatgattccgttgatcacctggcggtggtcccgccatcggccgcaccggctgttgctcttgggcagcagcggctccagcaccgcccactcgtcgtccgtgaggttccccctgctgaacaggaccagaacaacaagctgaccgatcgaagaggtacgcccttccgtgagcgaaagtccccggtcagcggcccggaaatgagttgcccaggctgcggagcagttgttacggtcacgccggcgcgagagacgcgtgatcagcgggacagggaggttgatgaatatggctgccgtcggccgccttcagcatgccctcgtccggcccgcgcaatagcagagcgcggcccgggtcgttccaacgaccaggagagtcacgtgtcttcctcttcttcacccgcccacaccgacgtgatcaccaggcgcctgatcctgcggccctggaccacgaacgaggccaccgcggtcctcgacgacgccaggcccacgcactgggcgggcgactttccagccgaaggtgaccgtgtgatcgcgggcctcttcgagcagcaccccgcatggctcgacgcatacggccaccgtctgatcatcgagcgcgagagtggtttggtggtgggctcgatcggcctgttctggccgcccagcgaaggcgtcctggaaatcggatacggcatcgtggcctcccgccgcggccggggctatgcccccgaggccacccaggccctggcagagttcgccctcactgcacctgaggttcacaccgtgtccgccgatgtggaactgtccaacccgtcctcggtccgcgtgctggagaaggccggcttccatcggtgggccaccgaagagaacgcggagaacacggcccggttcaggatcacgaggccagaccgctcacgacgatgacccccagggccctggaggcgatgcctccggggcccaccgtggtggcggagccgagacaaccagcgtgatcggagagacagaacctagttgccgcgctcctcgaaccacgcctgcgcgcccgggttgagccgtgcgcgcggtccgggcttcgggtcgtggtaggccgcgtacgcctccgcgaaccactcgtccggtgtggagaattggtagttggacacggcgtgccgttcccgttcggcccgcagatagctgacccactgcccgtagtggtcgacgtggtacgtccggttcccgatcgcaagcgtgttcccgccgccgttcgtgagtgtccacggctgcgcgagggcgagccgtccgaactcgacgacgcggtcgagccgggtcttgaactgatcgtcctggtcggggaagccggcggcgagcttcgtgagccgttccggggtgccgcgggccacctccggatccagcgccaccgcgaccgaatcgatgagaggcatgtgatagcggtccttgacgttcagttggccgtcgagccctgcctcggtcaggatcgccatcgctaccggacgagagctgccgtaggcctcccagcctccgaagcggggttcatgcttcaggttctccgcccagcccgcctgtttgtcgacggagtggccgatctcgtgccgcagcgtccacttgaccaggttgccgttggccagcacatccgaagtgccacccatgacctgtcgtttctccccggcgatgcccagagcctcgtcctcgctgatcccttcgtagtcggccatcgcacccttgtccatcagggaacgctgccagggcacggcccggttcagttccgtgtagagccaggagggcatgccgaacgggctgaccatggtgatgctgcggtcattcccgtcgtacaggctggccgcgctctccgtgtcggcgccggcgggctggatcgccagcaactccgggttctccctgacatcccgggtcggcaggctgcccaggaccccgtcaatccggttgagcatggagtggctgaagtgatcgttcggccggccttccggcggcccgatgcggattccgtacttggcactgagctccgtctcgcgctgggcggctccggtattcgccaccagcccgccgagtccgtacccgccggtgctcctgttcgccatctggatcacgacggcgttccctacggtccgctgcaacgccattgcctgcgccggccgttcatcgcgccgctccgtccgcgcccgcggaacggcgcgcgccccggccgtccccgcttcccgccctgcgtgcatggttctcctgcctcggaaggtccaacgtccccctcccagcattcacggtgtgcggagtaccccggaagaggcgggagggcagacccgggggcaggcgagggcaggtcctggccgagatcagcacgcagcaaaagttcctcacccgtcgtctgcgcgaatggaccctgctgcggacgatcactgcgggcgagctcccgtgctccgggccaggtgtcgagatcgcggccgatgtcgacccactccgcgtagtccgagcgggagggcgccggcctgctggtgtggaaggtcgtggcacaggagctgccgagctgacccccttgcgccgtccgtacggccgttaccttccccgaacgggcggcgacaagcgccacatctcttcaacgggtcgcgtagtaaagggagttgcgcgcggtgtccggcagatagaggacatcgcggccgtccgagtcccggcgtaccgcgagccggtccgcgctcacgcccggcgcggcggaccgggcggtccaggctccgtccgccgactgcgtcgccgcgaagacccggtcggtgcccgaggcggttacgtagtagatccgcttggtgtccgtctcgtcccaggtgatgccgagggcggccgtggtctgtccgtcggcgtacacggtcttgcgggcccagccgctgccgctcggataggcgaagtacacgcggaagtggccaccgctgtcggccgagcggtagcggtaggcgatcttcggggtgctgccgtcgagggtgagcttggcgctctgtaccgaggggccggggtaggtgttgtcgttgctccactcctcgcccgcggtgaggtcctggacgacgtcggaggtggtgggcgtgaccggggcggtgagcgtggcgccggtgctgtccgcgaaggcgccggtcgacgggtcgtaggtcagatacgagagctggtgacggaacgcggtcgccggcgccttcccccactcgtagaggaggtggacgcggccggaggcgtccacggtgatgtcgtcggggtacacggagcggtacagcgcgctcgcgaaggtcgcgacgacgctccagcgggatgcgacgttgttccagcggtacagcttgccgggccgctggtcggagcccgaaccgacgcgggccgccaagtacaggtcgccgttgggcgcggtggtgacgatcgggtacgtgatgccgacgccctggtcgggcagctcggacgcgtggtcggtgacggcggcgccgggggcctcggtgcggtagtagcgccaggcgttggcatgcatggaggcgaagacgtgcaggc

SEQ ID NO: 2963 - DNA, 13127 bp, Unknown
  Kingdom: Bacteria, Phylum: Actinobacteria, Class: Actinobacteria, Order: Streptomycetales, Family: Streptomycetaceae, Genus: Streptomyces
ggccgacgccggggccgccgccgccgtgcgggatgcagaaggtcttgtgcaggttcaggtgcgagacgtcgccgccgaacttgccgggcttggcgagcccgaccagcgcgttgaggttggcgccgtcgacgtagacctgaccgcccgcgtcgtgcacctcgccgcagatgtcggcgacgtgctcctcgaacaccccgtgcgtggacgggtaggtgatcatgagcacggccagctcgtcgcggtgctgctcgatcttggcgcgcaggtccgcgatgtcgacctcaccgtcgtcggcggtcttcaccacgacgaccttcatgcccgccatgacggcgctggcggcgttggtgccgtgcgcggaggacgggatgaggcagacggtgcgctggtcgtcgccgttggcccggtggtacgcgcggacggcgagcagacccgcgaactcgccctgggaaccggcgttgggctggatggacaccgcgtcgtagccggtgacctcggcgaggcgctcctccagctcacggatgagcgtgaggaagccctgcgcctgctcggccggggcgaaggggtgcagcgcaccgaactcgggccaggtgatcgactccatctcggcggtcgcgttcagcttcatggtgcaggagccgagcgggatcatgccgcggtccagcgcgtagtcgcggtcggcgagcttgcgcaggtagcgcagcatcgcggtctcggagcggtgctggtggaagaccgggtgggtcaggatgtcgtcggagcgcagcagcccctcgggcagcgcgtcggcgaccgtggcgtccagcgcctcgatgtcgccatcggcgccgaaggaggcccagactgcggagatctgcgcacgcgtggtggtctcgtcgcaggcgatggagacctggtcggcgtcgacgaggcggaggttgaccccgcgctcccgggcgtccgcgacgacggccgcggccttgccggggacgcgcacggtcagggtgtcgaagaacgcgccgtgcacgacgtccacgtcggcgctccgcaggccgtcggccaggatcgcggcgaagcggtgggtgcgccgggcgatcgtccgcagcccgtccgggccgtggtagaccgcgtacatcccggccatgacggcgagcaggacctgcgcggtgcagatgttgctggtggccttctcacggcggatgtgctgctcgcgggtctggagggccagccggtaggccttgttgccgtccgcgtcgacggagacgccgacgagacggccgggcagggagcgggcgaacttctcgcggaccgccatgaagccggcgtgcgggccgccgaagcccatcgggacgccgaagcgctgggtggtgccgaccgcgatgtccgcgccgagggcgccgggcgaggtgagcagcgtgagggccagcaggtcggcggcgacggtgacgatcgcgccgagctcgtgggcctgctcgatgacgggctcgatggcacgcacggctccggaggcgcccgggtactggagcagcacgccgaagacgccgcgctcggcgatctcggcggggatgccgtcgctcaggtcggcgacgacgacctcgacaccggtgggctcggcacgggtctcgatcaccgcgacggtctgcggcagggtgtcggcgtcgaccaggaagacacccttcttgaccttgccgacgcgccgggacagggccatcgcctcggcggcagcggtgccctcgtcgagcagcgaggcgccggaggtgggcagcccggtcagttcggcgaccatcgtctggaagttcaggagggcctccaggcggccctgggagatctccggctggtacggcgtgtaggccgtgtaccaggcggggttctccatgacgttgcgcaggatgacgggcggcgtgaaggtgccgtagtagccgagaccgatcatcggggccagcacctcgttgcggtcagccagcgaccgcaactcggccaggacctccgcctcggtgcgcgccgagggaaggttcagggcctccgcgctcttgatcacgtcgggcaccgcggcggcggtgagctcgtcgagggagccgtagccgacctgggcgagcatcttcgcctgggctccggcgtcgggccctatgtggcgctgctcgaacggaatgccctgctccagctgggagagcggagtgcgacggggggtcatggtggaggcctcctggtctgtcacgacctgcgaggggcaccacggcgcgggtgcccgaacggcctccccctctgtcatctcaacctgagagcttcaccggcccgcccgggggcgtgccgactttcaccgtcggtgagggtcgaatccgcctgggcctgcgcccgcacggaatcgccctgctttccagagtgacctcgtccgtgcggtacgggggcctgagagattccggggaggagttgctccttcggcgcctccggattctgcaccggaggactctcccgcacggggtcagcagccactgtcagcctaccagcggccaccgcgccggagttctcgagtggccgacgccacggatctgcacttgtgtggtgctggtggagcgacagcgaccaccctgagcagtggcgaccagtgggaggcaccgtgcagaccgatatcgatccgcgccgcctgatcggccgcaaggcattcgatcgcaagggcgccaagatcggaacggtggatgaggtctatctcgacgacgcgacgggtgtgcccgagtgggcggccgtccgcaccggcctgttcagcagggacgccttcgtccccctggaacccagcgaattcgtcgaggacgcgctgcgcgtgcccttcgaccgcgcgttgatcaagggcgcgccggacttcggcgtcggccggcacctctcacccgagcaggaactgcagctctaccgccactacgggctggactccccgcccccggaggagtcggcgcccgaccgggacttcggcaggctggcgggccaggaggagtagtcgggcgcgtcacggacgagcggcagcgggtcggcgggccgcagcagcggatcgtcgatgcggaacgtcagcacccggccgggcgcgctccacggttcctcgaaccggacggtgacccggccgacgccgctcccctgcacccagccgtgcccgtgctcctcgtggtgcacgtcgtgtccggcgggccagcgccgcgcggcgagcagctccgcgctgtccggctcgggctccgggacgctctcctcgccgccctccacgggcgtcgagctgtgctcctgggcccgctgagcgagctccctggcgtcggcggcctgggcgaacaggtcctcctgggtgtagtcggccagacccgtcacgccgacccccagcagtcgtacgccccccgtggtgtcgacggactccagcagccgccccgccgcctcgcggaccaccgtggggtcgtccgtggggcctctgagcgtctcggagcgggtcagcgtggagaagtcgtagcggcgcaccttcagcaccaccgtgcgccccgaccggtcggcggcgcgcagccgctcgacgcaccggacggccagccgctccacctcggcacgcacccgcacccggtcgtgcaggtccacgtcgaaggtgtcctccacggatacggacttggcgtcccgctcggcgaccaccggccggtcgtcgagccccagcgccatccggtagagcccgtggccgtgggcctttccgaccagccgtacgagctccgcctcgcccgcctcggccaggtcgtggacggtggtcatcccggcgcgccggagatggtcgccggtggccgggccgacccccggcaggatgcgcacggacatgggagcgagcaactcacgctcggtccccggctcgatgagcagcagcccgtcgggcttggcctcctcggaggcgatcttggcgagcatcttggaaccggccagtccgacggatccgctgaggccggtcaccgcgtggatggccgcccgcagcccttcacccgtcgcacgggccgacgccgagtcgtcagccgttccgccggcctccaggtccacgaaggcctcgtccaggctgagcggctccaccaggggcgacagccgccccaggagctccatcacctggtcgctcaccgtccggtacagggagaagcggggcaccaggtaggcggcgttgggtgcgagccgccgggcctgcgcggtgggcatcgcggagtgcacgcccaggcgccgggcctcgtacgaggcggtggcgaccactccgcggggtccgaggccgcccaccacgaccgccttgccgcgcaggctcggcttggccgcctgctccgccgacgcgtagaaggcgtccatgtccaggtgaaggatggtgggcgcgggtctcacaccgtcgatgctgccctacggcactgacaacgggacggtccggcgccccgtggggtgccggaccgtcccgtcgtcctgctcgtgctgctcgccgtgccgcgcctccggggcgttcagacggctcggttgcggcgccgcgccagctcgtcggccgggttgtgaccgacgagcgtctcgccggtgtcgacccgctcgccgtgcagctgcgagagcgccgcctccacgtcccgccagacgacgccgacggcgataccgaagattccctgcccgccctggagcaggctgacgacctcgtcgggcgaggagcactcgtagaccgtggccccgtcgctcatcagcgtcatgcgctcgagatcctgaaaaccgcgggcccgcagatgctggaccgtggtgcggatgttctgcagggcgaccccggtgtccaggaaccgcttgacgatcttgaggagaaccacgtcccggaaactgtagagacgctgggtccccgatccgtaggccgggcgcacactgggctcgaccagacccgtacgggcccagtagtccaactggcggtaggtgatccccgccgccgcgcacgccgtcggtccgcgatagccgatgtcgtcggcatcgctcgccgctgccacgccgcccgctgccaccgctgccggttgaaccggctgcctgatggcgtggtcggctccactgccgtgctgcggatacggcccacccgccgccgtaccgtcgccgctgcttctcacgccgacctccgtccttgacctgcccactcgaaggtaggcagtcactcggggtgcgtcaacgatcgccacactcggcacgccgagtgataatcaccctgagggtggtttcccgtgtctcgtttccgggaaaggcttgtcggatgcgctgacagcacccctgcgggacggtcactgactgttcgtaccgaagtcctccggagagatctggtcgaggaattcgcggaacttctccacctcgtcctcctgctcgtcggggatcgcgatgcccgcatcgtccagcacgccgtcactgccgtagatcggcgtgccggtccgcagggcgagcgctatggcgtcggagggccgggcgctcacctccactccgctggcgaagacgagctccgcgtagaagaccccttcgcggaggtccgtgatgcggacctcggtgagctcctggcccacggcctcgagcacatccttgaacaggtcatgggtcagcggcctggcgggagccatgccctgttgggcgaaggcaatcgcggtcgcctcccccggaccgatccaaatggggaggtaccggtcgcctcccacttcacgcaggagaacgatcggttggttggagggcatttccacccggacaccgacaacgtcgagctcgttcacacagcaaccctaggacgtgctcgccatgtttgggtagtcgggctccgccgaggtcagtgcagacggttgcgcagagcgctctgcacgagtgccgcgtgcagccgtacggacagctcggcgagctcgttcgcggtggcctcggcatgggctctggtctgcgggttacggtgccgccgcaagggtgcgaccagctgttccaccagccccgcctcccggtcggcggaggcccgcatggcccgaagatgacgcggttccagaccgaaacgtcccagatccgccaccagcttggcgaccgtcaccatctcggcgtcgtagccgcccccggcggcggggacgataagcccgtaggactcccactcggccagccggtcctcgtcgacctcggccgccgcaagcagctcggcccgtccgatccgggaagcggtcgccgtcccgggaccggtctcccacaccccgtcggcgaggtcccgccgctcgccgggcgagggcagaacaggctgctccccccgggccagcgcgtccaggtgctcccggatgaccttcagcggcaggtagtggtcccgctgcatgcggagcacctgcgccaggcgctccacatcgcgcggggcgaacttccggtatccggaaggagtgcgctgcggctcgatgagcccctcggcctccaggaaccggatcttggagatggtgacttcgggaaactcgtcgcgcagctggatgagcaccgtaccgatgctcatcgggcgcgcttccgcggtggcggtgccgtggccggcaccgcctgtcggtgttcgcagcatgggccttcctcggggtccccccggacggagtccgggggctggtcacgcgccccgcgggctcgcatagaagaccaggcggtactttccgatctggacttcgtcgccgttggacagctggaccgaatcgatgcgctcacggttgacgtaggtgccgttgaggctgccgacatcacccacggtgaagctaccgtccgggctcctgcggaactccacatgacgccgcgacacggtcacgtcatcgagaaagatgtcgctctgcgggtgacggccggccgtggtcaggtcactgtcgaggaggaagcggctcccggagttcgggccccgccgcacgaccagcagcgccgagcctccgggcagcgcgtcgactgcggcctgtgcctccggggagagcgagggcagagcggtctggcccgtcgcctccgcctcgtacgcctcgagcccggagatcgagatggtggacgtcgtctccgagggacgctcgggaacaccgccccgcagcggcgcgccgcagttggaacagaacctgctggcctccgcgttgcggtgaccgcacctcgtgcagaccggcatcgacgagccctccggggtgaaccctccacccgtactcgaggctgatggttcgccgaaacctatgcgtccggcaccggcagggtcaacagacgacacgccgtcaccacccggggcgccggacacctcgtcgcggaagagcggacgctccgcctcctgctcctcgccctgaccgtggcgcggcgcgcggtggcgggcagcactgttgctgtcctcgcgtgcactcttcccgaacaacttcgcaaacaacttcacgggcgattccccttgaccgacatagacccgcccgtggggcaggacgaaccctgattgaacacacctgccgacccggacatcttcacaacgtccgtatccacccgacagtttccaccacgcaccaccaatccggtgcgccgaccccccgcaaccgtccgacccgctccaccggccctcacgctcgcccggctcacggggatgacgaccgagcgtagtcaggccgctgcgccggtcgcaaggcgtccaccacgatgtcgtcggaccgctccacgagcaccgtggcctgctccttctccaacgtctgcaccacaccgccgggaatgttgagggcgggctccagatcctgcggtttgccgatcaccgtgaactcgtacggtgcctcgatcttcttcccgtccacctggacgtccccggcgtccccggagaagtaggtgttggccaccacccggaccccgttgacctggatcgcctcggccccggccgcccgcagttcctgaatggcgtcgagcagcatgtcgggcgcgaccgcccccgaggggtcggtgatcgtcagcgtgatgccggggccctgcgccgccacggtgcccgcgaggataccgagctggcgttccttctccagtgtctgcttacgggcctcctcggcctggtcggagctgttctccagctcggtgcgctgatcgtccagacgctgcttctcgtcctccagacgctgggtccggtcgtcgacctcgtcgaggatacggaccaggtcctcctgccgggcgccgcgcagcgcactgtcgtcgctggtggaccgcacctggatggcaagccccagaccgagcccgaacagcagcacggcgacgatcagttgagcccggctcagccgcggcggccagaggcctgccagcagcctctgccgaccggacacctccgcggcagccggcggcgcgagagcgtccggggcggcggacgcgccgcctccgggttgttcgctgcggggattctcgtcgttgttcatcggcctcaagcccggaagacgtgccggcggatcgcggcggcgttggagaagatccggatacccagcacgaccaccacaccggtggagagctgagcgccgacacccagtttgtcgccgaggaagacgatcagcgcggccaccacgacgttggagaggaaggagaccacgaagaccttgtcgacgaagatgccgtcgagcatggcccgcagaccaccgaagacggcgtcgagcgcggcgaccaccgcgatcggcaggtagggctcgaccaccgccggtacctcgggccggaccaacagtccgaccacgactcccacgacgaggcccagtacggcgatcacgatgtgcccttccctgtgtctgccgcaccactgccggcggccttcggctctgctgtacggacgatcaggctcggcgcggccggaagccgcacctccgcctgatcggagatgctggtgcggatgtcgaagctctccttgagcgcctgcaggtactggccgtcggcgctgtcctggaaggcggtcgcgagcttcttgccgtcccccaccgcgaggaccgtgtacggcggtacgagcggtctgttgtcgaccagtatggcgtcgccggcggcccggatggccgacagcgccgtcagcctttgcccattgatggcgatggcctcggccccggattcccacaggccgttgacgacacgctgcatgtcccggtcgcgcacccgcccggtgtcggcgaagcccgtcgactcgcgtggcccgccgccaccctggtcggtgttcttcgcctcgtcgacgatcagcttcacgccggggccctcgaccggggtcgctccggccagcagcgcgaccagttgtccctggtccccgccgtgctgctcaagcgccttgcgctgacgttcgctcacatcggagcggagttcgtcgacatcggactccaacgtgtccgcggcctgtgtctccgcgtcgatgcggtcgatcagctcctcgcgctccttggcgacgaccggcgcggagatccgcgcctcggcggcgccgagggtgaccacgagggcggccaccaccagtccggcggccaggccgagcttcgacttgagcgtacggggcagtccggcgctcccgtcggccttgcgccgcgcggacgcctccgcgtacccgtcgtcgaggctgtggtccatcacgttgttcagcagcgacatggaggcgtcggggcgtgcgggcggcgaggcgatgctccgatcgggggactgctgcgacatgccgcacatcgtcgcacgtcatcacggctgccgccgaatggccccaccggtgcgccgcgaccccctgcccggggtgtcgcagcgcaccgtcatcgcatcagtccccggcgctgtccaccaccgcggcccactcgtcgagcagtgcctgggccgaggcgtcgtccgggccttccgcccacagatgggtgacggcctccgcccggtcgggcaggaccatgatccaccgcccgtccgcctcgaccacacggaccccgtccgtggtgtccacgctgcggtcaccggccgcttcgacgacccggcgcatgacgagccccttgacggcccagggcgtcgccaggtcgcggcgcaggacatgcgcccggggaatccgggcgtcgatctggctcagggtgagctgggtgcgcgcgacgagcccgatcagccggacgaaggcggcggtcccgtcgaagacgctgctgaattcgggaacgatgaaccctccacgcccgtctcctccgaagatggtgtcctcttcacggcccacccgggtcagatcgtcgggcgaggtggtcgtccactccacctgggtgccgtggtaggccgccacctgttcggcgacgcgtgtggtcgtcacgggcagggcgacacgaccactgcgccgctcggcggcgacgagatccaggaggaccagcagtgcccggtcgtcctcgatgatccggcccagttcgtcgacgagggagagccgctcgcccaccgggtcgaaccgcaccccgaaggccgcccgtgcggaggacacgatctctccgagccgcaccagaccggcccgccggctttcgacggactcggtgggccgcgcctcgtcgagtccggggttgatcgtcagcgcgtccacgccgagccgcccgagcaggctgggcagcacgagtccggcgctgccgttggaggcgtcgacgacgaccttgagcccggagtccgcgatgccgtcgacgtcgacgttccgcaggagggacccggtgtacgagtcgaacacgctggacgggaagtgcaggtccccgatctcgccggggaaggccctgcggtactcctggcgcgcgtagacccggtcgagcttgcgctgctgcgcctgcgagaggtcggcaccccgctcgtcgatgaacatgatgtccaccgagtcgggtaccccgggggacgtacggatcatgatgccgccggcgctgccccgggcggtctgctgccgcgccacgggcaggggtacgttctccaggtcccggacgtcgatggcgctggcctggagggcagagatgacggctctcttgagggctcgggcgcctcgggagtggtcacgcgcggtcgtgaccgtcgagcccttcttcagggtcgtggcgtaggcgccggccagccgtacagccagttcgggggtgatctcgacgttcaggatgccggagaccccgcgcgcgccgaagaggtgcgcctgtccgcgggattcccagatcaccgaggtgttgacgaacgcgccggcctcgatggtcttgaacgggtacacccgcacgttgccctggatgatcgactcctcgccgaccaggcattcgtccccgatgacggcgccgtcctcgatccgggccgcccgcatgatgtcggtgttcttgccgaccacacagccccggaggttgctgtgctgtccgatgtagacgttgtcgtgcaccacggccttgtggaggaaggcgcccgtcttcacgacgacgttcgaccccaccaccgtgtgctcgcggatctcgacgtccgcctcgaccttggcgtagtcgccgatgtacagcggcccgcgcagcacggcgtcggggtggacctccgcaccttcggcgacccacacgcctggcgagatctcgaagccgtcgagctccacgtcgaccttgcgctccaggacgtccgcctgggccttcacatagctttcgtgcgtgcctacgtcttcccagtagccctcggcgatatagccgtagatgggcttgccctccttcatcagctgagggaagacgtcaccggaccagtcgaccgaggtgtcggcctggacgtagtcgaagacctcgggttccatcacgtagatgcccgtgttcacggtgtccgagaagacctgtccccaggtcggcttctccaggaacctttcgacctgaccgtcctcgtccacgatggtgatcccgaattccagcggattgggaacccgggtcaggcagaccgtgacgagtccgcccttctccttgtggaacgcgatgaggtcggtgaggtcgaagtcggtgagcgcgtcaccggaaatgacgagaaacgtgtcgtccttcaacgcctcttcggcgttcttcacgctgcccgcggtgccgagtggcttctcctcgttggcataggtgagctccatcccgagctcttcgccgtccccgaaatagttcttgacgagagaggcaaggaactggacggtcactactgtttcactgagcccatgcctcttgagcagccgcaggacatgctccatgatcggcctgttggccacgggcaggagcggcttgggcatgctcgaggtcatggggcgaaggcgcgtgccttcgccgccagccatcacgacggccttcatgtcggaaacgtcctcctagaagagacgacggtcagccgagttcgcccgtcggggcatcattcacaacatctgccgcgggccggccacactgcgcggcaccgcatcaacgagctcattcggctactgcgtccgccttcacgatccggcggacctgaaccacatagaggatccctgcccaccaatagagcgttgtaccccatcctgcgaacgcccatccgaagacggcagccagtgtggccagccaaccactcccgtcgctgagcagcaacaaggggaacgcgtacatcaggttgaaggttgcagctttcccgaggaagttgacctgcggaggcggataaccgtgacgtcgcaggatggccaccatcaccaggagcatcagttcccgggcgagaagggccgcggtgacccagaggggcaagatctcacgccaggtgaggccaaccagggtcgaaaggatgtagaggcgatccgcagccgggtccaggagccggccgaggctgctgatctggttccacttgcgggcgagcttcccgtcgaggtagtcgctgatgccactgagcatcagtaccagcagcgcccagttgtcgctgttgggccctccgaacacggggcgaagaatcagccacaggaagagcggtaccccgacaaggcgagccatgctgaggatgttggggatggtgagtacccggtccgtctggacccgagtctcctggacctccacccgggggcctcctgtgaagaacgtgccaatgatgccccctgaccctaccctcagcctcccccgtccggtgcacgggggtggagaaggcggtactcaatggtcccggaacgcagaaaagccccgcaccaaaggtgcggggctttcccggaaaaattgttcggcggcgtcctactctcccacagggtcccccctgcagtaccatcggcgctgaaaggcttagct

SEQ ID NO: 2964 - DNA, 2157 bp, Unknown
  Kingdom: Bacteria, Phylum: Actinobacteria, Class: Actinobacteria, Order: Streptomycetales, Family: Streptomycetaceae, Genus: Streptomyces
ggaacatctgcgtgctgcccgccgggtcaggggtgccctcggggcccggctgaggggcgtgggggttgtgtgccatggggcaggaccctagcgaactcgggcccacggcccaacccccgggccacccggcaccccgtccgacctgcgtcggcgcaggcggggaacgggcttgacccggaccctacggaggcttttgcgttcctttacttctgcaaggccgttttcgtttgcctgtagcaaccaacggcttctatcgttgccctaagcaacaacatggtcgtgagtgtgctgggggttcccgtggccgcacggagtagttacgaggaactggcacggcagctcagcgccgtcggggccgtcaagagggggctcgcccgcgcgctgccccccgagtgtcccgcggggtccgccgccgtgctgaccctcctggaccggcacggcgagatgcggatcagccggctcgccgagctgctgtccgtggacatgtcggtgaccagtcgtcacgtggcccatgtggccgatcacggctggatcgaacggtctccggacccggcggacaagcggtcccgcatcctgcggctgacccccggcgggcacgagcagctcgacgaactgacccggcggaccaccgaggtgttcgcccacaacctccaggactggtccgacgacgacgtcggccggctcatcgcgctgctgtcccggctgcgtgacagcttcgcctgtcgcggatccggcggctgcgcccccggaagtcacaccggcgagtgcaggacccgcctcggcaacgaggctcacacccgcacacctgtgtaacagaagcaaatacgcacggataaggaactcaatggctacgaccacacccaccggtgtgcggggcggccacgccaagcacggagggcacggtggcgccaccgcctccggcgcccccgagggcacgccgatgacacaccggcagatcatggaagcgctgaccgggctgctgctcggcatgttcgtcgcgatcctgtcgtcgacggtcgtctccaacgctctgcccgagatcatctccgacctcggcggcggccagagcgcctacacctgggtcgtgacggcctcgctgctggccatgaccgccaccaccccgctctggggcaagctctcggacctcttcagcaagaagctgctggtccagatagccctgatcatctatgtcctgggttcggtcgtcgccggcctgtcgaccagcagcggcatgctcatcgcctgccggatcgtccagggcatcggcgtcggcggtctctccgccctcgcgcagatcgtcatggccgcgatgatcgccccgcgcgagcgcggacgctacagcggttacctgggcgcggtcttcgccgtcgccaccgtcggcggtccgctgctcggcggcgtcatcaccgacaccagctggatgggctggcgctggtgcttctacgtgggcgtgccgttcgcgatcatcgcgctgatcgtgctccagaagaccctcaagctcccggtcgtcaagcgtgagggcgtcaaggtcgactggaccggcgcgttcttcatcagcgccgccgtctccctgctgctggtctgggtgaccttcgcgggcgacaagtacgactggctgtcgtggcagacgtacgtgatggtcgcgggctcggtcctgctcggcctgatcttcgtcttcaccgagtcgcgggccgccgagccgatcatcccgctgcgcctcttccgcaaccgcaccatcacgctggcctcgatcgcctcgctgttcgtcggcatcgcgatgttcgcgggcaccgtcttcttcagccagtacttccagctggcgcgcggcaagtcgccgacgatgtccggcgtgatgaccatcccgatgatcgcggggctcttcctctcctcgaccatttccggccaggtcatcaccaagaccgggcgctggaaggcgtggctggtcagcggcggcttcctggtcacggccgggctcggcatgctcggcacgatccggtacgacaccgagtactggcacgtcgcgatctacatgttcgtcatgggtctcggcatcggcatgatgatgcagaacctggtcctcgccacgcagaaccaggtcgcacccgaggacctcggttccgcgagctccgtcgtcaccttcttccgctccctcggcgg

SEQ ID NO: 2965 - DNA, 2487 bp, Unknown
  Kingdom: Bacteria, Phylum: Actinobacteria, Class: Actinobacteria, Order: Streptomycetales, Family: Streptomycetaceae, Genus: Streptomyces
gtggagtgtccggcgtccccggagacggaagccgccgacgacaggcagccgaccacagagacgaggcccttggtgaaggcgggacccctggtgaagtcgggagcggaatcgtgacgcggcagcccggcccccgagtcctccggcgcaccgcgtcgcccgtcctcctcttcctggccgtcctcctggcgcttctgcccgccctgtccgtcctgaccgcgccgggcgcgcgggcggccgacggcgaccccgccgtcaccctgtcgaagaaggaggcgggcaagggcggagagatcaccgtcagcggcagcggctggcgcgccgaagcgttgctgatgctgctgatctgtggtcagtccacgccggagcggggcgtggtcggcggcaccaactcctgcgccaacgccgacggtcgcgccgtcacgaccgacaagaacggcgccttcagcaagaagctgctggtcaccgaaccgccgaagccgtgcccctgtgtggtgcacgtcgccacggtgaccggcgaacaggccctggccgacgcggtgttcacggtggcgggccaccccacggcggagctgccggaagagaccggcgacgggaagctcgcggtgctggccaccacccgcctggagggagacagctccctgctcacctggttcggagccccgcccgcccgccgactcgtcttcaccgtgggcaacctcgggtcctcccccgtcaaggatcccgtcttcgagatcggcaccgcgcacggcgtctacgcgccgcagtgggaggaacgccagtggcgcggcacggtcgcacccggcgccaaggcgcagatcaagctgccggtcgagctgtcggcgggcgcgcacggcgactaccaggtctccctgcggtacgggcagaaggtgctggccgagcagccgtggggggtcggccgtccctggggagtgacgctcttctgggtcctgttctgcctggtcgtcccggcggccgtcttccgtatcggcatggcggtcgtggacagggtccggccgcgtcccgcgggctcgcaccgtacgcggacgccggccacgcgacggaagccgaagccgcgcgggcgcacgggcacgagcgaccaccagggcacggccacgagcacgacccatgacacggccacggccacgagcacgaccgatgacgcgaccacggccgtgctgccgtggttcaccccggattccgcaccgtcagagaaccgaccccgacccacgacgaagggacaagcgtgagcacgcaacggaggatgagcgcggccggagtcgcgctgatgctcggcggcgcgggcatcctgatggccgcgagtccggcccaggccgccgaggtcagttacgcgacggagtgcgttccgccgccgatctcgggactgcccgcggtgcagggcaccacgaaggtggagctgaccgccccggccgaggcgaaggtgggcgacgagatcgaggtcgtctggaagacggtcgaggccgcgtccaagaacccggacgtgctggacctgggagcggacacggtcaagccgaccgggaccgtcaccctgggcggtgcggcgagcggcgaactgaagctggagggcccccggcagaatccgccgattcccaagaacagccccatggtgctgcccgacatgaagggcacgctgaagctggagaaggccggggagatcaccctgacgccgggcgcgtacaacatcaacgtgtccaagccgatctccacggacaccaagtgcgcgccgaaggaagaggtggaggcggccgccacgatcaaggtcaccgaggccggcggctccacctcgggaggcacgacttccggcggaacggacgccgggggtaccacggctggcggcaccgacaccggaggaaccacgtccggtggcacggattccggcggtacgacatcgggcggcgcggacggtggtacggactccgggggcaccacctcaggcggaagcaccggcggcggtggcggggagaccgacttccccggcaaggaggtgtccgtcgcctacgcgtgcaagaccccgatcggggacaagaacgccacctcaccggtccggatcagcgccaggaagagcggcggcgactacgacctgacggtggagttcagcaagtccgtgatggacagcccgatcgacatcccggccggccaggtgaagccgtccatggacgtcaagctcggtggggcggacaagggcacggtcaaggtcgaggggccggtgaacaaggaggtcatcaagacgggcgccccgatcgagatccccgacctcaccggcacgtacaagcccggcgcgagcggtaggtccacgctcagccccggggtcctgacggtgatggccgccggcacgacgaccacctgcaccccgcccgccggcgtggccgtctccctggagctggacacctccgcccagccgggcggcgtgtccggcggcagcgggagcggcggcacggcgggctccggcggagccgcggcgtccggcgg

SEQ ID NO: 2966 - DNA, 4774 bp, Unknown
  Kingdom: Bacteria, Phylum: Actinobacteria, Class: Actinobacteria, Order: Streptomycetales, Family: Streptomycetaceae, Genus: Streptomyces
gccgcgcaccgtgatcaggtcggccgcgccggggcccgcgccgatgaagtacaccgtcatgatcgatctcccttgtacgaacgtgcctcggaacccgagggcttggtcaccgaccactgcgtcacgggcatggcctgacgccagccggtgaagccgccgaccgggacggcgtgcgccaccgcgaggcgcaccagatcgccgccgtgcgccttgtgccgttcggccagcagggcctccgactccagcgtcaccgtgttcgcgaccagccggccccccgggcgcagcgcctcccagcaggtgcgggtctttcccgtcgaggactcgccgaccagagtgaccatgacgctctcgccccggctcgcccgctccacggcttcgttgagctcgcggtcgtgcgcccgctcgacgtacagcggcagagcgggtaacgacttctgtcccggtacggtgatggcggggtgcacctccagggcgaagggatccagctccttcaccggggcgccgaggggttcggccaggcgggccgcgacccacatctccttgatccgacgccccgcctcgtcggcgtccgagcccgccatgcgggccagcagcaccgcgacggagaccacgtcctcctgccctgccgccaactcctcggatccgatgatgcggtggacggtggccttcgacgggctgcccgggaacgagtcgtcgtgctcgatggcgctcaccacactcttgagcgaaggggtacccgcctccaggtagagccgatacaggcaatccttcaactcccgcaccgcagtgggccccacggcaaggggtttggggatgcaccgctggctccccagccgctgcgtactccggtgacccgacatcgaaacatccttgcgtatccgaacagcagtcacacacgaagtgaccgattgacgagatggtcgggcacgaccccaccgggtcgatcaccacggtgatcggcgtgcggaccgctccgaggtcgcccgaccgccttctggccggtggatcacgggaacacccacctgatgaccccgtcggccatcgctccgaccacggcggtgacggcgctgcccagcagcactccccccagcatcagacgttcgcgacgactcagcttgcctcgggtcacggcggggctcccctcccggtcgacggcaccggccgagcaccggtccgttacccaagaattcccggttcgggtcagccctggacgagttgagacgggtcctggcgccccaccgttctccggggagccaggggcggtggtcggggaagcctcaggccgccggcttgcgccagaccgagatgtgcttggcggagtcctggccgaacggcgctccgtcccagtcctcgacccgctgttccagctccagtccggcgatgcgcgccatcaggtccagctccgccggccaggcgtaccggtgccgggagtcggcgcggcggtagcggccgtcgtcgccgtcgcgggtgaagtggtgcgagacgaggagctgctctaccaggtcgaaggtgtcgaagccgagatgacggtcggacacgtcgaacggcaccgcgacctgaccgggcggcaggaaccgcagcggtggcacgcccagttcgatgacgaaccggccgccgggcgccagatggcgggccgcgttgcggaagcactcgacctgctcgtcctgggtgagcaggttcgagatggtgttgtagacgaggtagaccagggtgaactcgccggggacgaccgtggtggccatgtccccgatggtcaccgggagggtctcctcgtcgaccttgcggcggagcacggccgccatcggctcggagagttcgatgcccgccaccggcacgccgcgctcccggagcggcacgcccacgcgtccggtcccgatggcgaactccagggcccttccggatccggcgagtcgggagaggaaggcgagggtcggttcgagggcggaggccgaggagatctcggcctcctcggcgtcgtggcggtcggcggtctctcggctccacagttcgctgctggtcacgggcgaccactctgccgggcgtccgggagttgtgtcgacgccttttcgtgcggccggctccctgggtacgggtgccgggtccgcgaccggccccggacacgttgtcagtgccccctgccaccatggtcatcatggcgacctacctgctttccgacatcgaacaggcgctgcgcagcagttggagcgccgagacctgcaccccggagtaccgggaccgctggaccccggacaatccggcgcgggaccagtgcggggtgaccgccatggtgctcaacgacctgctcggcggggagttgatccggggtgaggtccatgtcgacggagtgcggaccgacttccactggtggaaccgtctgggcatgggcgtcgagatcgacctgacccgggagcagttcgggccggaggaggtcgtcgtgggcggtgacgtcatcgtcaggccgcccgtcagcgagtggcggcgacttcaggaggagtacgcgatcctgcgcgaccgggtcgcggagaggctcgggcggggctgaggtcccggtggcggtccgtgccgcgctgtcgtcggagcgcgcgggccgagcctgcggcgtatagccgcggcgcaccccggtacgcctcgccgtacctgcggcgcaccccgatccgtgcccgttccgtgaccccgccggaccggccgaagtacccctcgtacgcactacggtgggcccatgccgtccgtgtgcttccggggcaaggagatcgaggagagcgatcatgggtgagtctctgaagaccttcgtcggcggtgccgaggtcgaggtgcccaacagcatcccggacatccgggccgcgctgcccgacgagagacgcgaggagttcgacctcgcgatcaacgaggccggggtgcacgagattcaggccgtcatgcggcactggatgctggaggccgtccccgatcccgaggccgagaagatcctggaccggctggcgcaggacgaggccgagaggcggagcgtcgcttgagcttccgcatctcctacgcaccgcccgccgacgacaccctggccaagatgcgcggcggcgagtccttccgggacgagatggcccgcactctcggcgaggagccgtacggccacgcctcctccgccgtcaagagcgaacgggaccggcgtgaggcgaccgtctccggggccatcgtcctctactacgtctcccggtccgtcctgaccgtcaccgtcgtccgcctcgtacccctgccctgaccaaccgagaggcaggaagggcaggggagcggcgcggcatcagtccacgtcaggcgagcttcctgtcctgcgccgccacgacctccgccggcacctcgaacttcacgtcgccgcccgccgccgccaggttgaaggagaagaacgtcgccacggcgccctccttgcgcagcgccaccagcttgaacggagccttgtcgccgtcgtcctcggaggtgaccgtccaggccgcggcctcgtcgccgccggtgaccttctcctcggtgatcgaggcgaccttcgtcggcgtgcccgcgaccgtggcggtgaagccgcccgcgcagtccgcggcggccttcttcagcgcggcgaaggcgtccgggcccgccgtcccctcgtaggagttcagcgcgacgaacgtggacgtcaggtcgaaggcatccttgaacgcgtcctcggcctcgccgtccgcgaggtcctccagcgacttcttggcgccggccttcggctcgtcgatcaccttgcgcttcgtggtggccaccgaacccttctgcgccacgccgtacatggcgtgggcgaccggcaggcaggcctccttgtccaccgtgacgccgtccgccgggacctcgtcggccgggccggcctcggtgaccttgcggcccttcacgtcgccctgggcgagggtggccttctccagctcggcggcagtgagcgccttggccggggcctcgggggccgcactgccggcgcccgccgtgtccttgtcgtccttcttgccggcgtccgaggtgccgccgcaggcggtggccagcagggcgagggcggccgcggaggcggcgagggcggtacggcgtacggcagtggcgcgcatggttctacttcctgcaatctccggttagggggcaaccgcccttcccccgcacggcacttcgacgccgtctgggacgggccgtcgcagtgatccacaccttacgatcgaacctgtgagcgatgaccgggtcggcggtcccctccggtgatcgtgattctgctgtgatcatcctgtgcacgcacggtgcggcaccgctgtacaaccccgccgcgcacccccgacccgacccgagccccacacccgcctctgcctctgccgtgcgaaaggcgtcaccccgtatgtccggccacgttcccgtcccgcctctcacccgtgtcctcgacgccctcgggatcggtgaacacgacatcgcctcgcgcgccaccctcaccggcggcacgtacaacaccgtcacccgcgtcacgctcaccgacggccgcgactgggtggtcaagacgccgccgccgcacaccgccgccctgaggtacgaacgcgacctcctcgtcaacgaggtcgccttctgcaccgccgccgcgcagaccggcagcgccacggtcccccgcgtcgtccacagcgaaccggacccggcctcgccgaccggcgcgtacctggtcatgaccgcccgccccggccgcccctggcacgagaccggcggggcgccgagcacggacgacgagccgcggctgcgcgccgaa

SEQ ID NO: 2967 - DNA, 6096 bp, Unknown
  Kingdom: Bacteria, Phylum: Actinobacteria, Class: Actinobacteria, Order: Streptomycetales, Family: Streptomycetaceae, Genus: Streptomyces
ccccgggaccctgcgccgggccgcccgcctcaccgcccccggcgaggtgcggaccctggagctctggaccaccgaacccggcctccaggtctacaccgccaaccagctcgacggcgcgttcaccgacggctccggccgccgccaccggcgccacggctcgctctgcctggagacccagcacctgccggactcacccaaccgccccggccaccccaccaccgtgctgcgtcccggcgagaccctgcgcagccgcaccgagtggcgcttcccgcacctgcgcgccgcggataaccggttgcggccgccggcggctccctgatctactccggcagtccaccggtacgacccaggagtaagaagcatgcgccgagctttcgtgtccctcccgacagaaactgacctttctctcaaggacatgaagcttcgtgcacacgttgaacctgggaatcctggcgcatgtcgacgccggtaagacaagcctgaccgagcggctcctccacaccgccggagccatcgacgccatcggcagcgtcgacgacggcagcacacagaccgactccctcgccctggagcgccgacgcggcatcaccatcaagtccgccgtcgtctccttcaccctcggcgccaccacggtcaacctgatcgacacccccggccacccggacttcatcgccgaggtggagcgggtcctcggtgtgctcgacggagctgtcctggtcgtgtcctcggtggagggcgtccaggcgcagacccgcgtcctgctgcgcaccctgcgccgactgcgcatcccgaccctgctgttcgtcaacaagaccgaccggcccggcgcacggtacggctcgctgctgacgagcatcaccgaacggctctccccggacatcgtcgcgatgggatccgtccggggcctcggcacccggtccgcgacgagcaccccgttcaccggagccgatcccggtctcaccggcgcgctcaccgacctgctcacccggcacgacgacgagctgctgagcgcgtacgtcgaggacccggcgggtctcacccacgcccggctcctcggcgcgctggccgaacagaccgcccggtgtctcgtgcacccggtcttcttcggctccgccgccaccggctcgggcatcgacgccctggtcgacggcatcaccggactgctgcccgccgccacgggggatccggaggcgccggcccggggcacggtgttcaaggtcgaccggaccgcgaacggcgagcggaccgcgtacgtccgcatggtccagggtgccgtgcacgcccgcgaggtgctgcgcttccgcagcccggacggccgggagggcgaaggcagggtttcggcggtcagcgtcttcgagaacggccgtgaggtgccggtccgggcggtccgtgccggccggatcggcaggctgaaagggccggccggcatccggatcggcgacagcgtcggcgcggaccgggccgaggccggacgccggcacttcgccccgccgaccctggagacggtcgtcgtcccgcggcgacccgaggaccggggcgccctacacgtcgcgctcggccgtctcgccgaacaggacccgctgatcgccgtccgtcgtgatgacctccgcggggagatgtccctctcgctctacggggaggtgcagaaggaggtcatccagacgaccctggccgaagagttcggcgtggacgtggtcttccgggggaccacgaccatctgcctggaacggccggccggcacggggacggccgccgagttcatcgacaccgaccccaaccccttcctcgccaccgtcggactgcgcgtcgacccggccccgtacggcagcggggtgcaattccgccgcgcggtggaactcggctccatgcccccttccttgatgcgggcggtcgaggagaccgtgcgtaccaccctgggccagggaatgcacggctggcaggtcaccgactgcgtggtcacccagacgcactccggctacagcagtgtgtcgagcacggcgggcgatttccgcggtctgacgccactggtcctgatggacgcgctgcgccgcgccggtacgcgggtgtacgagccgatgcaccgcttccgtctggaggtgcccacggacgccttcggagcactggtcccggtcctcgcccggctccgcgcggagccgggaccacccgaggcgcacggtgctctctgcgtcgtggagggcgagatcccggcggcccgggtccacgagctccagcggctgctgccggggtcgacccggggcgagggggtgctggagtccgtcttcgccggccaccgcccggtgaccggcccggtcccggaccgtccgcgcaccgaccacgacccgctgcaccgcaaggactacctgttgcgcacggtgcggcgggtcgccgagtgagtcccgctacttgaggtaggggcccgccgcgccgatcttccccggcgcggcgttcttcccgccgaggtccaggacgtacacgcgcaggttgccctttcctggggccgggaccgcgagggtcccaccggtgacggccttcgtgtcacccgtcacgacgtccttgtacgtgccgttggggataccggtgtacgtggcgccgccggagaccgtcaccagggcgaagctgtcggtgccgctcgccgcgtcggtgtagcgccgcttgtacgccatggagccgctgatgccctccgtggagtactggcccatctggagggcgggcaccgcccgccggatctcgttgagccgctggaggtgccgggccagcggcgcggccagggtgtccgcggccttcccggtggccgaggacaccttgccgaagtcggaggccgtcacctcaccggccaggtggtccccgaagtaggcacgcccggtcgtcgccaggggacacgtcggcccgcagtcgatcttcttccccttctggaactcgatctcggagccgtagtagagcgtcgggatgccccggaaggtccacatcagggacatgttctcggcccaggcgtcggtgccgcccgcgtagcgctcgctgctcttgttgggcccgtagtcgtggctgtcgacgtagacgacgttgtacgtggcgtcgttggtcgcgtcgtcggagtccttgccgttgtggtaggcgttgttcgcgtccccgaagttcatgtgcatccgcatgtcgatgacgttcataccggagaaccggctgcggtcgggggtgtggtaggcgttgcccttgaggaaggcgttgtcggagacgggctgcgccgccgtgccctgctgctgctcgtagtcgtacatctccagggcggccttctcgtcgtccgcgctgtactccttgcgttccttccaggtgaagaactgcgcggagtggttgaccgaaccgcggttccacttgtcgttgacgaaggcggcgacctcaccgaagacgaagaagttcttcgcggccccggccccgaaccgctgcgtgacccgttcctggatcgcgggcaggaagcgacggttccaggtggtgcgggggatgtgcaccgcggtgtcgagccggaagccgtcgacgcccatgtcgatgtacttgtcgtacgcgccgatcagatagttctggacctgcgcgttctcggtgttgaagtcggcgaggtcgtcgtgcagccagcaggagcgggagtcctcgccctcccagttgccgatccagcagatgtggtacagcgccttcgggaacatgcccgaagtggggctcggccactggcagttgtagatccggtagccctccggagaggtgtgtccggtgggcgttccccagttgaggcaggtgttgccggacggttcggccgtggaccacaggtcgccgttgtagtacgacttccccgacttcggctcgacggtgaggccgtcgtacgcgaaggcgtcgttcctctcgtcgtagaaccagctccactgggcgtcgcgcaccccgtaggccttcggggtgaacagtcccttggcaccccagcgcgaggagtggttgtggaccacgtcctggtagatcttcatccccttggcgtgcgccgcgttgatgaggtcctggtacgaggccccggtggactccagtcgcgggtcgaccttgtagaagtcgtagccgtggtagccgtggtagtcgtagtccgagcggttgagcacgaccggggtgatccagatcgcggagaagccgagccccttgacgtagtcgagcttctgcaccagtcccttgaagtcgccccggaacatggggtcgccgcccgcggcgttgccggacttctcgtgctggctgccgccccggttgttcgcgctgtcgccgtcgttgaagcgcgcggtgagcacgaagtagatcgggtccttgcgggggtcggtgcccagcggtgtacccgtcgccggggcggtcggcctgtcgccggtggtggcggaggccggggtggattccgccgagacgttcccggcggcgtcgacggcccggacggtgtagcggtaggcggtccgcgcctcgagaccggtgtcggagaacacggtcgaggtggtgtcggagaccaccgtgcccttcgtgccgccggtccggattacctgataccccgtcacccctaggtcgtccgtggcgggttcccaggtgaccacgaccgcgaccccgtcggcggcggccctcaccgccgtgggtgcggtgggtgactcggtgtccggttccccggcggcgcacgggtccttcgcggaggccgtcaccgtgcggtccttcaccgtggtgagcccggccgccagggtgtagtcgttgccgttgttgttgtcccagacgccgttgccgtcgttgaacgtcgcctggaggccggcggcgctgcccaggtccaccgtgcgcttcacccagccggtgcaggcggcttccatgccgatgccggggacggtcgtccaggctccgccgtgcgggcggtagtggagattgacggtggaccagccgacggtcgaggtggcgtagtagacggaggcggtgttcggcccttggggctcctccggctcctcggggcctgtgtccgcgcacgggtcgctgtgtgccacgacgccgccccggacggtgatgttcccggtgcccaggtcgtagttcttgcccgcgttgttgtcccaggtgcccgagccgtcggtgaaggccgccctcagtccgcccgagtccccgagggggaccgccagcttgacccagtcggtgcaggcggcctccatccgggtgccgggcacggccgtccaggagccggcgtcgggggagtaatggaggtagtacgccgaccagtcgcgggtcttcgtggagtagaagacggtcgcggtggtcccggcggcggccgaggccccgacgggtgcggtggccgggccgggatcggcctgcggtgcggccgcgaggagtcccagcagcccggctgctgccacggccgccgcgagcgggcgtcgcagcagccggtgaggggtgcgtctcatgcgtgtctccaggggagggggagaaccctgacgcgcctcggggttcggcgagtgaacacgatccggcggcaaattccgccggaatgttgctgcaatcccttgcggggaggaagttaccggtgcatgacaggtgcgtaaagggatccggcagcaccgctccgccggaatgggcggccgggcgagggcgttcgcacggtcatgaccttctccgttgatgtgaccgtgcgcggctacgagctcgacacccagggccacctgaaccaggccgtctacctccagtacgcggaacacgcccgctgggagctgctgcgcgccgccggactgccccaggagaagctgctggccgacgggatcggcccggtgcagctggaagtgacggtcaagtaccttcgggagctgcgcggcggcgagcgcgtacgggtcacctgccggttcgactacggcacgggcaagacgttcacgatggagcagcagatcctcaaggaggacgggaccgtggccgcggagatcaccggagtggccggcgtcctcgacctgaccgaacgccggctcgtcccggacccgcggggccgtctggccgcgctggcgggcaacccggatctgctgaccggctgaccggtggcggagcggaccgctccggagcccgccacgacaagcccgtcgcccc

SEQ ID NO: 2968 - DNA, 686 bp, Unknown
  Kingdom: Bacteria, Phylum: Actinobacteria, Class: Actinobacteria, Order: Streptomycetales, Family: Streptomycetaceae, Genus: Streptomyces
ctccctcgccgcgcggggcctctccgggccgaccggctgcgtaactttgtcgatatgacgcgcaccgagtaccgctggctgctgccttcggcgatggccgatcccgagctgcccggcgaccggccccggacgcggcggaccgtgcgggactgggccgtcgacatcacggccttcctctgcgccgcgggcatcggcctgctggccctcgccgccatcgacgccgacgagaccaccgcggatgtcttcgtcctcgtcgactcggtgatcggggctgccgcctgctgcgcactctggctccggcggcgctggcccgtcggcctggccgtcatcctgaccgtcgtctgtgtcgtcgaacccgtggctgccggagcgctgatggtggccctcttcagcctggccgtccaccgacccttcaagcccgtggcgatcgtcggtctcggcgccctggcagtcgctcccctccagccgctcctgcgccccgacccggcgacctccttcctcgcctcggtcatcttcgggatcctgctgatcctgctggtgctcagttggggcatggtcgtacgctcccggcgccagctcgtcctcacgctccgcgaacgggcccgccgcgccgaggcggaggcggacctgcgcgccgagcaggcccagcgcctggcccgggaggccatcgcccgcgagatgcacga

SEQ ID NO: 2969 - DNA, 1763 bp, Unknown
  Kingdom: Bacteria, Phylum: Actinobacteria, Class: Actinobacteria, Order: Streptomycetales, Family: Streptomycetaceae, Genus: Streptomyces
gtccgcggccaccgtcgcggccggggcgcgctcgggctcggccccggcggtccggcccgctccgatacccgtgccgaaggtgtcgcgcacgatggcgaaggcacggtcgagctgggcttccacatcgccctggccacccgcccgcagccagcggcgcagcacatggttgtgcgcggtgaccacggcggacgcggcgacctccgcgagcagcggatcgtcgttgcccacatggtggtcgcgctcgtcgaagtggcccaggagataacgggtgaacagccgctcgtagcgggccaccgacgcgatctcggcctccctgagggtcggcacctcacgggtcagtttgtagcgggccacggagacggcgggcttggccgcgtacatcttcatgacttccttgatgccgcggcagacggtgtcgagcgggtgctcgtgcgcgggggcggcgttcaggacggcctcggccctgacgagggtgtcgtcgtggtccgggaagatggcctcttccttggagcggaagtggcggaaaaaggtccgccgggcgacgcccgcggcgcccgcgatctcgtcgacggtggtcgcctcgtagcccttcgtggcgaagagctccatcgcggcggcggccagttcgcggcgcatcttgagccgttgggcggcggcgcgcgtccccgcggtggtggtctccggggcgtcggtcgcggcggtggcacggggtgacttggcgggctgggacatggcatgaacgtaacgcatcggtgcaggagagcgcgcctgcgggggcggaccgccggagggtcccagcagcccgccccacccggctcccgggtcagcgacgggcatattcgcggaagccgcgccccgtcttgcggccgaggcaccccgcggcgaccaggtgctccagcaaaggcgcgggggccaggcccgggtcgcggaactccgcgtgcagcaccttctcgatggccagcgacacgtccaggccgaccacgtcgagcagttcgaacggacccatcgggtagccgccgcccagcttcatcgccgcgtcgatgtcgtccagggaggcgtagtgctcctcgaccatcttgatcgcgttgttgagatacgggaacagcagcgcgttcacgatgaaaccggcccggtccccgcagtccaccgggtgcttgcggaccttcgcgcacaccgcgcggaccgtggcgtggacgtcgtcggcggtcaggacggtgcggaccacctcgaccagcttcatcgcgggcgccgggttgaagaagtgcatcccgatgacgtcctcggggcgcgcggtcgcccgggcgacggcgatgaccggcagcgaggaggtggtggtggcgagcaccgcgcccggccggcagaccttgtccagcgcggcgaacagctgctgcttgatctccaggtcctcggcgaccgcctcgacggcgaggtcgacctcggcgaacgcgtccagcgaaccggccgccgtgatccgcgccagcgtctcgtcccgggcctcggcggtgatccgccccttggtcaccgaacgctccagcgacttcgcgatccggctcttggcgatgtcggccttctcctgggacctggccgcgagcaccacgtcgtagccggccttcgcgaacacctccgcgatcccggaggccatcgtcccggagcccgcgacgccgacggacgccacctcgcgcccggctccggaggcggcgtccgccaccggggtcagcgcgtcggggaccacggcctggccgccgggggcgtcgtacgtgtag

SEQ ID NO: 2970 - DNA, 1831 bp, Unknown
  Kingdom: Bacteria, Phylum: Actinobacteria, Class: Actinobacteria, Order: Streptomycetales, Family: Streptomycetaceae, Genus: Streptomyces
gcggccggtgcgggtgcggctgcgggcggcgcctcttcctcggcgacctcgccgccgaagttcttcagaagcgcgtcgagaccgccgtcgaagccctggccgacggcggcgaagcgccagacgtccttcaggtagaagtcgccgagcatcaccgcgcgctcggtggtgaactccgatccggtgaaggcgtaccgcaccacttcctcgccgcccgcgacgatccggatgtaccccggaccgatctgggacatctgcccggaaccgtcgagcgtcgcggtgaaggagagcttctggatggctgccggaatgcggtcgagcgtgacgcggaaggactcggtgtcaccggactgcgcgccgaggagctgaatggactcctcgggcgatttcggctgattgaagaagatgaagtaccggtcgtcggagagctgctcattggcgtcgaggccgaagcagctgatgtcgaaagtcagccccggggccgcgatctgcacgcctacgtacagatccgtccctggcgtgagatcactgatcttggccttgtggccgcgttggaattccctggccatgcgtaacgaccgtcccccatccagaaggtaaatgcgtcgcgtcaggctaaccgcaaacgacgacatcgagccaagccggtacagacccggtacagaatcggcgaacgcgaccggccccggtcactcctcgcgggcggcgggcaggtgcggcagccggtcggccgccaccacgccctccagatacccgcgggcgcgctcggtgcgggggtacgcctccagcagccgccagaaccccggaccatgtccgggaacgagcagatgtgccagctcgtggaggagcacgtagtcgaccacgtactccggcatgccctgcaggcggtgcgagagccggatgctgccctcggcaggggtgcacgagccccagcgggtgttctggttggtcacccaccgcaccgagacgggcctggcgcgcccgtcgaaatactgggcggacaggcgcacggcacgctccgcgagttcggtgtcgcccaggacgcgcttgttctcctgggcggcgagcttgtccagcatcacgcccacccagcgccgctcctcggcctccgacatccgggcggggatgagcacgatcgtgcggtcgccctcgcggtaggcggagaccgttctcctgcgccgtgtgctcctgcggacctcgaccgcgctcgtcgccgaagcgcgggccggatgggctgccgcgctgcgctgatggcttccggcgctgggcgcgggggtctccccggcgaagccggacgacgggtcggcgggcacgccacgacgttacccgctgtccgtgggggaagtcccgccccgggagcggttccgcggtgatcctcgccagggcacgcaccatttgaacgactaaaagcttgaacgactaataccccctgcctgtggacgactccgtgcacggttcggcgcgggcccgcattctgacggtggtcctgcggaaagacccgtggatctgccggtctgcgagcacacccgtgcccgcgacaccgctcggggggagaaatcatgcatccgatgctgaagcccgcactgcgtcgcgcctggcgtggacggaacaccgtgcaattcggtgtgacacccgctcacgccgtgacgctcggaccggtggacctcgccacggggagttttctggaactgctcgacggcacgcgcggactgcccctcctgcacgaggaggcacgcgctctggacctgtcggaacgacatgtggacaccttgctgacacgattggcggaggccgggctcgggtcgtccaggagcccggcctccgccaatcgtgt

SEQ ID NO: 2971 - DNA, 7164 bp, Unknown
  Kingdom: Bacteria, Phylum: Actinobacteria, Class: Actinobacteria, Order: Streptomycetales, Family: Streptomycetaceae, Genus: Streptomyces
gggtggcggccgcgtcggcgaacaccacgtcgatctcctccggggcgagacccgcgtcggccagggccagttcgatcgcccgggccagtccggggggacgaccgctgcccggccgggggtccagggtcgagccgaatccggcgatctccccgtagacctcccggtccccccgggcacggacactctccaggtcctccaggaccagcagcgccccgccctctcccggcacatggccccgtgcggcggcgtcgaagggcagatacgcccgcttctcgtcctcgctcgtactcagtcggccactcgccatctgggcgacccagccccacgggcagatcgatgcgtcgacggccccggtcatcaccagtccggtgcccttgcggatctgccgccgcgcatgggcgatcgcgtcgagcccgcccgcctggtcgctgacgaccacaccgctcgggccgcgcataccgttgcgaatggagatctggccgctgttgaccgcgtagaaccaggcgaaggactggtacgcgctcacatagcggctgccctggctccacagcgcctgcaactcccgctggccgaactcgaacccgcccgatgaggaggccgtgatcacccccatgccgtactcgggcatctcctgcgggtcgacccccgcgtcggcgagtgcccagtcggcgctcgccagggcgatccgggtcatccggtcggtctgcggcagcaaccgtcccggcagatggtcctcggcgacgaagtcgttgatctccccggccagttgagccgggtactgcgcggggtcgaaccgcgagatgcggccgattccgctgacccccttacgggctgccgcccagtacgcttccgtaccgcaaccgttgggggcggccacgcccagaccggtgaccacggttctcacggcggcgccgctcatgccgcgctcctttcgggacgggccagcaccatcgcgctctggaagccgccgaagccactgcccaccgagagcacggtgtcggtccgccagtcgcgtgcggtcaacggcacgtagtccaggtcgcattcgggatcgggagtgtgcaggttcgcggtcggcggtacgacgccgtgctccatcgcgagcacactggccgcgatctcgatcgaaccgatggcacccagcgagtggccgaccatcgacttgatcgagctgacgggcacgcggtacgcgtggtcgcccaggctgcgcttgaacgcggcggtctcgtgccggtcgttctgcttggtgcccgagccgtgcgcgttgatgtagtcgatgtcgtccgggttgagccgggcctcgttcagggcggtgcggatggcctcggccatctccctcccctcgggccgcaggcccgtcatgtggaaggcgttgctgcgcgtggcgtagccggcgatctccgcgtagacgcgcgcgccgcggcgcctggcgctgtccagctcctccaggacgaagacggccgcgccctcgcccaggacgaatccgttacgggtgcggtcgaagggacgggaggcgtgctccgggtcgtcgttgcgcgaggtggtcgccttgatcgcatcgaagcacgcgaccgtgatcggggagatgggggcgtccgacgcgccggccaccatgacatcggccgagccctcgcggatcagctcggcggcgtaccccaccgcgtccagcccggaggtgcagccggtggagaccaccgtggcggggccctcggcgcccacggcccacgccacctcagcggcgaaggaactgggcaccaggtagttgtagaggtgcgggacggcataggtgtggtcgacgagttcgagccggccgctgtcgctgacggtgcggtactcctcgtccagccccatggtggcgccgaccgcgctgccgatggtcacaccggtgcggtgcgggtcgagggcggtgaggtccagcccgctgtccgtcacggcctcgcgcgccgtcaccacggcgaactgcgcggcccggtccatccgccggatctcctggctgctcagcccgaggagttcggcgtcgaagtcggcctccgcggcgacctgcgagcggaacggggacgggtcgaagaagctgatgcgacgggtggcggtgcggccgtccgtcagcaggctccagaagttcttgctgcccaccccgcccggcgcggtgacgccgattccggtgatgacgacgcgcctgccgtgcggcgcgctcactgtgcggtccagtcgtagaagcgctccgccaccgcgtcggcgggagagcgccaggtcgccgggtcgtatgcgctgatgtacggcttgaggtcgttgctgatggcgacgaaccgggagtcggtcttcgcctcctcgatgcgctcgccaccgtcttcgccgtcgaagtcctggaggtggaagtacaggccgcggtacgagaagagctgacggcgcctggttcccatccggtgcggcatcgtggtgtcgtcgaacgcgccgaagaggtgcgcgacctccgtggccgagtggggttccatccgggccacgatcaacgtgctgtgcatccaaatctccttgtcgggatgagccgatccgggaaaggccgagtccgggggcgaatccttgatgggcacgccgaagcggcgcaccgggatatctcatcggtgcgccgcgcgagaaattcagtgatgtcacttcggaccggacgggtaattcgggccggacgggaaatgccccataaacggtctgcgcttgtcctggccgccgtcccagccgccgaatcgacacagtgctgaggaagttagtgaacagcttcttcgggagaccgccggatgtcaatgcccttttcttcaagcagtgacagggctgagtcagagaatggttaagtgctgctgtgcggacaacgcggtttcacctggccagggtgcggatgcgcgcggccgcggtcgcgcccgcgcatccgtgcgaaaacggaagcgggcacggcgtcgatgccgtgcccgcctgccctggaggaccgatccgtcaggagcgaccgccggtgcgcgctcccagggagcgcaggacgtcctcctcgtggtagaaggtgcggcccttgcccgtacgccgccgccactgctgctcgctggcatggcggtacacgctgccggagggggttccccacagcagggagatgtcacgtgcgctcagccatcgcaccgtcgacgccgggcgcaccggcccagccgtgcgctcagccgggcccggacggcccgtcgcctccgccccgtccgccacctccgtcgtacgctccgcgggctccctgcggctcagcgccatccactcccgggcggaccagcggtgcgaggcaaccgcgccgcagctgacctcgatgggcggatcaccttggccggagccgcgcaccacggccgtcaactcgccctcgcagccggccaccacgcacgccccgacccgcaggcccgacccccgggacgggtcgatcacgtacatcacccggcgtaccgctcgcgccacctcggcggacagctcgcccgcggcctcgtgggcggccagccatccggcgtgccggatcaggaacgcgacgacaccttccagggtcccccggggcgcggcgacgctccgctccccgacgaccagcccggcccaggagcggaccaccccgacgatcacggaacgggcctcggccgccgcggtgttgaaggggagcccgggcgccacgccgccgccaccggacgtacggtcgcgcggccggtgggatccaccgaggagcagcccgcactcgtcgtacaggcggggcagccgcgccagatcgctggtcaggcgccggacacagggcgagcagagccgggttccgcgcgcggcgagggatcgaggacgtcccgctgcctcacctctgccgcgacaggcgatgccctcgcattccgccaggtccgccaggtccgccactgtgttcaccgagtagggcgctcttgtcgtgtcattgaattcgcgcgtcatcttgcccccgtcttgagtgggggcgaatgtatttcgcggattcgatgacaggcaaggaaaggcctgatccgtgtaaatcctctgtagtaggtcttccattcccctgacggaactgtcccacctatgacgatccactgaaaccgatcgacacccgtcacatttcggacggctcgtaatcgattttcagccgggccgcgataccgtcgaggacacagtccagaccgacctcaaaatgccattgcgcgtcgtccgtgcaggcgggttccccgaggtagcgctcgcacatcgggtagcgaccggtcttcatcaaccaggccatctgtggggacagttgggagagtgccttctcctggctctgccaccccctggcccgcagcagctgggtcagcccgatctccgagtcgacggtgccccgcacaaaggaggtaacggtgctgtatacggccgcggaggtgtcggcgtcgaaccggttgtcggcgagcacggccagtgcgccttccagcgcggcgagctggttcggcgtgggtccgcaccagtcggcccggggcacccagggatgcttgaggaacaccgcgcgcagacgcagggccagcacccgggtgacctgccgccagtcggactcccctgagggcagctcgagttccccgtacgcgtggtcgaccatcagctccaggagctcgtccttgccggtgacatagcggtacacggccatgggtacgacgcccagcgcggcggcgaggtgtcgcatcgtgagggcgtccagaccctcggtgtcggcgatcgccaccgccgcctcggcgatccgctcaggggtcagcgaggttcgcggcgccggccggtcgagccgttcccataaaagggtgctcggccggtccttgctcatgtcctgcctgtccctgatggacatcaacgggactccttccactcgagaggtcgtttcctgtggcaccggcggccgttggatcagccttgagggacggatccgggtggagctgctggtaccggacgagctgtgcgtctcgtcacggcgcatggtgccgccgaccgaggtgttgcatccgcagggtggtgacatgggcaagcgggagatcgccaagccctggcagtgatcgtcttcgcagccactggagatgcacccggcggcaaccgccacccgtgtccgggcccctggtggcagacggtccacaagcgtttcgcccagtgcggccgggaccgtgctcggctccacgcgtcctcctcgatggactcggcgccggggagagctggactgactggacacaatacgcaattgcttccgccgacgtccggactgaaaaggcgcaccgcttacggaagcaaatccgaccacccctggtaggaaaaagacggaagaccgcctgtcagttggccggaacgaacaacctcggtcaccgggccaacctcacccctcaagcagacttgaggtcaagacgcgaggcagacccgcccggttccgggcgcgcttcagcatcgatggttccgggcttccgctcctgcggtaccagccggacacgacctggtggtgcaccggccccgcgacccggtccccttctccgagccatgcacaagggaaccgccggtccccgagcaccgcggcccgagagccccagcgggccataccctccgtgcgacaaccacgtcacccgctacactggcggcggcgagcagccctcatggggcgatcaccaacctgtctcgaacaggtcagaacgaggctgcgtgagcgacaccgttccagacacatttgtagacagatccccgccttcgtagctcaggggatagagcaccgctctcctaaagcgggtgtcgcaggttcgaatcctgccgggggcacagcacgttatgccgatgccctggggtttcctccagggaaggcgttccgcacggccccggactcctcgtccggggccgttcgcgtgggcggtgccgcctccggccccggacggccatcggaccttccggccgatcttcttgctcagggcctcacgcccggaacctcccctccccctcggcgaggatctcgtcgatcacgtgcgcggcggtcctcgccatcaccgggttcgtgtcccggtagtgcgcgagctccaccagggcgatggacagcgcccagccccgcccccgcgtccaggtggcgtcgtcggccgcgaccgccgtgcggaacgtctccctggcccccgccgccagcaggtaccaggccgcgatcaggtcgacggccggatcggcgagaccggtgcagccgaagtcgatgacgccggtgaggcggccgtccgcgaccaggatgttgcccggctggaggtccccgtgcgcccagacgggccggtccgtgaagggctccgcggtcagggcctcgtcccaggcggcggtggcgctcgcccggtccaggaccccgctcagggccgccagcgcctcacgggtcgcctggtcacgggaggccagaggttcgccgcggtaggcgggcggtgcgtccgccggatcgatccggcgcagcgccagcacgaactccgccagatcggccgcgagcagttcggaggccgaagagccgtcgccggccaccgggttcgtgccgtccagccaggtgcggaccgaccagggccggggaaaggccttgtccggaactccctggaccagcgggaggggtacggggaagggcagccgcgaagccagcagcggcagccagcggtgctccgtcgccacatccgccgcgctgccctcggtacgcggcagccgtacggccttgtcggcgcccaggcggtagatcgcgttcgcggtcccgctcgcgccgaccgcctccaccggcaggtccgcccagtgcgggaactgggcggcgatcaggccgtgtacgagtgacggttcgatgatcatgcggcgatcgaaccaggtggtcccgggcgcgcacaacgggttctcccgaccccgccgtaccgctggtcttcgcacgcgttcttcccctcgggcccgtcccgtccccgccgtcccggaaaagtcggtgcggcgcggtgccccgtacgggaggatctgcggccatgacgtgtccgccgcgcatcctcgtccttccgccccggctcaccgcctccgcccggacgttgcgtgccaccgcgctgcggcgcggcctgcggatcgtcgaggccacggcctccgccgtaccggaagggctgggaggcgcgggatgggcagggtggccggagggagcggggg

SEQ ID NO: 2972 - DNA, 7634 bp, Unknown
  Kingdom: Bacteria, Phylum: Actinobacteria, Class: Actinobacteria, Order: Streptomycetales, Family: Streptomycetaceae, Genus: Streptomyces
ccggccggatgcatgtgccgttgtgggccgagcccacgggacggggctggtcgcggcggagaattcggcatcgccggacgcccggagggggcttcgcgagaacgcgcccgcgctacttggtcgcgccctgggcgaagccgttgtagatgtagcgctgaaggaagaggaaggcgatcagggtgggaacgatgaccaggacggctcccgccgagatgttctcccagtgggctccgaaggggcccttgaagcggaaaagggccgtggagatcgtgccgagctcttgggagggcatgtagaggaaggggatgtagaagtcgttgtagacggtgatccccttgatgatcaccacggttgcgatcgccggcttgagcagcggcaggatgatcttgcggtagacggtgaacgagttcgctccgtccagccgcgcggcttcgtcgagggagaccgggatgccgcggatgaactgcaggaagatgtagatcgagacgatgtcggtgcccatgtagagcaggatcggggcccagcgcgtgtcgaacagcccgaagccgttgatcacctggaaggtcgcgacctgcgtggtcaccccgggaacgagggtggcgatgaggaagaggcccatgacgagcttcttcgcccggaagcggaagcggtcgatggcgtaggcggtcatcgaaccgacgatcacggtgccggtgatcgagaacagcaggatgaacgcggtgttcgcgaacgccgtcagcatgtgaccgtcggagaacgcggtcgcgtagttgtcgaagttcagccagttgcccggcagcgacagcgcgccgccgtccgaggcttccttggacgtcttcagcgaggtgaggaagacgacggcgagagggagaagcaccaccagtgaggcgatgaccagcgagaggtagacgagcgtctgcccgagccggccacgcggcccgtcggcgcgagggcggcgcgagggtgcggtggtctgcagggccgtggtcatacgaggtccacctcttcgtcgggcacgagccgccgctggatccaggtgatcaggagaatgatcagcagcagcacgacggctgccgcggaggccagcccggtcttgttgaactggaaggcgagcttcaccgtctggatgacgaacgtcgacgttccggtcgcgccgccggtcatgatgtacgggatctcgaagacggcgagcgagccggagatcgccaggatgacgctcaggctgaggatgggtctgatgctgggggcgatgatgtggcggaactgctgccggcgggtcgcgccgtcgagttgggcggcttcgtagagttcaccgggaatcgactggatggcgccgaggaacaggacgaagttcaggccggtgaagcgccagaccgagacgccggcgagcgaggtgttggccgaggtggggtcacccagccacgcgtggtcggttcctgcgccgaaccaggacaggaccgagtcgagggtgcccccgtcctggaagaagtacaggaagacgaatccgatcgccacgccgttgatgaggtaggggaagaagagcaggcccttgaacagattgcggaaccgcaggttgaagctgagcaccgtggcgaagtacagggcgacggcgatctgtacgccggacgccgccaggtagtagaggctgacgaagaagacgcggaacaactcggggcgggtgaagatctggacgtagttgtccgctccggtgaagttgcggtcgggactgatgccgtcccagtcggtgaagctgtaatagatcatgttcgccacagggacataggtgaacgtgatcagtagcgtcagcggcgccaccaggaagagccagggcgtcgcgcggcgcagcagttgcgcccgcggtgacggtgcggtgcggctgcgggcggtggccccgcgccgtgcggatgcggcacggtgcgtcttcccgcccgccacctcggtcgttttggtcatatcgggcctttcgtcatccgcgtctcgattccatgcgcgcgggagggtggcggccccggccggtgtcgtacggccggggcctccctcgccgggtcaggatccggcggtcttcgctgcctcgtcccaccgcttgttcaggtcggtgaagtagtcctcgaggctgcccttctgggctccgcgggcgatgtcgaccagcttctggcggtagtcgggcttgttgagcccgatctcggcggcgttgtcgatgtcgttgacctcgcccgtgccggtctccgagcgctccgtgaaggtgacatcgttgtcaacaaagtccgccagggtggccggcatcggggcggacttgagggtgggtacggcgccttccttggcggagtaacccgacttctcggtgaaccagtcgatccatgcgcgggccgcctccttgtgctcggagtgagcgttgacggcctgctggtagtcggagacgagggtggcgcagtggccgtcgcccttcaggaccgggaggggcatgtagccgatgtcgtccgggttcttgcccgccttcttggcggcgtcccgcatctgggtgatggcccaggagcccagcatcatggagccgatctcgcccttggcgagcttgctcttggaggcttcccagttggtggtgctggggtccttctccgagagccctcccttgacgatgtcgtgcagcagggtgtcgatcacctggagttcgcttccctgcttccacggggagacggggccggcgagcttgttcgtggcgttctcgtcgcaggtgaccgagccgatgttggtggtccactggaccagtggccagccgtccttgaagttggtgtagtacggggtcgcgccggtcttggccttgatcgcctccagtccggcgaggaactcgtccggcgtggtgggccaggcggtgaggccggccttcttccacagggccttgttgtagacgaagccgttggcggtgccgaactgggcgatgccgtagaccttgttgtcgacagcggacttgtcgctgaagcggtacgtgtccgccatcttgatggaggagcccagcggggcgaagaacttggggtagtcgttcttggagacggaagccgggatcatgaggacgtcgccgtagtcctcggtgttcatccggatcttgacttcgccctcgtagtcggtcaggccctcgaacttcaccttgaccttcgggtagaccttgttgaactccgccgcgtacgcgtccatcgccccgctctggaccaagtccgtccgctgcgtgaggaccgtgatggagccggtcgccttgcccgggtcggcgggggccgtggccgtttcggtcgacggcgctccgccgccgctgcaaccggtcacggcgagtgctgcgacggtcagaagtgcgcccgtaagcgtcttcgtgttccccatgtgcccaactccttagatggcggctcgggtctgcggtgggatgttggcactatggcaggacgtatgtgaaccggtaaagctctcatttccacgacgatgcctaatcgttaccatgtgttgtcatcgctcccccaatgggcccagttctccgcaccttgcgttacgacttcgtgactagaccggtttatggacagtgatcaatctgcgggttaagttgtgtccgtcatccatctgagaccgcgcgaattcgggcgattggagccgcacatgaaggacgtcacccagctcaccgacggctggagcctgcgctacggccaggagctcctgccggcccaggtccccggctgtgtccacaccgacctgctgaccgccggagtcatcccggaccccttcctcgacctcaacgagaccgaggtcgcctgggtcggccgacgcgcgtggtcctacgtcgccgacgtgtggcacgacagcgggcacgagcgcaccgaccttgtcttcgacggcctggacaccgccgcgcggatcaccttcggcggccgcgaggtcggcagcacccgcaacatgcaccgcacctaccggttcgacgtcaccgggacggccggagagctggaggtccacttcacctccgcctacgacgaggccgaagcggtccgcgaagtgaccggagaccggcccaacgtctatcccgagccgttccagtacatccgcaaaatggcctccagcttcggctgggactggggaccgacgctcgtcaccgccggcatctggcgacccgtacggctggagcactggtcgacggcacgtctctcctccgtccgcccgctggtcaccgtcgacgaaggcacggggagcgtggagatccggctccaggtggagcgtacggaccgcggcgcgggcaggagcctgctggcgcgcgccacggtcgccggggagcacacggaggtccgcttcgagggcgcggaggccgtgctgcgcctgacggtcgacgaaccgcggctctggtggccgcgcggatccggtgaccagccgctgtacgacctcgacgtcaccctgtccgacgacgacgggcagctggacgcctggcaccggcgcatcggcttccgcaccatcgaactggaccgggcgcccgacgcgcggggctcgggcttcaccctcgtcgtgaacggcgagcgcgtattcacccggggcgtcaactggatccccgacgacgtgttcccctcccgcgtgacccccgagcgctaccgcacccgactgagccaggcagccgacgccaacgtggacctcgtacgcatctggggaggcggcatctacgaggacgaagccttctacgacgtctgcgacgagctcggactgatggtctggcaggacttcctcttcgcctgcgcggcctacccggaggagcagccgctgcgaggggaagtcgaggccgaagcccgcgacaacgttgtccggctcatgccgcaccccagcctggtcctctggaacggcaacaacgagaatctctggggcttccgcgactgggactgggagcccggcctcgcgggcgactcctggggtgagggctactacctcggactgctgccccgcctcgtcgccgaactcgaccccactcgcccctacgccgcgggcagcccgtggtcgggatcatgggaccaccaccccaacgaccccgaccacggcacgtaccactcctgggaggtctggaaccgccaggactacgccgagtaccgcgcgaacgtcccccggttcgtcgccgagttcggctggcaggcgccgcccgccatggccacgctccgccgcgcgctcaccgacgaggaactggcccccgactcccccggcatggcgcatcaccagaaggccgaggacggcaacggcaagctcgaccgcggagtcgcgcgccacttcgctctccctgacaacgacttcgaccgctggcactacctgacccaggtcgtccaggcccgagccgtcgccgcgggcatcgagcactggcgctcccactggcccacctgcgccggcaccgtggtctggcagctcaacgactgctggccggtgagctcctgggccgcgatcgacggagacggccgtcccaagccgctccaccacgagctgcgccgtgtctacgccgaccggctcctgaccctgcaacccggagaggaagggctggtcctcgccctcgtcaaccagtccgcgaccgagtggcacacgacggtcgccctgcgccgcctggaggcgaacggggcgacgctcggccgcagcgtgcaggaggtcgttgtcaacgcgcgttccgtcctgcgcctcccggtaccggccggactcgtgcccgaggagcacgccaccaaggagttcgtcgtcgccgacgctgacggtatgcgtgccctgcacttcccggtgccggacaaggagttctcctacccgaggccggattacgacgtcgtcctggaaccggtcgagggcggcggcggtaaggtcgacgtcgtggtgaacgcgcattcccttgtcagggacctcctcctccaggccgaccggctcggccccgacgctcgcgccgaccggggcctcaccaccctgctggccggcgaacaggtccggatccgcgtggccggctgcggcagcgtgacgacggacgaggtacgggccgcactgttctgcgtggacacgaagtgaacagtcctgcccgcatcaccatcaaggacgtcgcggcccgggccggtgtgtccaaaggcgcggtctcgttggcgttcaaccgcaaaccgggtgtctccgaggcgacgcgcgagcgcatcttcgaagccgcccgggatctcggctgggcaccgaatcagaccgcccgcagcctctccagccagcgagtcgacatcgtcgggctggccctgtgccgccccgcccggctgctcggcctcgaaccgttctacatggacttcatctccggaatcgagagcgtcctggccgagcggtcgtgctcgctgctcctgaggctggtacgcgacgtcgacgaggagatcgacctctacaagacctggtggcgcagccagacgatcgccggtgccattctcgtcgacttcgaggaaaacgatccgcgggttccggccctccaggccgtcggtctcccggccgtagccgtgggacacccgtcgctcaccggctcctttcccgccgtatggacggacgacgccacggcaacagccgaggccgtccgctatctggccgctctggggcaccgacggctcgcacgggtgggcgggccggccaggttcgggcacagcgccatcagagccgcggctttcgcctcgaccgtgcgcgagctgggtctggaagaaggacggcagatagcgaccggattcgacgaacgagaaggcgcacgcgcgacgcggtccctcctccttgcggcgaaccgccccacagccatcatctacgacaacgacatcatggcggtcgccggagcaggcgtcgcggcggagatgggtttcgtcgtcccggacgacctctccctgctcgcgtgggacgactcccagctgtgcaggatcacccaccccaccctgtcggccatgagccatgacgtccaccacttcggtgccgtagtgacccggaccctcttctccttgatcgagggcacgcacaccggagctcttcaggtccccaccccctccctcaccccgagaggatccactgcaccggcgccccagatgtgagcaccacggccctgcgagacgcacacagaccggcgtccggtcgaatccacgacgccgccggtgaggccgcggggtcaggggcggccggtgggcacggtgtccttcgtcagcagcgtgtcgccggaccagcagagccggtagaggtcgacctcgtccaacaggtcgcggccggaacggtagaactcgcaacgggcgcccggcggccggggcgcggaacgggcgtggtcggacgggtaggggtaggcgcgggccggcagcagaggggtgagttcggtgcgcggccggccggtcgtcaactcgtcgaaccgggagggcgggagcacgctcgtcgtcagttgccacgccagatagacggcggacggcacgaagaagacggccgcgacgacaggcgcgacgaaggcgagggccgagcgtcgacgggcatcgctccgtacggaggcgagccgctcggcggactccggcaggacctcacccggggcggtatccgggtccatggctctgatcgggtccggggccaagcccggggccaagcccgggtccggggccatgcccgggtccgggcttggccccgggctt

SEQ ID NO: 2973 - DNA, 18840 bp, Unknown
  Kingdom: Bacteria, Phylum: Actinobacteria, Class: Actinobacteria, Order: Streptomycetales, Family: Streptomycetaceae, Genus: Streptomyces
ttccagcgcctcgggccagctcgccggttccagctcgccctcggcgttgcggaccagcggggtggtgagccggtcgcgctgctgggcgtaacggaagccgaaccgccccttgtcgcagatccactcctcgttgacctcgggctcgttggccgcgaggcggcgcatgaccttgccgcgccggtggtcggtccgggtcgaacagccgcccgcgcactgctcgcacaccgagggtgtggagaccaggtcgaaggggcgggagcggaatcggtaggccgccgaggtcagcgcgccgaccgggcagatctggatggtgttgccggagaagtacgactcgaaggggtcgccctcgccggtgccgacctgctggagcgcgccgcgctcgatcagctcgatcatcgggtcgcccgccacctggttggagaaccgggtgcagcgcgcgcagagcacgcaccgctcgcggtccagcagcacctgggtggagatggggacgggcttctcgaaggtccgcttcttgccatcgaagcgggagtcggcgccgccgtgggacatcgcctggttctggagcgggcactcgccgcccttgtcgcagacgggacagtccagcggatggttgatcagcagcagctccatcacacccttctgcgccttctcggcgacaggagaggtgatctgcgacttgacgaccatgccgtcggtgcaggtgatggtgcaggaggccatcggcttgcgctggccctcgacctcgacgatgcactggcggcaggcgccggcggggtcgaggagcgggtggtcgcagaagcgcgggatctcgatgccgaggagttcggcggcgcggatgaccagggtccccttggggacgctgatctcgatgccgtcgatggtcagcgtgaccaggtcctcgggcgggatggccgcctcgccgcccccggagggcgcactcgtggtgactgtcatgcgttcaccccccggtgagcgttcttgccgtcggtgttcttgtcgtcggcccaggccgtggaccgggcgggatcgaaggggcagcccttgcccgtgatgtgctgctcgtactcctcgcggaagtacttgagcgaggagaagatcggcgaggccgcgccgtcgccgagggcgcagaacgacttgccgttgatgttgtcggcgatgtcgttgagcttgtcgaggtcggccatctcgccctggcccgcctcgatgtcgcggagcaactggaccagccagtaggtgccttcgcggcagggtgtgcacttgccgcaggactcgtgggcgtagaactcggtccagcgggtgacggcccgcacgacgcaggtcgtctcgtcgaagcactggagcgccttggtgccgagcatggacccggcggcgccgacgccctcgtagtcgagggggacgtcgaggtgctcctcggtgaacatcggggtggaggagccgcccggggtccagaacttcaagcggtgcccggcccggatgccgccgctcatgtcgaggagctgccggagcgtgatgccgagcggcgcctcgtactggccggggctggtgacatggccgctgagcgagtagagcgtgaagcccggggacttctcgctgcccatcgacttgaaccagtccttgcccttgttcaggatcgcgggaaccgaggcgatggactcgacgttgttcaccacagtggggcaggcgtacagaccggcgaccgcagggaaggggggccgcagccggggctggccacgccgtccttcgagagagtcgagcagcgcggtttcctcaccacagatgtacgcaccggcgcccgcgtgcaccgtgagttccagatcgagtcctgaacccaggatgtccgtccccagataacccgcctcgtacgcctctcgtacggcctcgtgcagtcgtcgcagcacggggacgacctcaccgcgcagatagatgaacgcgtgcgacgaacggatcgcgtaacaggcgatcacgatgccctcgatgaggctgtgcgggttcgcgaagaggagcgggatgtccttgcaggtccccggctccgactcgtcggcgttgacaaccagatagtgcggtttgccgtccccctgcgggatgaactgccacttcatcccggtggggaagccggcgccgccgcgtccgcgcagaccggagtccttgacgtacgcgatgaggtcgtcgggagccatggccagcgccttgcgcagaccttcgtagccctcgtggcggcggtaggtctccagggtccaggattcgggctggtcccagaaggcggagaggacgggtgcgagcagcttctcggggctcgtcccgttgtggtcgatctcggcggccaaggtcatcactccccctcctcggctgcgggcccggccgggtgctccgggtcggaggccgaggtctgctgcggtgcgtcgtgcgagctgaggtgctcggacggtgaagggtcgtgcggctgcccgtcccggggctgcgcgtcctggggctgtccgacgcgcggggagaccacgcgcgcctgcgggagtgcctcgcccttggcgagcttcagcccgacgagggaggcggggccggcgccgccggtcgcctcgacggcgccgggccgctcgtcggggaagcccgccaggatgcgggccgtctccttgtacgagcagatcggtgcgccgcgggtgggctcgacggtccggccggcgatcaggtcgtcgacgagctgcgtggcgctctggggcgtctggttgtcgaagaactcccagttgaccatcacgacgggcgcgaagtcgcaggcggcgttgcactcgatgtgttcgagggtgaccttgccgtcctcggtggtctcgttgttgccgacgccgaggtgctccttgagggtgtcgaagatggcgtcgccacccatgaccgcgcacagggtgttggtgcagacgccgacctggtagtcgccgctcggcctgcgccggtacatggagtagaacgtcgcgacggcggtgacctcggcggtggtgaggtcgagcgtctcggcgcagaaggccatgcccgtacgggagacgtatccctcctcggactgcacgaggtgcagcagcggcagcagggcggagcggctgccggggtagcgggcgagcacctccttcgcgtccgcgtcgagccgggcgcgcacctcggccgggtagggggtgggggggagctgcggcatccccagactgacgtcttggcgtgatgtggtcaccggtcgacgcctcccatcacggggtcgatggacgcgacggcgacgatgacgtcggcgacctggccgccttcgcacatcgccgccatggcctgcaggttggtgaaggacgggtcgcggaagtgaacccggtaggggcgggtgccgccgtcggagacgacgtgcacgccgagttcgcccttgggggactcgacggcggtgtacgtctgtccggccgggaccctgaagccctcggtcaccagcttgaagtggtggatcagggcttccatggaggtgcccatgatgttccggatgtggtcgagcgagttgccgagtccgtccgggccgagagcgagctgggcgggccaggcgatcttcttgtcggcgaccatgaccggcccgggctccaggcggtcgatgcactgctcgatgatgcgcagcgactggcgcatctcctccaggcggatgaggaagcgtccgtaggagtcgcaggtgtcggtggtcgggacctcgaagtcgtaggtctcgtagccgcagtacgggtcgctcttgcgcaggtcgtgcgggagtccggccgagcgcagcaccggacccgtggcgccgagcgccatgcagccggtgaggtcgaggtagccgacgtcctgcatacgggccttgaagatcgggttgccggtggcgagcttgtcgtactccggcaggttcttcttcatggtcttgatgaactcgcgcagccggtcgaccgcgcccgggggcaggtcctgggcgaggccgccggggcggacgaacgcgtggttcatccgcaggccggtgaacagctcgaagaggtcgagaaccagttcacgatcacggaagccgtagatcatgatcgtggtcgcgccgagctccatgccgccggtggcgacgcacaccaggtgcgaggagagccggttgagctccatcagcagcacgcgcaggacggtggcccggtcggggatctggtcctcgatgccgaggagcttctcgacgcccaggcagtacgccgtctcgttgaagaacggcgtcaggtagtccatccgcgtgacgaaggtggtgccctgcgtccagttgcggaattcgaggttcttctcgatgccggtgtggaggtagccgatgccgcagcgggcctcggtgacggtctcgccgtcgatctccaggatgaggcgcagcacgccgtgcgtggacgggtgctggggtcccatgttgacgatgatgcgctcgtcgtcggacttcaccgcggattcgacgacctcgtcccagtcgccgccggtgactgtatatacagtcccctcggtcgtggcacggggtgtcgcgtggggagtggtcatcaggagtacgacctccgctggtccggagccgggatctgggcgcccttgtactcgacggcgatgccgccgagcgggtagtccttgcgctgtgggaagccctgccagtcgtccggcatcatgatccgggtcagggccgggtgcccgtcgaagacgatcccgaagaagtcgtacgcctcacgctcgtgccagtcgttggtcgggtagacctcgacgatcgacgggatgtgcgggtcgctgtccggggcggacacctccagccggatcagccggccgtgggtgagggaccgcaggtggtagacggcgtgcagttcgcggcccttgtcgcccaggaagtggacgccgctcacgcccgtacagagttcgaagcgcagggcggggtcgtcgcgcagggtgcgtgcgacctggaccaggtgctcgcgggcgatgtggaaggtcagctcctcgcggtcgacgaccgtcttctcgatggcgttggaggggagcaggtcctgttcctccagagcgccttcgagctcgtcggccacctcgtcgaaccagccgccgtacggccgggaggcggctcccggcagggtgacggtgcggacgagacccccgtagccggaggtgtcgccgccgttgttcgcgccgaacatgcccttgcggacgcggatgacctctccgccggtgtcacgcggagcgggtacggcgttgccgttctgctcgccgttcgcgtcggtgttctcggtcaccgcaggagccccttcatctcgatcaggggcagtgccttgagggccgcttcctccgcctcgcgggcggcctcctccgcgttgaccccgagcttggaggtctggatcttctggtggagcttgaggatggcgtccagcagcatctcggggcgaggcggacaacccggcaaatagatatcgaccggaacaatgtgatcaacaccctgcacaatggcgtaattgttgaacattccgcccgatgacgcacaaactcccatggaaatgacccacttgggattcggcatctggtcgtagacctgccgcaggacgggcgccatcttctggctcactcgtcccgcgacgatcatcaggtccgcctgccgcggcgatccgcggaagacctccatcccgaaccgggccaggtcgtagcggccggcgccggtcgtcatcatctcgatggcgcagcaggccagtccgaacgtggccgggaagacggacgacttccgcacccagcccgcggcctgctcgaccgtggtcagaacgaagccgctcggcagtttctcttcgagtcccatggtgtgcccctcagcccctcagtcccattccaggccgccgcgacgccatacatacgcataggcgacgaagacggtgagcacgaagagcagcatctccacgagcccgaagatccccagggcgtcgaaggagaccgcccagggatagaggaagacgatctcgatgtcgaagacgatgaaaagcatcgccgtcaggtagtacttgatcgggaagcggccgcctccggcgggagtcggggtgggttcgataccgcactcgtacgcttcgagctttgcccggttgtaccgcttggggccgataagcgtggccatgaccacggagaagatcgcaaaccctgccccgagggcgccgagcacgaggatgggcgcgtaggcattcacgctcctcgctccttccagtcgtccttgacctgtggaccgcatcgggcgaccggctcgccgcctcaccaagatcgtgcacatgtgaggcagttcacaagcccgactgccccgcatcctatgcccggccccctgtgatctgcgacacggggtacgacaacggctttgtgatctccaccacctgacgaaggatcatgaagtcgtatgagcggtgatcttcgtacgcgaagcggccgagtgatcacgagacgtgacattcgatggtgttaccgctggtcaaaggcgtgccgcgctatcaatcgacggcccctacaagcaaattggcggtggaacaccccgggatgataaggacgtcggccgggaccgatgctcacccgcaaggggggtggcggggaccgaaggggacatgtgcacgcattcacgaacttcccggatcgagcacccggagagagcacccacccgctcacccggcggcccggcgcgcgagcggagtcgccgcttccgtccacggggtcgaccaccggctacgccgcgagcgcccacgcgcatcgcgcccgcgagggttgcccgccccggcggacccacgctgtgacctgcgccacacgacatcgggtcccggaaagccgggcttggccatcggtgtgaacggatggtaagcgacgggcaattcgggcgtattaccgaaaggcaatgatcacgggcctgatgacggccgcccgatttgcccgttacggcgtcaataaaggtgcccagaaagcggattcacagattccgaacgtaactgtgtcgcaacacacgtttcttgatgggacccctacagccctgatagcgctagtacccatgtcccacaccgctcacatacccagccaccggaagccccgtcagcgcgcctcgaagtcggcactgcgagccggagttgccggtggcgtcctcagcaccatcgcggtcgcgggtgccgccggcccggcccaggccgagccggtgacccagacgatcgagatgcccacgatcacgtccggcttctccaccgctgtggccgcctccgctcaggccacgcagcaggtcgccctcgacctggagacgcaggccgacgaggacgccgcggccgagaaggccgcgaagacggccaagaaggcccacgccgaggccgtccgcaaggccgaggccaagaagaaggccgaagccgccgccaaggccagggccgaggcggaggccaaggagcgtgccgagcgcgcctcccggacctccgagcgcacgacgctcagcgcctcctccggctcgtcggactcctcggagtcctcgggcagctctgcctccgccccctcctcctcgaacgtgagcggttccgccgcctccatcgtcgcgttcgccaaggcccaggtcggcgacgcgtacgtgtccggcggcaccggccccaacgcgtgggactgctccggcctggtccaggccgcgtaccgcacggcgggcatcgacctgccgcgcgtctcgcagtcccagtcgaccttcggcacgcaggtctccctggacaacctccagcccggcgacatcctttactggggcagcgctggcagcgcgtaccacgtcgcgatctacgtcggcggcggcgagttcgtcggtgcgcagaactccagcaccggcacggtgcagcgctccctggactacgaccggccgaccggcgcggtccgcgttctctgattcacaagcgcccgcgggcgctccgctgcacggctgagggccgccgctcccccgctcgggggcggcggcccttcgccgtcgtcgtcgcggcgacgaacagggccaggaccatcagcagcgcgctcacccagaccggcgcccggtagccgaatccggcgtccagggccacgccgcccgcccacgggcccaccgtcgcccccaggttgaacgcggtcgtcgagaaggcgccggccagcgtcggggccttggaggcaaggcccaggacccgagtgatcagggcggtgcccgtgccgaaggcgagcatgccgaggagcggaatcagcgccagggcgagcaccgggtggcccgccgccagggcgagggccccggcgatgtggaccccgccggtgtaccagaaccggcctccggggctctcgtccgcgagggccgggccgtcgtagcggttgcggcgcagcaggatgtcggtggcgtagacggcggtactgggaccgagcaggacgacggtgagctgaaggacgtcgctgatggtgccgaggagatccgacaccaacagcgcgtacagggtcagggagaccgccgcgacgccgtccacgagcacgctgagggagcgccggatgcgcaggcccacggcctggagcgcgagtcccgcgctgtaggcggtgagggcgttgatggcgaccgtgccgagcaccagggcgagcaggaagacgggggcgaaccagccgggcaggatcccttccagcccggactgcgggtcgctcatgtcgaccgccgtggcggcgagcgcgcccagggagcagacgacgacaccgggcacgaagccccccagggcggtccagcccacgatcgccctcttcggagtcgcacggggcaagtaccgggagaagtcggcgctggtggtgtaggacagcggccccgacgcgacgagcgcgaggcctgcggcgagcgtcgcccacagggccctgccgctcagcggctcggcgggacggtaggagaggtcggcgtgcccgaagacgctgaaggcgacgacggcgaaggcgagggcgagggccagggtgatcggcagatacagcttcatgatcgcggcgtgcccgtagacgctgatgacgagggtgagtgcggcgatcacgatgacgacggcggccgtgaccccgccactgggcgcgatgcccgcccgtgcgacgagggctgacgcggcgctcgccgcggcggccaggttcagggcgaagtagcagacggagatcatccagccgacgaccgcgttgttgacccggttgccgcggactccgtagaccgccctcgtgatcacctcgctcggggcgccggcggccggtccggagacggcgagcaccccggtgagcagccagaagaggttgccgaccacgatcaccgcgagtgcctgagccaggctcagccccagcaggacgagcacccctccggccagcaggctgaggtagttgacgttgaccgcggcccagacggcgaacagctcgcgcggcttgccgtgccgctcggagtccgggatcgggtcgatgccatgggcctcgatgcggcgggcggcgcggtccggtggcgcacccgtcccgcccgcctcttccggcggcgccgcgcccggacgccggaccgcgccggaaggcagcggcccggccggagtcagcgacccgaccggggggcacgcggcttcgtgcggacctgggagcgggtcgggaatcgtggacgccatgggccctccggatgctggtcgtacccacctgcttgcttattggtcgcacactcaataacgttcggggcatgccgtcaagcgttcagcgtccccgtattcggaaaagtccggccgcccgacgtgcggagatcgtcgaagcggccgcctccgtcgccctcgccgaagggctggagtgcatcaccctgcgacggatcggcgacgacctgggcgtgcgccccggactgatcagccattacttcccctccgccgaggacctggtggccgaggcgttcggcagcgcggccggcggcgagctggacacactgctgccgaaggaccccgtcggcgccgctcccgtcgagcggcttgcccggttcctcgcccgcacggtcggcgggccctacgacgcgatcagccggctctggatcaacgcccgccacctcagccgctatcggcccgccctgcgggaccgggtcgccgaacaggaggccgcctggcgcggacggctggagggcgtgatcctggaaggcgtggcgtgcggagcgttccgcacgcccgacccagcggcgacgaccatgcagatcctcgtcgtgctggacggtctcggcgcgcacgccaacaccgagacgggtgaccggcccgccgccgtgacccggatggcgctcaccacggccgaacgcgaactcggtctggccgacggggcgctgacccgcacggctgaccgcgccgactgaccgccgccgcgcccggcagccccgcgccgcccgccccaccgaccgcatccctccccggcctacgcgccgtcacccgccctggagtctccgtgcgcccctctctcgtcctgctctcggcccgtctgctcgacccggccaccggccgggtcctgccggaaaccgcgttggccgcgtccggaggccggatcgcggcactgggcgggaacgaggagatccgcgcgctggccgactcctcgaccacggtgatcgacctgaagggcgcggtggtgacccccggcctggtcgacgggcatctccacccggtctcgggggcggagttgacgcacgggctggacctctcgggctgcaccgacctggaagcggtgcgcgccgcgctggcgagcgaggccggtcggctggccccgggtgcttggctgcacgcctgggggctggatccgaacgtcttcggcggcggggccgtcgaagccgcggccctgtcccccgtactcgacgacgtaccggcactgctccagctcttcgacgcccactccctgctcgccagcccacgtgcgctggaactggcgggcgtcgacgggccccggacgttcgcgcaggccgccgaagtcgtctgcgacgcggcggaccgccccaccggcctcctgctggaggacgccgcctgcgaactcgtcgagcgggccgctccccggcccacccgtgagcaacgccgcggccggctcgccgccgcactcggctccatggccgccgcaggcctcaccggcggacacgtcatggacgcgaacggggacagccttcctctctacgccgagctggacgcggccggtgaactgcccctgcggttgcgggtcgcgccctggtgccagcccggcgcggacaccgcggcggtacgcgagctgatcgaggggcagggagccggcgggacgctgtggcggacggcgggcgtcaagctcttcatggacggcaccatcgacaacggcaccgcctggctggagcggcccgactgccacggcgagtcgacgcacgccttctggccggaccccgaggcctacacccgcgtcatcggcgaactgcaccgcgccggggttccgacggccacccatgccatcggagacgcggccgtccggcacgccctggactccgtggaacgggccacgacctccaacggcccctccgtacggcaccgggtcgagcacatcgagacggtgcccgacgacactctggaccgattcgcgcacctcggcgtcatcgcctccatgcagcccacccactgctgcgacttcacccgggccgaccacaccgacaactggtcgcagcggctgggcgaggagcgagcgtcccgggcctggcgctgccgcgacctgtgggacgcgggcgcacgggtcgtcctcggctccgactggccgatcgctcccttccccccgctgggcgtcatggcgggagcccgccaccgtcgccccggacgggacctcacccagcccccgcacggccccgagcaggccctcaccgccctcgaagcgcttcagggcatgaccatcaacgccgcctgggcggcgggcgaggagcacgaggccgggcggctcgccgtcggctgccgcgccgacctcacggtcctggccgacagccccctgaccaccgcggccaccgagctgccgggtctgccggtgctgctcacggtcgtcgacgggcggcccacgcaccgcgaccctgcactctgaaacaccgcacgcggcggggccacggggccggcagaggcgcttctgccggccctcacctgccgaagcggcgttcccggttcgcgtacgagcgcagcgcgcgcaggaagtccacgtggcggaaggccggccagtagcagtccacccagtgcatctcggcgtaggcggactgccagaggaggaagccggacagccgctgctccccggaggtgcggatgatgaagtcggtgtggtcggccacgggcgagtagaggtgccgggagatgtcgtcgatcccgaaccgggcgaccagttcggccgggtcgccgccggccgcgatgtgctcctcgaaggcgctcttcacggcgtcgacgatctcgcgccggccgccgtagccgaccgccacgtccaccttgaggccgccgcgcccggccgtggcggctgtggcctccttgaacacccgggcgctggcgccgggcagcatgtcgagcgagccgatcgcccggacctcccagtcgcggccctcggcggtgatgtcccggacggtctcctcgatgacctcgatcagcgggccgagttcctcggcggggcggcccaggttgtcgtcggagagcatgaagagggtcacgtgctcgatcccggcggccgtgcaccagccgaggaacgtggtcaccttggcgccgcccgcccggtagccctcccggacgtccgtgtgcccggccttccgggcccagcgccggttgccgtcgaccatgatcccgacgtgctgggggcgcggcaggcccaccagggtggcggcgagccgacgctcgtacaccgcttcgatcggccgtcggaggaacaggggaagcagcttcatgggcccactccatcacaggtccgccggcacaggacgatcccgtcggcggacccggacacctccggccggatcgtcacaacgggctgtccccgccctccggttcggtgaccgggtggtcgctgaccagagcggccagcaccagcggcgcgtccccgtcgctgtgacccacggtcagagcgatccaccggccaccgggggcgaccgggccccagaccaccaggtctccgtacaggtcctcggcgaacagcgcctcgaacagcggctccacgggcgtgccggcctcccgccgcagcagcgccacgtgcagccgcaccggccggtgcggaccccaaaggccgtccaactcccttgccagcgcggccagatggccctcggcggcctcctcggcgtcgttccactcgggggcgtacaccccggtgagggggttcccctcccagagcggcacgatccggaagccctccccgaccgtgaccgtccattcaccggtgaccgggtcgccctcggcggcggtggggccggtggccggtacgggcgcggcgaggagcccggtcacctcggcggccgcgcgctccgcgtcgaagtcctcgcccgcccgggaggtcacaggaccgcccggtccatcgggcggggcagcggctccagcgcccccgcctcacgcagccgctggtacacccgcaccacgctcgcgctgtcgcccggggccgcgatgctcagcaactccccgccgccgggcagaggttcgcggaccacctccaggccgtcggggacgagggcggcgcgggccggggagaggtagccggtccggccgacgaccgggtcgccgacggagtacccggcgtcgtcctccagtgcgtccagcacgtcgtcgtcgctcacgtcgccgaagtccggttcccacacccgggcgacgagcgacaggagcgcctcctcggggaccacggcctcgtccggggcgtgcaggatgatcgcgagcgactggagcaggaactccggcgaccctccggcgagtccgctgatctcggcctcccagccgggcgccccggtgccgacgagccgcaatccggtgccggtgaggtccgaccagtcggccgcgctctgggcggtgcggagcgcgccgagcacggcgtccccgtcggaggtgaaggcggtggcgggtccgttcccgtggacctggctccaggcgtcggccgcctgcgggaccagctcggcgaacccgtcgagggtccgccgccaccggtcggccaacgcctcggccggctccggccggggaccccagaatccccgcactacacgtcgcatgctcgtctctcctccgtcggccggcccgctgcacgcggccccccggccggactgcggccgggatcaccacgcgtgcaggctactaggggtgtttcgaaagtagcgccgtccgcccggagggcgggtcccgcggcgttcggccacgtgaatgacagcgtgtccgcgggcgacgcgggcacgggcgggcggcatggcgtcatcaggagaaacagccgccgaccggtcggttcgcgccctatcctcgtcgccaggatggttgttcggactgcgagggggacgcgatggatccgatcgctgtggcaggactggccggtaccgcacttgtgggagccatggccaccgacgcttggcagcagacgcgggacggggtcgtcgccttgtggcgtcgtgtccatcccgagcgtgccgaggaggtcggccaggagctgacgcggctccgctcgatggtcgaggagcgcggatccgccgaagtcgaagcggcgatgtcgcagctgtggcagctgcgactgcgcgatctgctcctggccgacccggccctcaccacagagctcaccacccagctggctcaccttgccgacgagatgggcgcacggggtgcgtccccggacactcaggtcgtcggcagtcagcgcctggaggcgcacgcgtccggcagcggccgggtctaccaggctgcgcgggacatgcacatcaccgagagctgaagggccgcagttcatgggcgggcgggaggcggcggaggatccaccgctctcgacggctccccccacgggtgccggtccgggcgccggtcccgagccgagtaccgagtcctccgcgggagcggattccgtgacaccgcagcccgttcgcctggacgccttcgcacccggcggccgggtctaccaggccgcccgggacctgtacgtctcggaggcccaccacgtcaggccggccgggcccctggccgtcgtcgaacccgtgctgcccaccggcgaagcgacagccgaggtcttcgtgggccggggcaccgagaggcgggaggtcctggctgttctcgatccggctcacggcgccaccggcatgatcgtcgcctcgtccgtcgcgggactcgccggcatcggcaaaaccgccctcgcccgctcctgcgccgccgaagccgtggagcggggctggtacgccggcggcgccgtgttcgtcgacctcaacggctacgcgagcgaccccgtcgatcaggtcatgcccgagcatgttttcgctcccctgctccacgccctcggcttccagggccgcctggccgactcccccggcgggcaggctgctcagtaccaccggatgctcgccgaccgggctgccgaacggcgcccggtgctgctcgttctcgacaacgcgtccagcaccgctcagatcgccggcctcatgccgcgctccagggcccaccgcgccctcatcacctcgcggcacaccctggtgacgcgtggctcccgcaccctcgaactcggcgtcctgtcacccgccggcgcccgtgccctcgtcgaggaacagctcgatttcctctctcccggcgagacacgcacccgacaggacgccatgggcacggagcgcctctgtcgcatgtgcggccatctgccgttggcccttcacatcgccaccgccctcctcgcccgcgatccggacctgacgccggcagccctcgcggacgaactcgcccgcgcacgcaacaagctggacatcctcgacgacggggaacgggcggtgcgcgccgcgttcgagctctcctaccgccgcctgacgcccgaacaagcccggttgttccgactgttgcccctcaaccccgggccgcatatcgccacggacgtcgtcgcacggctcgccgacatcaccgacgaccaggccgtcgggctcatccgggagctggcccgcgcccatgtcgtcgagcgggcgggcaacagcgtctggcggcagcacgacctcatgcgcgcctacgcgatcgagctcctcggcctccacggcgatgaccagggtgcggcgtcgaaccggctcatcgagcactacatagccttggcagccgacgctctgtcgaccctgcacaccgaccggccctccgcccctttccgtaccgtggaggacgcactgacctggtacgaccgtgagcaccccaacctccaggccgcgatctcgatggctgcgaccttcggcgacgacgacggcgccctgcgcatccaggagaccttgatcgcggtgcacgcccaccgcgggcagacggccgaatgggaggccgccgcccggatggcggtgcgctacgcgagagaagccaaggaccaccccggcagatcccgcgcactgcaccaggtgatggtcgccctggaacgcggcggccgacaggaccaagcggaggaagcggcaagggagttgctccgctttcagcacgaagtcatcgaggccgcctcccgggccgaggatcccgtcgactgccagcgcctcctgcaacacgccgtcgccgcggtggcggagagccggcgtctgctcggcgacagcgagagtcggttgctgcacacccggcgcgaggacatcgcacgggtggcgagcgcccgtcacctggacgagacctttcaggagatcggcccacggcctccgcgccgcctgagcgagccacccaccgatggagtgccgggcgtttcggcggaggcggtgaggtgggcccgaagtgcgctggagcgcttaccggagggtttctcccggggtaccgatccggtcgccgacgccgcccccgcgcagatggcggctcggcgcgctctgtccctgattcccgaggacctgcggccggaggatggcgacgactggcgggaggtgtgcgaactgctggcgcgcttcgccgcgaaacgactcgcggggggcgcgaggtcgcgcgactccgggcggcccgccccgggggactggtcctggcgagtcctgccccacgtgacgagtacgtacgagatcgctgtgcaggcctaccaacgcatcaacgatcctgcggcccaggtgcgcctgtacaccgacctcgcggaggagagcttccaatccggggactacccacgcgccatcaggtgccggctcgctgtggccggaatcgcgaaaacgatgggcgatgaggcaggccagggcgaggctctggccgctgtcgcacacgccaacctgctgctggagaaccacgagaaggccgtccagttcgccgagagcgccgtccccctcctcaccgccacacagcgtcccgggcccgccggccgagctctcaccaccctggcaaacgcccgctacagcctggccctcccggcccaggcgctctccgccgccgtcaacgccgaagccctcgccacatcagcggacgatctccagggccgcatagcggccctcctcatcctgggtctcgcacagcgcgacaccgaccacaccgaagacgcctccgcctcctggagggccgcgttgcgcatcgcccggaccctccaggacccctacctcaccccccggacggagtccttcctcaaaagcgtgggttacctgcgcacctgacacgaggaggaccacgccccggaaggcagcgcagaggtcgatccggttgctcttcgaccggatcgacgcatgcccggatccgcgtccggcctggcggggttcctcggccatcgggacgcgttctccctggctgaggacgcctacgcctccggcgacctggacgaccggcaggtctcggagctggataccgagggctgggccggcgacaagcacggtgcggagacggctccggcggacccggccgtgatcggcaagccgtccctcagggttcgcggccttctgtccgggccttccctcccggcgcggcctactcgtcgaacgcccccggtttcctggtgctgtcgttgggcttcgtcgggctgtgcaccaccttgaccggcagtccttcgtcccggaaggccttgcgggcggccttggccacctccgggtcggagaagtgccactccacgctccggcctccggacgcctccacctgggcgcgggcctcggtgacgaacttgtccttgcccgacggggtgagggagccgctgtcggacttggacagatagctgccgtaaccgttcttggcctccaggaacgtctgccgggaggagtcccagccgtcgtactccaccgccggcttgccctcccgggggtgcggcacgacgtactcctggccccggttggtaccggtcacctgctcctggtagcgcagccaggactcgttcttccagttgggtgcggggttacggtcccggctcgcccagtagccgtcgcccgcgtcggcgtccccgagcgtgcggtccttgaggtcatcggcccaggacggcgggttgtagttgcgcgggtcggaggtgtcgttgcgctgcgcctccgggtacttcttcttgtccacctcggccttgcgcgcccgctcgggctcctccagcctcttccgctccaggtgggcggcccgctcggcggcccgcgcctgggcggcggctgccttggccgcctcgtcgcacccgtcgttcgcgaggacgatccggtccggggagccgcccgccagcactccggtgcccgagcccggtacaccggtggccccgcccccgccgtaccgcacgcgcggcgggcccgaggcgatgacgcagccggtccggcgcgccgcgtcctcggcggtgtccgccgcgtcgtcggcc

SEQ ID NO: 2974 - DNA, 3769 bp, Unknown
  Kingdom: Bacteria, Phylum: Actinobacteria, Class: Actinobacteria, Order: Streptomycetales, Family: Streptomycetaceae, Genus: Streptomyces
gcgcccggcgtcgccagcaccgtcccggcggcgatcgccgccgccacggccgcccgtctcgcccctccacgtcccgtacgtcctgtcatgtgcgtacccctcccctgtcctgcccttgaagatcggagatcaagagctgagggagattaacaaccggatgcaccgaccgcttccggatatcggcccgtcggagcgcccggctcctcccgccgtcagcgtctcccatcgaggacctgcgtgttctgagccgccgcgacgcgccggaccccgtcggcgcgggcggccgggcgccggcccgacgcctccctccgcggcttccgcgaggacgccatctgtcaagcaccgccggggccacgccaacgggcttgatctcatgtctggttgaggttctagcgtctcggcatcgaacaggcgggggctgaacaggccgcgcctgaacaggcagcgaccggacagaggagcgctcagcgatgatattggtgaccggtgcgaccgggaacgtcggcagcgagctggtaaggcagttgtccgcggacggccgccggagcggcgtccgggcactgacccgcgacgccgcacgggcccggggggtattgcccggcggggtcgaggtggtggaaagcgacctggggcgggccgggtcgttgaagtccgccttggacggagtgcgttcgctgttcctgatctccggtgtcggcgacgacgccggggtgctggacgccgcccgggaggcgggggtggagcacgtggtgctggtctcctccatcaccgtcgagacccatccgcacctcggccccgcgcaggcgaacctcgccgtcgagcgtcggctgcgggagagcgggatggcgtggaccgtcctgcggccgacgcagttcgcctccaacaccctctggtgggcggggtccgtgcgcgaggagtccgtggtgcgcgtgccgtacgcggacgtcggactcccgaccgtccaccccgccgacatcgcctcggtggcccgcgcggcgctgaccgggccgggtcaccgggggctgacgcacccggtcaccgggccggagccgatcagtccgcgccgacaggccaacgagctggggcgggtgctgggccgggatgtggcctgcgtcggaatcacccgggacgaggcgtacgcgccgatggccgcgatgatgggggccgaggtcgcggacagcgtcctcgacctgatgggcggcgacgtcaacgacgcgctgctggccgtgcacgacacggtcgcccggatcaccggatcgcccgcccgcccctaccgcacctgggccgaggagaacgccgacgcgttccgatgaaccgaggcgccgcagcggggccgggcggcggccggcaacgggcggctacttcaccgggcgcaggcccagcggcgccgcgatctcctggagcatcacgcggcccgcctcctcggcgaggtcctcctcgcccgggtcctggtcggtgtccaggccgtccagttcctccaggggctggccgaggcggatgtgggcgaccagggactggagcgcgcggagggtggcggaggcggtggagccccagttggagaagtacgagaactgccaccaccacagcgcctcggcggtgcgctcggcgtcgtagtgcgcgaggccgtggccgaggtcggtgaccaggtcggccaggtcgtcggagatccggtgcgggaccggggccttccggggctcgtacgggtcgaagacctcggagtagacgtcgatcggctccagcagcgccgcgaaccgctcgcgcaggccgtccgtgtccggctcggggccgaggtccggttcgtaccgctcgtcgggcaggacgtcctcgtacgcgccgaggcggccgcccgcgagcaggagctgcgagacctggaggagcaggaccgggactgcctcttccggctcgtcgaccttggacacctcggtgaccgcgacgatgaacgtcttgatctggtccgcgatctggacggcgaagtcgtccgggtcctgcgtgacggagttcagcgtggcgtcagacatcgaggggacctcccgtgggcgcggtcacagacggtgaagcggacggcgaagcggacggcggtacgtgaagggggcgtacggcggtggtgtcagacatccagcagccgcctcccctcgaaggcgcggcccagggtgacctcgtcggcgtactccaggtcgccgccgaccggcaggccgctggccagccgggtcactctgaggcccatcggcttgaccatccgcgccaggtacgtcgcggtggcctcgccctccagattggggtcggtcgcgaggatcagctccgtgatggaaccgtccgcgagccgcgccagcagctcgcggatgcgcaggtcgtccgggccgacgccctcgatgggactgatcgccccgcccaggacgtggtagcgaccccggaactcacgcgtccgctcgatcgccacgacgtccttgggctcctcgaccacgcagatgacgctccggtcgcggcgctcgtcccggcagatcccgcactgctcctgctgcgcgacattgccgcacaccgcgcagaaccggaccttgtccttgacctccaggagggcgtgcgcgagccggcgcacgtccgtgggctcggcctgcaggatgtggaaggcgatccgttgcgcgctcttgggaccgacgccgggcagcctgcccagttcgtcgatgaggtcctgaacaacgccttcgtacaacggaacgcctttctttgcttcctgctccgtaccgtagtgggtacgggtcggtaccagtaggccccgtggacctgcctgtggccggtccggtcaggggtcctgccggaggccctttcggagctcccgtcagaacggcaggccggggatgccgcccccgccgcccaggccctgcgccagcgggccgagcttctcctgctggagcgcctgcgcgttctcgttggccgcctggacggccgcgacgacgaggtcggcgagcgtctcggtgtcctccgggtccaccgccttcgggtcgatcaccagggcgcggagctcgccggagccggtcacggtggccttcacaagaccgccgcccgcctgtccgtcgacctcggtcctggccagttcctcctgggccgcggcgagatcctgctgcatcttctgggcctgctggagcaactgctgcatattgggctgaccaccaccgggaatcacggtcactcctggcatttcgacgacaaatgtttcggtaagccgagcctacgtgctccccggtcaccgcgctccacccgccggggaccaactctttcgggtgagattcgggaaccggcgtgagtgctcctatacctgaccagcggccctgcgcaggcgggaatcccgcgatttcgaccccgcggcccaccattcggcggtaggaagggcatgcacatcggcacacgagcgtgcatgtgtggtgacgcagagttaccccgcgggggtcgtcggtcgtgcggaccgccccgtcttctccgggccggccgggtccggttccgggaagccctacgcgtccgtcccgtccgtcagagtgcagaggagtgccccggtgagtcagccggagatgcagcccgaggggccgccccgcaaggagtccgatgcgggatccggtgaaaacggagctgagcattccgcttccggcccgggcaggggtcgccccgccgggcgcgatctgaccgggcgagcgttccccctcggcgactggggcgagcccgccgaacggctcgacgagctctaccgctgggtcgagaccggcgcgctggacaccgccga

SEQ ID NO: 2975 - DNA, 718 bp, Unknown
  Kingdom: Bacteria, Phylum: Actinobacteria, Class: Actinobacteria, Order: Streptomycetales, Family: Streptomycetaceae, Genus: Streptomyces
gcaaccttctgatccgtagtcagatgctctatccgttaagctacgagtgcttggcgttccgggcttttttctccccggtcggcgttgcgagaacaacattacatgacctgcgccgtgacgcgaaatccattagctgcaccgctgccgacctgcggaaacggcctcccgagacgcatctcggccacccttccggaccagtcccgaaccggtcccgaaccgaccccggcgcaacctccgcaccctccgcgccctcgcgcgccccggaacgaccgaagccccgtgccaggggcacggggcttcggggtggagcggaggcggagggatttgaaccctcgatgggctttaagacccaaaccgcattagcagtgcggcgccatagaccggactaggcgacgcctcctccacacacctcgcgcggacgcgagtggtgcgtgcagatgatgacacagtcgagcgtcgtgccaccaatcgcggtcaacgttactaggcctccgggtgcgcaggcaaagcagttcggcgtggtggcgcaacgtccgggcgcggtgcgcgttagagaggggtgggggccccggtctccgtccgttgtcgtcgcccgtcagtcgtccgtcagccgtggctccggggcggggccgtgatcgtccgtgaccgccgcccgtgaccgcccgcgctgcagagatcctggagcttccgcatgctgcgccgtctcgccctcaccgcc

SEQ ID NO: 2976 - DNA, 8358 bp, Unknown
  Kingdom: Bacteria, Phylum: Actinobacteria, Class: Actinobacteria, Order: Streptomycetales, Family: Streptomycetaceae, Genus: Streptomyces
  misc_feature (8093)..(8094): n is a, c, g, or t
gccgcgcccgccgcggcctccagcgccgtcagggcccggcgcgcgtcgccgcccgcgatgcgcagcagatgcgcctcggcgtcctcgggcagggtgaccgccccgccgagaccccgctcgtcggtcagcgcccggcgcagcagatcacgcaggtcgtcgtcggtcagcgattccagggtgagcagcagggaccgcgacagcagcggggagatgatcgagaagtacggattctccgtggtggcggcgatgagggtcacccagcggttctccacggcggggagcagggagtcctgctgggccttggagaagcggtggatctcgtccaggaagaggacggtctccttgccgaagccgccggtggcgcggcgcgcgctctcgatgacggcccggacctccttgacccccgcggtgatcgcggagagctcgacgaagcgcttgttggtcgccttgctgaccacgtacgccagagtcgtcttgccggtgccgggcgggccccacaggatgaccgaggacgcgccggccgggccgccgcttccctcgacaaggcggcgcagcggcgagcccggcttcagcagatgctgctggccgacgacctcgtcgaggacacggggacgcatccggacagcgagagggctgctggacgggtccttctcctggcggtcttcggcggctgcggtaaagaggtcgggctccacgtcatgaagcctatgcgaccccactgacagtgccgccgacccacctaccagattggtaggtgagggtcagctggtccagaagtcccaccagcgggtcaggatcagcatgccgatgatcccgatccacatcaccggaagcacccaggggaactcggtgagcccgctgcgcagccaggccggggccgggaggatgcggtgcttgacgttgtgcgtggtcacgtagcagaacatgacgatggtggcgacccaggccaggcagcaccacaggcagagcgagttgatgttgtacagcgactggtactggagccaggtgcagaagccgacgccgaacagcgtcccggcgttcagcccgagccagaaccagccgcggtagcgggcgccggcgagcaggcccatcccgatggcgatgaccatgccgtaggtgaccaggcccagcatcgggttggggaagccgaacgcggaggcctgctcgctcttcatgatgttgccgcaggcgacgacggggttgaggctgcacccgggggtgaaggaggggtcctccagcagcttgaacttgtcgagcgtgatgacccaggaggccagcagcccggccgcgccggtgatcaccaggagcagggcgagaccgcgtccggccccgaaggcgcgcttgcggccgccctcgtcctgatcggaggagagatcgtggtctaccgctgcagtcgtcatatcgccgttccatcaccgagtggtcagccgggcaaggtcattgtgccgtacccccgtacggatcaaccgttcgatggacataaaggtgtacgcccgtgagcgctcctgcgggtggactcctagggcgacagggccgggacgacggaagatgtacgtgtccccggcaatggtccggcgacgccggccgcgcgggcggctccaagtcggggtcaccggccgggatgaatccgcgctcgccgagttgacggcggacgagaaaggcgcgggcggcaggacctcacgtcccccgcccgcgccccgctcacgactcggtcagccgaggcgcttcgtcagctccgccgcgacatcggccagcggcaccgcgccctgctcgccggactccatgtccttgagctggacgactccctcggcgagatcgcgttcgcccgcgaccagggtgtagcgcgcgcccgagcggttggcgctcttcatcgcgcccttcaggcctcggccgccgaacgcgaagtccgcggcgatccccgcgcggcgcaactcggtgacgacgccgaacagcacccgtcgggcctcgtcgccgagcgggaccgcgtacacgctggtggtgacgggcaggtcgagctcgacgccctcggcctccagcgcgaggaccgtgcggtccacgccgagcgcccagccgacggacggcagcgcggggccgccgatcatctcggacagtccgtcgtagcggccgccgccgcccaccgcggactgcgagccgaggccgtcgtggacgaactcgaaggtcgtacgggtgtagtagtcgaggccgcggaccagcttctcgtcgtcctcgaacaccacgccggcggtcgtgagcagcgcccggacctcctcgtggtacgccctgcaggtgtcgcagaggtagtcgcggagcttcggggcgtcggtgagctgcttctgtacgtcggcccgcttgtcgtccagcacgcgcagcgggttgatctcgatgcggcggcgggtctcctcgtcgaggtccaggtcccgcaggaaggtctggagcgcctcgcggtagaccgggcggcactccttgtcgcccagcgagttcagcaggatccggaactggcgcagacccagcgaccggtacgcctggtcggcgaggatgatcagctcggcgtccaggaccgggtcctcggtgccgatggcctcggcgccgacctgcgagaagtggcggtagcggcccttctgcggacgctcgtagcggtagtacgagccggagtaccagagtttgacggggaggttgcccgccttgtggaggttggcctccagcgccgcccgcagcaccgatgcggtgccctcggggcgcagggcgagctgggagccgcccttggtggtgagggtgtacatctccttggtgacgatgtcggtggactcgccgacaccgcgcgcgaagagctcgacgtcctcgaagccgggcgtctcgatatagccgtagcccgagtcgcgcagcggggccgcgatggcctcgcgcaccgccaggaacttcgcggagtccggcggggtcaggtcgtatgtgcccttgggggcctgaaaggtgctcacgatggcgtctctcgtctacattcctcggcgcggcgccgcgtccagaccgttcagatacgggttggaggcgcgctcgcggccgatggtcgtctgggggccgtggccggacagcaccacggtcgagtcgtcgagcggcaggcacacacgggccagcgactcgagcagctcggcgtggtcgccgccgggcaggtcggtgcgtccgacggagccggcgaagagcaggtcgcccgagaagaagaccggcggaatgtccgcggcctcgggcatcccgaacgtcaccgaccccttggtatggcccggcgcgtgcgagacgccgaactccagaccggccagggtcagcttcgagccgtcggtcagctccttgacgtcgtccggctcccccacggtcagctcgcccatgagcggcatcccgatcgagcggccgagcgccttctccgggtcgctcatcatgtagcggtcctcggggtggatccaggcggggacgtcatgggcgccgcagaccgggacgaccgaggcgacgtggtcgatatggccgtgggtgaggacgacggcgacgggcttgagccgatgcttcttcagcgtttcctcgacgccctgggcggcctggtggcccgggtcgatgatcacgcactcctcaccggcggcgggggcgaccagatagcaattggtcccccaggccccggcggggaacccggcaatgagcacgatcgtccttaatgttcgtccggaggatgcggcagcggcgaaggatgcagcagatcagagcctaccggcgctcctcatgacacaggtaacccatatacggtacgggcaactcaggccctcatctcacgacgtcacaaggagcccaaccggtgtccagcagcgaacagcggcggcggcagctcgcccgggaaaagttcgagcgccagcagaagcgccgggaggaggcccgcagcaggacgaggcgcatcaccgcgatcgtcgcggcctcggtggccgtggtcgccgtcgtgggcgtgagcgcgttcgtcgtggcgggcaaggacgacgacaaggacaagaagaacgaggccgcggcgagccagagccccaccccggagccttcggagagcgagagcaaggctcccacgccgccgatgaagatcgacaagaaggccacgtactcgatgtcgctcaagacgagccagggcgacatagcgttctcgatggacgcggcgaagactccggagacggtgaactccttcaaggcgctcgccgacaagggctacttcgacggcaccaagtgccaccggctgaccacccagggcatcttcgtgctccagtgcggcgaccccaagggcgacggtacgggcggtccgggttacaacatcccggacgagaacctggacgcgctcggcaaggccggcggcgacggcacggtcgtctacccgccgggcacggtggcgatggccaataccggtcagccgaactccggtggcagccagtacttcctggtctacaaggagacgaagctcccgcccacctacaccccgttcggcacgatggacgaagcctcgctgaaggccgtccagaaggtcggcgaggccggcgtcgagggcggtgcgggcgacggcgccccgaagaaggccgtgacggtcgagaaggcttcggtcgagaagggctgaaccggcgggacggaaccgacggtagggcgaccggccgggtggccaccggcggggcagagcgctgccccggaccggagcgaagaatttcggccgtgctgagtgcggacagccgggtggccggtcgcctagattggcgttgtgcagggcgggcgatgcccgccccaggaaactgtggacgatgcccggggggcgaaccccctcgcaggcatcaggtggaggaggcgctgtgagcagcgacccgtggggccgcgtcgacgagacgggcaccgtgtacgtgcgtactgccgagggcgagcaggtcgtcggatcgtggcaggccggttcgcccgaggaggctctggcctatttcgagcgcaagtacgacggcattgtggtcgagatcggcctcctcgaacggcgggtgaagaccaccgatctgtcggcgaaggacgcgacgacggcgatcgaccatctgcggcagcaggtcgacgagcaccacgcggtgggcgacctcgacgcactgcgcaagcggctggacgcgctcgtcgcgacggtcgaggcgcggcgcgaggagcgcaaggtcctcaaggccaagcagaccgacgaggccaagcaggccaaggaggcgctggtcgccgaggcggaggagctggcccagagcgagcagtggcgctcggccggtgagcggctgcgggcgctggtggacacctggaagggtctcccccgtctggaccgcaagtcggacgacgagctgtggcaccgcttctcgcacgcccgctcggcgttctccaagcggcgcaaggcccacttcgccgcgctggacgcccagcgcgaggacgcccgcaaggccaaggagaagctggtcaccgaggccgaggcgctgtccggctccacggactgggtgaccaccgccgcgcgctaccgcgacctgatgaccgagtggaaggcggcgggccgcgcccagcgcgagtccgaggacgacctgtggaaccgtttccgcggtgcccaggacgtcttcttcgccgcccgcagcgaggtcttcgcggagcgggacgccgagcagggcgagaacctcaagctgaaggaggagctcgccgcggaggccgagaagctggtgccggtgaaggacctcaaggcggcccgggccgcgttccggtccatcaacgagcgctgggaggccatcggccacgtaccgcgtgacgcccgcccgaaggtcgagggccggatgcaggcggttgagcggacgctccaggagtccgaggagtcggagtggcgccggacgaacccggaggcgcgggcccgcgccgagggtctgaccggtcagctccaggccgccgtggacaagttgcgcggccagatcgacacggcccgcgcccagggcaacaacgcccgcgcggacaagctggccaaggagctggagggccgacaggcgctgctggaccaggcgctcaagggcctggaggagttcggcggctgagacgggctgccagaaggccccggtacgcggttgcgtaccggggcctttccgttgccgccgctacgggacgacccttacggcctgcgggccgaggtgacccggtagacgtcgtagacgccctccactccgcgtacggccttcaggacgtggcccaggtgcttggggtcgcccatctcgaaggtgaagcgcgaggtggccacgcggtcgcgggacgtctggacggccgccgagaggatgttgacgtgctggtcggagaggatccgggtgacgtcggagagcagccgggagcggtcgagcgcctcgacctggatggcgaccaggaagaccgaggactgggtgggggcccactcgacctccaggatccgttcgggctgctgcgagagcgactccacgttgacgcagtcggcgcggtgcacggagacgccgctgccccgggtgacgaagccgatgatcgggtcgccggggacgggcgtacagcagcgggccagcttgacccagacgtcctcgacgcccttgacgacgacgccgggatccgcgttggcgcggcgcttgccgcgaccgccgtgcgagggcggggtggactcggcgaggtcctcgttggcctcgtcgtggccgccgagcgcctgcaccagcttctgcacgacgcccgctgccgcgacatggccctcgccgatcgccgcgtacagcgaggagatgtccgggtagcgcatctcgtgcgcgagagtgacgagggagtcaccggtcaggatgcgctggatcggcaggttctgcttgcgcatggcgcgcgcgatggagtccttgccctgttcgatggcctcgtcgcggcgctccttggagaaccaggcgcggatcttgttgcgggcgcgcggcgacttgacgaagccgagccagtcccgggagggtccggcgccggccgccttggaggtgaagacctcgaccaggtcaccgttgtcgagcgtcgattcgagcggtaccaaccgcccgttgacgcgtgctcctatggtgcggtggccgacctcggtgtggacggcgtacgcgaagtcgacgggagtcgcgccggcgggcagcgctatcacgtcgcccttcggcgtgaagacgaagacctcgttgcgcgagaggtcgaagcgcagggactccaggaactcgctggggtcctcggtctccttctgccagtccaggagctgacgcagccacgccatgtcgttgacggtgtcctggccgcgcccggtgttcttggggacgtcggtgcgcaccttggaggcgcccgctacggcctcctgcttgtacttccagtgggcggcgatgccgtactcggcgcggcggtgcatgtcgaaggtgcggatctggagctcgacgggcttgccgctgggaccgatcaccgtggtgtgcagtgattggtacatgttgaacttgggcatcgcgatgtagtccttgaaccgcccgggcaccgggttccaccgggcgtggacggttccgagcgccgcgtagcagtcgcggacggtgtcgacaaggaccctgattcccaccaggtcgtagatctcggcgaagtcgcggcctcgcacgatcatcttctggtagacgctgtagtagtgcttggggcggccggtgacggtggccttgatgcgggcggcgcgcagatcggcctgcacctcgtcggtcactatggcgaggtattcgtcgcgcttgggggcgcgctcggcgacgagccggacgatctcgtcgtacatcttggggtagaggatcgcgaaggcgaggtcctccagctcccacttgatggtgttcatgcccagccggtgcgccagcggggcgtagatctccagcgtctcgcgggccttcttctcctgcttctcccgcttgaggtagcgcatggtgcgcatgttgtgcagacggtcggcgagcttgatgaccaggacccgggggtccttggccatcgcgacgaccatcttgcgtacggtctcggcctgcgcggcctcgccgaacttgaccttgtcgagcttggtgacgccgtcgacgagnncgaggatcgtggtgacggccagcgggtgggtgatgtaggggtcgccgctcttgcgcttctggccccggtgccagcgctcggcgacctggtaggccttctcgatctggcggagtgtggccgtctcgatcttggggtcgttgccccggaccgtacgcaggaggggttccagtaccgggttgtacgggctggagcgctgtacgcccaggcgggcgaggcgggcccgcacacggttggaggagccgccggtgcgcgaggcggacccgg

SEQ ID NO: 2977 - DNA, 798 bp, Unknown
  Kingdom: Bacteria, Phylum: Actinobacteria, Class: Actinobacteria, Order: Streptomycetales, Family: Streptomycetaceae, Genus: Streptomyces
gccgcaccggcgccgccgacgcgacccggtgggcgtcggcagcggtgtccacgtcgaccagcacgggcagatcgcgtacggcgagtcccgcctgaaccagcctgtgccgctggaccgcacccgtctccgggacggacatcggcaccccgcgcaacaggaccggatcgggatccgccaggcccagggcccagaagccgccgtcctcggccggaccgaaccaggccccgacgccgtcccaggcgcccggggcgagagcgggagcgagcagcgcgcccgtgatctgcggggtgtccatgccgatcaggagggccgggcccgtacacctgccgaaggcctcggcgagacgttcgtcgagaccgcccgcgctctgcggcaccacatcgaagcccgggggcacccagggacccggccgcccgtcgaggaccaggacgcgccgccgggcggggagggcgagcacggcttccagggtgtccgcgagagccgcggtggcgagttcggcggcctcggcgggggagaagggcgggcagagccgggtcttgacccgccccgccaccggctccttcgcgatgaccagcagctccgtgggtccgtacgtgcccgtccgacggctggcgtccccgccgtgcgcgtcctcccggccgctcccgtccccgtacgcgctcatcggacggcccccgtctccgtgcgtgcgacccggccggacgctcccgcagcaccccccgcatgtcgcgcaccgggaagtcgaaggtgaccggcacctggcgcgggacctggcaggcggtgcgcgacatgcggggg

SEQ ID NO: 2978 - DNA, 2180 bp, Unknown
  Kingdom: Bacteria, Phylum: Actinobacteria, Class: Actinobacteria, Order: Streptomycetales, Family: Streptomycetaceae, Genus: Streptomyces
ggccacccgcacctcggtcgccgcccaccgcgcggcgcggttcgccgggctcggcgtgcggagcgtggccgacctgtgctgcggcatcggcggcgacgccctcgccctggcgcgcgccggaatctccgtcctggccgtggaccgcgacccgctgaccgccgaggtggcccgcgccaacgccgaggcgctcggcctggaggacctgatcgaggtgcggtgcgccgatgtcacggagatcgacacctccccgtacgacgcggtcttcgtcgacccggcacggcgcggcggacgcggcaggatcttcgatccggaggcgtattcgccgccgctgtcctgggcggcggcggccgcgctgaaggccccgagggcggcgctgaagatcgccccgggcgtcccccacgacgcgatcggcccggaggcggaggccgagtggatctcggacggcggcgatgtgaaggaggcggtgctctggtacggggagggcttcgcgcccggtgcgttccgggccacgctgctgccctccggggcgaccctgaccgccccggccccgctgcccgccccgccggtgggcccggtcgggcgctatctgtacgagccggacggcgcggtgatccgggcgcatctggtcgccgacgtcgtggagcggtgcggcgggcggctggtggacgagacgatcgcgtacgtcacgagcgacacgcggtactcctcgccgtacgtctccgggtacgagatcaccgaccggctgccgttcaacatgaagaagctgaaggcgctgctgcgggagcgggaggtcggcgtactgaccgtcaagaagcgcggctcggcggtcgagccggaggagctgcgtcgccggatgaagctgagcggtcctcactcggcgacggtgttcctgacccgggtggcgggggctccgacgatgctgatcgggcatccgctggaatgaaccggagtgtcagcggtgggccggggcgtccggtggggcaggcgccgtcaggacgcgcagcacccagcggcggtgcgtcaacgccttgacggcgccgatgagtccggtgagccaggcgaccatgccgaggcccatgatcagggcgaccatgccgtacgtgtcgtcgccgggccgggcgctcgccgggccgatcacgcagagcgccagcccgcccgccgccaggagagacgacagcagcagccagaccaggctcatcccgggcagccgcaactcccggtcgcgctccggatgccggtccagcgcggcccactccacgagcagcgcgcggatctcccggtcccgggcgacgtagagggaggcgaggacgaccgccggtatcagcgcccccgccccgaggagcagggacaggattccggcgatcccgctgaagaagtccgccgacgcctgctcgaacatgacgagtccggaccccacgagcagccagccgaacgcggcgagcccggcccacatcaccagcacaccgagccgcgccggacccaggtgcatccccaccagcgcgcgcaggatgagcgcccggtcggcgagcatcgcctcgcggtccggccaggtccggatctccacgggaggcgggggcggtggcagggaggggcggcgtgacatggaccagacactatcgggagcgggcccatggtccgggtgtccggaggctcaggcgtcgcgcagtgcctggatgtccagcttgcccatggcgagcatcgccttcatcgtccggtccgccttcgccgggtccgggtcggccagcaggcgcggcagctcgttcggcacgatctgccaggagactccgaacctgtccttgagccagccgcactgtccctcctcgccgccttcggagagcgcgtcccagaaccggtccacctccgcctggtcggcgcagtccacggagagcgagatcgcctcggtgaaggggaactgcgggcctccgttgagaccgatgtagtcctgaccggcgagccggaattcgacggtgagcacggagcccgtctcgcccggggcggattcgccgtagtgggtgacgtccaggatgcgggagtccccgccgaagatcgcgacgtagtgctcggccgcctccttggccttgccgtcgtaccagagacagggggtgatcttctgcatggtcttctcctcgtcgggccgtccacgcgtccgggccggccggtccggacgtcgtggaaggtag

SEQ ID NO: 2979 - DNA, 6391 bp, Unknown
  Kingdom: Bacteria, Phylum: Actinobacteria, Class: Actinobacteria, Order: Streptomycetales, Family: Streptomycetaceae, Genus: Streptomyces
tacggctacccgcagcaggccccgcagggcgtccctccgcagcagccgaacccgtacgggcagccgcagcagccgcagcagggctacggctacccgcaggcccagcagccgggcccctacggccagcagccgcccgcgcctccgtacggcggccagccggggtacgacggacagccgcagcagccgaagaagaagaccggcctgatcgtgggcgtggctgtggtggccctggcggtcatcgcgggcggggtgtacttcctgacctccggcggcggcaacagtgacgtggcggactccacgaaggggtacaagctgacgccacctgcgtcggtggaggactacaagaaggacgcgtccaagcctgctccgtccggtccggtcaccggcgatgacaaggccgaggccgaggccatgggcatcaccaacgccaacaaggctgccgctcagtaccagagcggcacgaaggacaacccgctcgctcagaagatgctgatgttcgagggcctctggggcgaggtctccgacccggcgaagacgctcgacgacgccttcgacaaggccgagaagaacatgtcgaaggactccgacaacgacaatgtctccctggtgggcagccccaaggagttcaagccggacggcttcgacggcgcgctgatgaagtgccaggacctcaaggtggtcaacgacaaggccgacggcaccgccgcgaaggggccgaaggagttcaccatgccggtctgcatctgggcggactacagcacggtcggcatcgtcgccggtgtcgatgtcggttcggcgctgacgggcaagtccgtgccgcaggaagaggcggccgacctcgccgccaagctctacaacacctcccgcaccaagatctgatcagatctgatctgatcgctcaacgccgaaggggcgtccgccggttcatccggtgggcgccccttcggcgtacgcaggtctactgcggctacgcggacttctcgtgccggccgccgtcgttcttgccgatcgtgcgcggctcgcgcgggaccagcgtcgggttgacgttgttgcggacgacgtccggggtgatgacgacgcgggcgacgtccttgcgggacgggacctcgtacatcacggactggaggacttcctccatgatcgcgcgcagaccgcgtgcgccggtctggcgcaggatcgcctggtcggcgatggcctccagcgcctcgcgctcgaagtccagctccacaccgtcgagttcgaagaggcgctggtactgcttgaccagggcgttgcgcggctcgatgaggatctggagcagggcctcgcggtccaggttgtggaccgaggtcagcacggggagacggccgatgaactcggggatcatcccgaacttcaccaggtcctccggcatgacctcctggaactggtcgctcgcctggatctccagcttggagcggatcgtggcgccgaagccgatgcccttggcgccggcccgggactcgatgatcttctccaggccggagaacgcaccgcccacgatgaacagcacgttcgtcgtgtcgatctggatgaactcctggtgcgggtgcttgcgtccgccctgcggcggtacggaggcggtggtgccctccagaatcttcagcagggcctgctgcacgccctcgccggagacatcgcgggtgatcgacgggttctcgctcttgcgggcgaccttgtcgatctcgtcgatgtagatgatcccggtctcggccttcttgacgtcgtagtcggccgcctggatcagcttgagcagaatgttctcgacgtcctcgccgacatagccggcctccgtcagcgccgtcgcgtccgcgatggcgaacgggacgttgagcatgcgggccagcgtctgcgcgagcagcgtcttaccggaacccgtggggcccagcaggaggatgttcgacttggcgagctcgatcgcgtcctcgcgattggcaccaccgccgttctccccggcctggacccgcttgtagtggttgtacaccgcgaccgagagggccttcttcgcgggctcctgcccgacgacgtacccctccaggaactcgtagatctcgcgaggcttgggaagctcttcccagcgcacctcgctcgtctccgcgagctcctcctcgatgatctcgttgcagagatcgatgcactcgtcgcagatgtacacaccgggtcccgcgatgagcttcttcacctgcttctggctctttccgcagaacgagcacttgagcaggtcgccgccatcaccgatgcgtgccacgaggtgcttccccttcgcctgggagacgcctggttcagcggctcctggtgcctctatccgacggtaccttgcctgggcccccgttcgggccccccttggcacggttcacacggccgtggccgtgcaaacggaatgtgccaaggggaaagaccgacgtcagagcgatgcgcccgcggtggtcttgcgggtggaaacgatctggtcgaccagaccgtacgccagggcgtcctcggccgtgaggatcttgtcgcgctcgatgtcctcgctgatcttctccagcggggtcgtcgagtgccgggcgagcatctgctccagctgcgtgcgcatacggaggatctcgttggccgcgatctccaggtcggagagctgctcgcggcccgtctgcgaggacggctggtggatgagcacccgggcgtgcgggagcgccatgcgcttgccgggggtgcccgcggcgagcaggacggcggcggcggaggccgcctggcccatgcagaccgtctggatgtccggcttcacgaactgcatggtgtcgtagatcgcggtgagcgcggtgaacgagccgccggggctgttgatgtagatcgagatgtcgcggtcggggtccatcgactccaggcacagcagctgcgccatgacgtcgttggccgaggcgtcgtcgatctggacgcccaggaagatcacgcgctcctcgaagagcttcgcgtacgggtcgtactcacgcacaccctgcgaggtgcgctccacgaagcgcgggacgacgtagcggttgtccacctgcgggccggtgtagaggccgctcgcggaggcgccggagaagttgttcatgtgggtgttcaccatcctggtggcgttctgtgggctggaggtctcggcgtgcgagaggcgtgcgggaggtggtgcggccggtccggtgggaaccggatcaggcaccggtgccgccgccgcccgggatgcccgacgcgaccgtgatgatctcgtcgatgaggccgtagtccttggcctcctccgccgtgtaccagcggtcgcggtcgccgtcgcggatgatcgtctcgacggtctggccggagtggcgggcggtgatctccgccatccgcgtcttggtgcggagcaggtactgggcctggatcttgatgtccgaggccgttccgccgatgccggccgaaccctggtgcatgaggatgtcggtgttcgggagcgcgaagcgcttgcccgcggcgccgccggtgagcaggaactggcccatggaggcggccatgcccataccgatggtgacgacgtcgttcgggatgtactgcatggtgtcgtagaccgccataccggccgtcaccgaaccaccggggctgttgatatagaggtagatgtccttgtcgggctctgcggcaaggaggagaagctgtgcggtgatcttgttggcgatgtcatcgtcgacctgctgaccgaggaagatgatgcgctcgccgagcagtcggctgtagacctggtcaccgaggcctccaccgagggacggctctccggcggcgtagggcatcagattcgtcacgtatccacctgctcgtctctgacggctccggccgtctcagcgtcttcgtaccgggcgggtgaagtcactgccccacccttcctcttcatggaccctaacgcgcaggtgggacaacgccatcccgcttccgcaactgttcgctgggagcgcaaggtccgcagtgggcacaagggttccggggctcgcacagcgatacgacgcgatacggggacgggccccggacgcgtggcgcgtccggggcccgtcgtgccggtcggcccgaaggccgccctgggatcgggacgaggctcaggcctcgttcttctcctcggccttgtcctcggtggcggcctcggccgtctccgtggcctcggcggcggcctcggtggcctctgcggtgtcctcgtcgtcttcgaggtcgacgacctcaccgttggtgtcgacgaccttggcggcctcgacgacgacggcgagcgccttgccgcgggcgacctcgccgacgagcatcggcacctggccaccctcgacgacggcctgggcgaactggtcggggctcatgccggaggaagcagcgcgccgcatgaggtgctcggtgagctcctcctggttgacgttcagcttctccttgttgacgagctcgtccaggatgaactgggtcttgatgcccttgatggcctgctcggaggtctcgttctcgaactcctccagggtcttgccctggatctcgaggtacttctcgaggtcgagacccatctgaccgagctggtggtgctccaggttgtgcttgcgggtctggacctcgtccgcgagcagcttctccgggatcgggacctcggcgagcttcagcagctcctccaggacgcgctcctgggcctgggtggcctggtcgtactgcttggtggtctccaggcgcttgcggctgtcggccttcagctcctccagcgtgtcgaactcgctggccatctgggcgaagtcgtcgtccagctcggggagctcacgggcggcgacggcggtgaccttgacggtgacctccgcggccttgccctcggcggagccgcccttcagctcggaggtgaaggtggcctcgccaccggcctccaggccggtcacggcctcgtcgatgccgtcgaggagctcgccggaaccgatggtgtacgagacaccgtcggccacgccgtcctccaggacctcgccgtcgaccttggcctccaggtcgatcgtgacgacgtcgccgtcggcggcggcgcgctcgaccgggttggtggcggcgaagcgctcacggagctgctcgacggccttctcgacctcttcgtcggtgacctcaagggcgtcgacggtgacctcgatgccggagtagtccgggatctcgatctcggggcgtacgtcaacctcggcggtgaaggccagcagctcgccgtccttcagctcggtgatgtcgacctcgggctggccgaggacgttcagctcaccctcgttgaccgcctcggtgtagaacttcgggagggcctcgttgacggcctcctccagcacagcaccgcggccgaaccgctggtcgatgacccgggcggggatcttgcccttgcggaagcccttcaccgtgacctgctggttgatcttcttgtacgccgcgtcgaggctgtccttgagctcctcgaagggcacctcaatgctgagccgaacccgggtcgggttcagggtctccacggcgctcttcacggttcggtctccttggtggctgacttcttggggttctgctgggccgccgagtggcggcttcgcggaccgagcccggtacatcagacacacgggcacgcattttgcatagtaacggcaagggggatgactcccacaatgcgatcttgccggtggtcggggtggccggattcgaaccgacgaccttccgctcccaaagcggacgcgctaccaagctgcgccacaccccgtcggtgcgacacgtagggtacatgcacgggagcagtggatccgccgctttgcggagcggctccaccgggtccggtccggtggccggcacaacaggtgtgcgggcaccgccgccgacccgctacgatgctcttcgtgccgcggtccacggacctgcggtgcgacgcttgcgggcgtagctcaatggtagagccctagtcttccaaactagctacgcgggttcgattcccgtcgcccgctccacgcagtcgagggccgggccggaggatgatcctccggcccggccctcgtgcgttgcggtgcttcagaagctgatctggttgatggtgtcggctatcgagttcatgaacctgttgatcgacggagccatgccggtcgacgccaggaagaagccgaagagcgcggcgacgatcgcaggaccggtcttgatggagccaccacggatcattaccaccaggatgaccgcgaacagcagcaccatagacagtgaaatagccacgtctgatcacaccctcggtcggtccgccttgccggcccggaagcgcacaccaccgcgcgccccgtcgcccccatcgtgccaccaactcccccgtggttgctgccgggtgacggaacgcactgacgtgatcccgccatccttcacgggccggcgccatcgcggcggc

SEQ ID NO: 2980 - DNA, 9022 bp, Unknown
  Kingdom: Bacteria, Phylum: Actinobacteria, Class: Actinobacteria, Order: Streptomycetales, Family: Streptomycetaceae, Genus: Streptomyces
accggcgcgccccggcctccggagcgctcgggcccacctccgtgacggttgcgtcctcaggcgccggacggtcggggatcgccggggccgccgccgggcggacccgaagtgcttccgggcggccgggacggtgacccgatgccgttgcgcagctcccccaggaccccgaaggccgccgcgcacagcgggacggccagcagcatgccgagcaggcccgccacgctcgcccccgccgtcagcgcgatcatgatcatggcggggtgcatctggaccgtacggctctggatcatcggctggagcacatggccctccagcacctggaccgcgagcaccacccccaggacccacagggcgatcacgaacccccggtcggccagcgtgaccagcaccgccaccgcgccggagaggaacgctccgaggtacgggatgtacgcgccgacgaacaccagcgcgccgagcccaaccgccccgggaacgtccaggatcagcaggcccaccgtgatgcacacggcgtcgatcagggcgatgaacgtggtgccgcgcatgaagccctcgacggcctcgaacgcccggcgccccatggcctccaccaggtccccggtgccgcgcggggccaccgagtgggccaggttcaccgcccggtccgagtcgcgcaggaagaagaaggtcagcagcagggccagcacgctggtcgccaccagcgaaccgaccagactgatgccgctgagcagaccgccggccgcgctcgccccgaacttctcgaccaggttcttcgcgttgtcggccagatcgtcgacgtccgtggccccggcgatgtccagatggtccacgacccactggccggcgtccttcagcgagtcgacgatctggctgccggagtcgacgagggcggtgacgacgatgtatccggcacccccgaccaccgcgaccagggccgcgcaggtcagccccgcggccagcgaccggttgagcctgcgggcgatcagccaccggtggacgggtccgagcagcgcggtgccgagcagggcgagcagcaccggggtgaccgccgtcttgaggacgacgaccagccagatcgcgacggcggcgacgcccacgacgagcaggacgacaccgcaccaggcggccgcgcgacgggcgctctcgggaaggaggggcttgggtgcggacaccctcccacccgatcacggggcgctgcggccggcccgtccgccgcccccgtacgggtgacggggagtcacctgacgggagcggcgggaggtgtcacatgccgtggaccgcggggaccgtgcccaggcggccggcctggaagtcctcgaaggcctgcttcagctcgtcctgactgttcatcacgaacggtccgtagtgcgccatcggctcccggatcggccgcccgccgaggaggacgacctccaggtccggggtgttgccgtcctggcgctcgtccgcgcggacggtcagcgagccgccggttccgaacaccgcggtctggcccatcgcgacgggacggcgctccgcgccgaccgtgccgcgcccggcgaggacgtaggcgaggccgttgaagtcctcgcgccacggcagggtcacctcggcgccgggccggacggtggcgtggatcatcgtgatcggggtgtgggtgatgccgggaccctcgtgtccgccgagctcaccggcgatgacccggagcagcgcgccgccgtcgggggaggcgagcagctggacctcgccaccgcggatgtcctggtagcgcggggccatcatcttgtcggccttgggcaggttcacccagagctggaggccgtggaagagcccgccggacatgacgagcgactccggcggtgcctcgatgtgcagcaggcccgacccggcggtcatccactgggtgtcgccgttctcgatggtgccgccgccaccgttggagtcctggtggatgaaggtcccgtcgatcaggtacgtgaccgtctcgaagccgcggtgcgggtgccagggggtgcccttcggctcgccggcggcgtactccacctcacccatctggtccatcatgatgaacgggtcgaggtgccggtagttgatgcccgcgaacgcgcggcggacggggaagccctcgccttcgaatccgctcggcgcggtcgtgacggtgaggacgggacgggccacggcgtcacccgaagcggccaccttgggcagggtcagcgggttgtcgacggtcactgcgggcatggaagccacctccgggcgagtgttctgcaatcaatttagttgaatgatgaacatcctgcaaggcggcacgcattcccgggcggccacaccctcggacccacccgggaccccggcagcgaaaaagagggggccgcaggtggcggagttcgtacagcgccggatcgagccgccggagcacaccgccctgccgtcggcttcggccaggccgcccggtctcagtcgggcgccggaccggcgagtgcggactccgcggtgggcccctcgaagtcgcggggggtctgggtgcggtaggagtggccgagttccgggccgagtccgaagtagtggcggaagttgtagatgagagggctccaggcggcggggtctatgtggtcggtgcccggaacgacgacgcgggagtcggcgtgcaccttgcacacgacggcctccacgatgacgaagtccccggagacgtcaggccgcacccgctcggcacgggcctccaattggatcgggcatccggccacgcgaggaggccggaccagacgggaggactgggcggtcaggccggcggcggcgaacttgtccggctcgaagcggcaccctccgggcttgctggagggcactggattccggccggtcagtggtgccagccgttccaccgccggccactggtcgggggccggcaggctgatgaccaggtcggggcggctgccgaggttgtacgcggtctgcccttcacggcccagcccgatgacgaccgcccgcccgagggcccatgcggacgatatcggggcaaggttgaacgagccgtcctgattctccgtcgacaggagcaccactggcgtcccgaagtacagaatgctcggctcgatctccagatgggtggcgaccgtcggtacgggcagggtgctgggaggtgccgtgttcatggtgggaaacctaggatccgctcgcttcggccatggccgaagcgtcacgggggacaatggaccacatggacacgcggcgcgcacatgtggccagtcccggcctggccgccgtggcgaagcttctggccgatggtacgcgggcaggtttctgcctggccctgcttgacggccgggcttggacagcgacggaattggcacgccatgcgggggtggccccctccaccgcgactgagcacctgcacgctctcgtcaacggaaacctcctgaccgaggaacggcagggccgccaccgctacgtacgcctggccggtccgcacatcgccgagctggtcgagagcctcgccgcgatagcaccggagcgcacctcggcgccccgttccctgtcggcggcaagccgccgacaggccctcgcccacgcccgcacctgttacgaccacctcgccgggtccgtcggggtcgccatcaccgatgccatgctcgaacgaaggctgctggacctggagcgggggttcgggctcaccggcgccggagcgacctggctcgaagaactcggcatcaccgtcccgaccggcacgcgccgaccatcagtgcggccgtgcctggactggaccgaacgacgtccccacctggccggcgccgtcggcgccgccctgtgccgtcacgcgttcgacacgggctggatcactcccgtcggcaccacgcgcgccctcacggtcacatcgctcggacgacaggcactccgacgccatctcggcctgtccgatgaactcctgtcgcgcagggatgagcagcagtcctgagagcgcggccccccgccggaagcacctgccgcacccgcggcggcagggccaccccgaagcaccacgccccacgctcacccccggctccgctccgggcacgaagtccgcgccaccctggcacgggcccgcatccggacacgaaacagcaggtcagcggcccactaggacgtcacactcacccatacatacgacgcatcgcgaagtcgaccatctgctcgacggccttggcgtcgaagaccatccggtgatcaccctccatgtccaggacgaagccgtagcccgtcggcagcaggtcgatcacctcggccccggtgatcacgaagtacttggactccttgcccgcgtacaggcgcagctccttgagcgtggtgaacatcgggatcaccggctgctgcgtgttgtgcagcgccaggaagcccgggttgtcgccgcgcgggcagtagaccttcgacgtggcgaagatctgttggaagtcctcggcggagagggagccggtggtgaaggcccgtaccgcgtcggccagggagggcggcgacggttcgggatacagcggctgctccccgtagccgccgcccatctgacccatctggcccatctgacccatctgctgctgagcaccagggttctggtcgtagccgtacatgctgcaaagagtaatcggacacatctacggcttgaggggttgcgccttattactggcgggtagcatcatcgtagaggtcagctgatagacctacgcctgcctgtcgcccgacccgcatccctccccggggcgctgtgcgccactgctattgattacggagccttcccatggggcactacaagtcgaatctccgcgacatcgagttcaacctcttcgaggtcctcgggcgcgacaaggtgtacggcaccggtccgttcggtgagatggacgtcgacaccgcgaagagcatcctggacgagatcgcgcgcctcgcggagaacgagctcgccgactcctacgccgacgccgaccgcaacccgccggtcttcgacccggagaccaggaccgccccggtcccggcgagcttcaagaagtcctaccaggccttcatggactccgagtactggcgtctgggcctccccgaggagatcggcggcaccacctcgccccgctccctgatctggggttacgcggagctgctgctcggcgcgaacccggccgtgtggatgtactcctccggcccggcgttcgccggcatcctcttcgacgagggcaacgaggagcagaagaagatcgcggagatcgccgtcgagaagcagtggggctcgacgatggtgctgaccgagccggacgccggctccgacgtcggcgccggccggacgaaggcagtgcggcaggaggacggctcctggcacatcgagggtgtgaagcgtttcatcacctcgggcgagcacgacatgtccgagaacatcctccactacgtgctggcccgccccgagggcgccggacccggcaccaagggcctctcgctcttcatggtcccgaagttccacttcgactggaccaccggcgagctgggcgagcgcaacggcgtctacgcgacgaacgtcgagcacaagatgggcctcaaggcctccaacacctgcgagatgacgttcggcgaccagcaccccgccaagggctggctgatcggcgacaagcacgacggcatccgccagatgttccgcatcatcgagttcgcccgcatgatggtcggcacgaaggccatcgccgccctctccgcgggctacctgaacgcgctggagtacgccaaggagcgcgtccagggtccggacctggcgaacttcatggacaagtcggcgcccaaggtcaccatcacgcaccaccccgacgtgcgccgttcgctcatgacgcagaaggcgtacgccgagggcatgcgctccctcgtgctgtacaccgcctccgtccaggacgcgatccaggagcaggaggccgcgggcgaggacgccaaggcgctcaacggcctcaacgacctgctgctgccgatcgtgaagggctacggctccgagaagtcctacgagcagctcgcgcagtcgctccagaccttcggcggctccggctacctccaggagtacccggtcgagcagtacatccgggacgccaagatcgacaccctctacgagggcaccacggccatccagggccaggacttcttcttccggaagatcgtccgcgaccagggagcctcgctcaacacgctctccgaggagatcaagaagttcctcgcgggcgcccacggcaacgaggagctggccccggcgctggactcgctcgccaaggccgccgtggacctggaggcgatcgtcggcacgatgatcaccgacctcacctcgaccggcgaggacgtcaagaacatctacaaggtgggcctcaacacgacccgcctgctgatggcctccggcgatgtcgtcgtcggctacctgctgctcaagggcgcggccgtggcggccgagaagctgccgaccgcctccgccaaggacgtcgccttctaccagggcaagatcgccgccgcgaagttcttcgccgcgaacgtcctgccgggcgtctccaccgagcgcgcgctcgccgagtcggtcgacaactcgctgatggagctggacgaggccgcgttctaggacctcgcccgcccgcccggcgatacgacccgcgccgccatccggaattcctccgggtggcggcgccgtcgtcacggatctcccggtcaccggataccggaccccgggtcctcgttacagtgaagaacatgagttcccctctccggttcgaccgtgcgcacaccgatgacctgatgtccttcctggcggccagcccgtccccgtaccacgccgtggcgaacgccgccgggcgcctggaggaggccggcttccgacaggtcgaggagaccgccgcctgggacgcgtcggccggcgggaagtacgtgctgcgcggcggggcgatcatcgcctggtacgtgccggagggcgcgcgggcgcacaccccgttccggatcgccggggcgcacaccgactccccgaacctgcgggtgaagccgttgcccgacaccggggcgcacggctggcgtcagatcgccgtcgaggtctacggcggcaccctgctgaacacctggctcgaccgggacctgggactggccgggcggatctccctgcgggacggcacccaccggctggtcaacatcgaccgggcgctgctgcgcgtgccgcagctggccgtgcacctggaccggtcggccaacaccgagggtctcaagctcgaccggcagaagcacatgcagccgatctgggggctcggcgacgtcgaggagggcgacctgatccggttcgtcgccgaggaggcgggcgtcgacgcggaggacgtcaccggctgggacctgatgccgcacgccatcgagccgccctcgtacctgggccgggaccgggagctggtcgccgggccccggatggacaacctcctctcggtgcacgccgcgaccgccgccctggccgccgtcgccgggcaggacgacgccgacatcccgtacatcccggtgctcgcggccttcgaccacgaggagaacggctcccagtccgacaccggggccgacgggccgctgctgggctcggtgctggagcgctcggtgttcgcgcgcggcggcacgtacgaggaccgcgcccgcgccttcgccgggacggtctgcctctcctccgacaccggccacgccgtgcaccccaactacgcggagcggcacgacccgacgcaccacccggtcgccaacggcgggccgatcctcaaggtcaacgtcaacatgcggtacgccaccgacggcagcggccgtgcggtgttcgccgcggcctgtgagaaggcgggcgtgccgtggcagagcttcgtgtccaacaacgcgatgccctgcggcaccacgatcggaccgatcaccgcggcccggcacggcatccagaccgtggacatcggcgtggcgatcctctcgatgcacagcgcgcgtgagctgtgcggcgccgacgacccgtatctgctggcgaacgcgctcgtcgcgttcctggccggctgaccggaagccgcccaaccacctcctcacacatggttgttaccgggccgggtacgcgactcgtacaccggcccggactcaccgggcggtcgaggaggcggaattcatgggactcggaggatgcattcttctgatcggtgggggcgcgatcctggcgttcgccaccgactggcagatggacaccgtcaacgtcgacctggtcggctggatcatgatgctcgtcggcctcgtgggggtcttcgtctacatgagcatcgcgcggcgccgccgtatggtcgtgccgcccaccaccaccaccgtcgtcacggacgacgagcagcgctaccgctgacggcccgcacgacggctggcccgcgtggacggccgaaatccgtcaccgggccggtcggctctgcgcgggacctgcggaatccccgatattctgggtcggatcccgcgcacccaccgtgggtgcgtcccgcccggaaagggagccgaccgtggagttccggctgctcggcacggtctccgtcgaaacgctcaccgggcccctgccactggggccggccaaacggcgcagcctgctcgccgctctgttgctgtccgccaacacgcccgtctccatcgggcggttgacggagtgcctgtgggacgacgagccgccgtcccaggcccgtggcgtcatccagggccacatctcacggctgcgcgccctgctggcgggcgcggacgcggaggcgtacggagtggagctggccaccctcggcgacgcgtacgtactgcgggccccggagacgctgctggattcgcagcggttcgaggaactgctgatgctggcgcgggagcagcgcggccccgccgacaccgtgctgatgctcaaggaggccctgtccctgtggcagggccccgcgctcagcggtgcgttcgccggtccgccgctccgggtggccgcgcactccctggaggaatcgcggctggccacggtcgagcagttgtcccgcgcgtacggagcgctcggcgagcaccaccgggccgccgccctgctgacggc

SEQ ID NO: 2981 - DNA, 4294 bp, Unknown
  Kingdom: Bacteria, Phylum: Actinobacteria, Class: Actinobacteria, Order: Streptomycetales, Family: Streptomycetaceae, Genus: Streptomyces
tcgacaccctccccgagggcacggcggggccctcggggagggtgtcgagataggcgagggcgtcgtcgttgaccgacagcagcgcgccgctcggatcgaacaggaggagcccggggccgtacggagcgtccggcagcggctgcggcgccggctccgcgaacgagcgcagctgcctggcgagcggagtgaggacggaggcgatcagctgggtctcggcgtcgtcgaaggccgcgcggccctccgcgcggaacaggctgatgtggccctgggggtggcctccgacacgcaggaccgcgcgcagctcgtcctggaatccgcgaggccgcatgaaggtctggtagagcgtgctgcgagcgggcaggtcgccggtggtctgccggagcccggcgaccggcacggaggcctgcgccagatcgcggaacaggttgacgttctcggtgaacagctcggattcccagtagacggcacagccgccctcgtccaggttctccgcgcggatcggcgcggtcatcatgccggtcaccgggtcggtgacccgccataccgccgcgtcgtacggcatgagccgtcgcagttgggtcgaggcctcggcgaacatgctgagcgcgtcggtggccttcgcggaccgggacagcagttccgcccggcctaccgaggtgcgcgaaatcgtcgaaccggtcatcccacgactgtgtcagtcccgcagcccgcctccaaccccccgtctgaggggggcagttctttcacgccgtttctccggggtgcgccgcgcagtgcgccgccccccttgattgcgggatgggaaccgcgcccgtatcccgcaagtgtgccgttcatgcggattgggattatcggagcgggaatgttggggcttgcggtcgcccggcgggcggcgctggcgggcgccgcggtgctgctggcggaccggagcatcggacgggcccgggccgcggcggccggggcgacgacggcggacaccgccggcaccgtggtggccaccactctggcggccgcgctccggccggagatcgtgatcttcgcgatcgggtggccccaggccctggagctgacccggctgcacgcgggtctgctggccggcaaggcggtcgtggacctgagcgttccctcgcggaccgatccggagtcgagcgcggtccggcaactggtcggtctcgcacccgaggtgcggtgggtgaaggcgctgaccaccgccgacgccggcgcgctgcaccgaggctccagcgacgggctcccggtggacgtgttcgtcgcggccgacgacgagcgcgccaaggtggccgtcgtggagctgttcgaccggtcggggctgcgcgccttcgacgccggaggcctggacaacgcctgggtgctggaaggcatggggcggctggggcaggaggtgggagagcggcttcagctcagcgagagctggagcttcaagttcatgcccagttggtgatctcccggacattgcggttgagtttcaggaaggcgttcacatatgtctacgcaccatcaattctccgttctcggtcccctcgtcgtccaaggtgcgcacggacccgtgcgcctcggcgggaatcggcagaggatcctgctgaccctgctgctgctggaagcgaaccgggtgatcggcgtgggccggctgatcgaggcgatctggagagaagcgcccccggcgacggtccgcagtcagttgcggatctgcatatccggccttcgaagacttctctccgccgcgaaagtggcggccgagatagagacgcacccttcgggctacctgatccgtgtgccacgggtgcatctcgacctgtcccacttcgaggatctgctcagccgggcgcgggcggaggcgcggtcggcgtcaccggaacgcgcggtcgtgctgttccagcaggcactccagctctggcacggaccggtggggtccgggctgggaagctcgctcctggagaccgtggccctgaaggtgaacgaggaccggctgtccgcgatcgaggaccgcatcgagctcgaactcgcgctgggccggcaccgccaggtgctgggcgagctgacccggcatgtggcggagaaccctttccaggagtccctgtgccttcagctgatgctggcgctgtaccggtccggacggaccgcggaggcgctgtccgtctaccgggacacgcgcaggaggctggcgcgggagctgggacttgagccgagcgagaagctgcgcatgatggagcggctgatcctggaccggcgcccggcgggagagctctcgccgggaatcgccccggcgctgccgatacccgtacgcgccgccgccacggggccgcaggaccggatcgccctgttggagcgggagatcgcggacctgcgcgacgcgagcgtgcgtcccggctgaccgccgccggccaccgtgcccgggtcccctgccgatcgccgcccgccaccgcgtgcgtcccgtgttccccgcgccggggtcccgatggagggccgggccctctcccataccccctaagcaggggatgggagagggtccaccggacgagaacactgctcctcatcgccgccgcgccatgcgggaccgccgcgcggcacgggaggaaggacgtgatcgtggcaggacaacctggacacgcgggcatcgccgagagctccatggacgggctcgtcgcacggctcaagggtgaggtcttcactccgcaggacgcggggtacgagagggagctcgcggggttcaaccggatcgggcagcaccggcccgacgtgatcgtcgccgcgcagtcggccggggacgtgtccgccgcggtgtccttcgccgcccgggaggcgctcccggtcgccgtccaggcgaccggacacggcatcgcggcgtccgcgcccggcggagtcctcgtctccacccgccggatgaacgcggtcgccgtcgacccgctcacccgcacggcacacgtggaggccggagcccagtggcaccaggtgatcgccgccggcggaccgcacggcctggcgccgctcaacggatcgtcgccgctggtcggcgtcgtgggctacacgctgggaggcgggctcggtccgctgggccgccagtacgggttcgcggcggaccacgtgacctgtatcgaggtcgtcaccgccgacggcggcgtccggcaggtcacccgcgaccggcatccggacctgttctgggcgctgcgcggcggcaaggggaacttcggcatcgtcaccgggctctggttcggcctgatgccggtgcgccggctctacggcggcgggatctatttccccggtgagcaggcggcgcaggtcctgcacacctggcggcagtggaccgcgaccgtgcccgaggagatgacctcctccgtgtcgctgctgcggttgccggacgtgccggacgtgccggagttcctccgcggcacgttcgccgcgcatgtgcggatcgcgttcaccggccgggccgaggagggggagcggctcgtccgtccgctgcgcgagtgcggtacgccgctggtggacggggtcgccgagatgccgtacaccgcggtggccgacatccacagggacccggtgcatccgctcgcgtaccacgaacgcaacatcgtactgcgggagttgggatcggacgccatggaggcgctgctgcgggcggccggagcgggttcctcctgcggcgatctgatggtcgaggtgcggcacctcggcggtgcgctctcccggcccgccgaggtgcccaacgcggtcggcgtccgtgaaggcgcgttcacgctcacgacgctctcgcccccgggctcgccggacgtggtcctcgagccgatggagccgtggagcacgggccgccgctatctgaacttcctcgcgggcgcggacacggccgacgcgacggcggagtgcttcgatccggagaccctggcccggctggcgcgcgtgaaggccgcggtcgaccccgacaacctcttccggctcaaccacaacatcgcgcctcttccgtagggcggtcgccgctcgcccggcacgccggactgccctgcgcgctccggtggatccgggctcccgagccgctgtgttttggcaggtgctcgtcaatctttggagttcatcatgaccacgcacgaggccgcgtcgaccgcggccgccggtaccgtctcctccccgggagcccgctcggacgggttgcgctacggcgctctgttcggcccggtcgtcttcggcgtcaccgccgccggcgtcgctctgcccgacgtggcgtcctcgctcgacgcctcgtccaccgccaccgcctgggtcctgacggcccacgcgctcgccc

SEQ ID NO: 2982 - DNA, 4081 bp, Unknown
  Kingdom: Bacteria, Phylum: Actinobacteria, Class: Actinobacteria, Order: Streptomycetales, Family: Streptomycetaceae, Genus: Streptomyces
agccgttcctgcacggcgcgagctgccagccgtcgcgcgcgccgtgcaggaacggctggaggacgccgagggtgagtggttcggggccgggcgcctcgaaccaggcgaccggggccggtacccgctcgcacccctcgccgccgagggcgagaggcagttccaggtccgggttggtgcccgggaagacgcgccggaagatcttgaggatgaacgcgtccccgtagacgagcgaggagttggactgttcggcgtccagcacccggggtgcgagaccggccgggatcgcggcggtccgctcgaagcgcagcgagccgaggctcccggggcggcggaagcgttccagcagcacgtcggccagccgggggtcgtgcagcgcgtcgtagacgatccgtccggcgagcgggccccgctccacccggccgatcagggcgcccgagagcagcggcggaagtgacgttcttgcgccgagcagcagttggtagcagtcctcggcggggcgggcctgctgggagggctgctctacccgcagcagcaggtgcagcaggccggggccggccgtgccgtccagcggcagcatctcggtggccgagaccagggagaagccggtgaccggccggcccttgccggcgaaccaccgctgccgtggcagccaggcgtggagcagcggcgcgagggacgggagcagggtcccgtcctgcgtactgctgggtgttgcgctgttcctcgtgctcttcgccagggcgacgtgagtggatgcagcctccgacatggcatcgcgtcctttccccgggcacaccacaggatgcgaagagtgtcccggattgcggcaatggctgtccggctgtgcgggacgtgtcgggagaggagagttcttacggactcgaacggcggaacggtgaaggccgaaggcgccggaaccgtgaaggccccaggccttctcctggggtcagggtgccccgtgcgggtcggtggaaaccgtcccgcacggggcgggtggacctcaggccggcggcgcgtccttgcgcagccggaaccagtagaagccgtgtcccgcaagggtcagcaggtagggccactggccgatggccgggaagcgtacgccaccgatcagttccaccggatgacgtccgtcgaacgatcgcaggtccagttccgtcggctgcgcgaaccgcgagaagttgtgcacgcacaggacgagatcgtccttgtactcgcgggtgaacgccagcaccgccgggttggacgagggcagttcggtgtactcgccgagaccgaaggccggattctgcttccggatctcgatcatccggcgggtccagtgcagcagcgaggacggcgaggccatcgacgcctcgacgttggtgacctggtagccgtagaccgggtccatgatcgtggggaggtagagccgacccggatcactggaggagaacccggcgttgcggtcgggcgtccactgcatcggggtgcgcaccgcgtcccggtcgcccagccagatgttgtcgcccatcccgatctcgtccccgtagtagaggatcggggagccgggcagcgacagcagcagggcggtgaacagctcgatctggttgcggtcgttgtccagcagcggggccaggcgccgccggatgccgatgttggcgcgcattcgcgggtccttggcgtactccgcgtacatgtagtcgcgttcttcgtccgtgaccatttcgagggtcagctcgtcgtggttgcgcaggaagatgccccactggcagttcttcgggatcgccggggtcttggccaggatctcggagaccgggtagcggctctcgcggcgcaccgccatgaagatccgcggcatcacggggaagtggaacgccatgtggcactcgtccccgccctgctcgtagtcgccgaagtagtcgacgacgtcctccggccactggttggcctcggcgaggagcacggtgtccgggtagttggcgtcgatctccttgcggacccgcttgaggaagtggtgggtctcggggaggttctcgcagttggtgccctcgcgctggtagaggtagggcaccgcgtcgacccggaagccgtcgatgcccaggtccagccagaagcgcagggccgccaggatctcctcctggaccgccgggttctcgtagttgaggtccggctggtgcgagaagaagcggtgccagtagtactgcttgcgcaccgggtcgaaggtccagttggacgtctcggtgtcgacgaagatgatccgggcgtcctggaactgcttgtcgtcgtccgcccagacgtagtagtcgccgtacggcccgtccgggtcggtgcgggactgctggaaccactcgtgctgatcgctcgtgtggttcatgacgaagtcgatgatgacgcgcatgccgcgctggtgcgaggcgtccacgaactccacgaagtcggcgagatcgccgaactccggcaggacggcggtgtagtcggagacgtcgtagcccccgtcgcgcagcggcgacttgaagaacggcggcagccagaggcagtcgacaccgagccactggagatagtccagcttggcggtgatgcccttgaggtcgccgattccgtcgccgttggagtcctggaaggaccggacgagcacctcgtagaagacggcgcgcttgaaccagtcgggatcgcggtccttggcgggagtgtcctcgaacgtgtcgtggacaggctcattgacgatcatggtgtgggtgaccctccggtcggcggggacggtcgcaggacggcgatgtgcgcgggcgtgatgcccggctctaggcgcacatagaaggtcctgccccagtggtaggtatcgccggtgagctcgtcgcgcaccggtacgcgctcgtgccatgagaggccgagccgctccatgtccaacgagaccgtggcctcctgggtgtggtgcgggtcgaggttcacgaccaccagaacggtgttcgctccggagcgcttgctgtaggcgatcagcgcttcgttgtcggtgtggtggaagtggacgtcgcgcagctgccgcagagcggggttacgccggcggatccggttcagagaggtgatcagaggggtcagcgtgcggccctcgcgttccgccgactcccagtccctcgggcgtagttcgtacttctccgagtgcaggtactcctcgctccccggcttggccggagtgttctcgcacagctcgaatcccgcgtacacgccccaggacggggagagcgtcgcggccaggaccgcccgtgcctcgaaggccgggcggccgccctcctggagatagccgggaaggatgtcgggggtgttcacgaagaagttgggccgcatgtacgacgcggcctcgccggacagctccgtgacgtactccgtcagctcctgcttggtgttgcgccaggtgaagtacgtgtacgactgctggaagccgatcgcgcccagggtgtgcatcatcgccgggcgggtgaacgcctccgccaggaagaccacatcggggtcggcgccgttgatctcctcgatgaccttctcccagaagaccaccggcttggtgtgcgggttgtcgacccggaagatccgcacgccgcggtccatccagaaacgcaggatgcgtaccgtctccgccaccaggccgcgcaggtccttgtcgaaggcgatcggatagatgtcctggtacttcttcggcgggttctcggcgtacgcgatcgaaccgtcggggcggtggtggaaccagtccgggtgctccttgacccacgggtggtccggcgagcactggagcgcgaagtccagcgcgatctccatccgcagattgcgggccacggagacgaagtggtcgaagtcctccagcgtgcccagctccgggtggaccgcgtcgtgcccgccctcggccgaaccgatcgcccacggcacgcccggatcgtgttccccgggcgtcaggctgttgtccggacccttgcggtgggtggtcccgatcggatggatcgggggcaggtacacgacatcgaaccccatcgcggcgaccgccggcagccgctcggcggccgtccggaaggtgccgctgaccagtcgggtcgcagcgtccgccgaggtgtccgccggg

SEQ ID NO: 2983 - DNA, 2100 bp, Unknown
  Kingdom: Bacteria, Phylum: Actinobacteria, Class: Actinobacteria, Order: Streptomycetales, Family: Streptomycetaceae, Genus: Streptomyces
cgcgtaccccgagccggtggaagtgccgcaggagggctggtacgccccgccggcccccgttccgggccggagccccgagcccgccgccgtgccctcccccgctcccgcagccgagacctcttccgccgctccggccggagagcagacgagcaaggacctccgatgacgacgccggccaccccgcaggcccaccagcaggcgccggacgccggtccgccgggtccctacgagtcgccgatcccgatccggcccgccaccctcggcgacgcggtcgcctcggagtggaccaagatccgttccgtgcgcgccacgatctggacgctcggcgtgatggtcgcgctgatgctgacgatcgggctcggcaccgcgctgctggtcgcgacggacggcggcagtctgacgaacgaaccggttctgggcctcggcttcttcggggtgctgctgggctcgatctgtgtgatcacgctcggtgtgctgaccatcggatccgagtacagcaccggcatgatccgtacgacgctgacagcctgtccgagccggggccgggtgctcgcggcgaaggcgatcgtcttctcctcgctggccttcaccgtcacgacggtgaccgccacggtcgtggcggggctccagaacctgctcctggacggcgctcccgcgtcggccgacgactggctgcgcggcacggtcgggatcgggctctacatcgcggccctcggcctgctggcgctcgggatcggcgcgatcgtgcggcattcggcgggcgcgatcaccatcatggtcggcgtggtgctgctgcctctggtcctcgcgctgttcatgttcgccgacagcctgcggggtgttcagcgcgtcctgatcgactactcgatcccgaatcagatcggcggcctctacggcacgacgatgaccagtaccggcccgtccggctgggagccgctgctgctgatgctgtgcctggccgccgcggcgctcggcggggcggtcgcgatactgaaccggcgcgacgtctgagtggtcgggagacgtccgagggacctcgtacgcccgggggaccgcggcctcagtggcgcggagcgttgcgggaccgctgcaccctggtggtgcggcggtccttcgcgttccagcacgccttgtgccagtgcctgcggtcgtcgatgccgccgaactcgggccaggtcacgaggtgcgggaccccggaggggatctcctggtcgcagccggggcagcggtaccgcttgccctgggcgctcgcgccgctgaccgggcgcaccgaccactcctcgccctgccagctctcggtggcccctcccccgccgtacctgccggaccccgggccggggcgttcgtcgtgactctcgccgccacgggggcggttacggcgcggggacacaggacacctcacggagcgggtcggacacggttcgcccaagcctagagcctggcgtcgggggcagccgtcgggcggcccggcggtccggttcggcagtggggtgagttagcggaaaatcgcaacaacttcctcagggaccgtgcctttggcacgtgtcagacgttgttgccggtgggggagaaacgcgtcggccgcaaggaggcaataggcgatgcgcatcggaacgttcgttctggcagcccagttcccgggacaggggccgggtgaggccctgcaccgggccgtccggtccaccgaggccgcggaggagagcggtctcgactcggtctggctggccgagcaccacttcgtgccgtacggggtctgcccgtctgcgaccacactggcagcgctgctgctgggccgcacccgcagaatccgggtcggcacggcggtcagcgtgctgcccaaccaccacccggtcgcgctcgccgagcaggccgcgctgctgcatctgaccagcggcgggcgcttctcgctcggggtgggccggggcggtccgtgggtggacctggaagtgttcggcggcggtctcgacgcgtacgagaacggcttccccgaggcgctcggcctggtgctcgactggctgcgggagccgcgcgtcgcggggcgcggcgagcggttcggcttccgcgaggtggctgtggtgccgcgcgcggacgagctgctgg

SEQ ID NO: 2984 - DNA, 9752 bp, Unknown
  Kingdom: Bacteria, Phylum: Actinobacteria, Class: Actinobacteria, Order: Streptomycetales, Family: Streptomycetaceae, Genus: Streptomyces
gtcctttcacggcggaacggtcggaacgggtcggaaggggcggagcgggtcggaaggggcggggaggagccggggcgagggtcagggcaggacgacgagcagggcgtagcgggtccgcccggggcccgcgcagcggaaacgggaggggccgtgcagccggaagcggaggcagtcccccgtgtacagggtgtgcgtcacctcggccaccgtcacctccaccgtgccttcctgtacccagatgtgctgctcgacaccgggcacgggtgcgtcctcgtaggcgaccgaagcgcccggttcgaggatcgactccacgacctcggcacgcagtccggcgtgcggcggcgaaaccgagcgccggacgaacccggcctcctcgtcgcgccagaccgcctgccgcgccgcgggcaccaggggcgggggctccgcctccacctccatgagcagccgggacatcgtccggccgtagaccgtgcacagccgcccgagcagggccgcggtcgggctcacctcgcagcgctccagccgcgacagcgtcgaccggctcaccccgcagcggtgggccaactcgtccagtgaccagccgtgttcggtgcgcagctccgccagtctcacggcgagccggacgtccatggggtccggctccgtcgcgtctctcatatcagggacgttatcccgaatgcgggacaggttctaggcggccttcttcggccgtccccggtccccgtccaccggcgcgggtgtcagccggagggtgatcacgtacgccaccaccaccgccacgatcaccaggggcatcacggtgaggccctccttgcccagcaggagcgtcgccaggagcaccgaggtcatcggcaaccgcagcatcgccacgcacatggccccgacgcccatcgcgaaccccgcggtgagatccagccccggcagatgggacagcgcgatgcctcccaccgcgcccacgaacatcgcggggaagacggggccgccccggaaacagctcaacgaggcgcagtaggcgagcgacttgcagatgatgagcaacaccagcgcgccgaccgaataccccgcgctcccggacaggagatggcccaactcgtgctcgcccgagtacagcacctcggaaccgtccttgcccgacgtctccgcgtacaccagcgcgagcccgccgacgaccagacccatcaccgccgtggccaccaccgtccgccgctccacacgttcctgcagggccagcgacagccggcggatgcccgcaccggcgaaggcggccgcgaccccgagaaccagcgcccacccgaacccggcggcgtcggggaccgccgtcggcgggacgtcgcccagcgtcagggagtaggtccccagacccgtccaggaacccagccccgtgaagatcagcgcgccgatccccgcggagagcagcccgggaaccagcaccacgcccagcatcggaccggccagccccgacacctccatcagcaggaacgcgcccagcagcggggaccccagcagggcgctcaccgcggcgaagctccccgaggcgccgaccagggaccgcgcctgtggtgtcaggtcccgtttgacgcggcccgccgcccaggcggccagtccgccgcccagcgcgatcaggggtgcctcgggcccgagcacggcgcccacgcccagcgagagcagcgccgccagggcgacgccgggcaggtccgccggggccggggccccggtggagaccagcccctccgcaggccggtgcccacccccgcccggcagtcggcggacggtgaggccgaccaggagacccgcgacgccgagcagcggtacgggccaccacgacggtgtctcctcgaagcccatggccctcggcagctccgtgtacgtcagcgactggagctccgagacgagggccaggaagccgaacgcgaccgcggagaccggtaccccgagaacggctgccatcagcagcagtcccacgtacctccgcttgcggaccgccgcgtacgggtcctccggtgctgcaacgggtgtgcccggaggcatggccggcataggtcgaactcctcggcgtgacgatcccgggaaggggaagggggcaggtccccacggttcacgccggaataccacgcaccggcggaccggacgcctccccgccgccggggacacgccctccggtacgcaaggtcagccgcccggccccggaggaccgttcgcgtcgcccgccgggacctccgccggcagtcgccccgaggccaccgcgtccaccagcgcccggtggtccagctcgttgcggtccgcgtacgactccgcgaacgtggcgagcgcccggtcgaagacgtccccccgccccaggtagccggcgatggcgatccggtccccggacctcgcgtgggcgcgggccagcgtggctccgcacacctcgccgaacgcgcgcatccccttcggcaccatcgactccggttcggcgatgcccttccagtcgcgcaactggcgcacgtagaagtccctgctccggccgtcgatcccgtcggcccgctcccagccgaggaagatgtcgctggaggcctgcatcaggcgctgccccgcgaccacccgctcgccctggtgggcgtagcggctcgccccggtgtgctcggccagcaccgagggacccgcctccttggcctggaggaggagcgggtccccgccgtcccggccgagcagcaggatgatccagcagcgggtgccgacactgcccacaccgacgaccttccgggccacgtccaccagcgcgaagtcctccagcaggctgcgccggtcggacgccaggctgcgggcgtaacccgccaccaaggcccggaactcccggtacaccgtttcgcgcgccacccccggcatcagatcggtgagcgggacgaccatcggcgggtccgcggcgatccgcagccgcccgccgaccacttcggcgagcttgccgaaggcctgcaggctgtcccgggagcgggccttgcccagcgcgcggtcgacgttcctgcgaccccgcccgcccaactgctccgcggccaccgtacgcagccgctcggcgtcggtcctcgcgtaccacacctccagattgcgcatcccggcgaaccgggccatcgactcccggtacgagcgcaccgcggcccgtacgatcccggcccgctcccggtgggtgaagccgttcgcccgccccgcgatgacgaggctggccgccagccgtttgacgtcccactcccagggacccggcagcgtctcgtcgaagtcgttgatgtcgaacagcagattccgctcgggcgaggccagcagcctgaagttcagcagatgggcgtcgccgcacaactgcgcccggatccccgagaccggggtgcccgccagatcggcggccatcagggcggccgcgccccggtagaaacggaacggggactcggtcatccgcgcgtagcggatcggtaccagctcgggaacccggtccgcggactgcgcttggaggacggtcagcgggtcgggacgtcgcggcgacggtgtgaactccgcatggctcgaccgcggggtgtcccgccgggcggccctgccgagcgccgcccgttcggccggtgtcgcgtgaggtgcggcgcgcagcggcgccgaggcttcccggtccatgaggtgccccttccgatgctcgtcaggcctcttcggtgagccggcggtcacggtcgcgccggagaccgacccaccgccagatcgcccgctgggccttgagcgcggccgtgcccaccacgatcagcaccaggatgttcaccacgagctggatgaccgagccccggacgtcggaccagctggtgaacgccgtggagaccgcgatgtccgccgcggccgggatcgtcgtcacggagatgaacacgccgagcagggcgctgctccgggcctcggtgagcgacacgatcccgacgatcccggccagggtggcgacggccaccgagaagaagttcggtgtgttgatgagattggagacgggccgcaaccccaggtcgaaggcctccgactgcagcccgaagccgcggatgaggagggcgaagaggaacgtggcgacgatggtgaggaggaaaccggtccccagggcggccagcccgctgcgcaccatggcccgatggccccggtcgatccccagcgccacgctgacgatggcgccgtactcaggcccgacgaccatcgccgccacgatcaggatctgcgagttggtgacgatgccgaccgaaccgatcagcccggcgaccacgagatagagatagaagctcggcgggtaccgcccaccggacctgatgcgcgcctcgacctgctcccagaccggcgcccggctcagcggccccagctcgcgccgccccttttcggaggcgctgccggggaaggccatgtcgaccggttcgatgaccagcgtgccccgctggtcgaggtggacatcgagcaggcggtgcagcacgtcgttcgccgcccccgccagtacgtcgcaggcgatggagtcgccgtcgggacggtgcgaggcgtcgcgctggacgatgaggttgagcacgcaggggtcgtccgagagcaggccgacgacctcgtcggtcaggtccggcgggctcaccgcgcggatgtggatcatgtccatcccggcacctccgcggctcccggccccgtcgcacggagctccacccggccggcggcccgggggctcactccagtaacgcggccccgggcccgttcggcaaaccgggcgcccggcccggacccgtcgcacggacgtgccgcgcacccggggagggagtgccggatagtgaggggacggggcccgaccgggaggaaagccgcgtggaccggtatccgccgatcgctgaccacgggctcgtgggcgacctccagaccctcgcgctgatctcctcgcgcggcctcgtcgaatggctcgccgcccccggtacgactcgcccagcgtcttcgccgccctgctcgaccacgagcgcggcggcttcttccgggtggcgcccgaaggcgtcggagaggtcctcgactggatgacccccggtccgctccggcgggccgaccggccgccacaccctcgtccgcaccgtacgttcggtacgcggcaccgtgcgctcggcctggagtgccggccccggttcgactacggccgtgccgcccacgcgctggaactggcccctacgggagacggagcggtcttccgcgcgccgggcgtcaccgcccatctccgcacgggcttccccctgacccgcctgttcgccgaggagatcggcccccgtggtgaacaactgggcaacttcccgcaggcgttcacccatctctcgctcatcatggcggcccgcaccctggacgaggcgctcgaccgggagcgcggtcgtccctgtgccacgagggccctgccgggcggccggggcgccgtactggcaggatcggcgtgtggacattcccgacgcccttcccgaaccgctgcccggtgccgccggagccgtcgcccgggagccggccgccgacggcgagcagcatcgaggccgccgcctcgtccgctgccgcctctgcggccggcctctcaccgggaccgactcgcgccgggccggcctcggaccgtcctgcgacgccaagctgcacccggcgcccccggacatccgcacccgccgccacgaggtcgaccaggacccgctgcccggcacgtagaagcgtgcgctagtcgttcgccagccgccggaacagtccttcctgcaccaccgacaccagcaactgccccgaacggtcgtagatccggccccgcgccagcccccggccgcccgtggcgatcggtgactcctggtcgtacaggaaccactcgtccgcccggaacggcctgtggaaccacatggcatggtccagggaggccatgtcgaagccgcgcgggccccacagcggctccaccgggatgcggaccgcgtccagcagcgtcatgtcactcgcgtacgtcagcgcgcaggtgtgcaccagcgggtcgtcgcccagggggcccaccgcacgcatccacaccgcgctccgcggatccgcgtccttgatctcgtccttcgtccagcgcagccggtcgacgtagcggatgtcgaagggctgccgccgggccatccgctccagcgcctccggcagcacgcccaggtgctcgcgcacctcctcggccaccgtcggcagctcctccgggtccgggacgatgcgggccggcggcaactggtgctcgaaacccgcctcctcggggcggtggaacgacgccgtcaggttgaagatcgtccggccctcctggacggccgtcacccgccgggtggtgaaggaccgaccgtcccgcacccgctccacctggtagacgatcggcaccccgggccggcccggccgcaggaagtaggcgtgcagcgagtgcaccggccggtccccgtcggtggtgcggccggccgccaccagtgcctggcccgcgacctgcccgccgaagacccgttgcagggactcctcggggctgcggccgcggaagatgttgacctcgatccgctccagatcgagcaggtccaccaggcgctcggccgggttcgtcatgccgtacctctccactcgtgtctcagggattccctcacagctggccgacctcggtgacccggacgatcgcccggccctcctcgtcggacgcggcgaggtccacctcggccttgatgccccagtcgtgatcgcccgccgggtcggcgaacgcctgccagacccgccacagcccgtgtgccgggtcctcctcgatcttcagcagcttcgggccgcgcgcgtccggaccggtcccgagatcctcgtgcgcgtcccagtacgcgtccatcgcctcgccccacgcgtcctcgtcccacccggcgtcaccgtccagctcgcccaggtcccggacccggtccagcgcggccagctccacccggcggaacatcgcgttgcgcaccagcacccggaaggcgcgggtgttggccgtgaccggcttgacctcgtccgccttctcctgggcctgctcggcggtctccacctcggggttggccaactgctcccactcgtccagcagactggagtccacctggcgcaccatctcgccgagccaggagatcaggtcctggaggtcctccgacttcacgtcgtccgggatcgtgtgctccagcgccttgtacgcgctcgccagataccgcagcacgatgccctcggtccgggccagctcgtagtgcgaggtgaactccgtgaaggtcatggcccgctcgaacatgtcccggatcaccgacttcggcgacaccgggtggtcgttcacccacggatggctcgtgcggtacacgtcgtaggcgtgccacagcagttcgctcagcggcttcgggtacgtgacctcctggagccgctccatccgctcctcgtactcgaccccgtccgccttcatctgccccacggcctcgccgcgcgccttgttctgctgggcggccaggatctgccggggatcgtcgagcgtcgactcgacgaccgagaccatgtccagcgcgtacgaaggggattcggcgtccaacaggtcgaacgcggccagcgcgaacgtcgacagcggctggttcaacgcgaagtcctgctggaggtcgaccgtcagacggacaatccggccctcggcgtccggcgtctccaactgctccaccaccccgccgtccagcagcgagcggtagatggcgatggcccgccggatgtgccgcagctgcgcccggcgcggctcgtggttgtcctccagcagatgccgcatcgcctcgaacgcgttgcccggacgcgcgatgaccgcgaggagcatggtgtgcgtgacccggaagcgggagttcagcggctccggctcggactggatcagcttgtcgaaggtggtctccgaccaggcgacgaagccttccggggccttcttgcggaccaccttgcgcttcttcttcgggtcgtcgcccgccttcttgacggccttctcgttctcgatgacgtgctcgggagcctgcgccacgacgaagccggccgtgtcgaacccggcccgcccggcccggcccgcgatctggtggaactcccgcgcgcgcagggtccgcacccgggtgccgtcgtacttggtgagcgccgtgaacagcaccgtacggatgggcacgttgacgccgacgccgagcgtgtccgtcccgcagatcaccttcagcagacccgcctgggccagcttctccaccaggcggcggtatttgggcagcatcccggcgtggtgcaccccgatgccgtggcgcacgtaacgggagaggttctggccgaacttggtggtgaagcggaagccgccgatcatgtcggcgatcttctccttctcctccttcgtgcacatgttgatgctcatcagcgactgcgcccgctccacggccgccgcctgcgtgaagtgcacgatgtagaccggcgactgccgggtgtccagcagctcggtcagcgtctcggtgatcggcgtgaagcggtattcgtagctgagcggcaccggacgggtcgcggagcgcaccacggaggtggggcggccggtacgccgggtcaggtccttctcgaacatcgcgacgtcgccgagcgtcgctgacatcagtacgaactgggcctgcggcagctccagcagcgggatctgccacgcccagccccggtccggctccgcgtagaagtggaactcgtccatcacgacctggccgatatcggcgtacttgccgtcgcgcagcgcgatggaggccagcacctcggccgtacagcagatcaccggggcgtccgcgttgaccgaggcgtcgccggtgagcatgccgacgttctcggtgccgaagagcttgcacaggtcgaagaacttctccgacaccagagccttgatcggcgccgtgtagaaggtgaccttgtcctgcgccagcgccgtgaagtgcgcggcggccgccaccagactcttcccggagccggtcggagtggaaaggatcacgttcgcgccggagaccacctcgatcagcgcctcctcctgagccgggtaaagggtgatgccctgggtctcggtccatgacgagaaggcctcgaagagggcgtccgggtcgggggtcttaggcagctggtcgatgagggtcacgccccccatcttgcctgtcttccgcccggatgagggaaccggcggacggcacgaagatcacggacgatacgctgcggtctcaacctgcccgcgccgtaccggtgatgggcggacgaagcgctgggggcgggaaaagaccatgatgggaccggcacactccctgtcaggggcagcggcctggctgggggtgggcgcggcggccaccgccgcgggccacacgatgccctggccggtcctcgtcgtcggggcgctgatctgcgccggagcggcgctcgcccccgacctcgaccacaagtccgcgaccatctcgcgcgccttcggacccgtctccaaagccctctgcgagatcgtcgacaagctctcctacgccgtctacaaggccaccaggagcgccggcgacccccgccgcaccggcggccaccggaccctgacccatacctggctctgggccgtcctcatcggctgcggcgcttccgccgcggccatcttcggcggacgctgggccgtcctcgcgatcctcttcgtccacctggtgctcgcggtcgagggcctgctgtggcgggccgcccgggtctccagcgacgtcctcgtctggctgctcggcgccaccagcgcctggatcctcgccggcgtcctggaccagccg

SEQ ID NO: 2985 - DNA, 13137 bp, Unknown
  Kingdom: Bacteria, Phylum: Actinobacteria, Class: Actinobacteria, Order: Streptomycetales, Family: Streptomycetaceae, Genus: Streptomyces
gcgtacggctatccgcagcctgccgccgagccgcccgcgtacggctatccgcagcccgcggcagccgccgcgcacgcgcccgacccccatttcgtgctgcctccccaaggtccgcagttcgtccggtcctgagcctccccgatctgattcccgcgtccgtcctccggcctccacggctgcccgggctcaggtccgggacttgtagccgcgcccccattgcatgccgtagccgtacagccggtccagctccgactggaagccgtacacgaacttcacctcgcggcgcacgatcagctcgtccttgatgttctccacggtgaacaccgcgcaggagcgggcctggggtgcgcgctcgtccagctcgatctcgatacgcgggccgttgcccgggtagagcgtgaccttggcgtgcgtacggtcgaacgcgggcgtccggtcgtagatgtagacgaagaacagcagccgcttgatctggtcgcgctggtcgaggttgacgtagaccgtctcccccgagggcgcgccgaaccggtcgtcgccgctgagccggacgtagggcgggccgttgaggtcgccgatcagactgcccagcggctgcacgacgcccttggtgccgtccgtcagctcgtacatgcagccgaggtccaggtcgacgttgacgacgccctgggtgtgcgcctggaccacttcgggctggaagagcttgagggggcgccgcagtctgccgctctggcgggaccggccctcgatgtccgaggtccgcatccgccaggacaggttgacccggaggttgcccgacagggcgccctgcttgctgagcgagatcgtggcgttccgtttggacagcacgatcgcgctcgacgtcgagttgcccgagtcgaactgcgccgcgcgccccggccacaggccgtcgaagaatcccataccaacccccacctgttcgcgtgccccggacacaccacggggcggccaccgggccgggtccgggagatcccggagagccgtcgccgtgtgggccgccccgcagagagcgttcctcaatccttaccgggtcacaccccggaggacacttcggacttgcttcccgagccgccgtccccgccggattccgcggcgagcgcgcggttgcgccggaccgaggaccagaaggagagggcgatcaggatcacgccgaccgagccggtgatgaactcgttgatctcgtactggatggtgatcagcaggatgatggagagcgcgccgatcgcgtagtgcgcgccgtgctccaggtagacgtagtcgtcgagcgtgccctcgcgcaccaggtagacggtgagcgaccggacgtacatggcgccgatgccgaggccgagggccatcagcacgatctcgttggtgatcgcgaaagcgccgatgacgccgtcgaaggagaacgaggcgtccaggacttccaggtagaggaagaggaagaacgcggccttcccggcgagggcgaccccggtgacgggcttgcccttctccttggcctcttcctcggcctcgtgctcacgctcctcctcctcttcgagcttgccctcgaagaatccggagagcccgccgacgacgagataggtgatcagaccggcgatgccggagagcatgaccgtcgccgccttgtccacgtgcccgccaccgtgctggtgggcctgggtcgcgaaggtcatggcggtgatgagcaggatgatcagcgcgacgcagaccgacagcatgtcgaccttgccgagcttggcgagcggacgctcgatccagcgcagccagtggatgtcacggtcctcgtcgaagatgaagtcgaggaagatcatcaacaggaacatgccaccgaaggcggcgatcgacggatgggcgtccgtgaccagttccttgtacctgtccgggtcgttgaaggacaggtcgatggcctcgatcggcccgagctgggcgctcacggccacgatcacgacggggaacaccagccgcataccgaagacggcgatgaggatgccgacggtgaggaagatcttctgccagaaggcattcatcttcttcaggattccggcgttgatcaccgcgttgtcgaaggacagcgagatctccaggacggacaggatcgcgacgatgccgaatgcctgccaccccccgtagaaaatcgctgcgaccaggccgagcgcggtgaccgcgaacgaccagccgaaggttttcagtaccactggctaccccatcgtgttggtaaagggtctcccccggtgtgtcggggtcccccgcgcctgagcctttcggcccgagcgcggccttatgaaacgttgacgccgaagtctagagcgatgccccgcaggccggacgcgtacccctggccgactgcacggaatttccactcgccgttgtaccggtagagctcgccgaagatcatcgcggtctccgtcgaggcgtcctcactcaggtcgtagcgggccagttcctggccgtcggcctgattgaccacacggatgaaagcattgctgacctggccgaacgcctggccccgattgtccgcgtcatggatcgagaccggaaagacgatcttgtcgcagtgggccggaacctggtcgagacggacgatgacggactcgtcgtcgccgtcgccctcccccgtgaggttgtcaccggtgtgctcgacggagccgtcggggctcgtgaggttgttgtagaagacgaaccactcgtcgccgagcacgcggccggactggcacagcagtgcgctggcgtcgaggtcgaaatcggctcctgtggtggagcgtgcgtcccagccgagcccgaccagcacctgggtgaggttgggtgcgaccttggagagggagacgttgcctcccttggcgagcgtgacgcccatgtgtgtcctccccgagtcgtgtaaaacgctgccgggcgctttcgacgcccgaggccgggcgtcgaaagcgcccggtcagggggtgtccggcgcatcgggccggacaccccctggggcccagagacgtcagacgttgacgccgaagtcctgggcgatgccacgcaggccggaggcgtacccctggccgatggcgcggaacttccactccgcgccgttgcggtagagctcgccgaagaccatcgcggtctccgtcgaggcgtcctcgctcaggtcgtagcgggcgagctcggtgttgtcggcctggttgaccacgcggatgtacgcgttgcggacctggccgaagctctgctggcggctctcggcctcgtagatcgagaccgggaagacgatcttgtcgacgtcggccggcacgccggccaggttcaccttgatgacctcgtcgtcgccctcgccctcaccggtggtgttgtcaccggtgtgctcgacggagccgtcggggctcttcaggttgttgaagaagacgaaattgccgtcggcgccgaccttgccctcggggttcgtcagcagcgcgctggcgtcgaggtcgaagtcacccccggtggtggtgcgggcgtcccagcccagaccgacgatgaccgcggtcaggttgggcgcggccttggtcagcgagacgttgccgcccttgctgaggctgactcccacgagtcctccagtagttttctcaggggccggcagacaccggcgtccccgtcgttcatggcatcggatcaacgagtggatcctagtgaccggttcccggccaaaacaggcttttgaccgggcgtcgccaggagatcgtctcagagcgcttcgagcgccttgacgtagtcgttcaggtcgcgggcgtccgggagcccgttcacgacgctccagcggacgacgccggccttgtcgatgacgaaggtgccgcgcaccgcgcagcccttgtcctcgtcgaagacgccgtacgcccgcgaggtctccccgtgcggccagaagtcggacagcagcgggtattccaggccctcctgctcggcgaagacgcgcagggtgtggatggagtcgttggagacggcgaggagctgggttccctcgttctcgaagcggggcagctcgtcgcggagcgcgcacagctcgccggtgcagacgccggtgaaggcgaacggatagaacaccagcaccacgttcttctcaccgcggaactccgacagccgcacggtccggccgtggttgtccttgagctggaagtccggggcctgactgccgacctcgatcgtcatggaacgcatccttatcgccgcttcgccgcatcccgggccgggtccgtccgggtgacaccaccctacgcagggacccgggcgggtccctgaggggccatggacgtacgaaggccctcacggtcgctgtgtgcgtccgtgagggccccggggtggtgcgaagcgtggttcagcgcttggccttggcccccttgggggtgaccagacggctgcccgtccagtccttgcccgcgctgatgctcttggtctgggcgagaccggctgtctgggcagcctcattgatgtcgctcggttcgacgtatccgtcacggccggtcttcggcgtcatcagccagaccgtaccgccgtcctcgatcagaccaatggcatccaccagcgcgtccgtaaggtcgccgtcctcgtcgcggaaccagagcaggacgacgtctgcgacgtcgtcgtactcctcgtcgacgagttcctggccggtagtggcctcaatgccctcacggagctccagctcgacgtcttcgtcgtagccgatctcctggaccacttgtccgggctcgaaccccaggcgtgctgccgggttggttcgctcctccgcgtggtccgcggtcgcgctcacgggttgcctcctgatcatgtcttcggaaaatgctgcagccacgcgcgtgcgcggggcgttggccgtagtccacacgggctcggcgaatcgcgcaagtacccagcgtgcgagaccgcctatacggtgacgttccctgccacgtcgccgcaagttcaggcatgtctctccggcggcttcccggggactcccccgggtcactccatccgtttacgtccttcctcagcttatgcggtttcgatccaccaatcggagtcgaacagcctttgggaacacttggacgccttgggcgtaaggttgcggtttgcccgtacccagccgcgtgctgcccacactcgtgccccacggacgcgcttcggaacctcggggttaccccgcggtagagatgacgttcgggccctcgcggtagcacgatggagacggcgcatacagagttcacagcgttggcagtgccgtccggggggcgcatcccccgtaacaggccccgtagagcaccaccgaacagcgaaggaacagtgtggcttccggatccgatcgcaacccgatcatcattggcggccttccgagccaggtcccggatttcgatcctgaagagacccgggaatggctcgactccctcgacgccgccgtcgacgagcgcggccgtgagcgagcccgctacctgatgctccggctcatcgagcgcgcgcgggagaagcgcgtcgccgtgccggagatgcgcagcacggactacgtgaacacgatcgccacgaaggacgaaccgttcttccccggcgacgaggagatcgagcgcaaggtcctcaacgcgacccgctggaacgccgcggtgatggtctcgcgggcccagcgtcccgggatcggcgtcggcggccacatcgccaccttcgcctcctccgcctcgctgtacgacgtgggcttcaaccacttcttccggggcaaggaccagggcgacggcggcgaccagatcttcttccagggacacgcgtccccggggatctacgcccgcgcgttcctgctggaccggctgagcgaggcgcagctcgacgcgttccgccaggagaagtcgaaggccccgaacgggctgtccagctacccgcacccgcggctgatgccggacttctgggagttcccgaccgtctcgatgggtctcggcccgctcggcgcgatctaccaggcgcggatgaaccgctacatggaggcgcgcggcatcgccgacacctccaagtcgcacgtgtgggcctatctcggcgacggcgagatggacgagccggagtccctgggccagctgtccatcgcggcgcgcgagggcctggacaacctgaccttcgtggtcaactgcaacctccagcggctcgacggcccggtacgcggcaacggcaagatcatccaggagctggagtcgcagttccgcggcgccggctggaacgtcatcaagctggtctgggaccgctcctgggacccgctgctggcgcaggaccgcacgggcatcctggtcaacaagctgaacaccacgccggacggccagttccagacgtacgccaccgagaccggtgagtacatccgcgagcacttcttcggcgacgacccgcggctgcgggacatggtcaaggacatgaccgaccagcagatcctgcacctgggccgcggcggccacgaccaccgcaaggtctacgcggcctacgcggcggccaaggcgcacaagggacagccgacggtcatcctggcgcagacggtcaagggctggacgctggggccgaacttcgagggccgcaacgcgacccaccagatgaagaagctcacggtcgaggacctcaagcgcttccgggaccggctgcacatcccgatcaccgacaagcagctggacgagggctacccgccctactaccacccgggccgcgactcggaggagatccagtacatgcacgaccgccgccagggtctgggcggttacgtcccgacccgtgtggtgcgtgcgaagccgcttccgctgcccgaggacaagacgtacgcggctgcgaagaagggttcgggtacgcagtcgatcgccaccaccatggcgttcgtccgcatcctgaaagacctcatgcgggacaaggagatcggcaagcgtttcgtgctgatcgcccccgacgagtaccgcaccttcggcatggacgcgttcttcccgagtgcgaagatctacaacccgctcggccagcagtacgaggcggtcgaccgcgatctgctgctcgcgtacaaggagtcccccacgggtcagatgctgcacgacggcatctccgaggcgggctgtacggcatccctgatcgcggccggttcggcgtacgccacgcacggcgagccactgatccccgtgtacgtcttctactcgatgttcgggttccagcgcaccggcgaccagttctggcagatggccgaccagctcgcgcgcggcttcgtgctcggcgcgaccgccggccgtacgacgctgaccggcgagggcctccagcacgcggacggccactcgcagctgctcgcctcgacgaacccgggttgtgtcgcgtacgacccggcctacgggttcgagatcgcgcacatcatgaaggacgggctgcgccggatgtacggcgaggcgaacgaggacgtcttctactacctcaccgtctacaacgagccgatccagcaccccgccgagccggaggacgtggacgtcgagggcatcctcaagggcatccaccgcttcagcaccggcgagaagggcgacatcccggctcagatcatggcgtccggtgtggcggtcccctgggccctggaggcgcagaagatcctcgcggacgagtggaacgtcaaggcggacgtctggtcggcgacctcctggaacgagctgcgccgcgaggcggtggacgtggagcgctacaacctcctgcacccggaggaggagcagcgcgtcccgtatgtgaccaggaagctcgaagcggcccagggcccgttcgtggcggtctcggactggatgcgttcggttccggaccagatcgcgcgctgggtgccgggcgcctaccagtccctgggcgcggacggcttcggcttcgcggacacccggggtgcggcccgcaggttcttccacatcgacgcgcagtcgatcgtgctggcggtgctcaccgagctggccaaggagggcaggatcgaccggtcggccctgaagacggctgtggaccgctacgagctcctggacgtggccgcggccgatccgggcgcggcgggcggcgacgcgtaagcaaggacagccgggaggggcggcggcgctggggcgccgccgcccctcccgcatgtccgggttcagttctcccagatcttgaaggcccgtacctggtacggggaccggggcgtccaggtgccgccgccggggtacgtctcgaactcccccgtctccgcgcactcggcggactggtaggtggtgacgggccgcccggtgcggttggcgagggactgggcgtcgccgcccttcggcagcgggacgcagctctcgatgtccacgccggagagctcgtaggcgtggcgggtcccggtgaagtcgggcttcttccagaggcagagcctgcccgcttcgcaggtcccgaggccgatgcccggggaccgctcgggagccgctgccgcccggtcgtgggccagggcctggggaacgagcgcggtgacggccagggcggccgccgcgaggacggtcgtacgcatgatggatcaacccccgtggttggtcggtgtgcttccgccgctcactctgtgtcaccgggcgtgctgtgcggaaggtcggccgggggtgcgccaccctgataggcgagagccccgccgaaaggattcggcggggctctcgcctgcgctgtgttgacggcctgcgcggcgtcgggcgtcagatgtggccgaccccggcacccgcctcggcgttcgcaccgcgcttggtgagggtggccacgaaggcggcgaccacggcgacgatgcccgcgaccgtgaaggccaggcccatgcccgacatgaacgtgtcgtggatgaccccgccgatgcggtcgatgacgtccggcgtcatgccgggagccttggcgagctcctcggccgggaccatgccgaactcggcggcctcctccagcttcgggtcgggtgtgccgggcaggcccgcgcccgcccagttgtccgcgaactcggagctgacccgggaggacatgaccgctccgaggacggcggtgccgagcgcgccgccgacctgcatggcggcctgctggaggccgccggccacgccggacagttccatgggcgcgttgccgacgatgacctcggtggcgccgaccatgaccggggcgagcccgcagccgaggagggcgaaccagagggacatcgcgaaggtgccggtggagtcgctgagcgtggtcatgccgaacatcgcggtggccgtgcagaccatgccgccgaccagcgggacgcgggggccgaacttggtgatcagcactccggcgaccggcgaggagacgatcatcatggcggtcagcggcagcaggtgcagaccgctgtcgaccgggctgaggccgtggacgccctggaggaagaacgtcacgaagaagaggccgcccatgaaggcgaaggccatgagcatcatgaggacgacgccggccgtcaacgggacggagcggaacatccccagcgggacgagcggctccttgaccttggtctcccagagaccgaaggcgaggaagagcaggatcgcgaggccgagccacgcccaggtccggccgtcgccccagccccaggactcaccggccttgatgatgccccagatgagggagaacatcgcgcccgagagcagcgcgatgccgaggacgtcgaaggagcgcggcgcgttggcggcgcggtggtccttgaggatcaccaggccgaagacgagggcgacgacgccgaccggcacgttgatgaagaagaccgactgccagctgacgtgctcgacgagcagaccgccgacgatcggaccgcccgcggtggacgctccgatgaccatgccccagatgccgatcgccatgttcagcttctcggcggggaaggtggcgcgcagcaggccgagcgcggccggcatcagcagggcgccgaagaggccctggagcacacggaagaggatgaccagcgagatctcgctggagagaccgatcgcgccggaggcgagcgcgaagcccgcgatgccgatgaggaaggtctgacggtggccgaagcggtcgcccagcttgcccgcggtgatcagggcgacggcgagggcgagcagatagccgttggtgatccactggacgtcggcgagcgaggcgccgaggtcccgttggatggcggggttcgcgatggcgacgatggtgccgtcgagggcgaccatcatcacgccgatggcgacggcgaagagggtcagccaggggtggccgcgaagccccttgaccggggcgggtactgcgttgtcttccggctcccgcggcgccttctcgacggtggtctgactagtcatacggcgagactagtgacagccgctgacagttgacaaaccaattcacaagtcagtaactgtcacgtagctcacacgtagctcacaggtatgctgagctggacaaacacgggaaaagaggaaccggtacgtgaccgacgggcagacagtcgagccccgagccggactgcgtgaacgcaagaaacagcgcacccgggacgccctggtacgcgcctccctcgaactcttcaccacccaggggtacgaacgcaccaccgtcgacgagatcgtcgacgccgtggaggtctcccagcgcaccttcttccgctacttcgcgagcaaggaggacgccaccttcgccgtgcaggagatggtcgagtcccgcttcatcgaggagcttcgccggcgccccgcggacgaagcccccttcgaggccatgcgccgggcggtgctgtgcgcgtggaacagcatcggcgaggcgatcgaggaggtcgtcaccgtcgatctccatatgcggacctaccagatgatcgagtcgacccccacgctgctcgccgcccatatgcggcgcggggtcgccctggagaaccaggtcgccctgctgatcgcggaacgcgaggggctcgacgtggagcgggacccccggccgcgggtggccgtcgccgcgttctccgcggtgatgcgggtgaccggtcagctgtggggacgggggctcgatccgagcgtggaggcgctgcgcgatctgaccgaggagtatctcgaccagctcgtcccggccctcgcccggaactggcgtcgggagtagcgcgagcgcgggccggggtggcgcgcccccggtacagcggtgaccctgcgtgagaaatccgtgatgaatccttcgcggacgggtgatgtacctcacccgaatcacggtggtcggcgcacgtctcctagggtgtggcgcagtgacttccttcgacacctcacccacgttgaccgcatggcgcgctctgctcgccgtggcggtggtgttcgtgatgctggcgacgacgggctggagcgccgtccgcgatcatcactccggcgggccacgcgaactcgcgctcgcctcctgggcgcgggaccggatagccggccgctcgctgccggacgccgacgctcccgcctaccgcctggcccacttcttcgccaccctcacctcgggacagcagatcgccctcgcgggcaagtacccgtcggtggtggggaacctgaacggtgctccggtcaccctgcgctaccacgccaaccgggtcgccctcagacaggccgtggccgtggagaagatgcgggcgcacgacgagaaactctcgccggacgggcgcggtgaggcgacggcccgtctcgaccggttccggtcgatgctcacgggcaaacgccagatcctggccttcgatccctccgggaggggccgtgcggccgaggtgttcgggaatctcgaccgggccgcccgggtctccgtcgtcgtcccgggcgtcgacacccatctgctgaccctggagcgcagcactcgcgcgtacagggcccccgtcggcatggccaagtccctgtacagggcggagcgctcggcctccccggacacccgtaccgccgtcatcgcgtgggccgactacacggcaccggccggcctcggcatggacgcggcgctgggcgggctcgcgacgaacggtgcggtccggctgaacgcgatggtcggcgcgctgccgggcgcctcgaaggtctcgctgttctgccacagttacggctccgtggtgtgcggggtggccgcgcacggggcccacgaccgggtggccgacatcgcggtcgcgggcagtcccggcatgcgggccgccaacgccgggcagttggagaccggcgcccggatctgggcgacgcgggacggggacgactggatcggggacgtcccccatctggagttcggcgggatcggtcacggggccgacccggtcgacccggccttcggcgcgcggatcgtctcggcggccggcgccgccgggcacagcggctacttcgaaccgggcaccgcgagcctggacaacttcgccgcgatcggcgtcggagcgtacggggcggtcagctgcgcgagtgccgacagcgcgtgccatgacggtatttccggccaacaggacggctgacgcgcgtagaggtcggtgtcgggcggattaattgggacttgctccgaggggggacgcgggcgactgtgccgcatacgatgaggcacatgggtgatgtgctggccggaattcatgccacctgggagttcgacaccgactccgtgctcatccgcttcgaacggggaatccgcacaccgaagctcttccagagcctgcgggaacgccgcatcccgtatgcggcgttgtcgtcggtgacgctgacccccggcaagcggggcacggtggttctgcgtgccgtgccgagagcgggtgccgatcccctggtggaggctgcctccgggcagctcaaggaggggtgcgacccctatcgcctggtgcttccggtggagcgggaggtgctcgccgagtactacgcggacgagctgcgggccctgctggacccggcgtccggcgagagcgccgaccgcttcctggtggcggcccccgaggcgccgatgaacttcaaggcgtacgacggccgggccagcttcgacggcgagcggatctccttccggtggtcctggaccggggcctccagcgccaaatggaaggccggcgaccagaccttccgtgtgagcgaactggctggaatcgtgtggcgctcgcccgaggcgctggacggctatctgcgtctggtgccccgggcggcggcaccggtcgaccaccgcaccggcggcagcctgggcgatctgcacggtcccggcggcagcggggaccgtgcagatcgccca

SEQ ID NO: 2986 - DNA, 4917 bp, Unknown
  Kingdom: Bacteria, Phylum: Actinobacteria, Class: Actinobacteria, Order: Streptomycetales, Family: Streptomycetaceae, Genus: Streptomyces
ccccagttggcggtacgcggcatcgacggcgtcacccagccgctgcgggtcgtcgtcgacacgaacgccaccgccgtgaagcccggcgcccgagtcctggacgacaccgcgcccaccctggtcgccgtcgccgacgacgccccggccggacaccttcccgaggccgccgtggtgcgcctgccccgcgccggggacggacccggcctggacatcacggctctcctcggggccctgcacacccggggtgtccgctccgtactcctcgaaggcgggcccaccctcgccggcgcgttcgtcgccgccgggacggtcgacaaagtcgtcggctatctcgccccggtactgctcggcgcgggccccgccgccctcgccgacgccggaatctccacgatcgccgaggcgttgcgcctcgatgtgaccgagaccgtccgtatcggccccgatctgcgcatcaccgccgtccccgcccctgctcggaagggaaactgagtgttcaccggaattgtcgaagaactgggtgaggtcaccgccgtcgagcagctggcggatgcctcccgcttccggctgcgcggccccgtcgtcaccgagggcgccaagcacggcgactccatcgcggtgaacggcgtctgcctcaccgtcgtggacaccgcagacggcgaattcaccgccgacgtgatggccgagacgctgaagcgctccggcctcggcgcgctcaccaccggctcccgggtcaacctggagcgcccgatggcgctcggcggccggctcggcggacacatcgtccagggccatgtggacggcaccggcaccatcgtggagcgcaccccctccgagcactgggagatcgtcaaggtctccctgccgcccgagctgacccggtacgtcgtggagaagggctccatcaccgtcgacggcgtcagcctgaccgtcgtggacgcggcggccgaccacttcaccatcagcctcatccccaccaccctcgccctgaccacgctcggccgcaagcagcccggcgacccggtcaacctggaggtggacgtcctcgccaagtacgtcgagcggctgctcggcgaccgggccggacaggacccgcgatgaacgcggcgaactggctcaactccgaggccttcacggtgttcggccagcacatcaagtggtcggacatgatcggcaacctcgtcggcctgatcgccctggccctcggctggcggcgctcgatctggacctggcccgcccaactcctctccggcgtgatcctgctcgtcgccttcgcctccgcgcacctctccggcagcgcgggcaagcaactggtcgtgatcgtcgtcgccctgtggggctggtggtcctggaaccgcggcaagcagcaggcccaggacggctccatagccgtccgcttcgccacctggcgcgagcgcggtgtgctgatcggcgccgccgcgctgggcaccctcgccgtcggcggcctgttcaccgccttcccgtcgctgtcctgggacccgtggccggacgcgtacatcttcgtcggcaccgtcgtcgcgatgtacgcccaggcccgcggcatggtcgagttctggttcgcctggctgctcgtcgacctggtcggcgtcccgctgaacttcgccaacggattcgccttctccggcttcgtctacgtcatctacggcgccctcgtcctgtgggggatgcgcgactggtggctgcgtacgcggacacccgctctggaaggagccacggcatgactgcccagcccacctggctgcaccccggccacggaccgctccccgagaacctctccctggacccggtcgagcaggccgtccgcgacatcgcagcgggccggcccgtcgtcgtcgtggacgacgaggaccgcgagaacgagggcgacctcgtcatcgccgccgagaaggccaccccggagatcgtcgccttcatgatgagcgagtgccggggcctcatctgcgctcccatggagagcgacgagctggaacgcctggaccttccgcagatggtcgagcacaacaccgagtcgatgcggaccgcgttcaccgtctccgtcgacgcctccgccgagcacggagtcaccaccggcatctccgccgccgaccgcgccaccactctgcggatgctcgcgggcggcgtcgccggccccggcgacttcgtccggcccggccacatcttcccgctgcgcgcccgctccggcggcgtcctggcccgcaacggccacaccgaggccgccgtcgacctcgcccggctcgccggcctccgccccgccggggccatcgtcgagatcgcgggcgaggacggcgtcatgctccggctgcccgagctgatccccttcgcccgcaagcacggcctgacgatcatctccatcgaggacctgatcgcctaccgccgcagcaacgagccgaccgtccgccgcgaggccgagacccggctgcccaccgcgttcggcgacttcaccgcgtacggctaccgctccagcgtcgacggcgtcgaacacgtcgccctggtccacggcgacatcggcgacggcgaggacgttcttgtccggatccactccgagtgcctgaccggcgacatcttccagtcccagcgctgcgactgcggcccccagctgcacgcctccatgcggcgcatcaccgatcagggccggggcgtcgtcgtctacctgcgcggccacgagggacgcggcatcggcctgctctccaaactgcgcgcctacgaactccaggaacgcggcgtggacactctcgacgccaacctggagctcggcctgcccgccgacgcccgcgactacgcggcgggcgcgcagatcctcgcggacctcggcgtgcgcagcctgcggctgatgaccaacaaccccgacaagaccgcggccgtcgtccgccacggactcgccgtcaccggccgggaacccatgcccgtccaggccggcgagcacaacctgcgctacctgcgcaccaagcgcgaccgcatgggccacgacctgccctggctggacggcgctcccgcgtcgacctgcgccaaccagtaacgcgaaccaccgaacaccacgtaaccggcaacaggagagacatgagcggcaagggtgcacccgaactgtccgtacgcaactgcggcgacctgcgcgtggccgtgatcgcggcccagtggcacgagaaggtcatggacggactcgtcgacggcgctctgcgcgccctgcgcgagctgggcatcgacgagccgaccctgctccgcgtcccgggaagcttcgagctgcccgtcgtcgccaaggtgctcgccggacgcggctacgacgcgatcgtcgccctcggcgtggtcatccggggcggtaccccccacttcgagtacgtgtcccagggcgtcaccctcggcctcacccaggtcaccgtcgacaccggtgttcccgtcggcttcggcgtactgacctgcgacaccgaggagcaggcgctggaccgggccggcctcgaagggtccaacgaggacaaggggcatgaagcggtcaccgccgccgtggccaccgcggccacgctgcgcaccgtcagcgaaccctggcgctgagtgcccttcggcgaccccgtattctgaggaccatcatggccaacaaaaccttcgaagagctcttcaccgagctccagctcaaggccgccgaaggcgaccccgcaacctcccgcaccgccgaactggtgggcaagggtgtgcatgccatcggcaagaaggtcgtcgaggaggccgccgaggtctggatggcggccgagtacgagggcaaggaagccgccgccgaggagatctcccagctgctgtaccacgtccaggtgatgatggtcgcccgcgggatctcgctcgacgacgtctacgcccatctctgagcacaccccgcccgtccgtcccgcaacccttcgcacaaaggaaacctgacctcatgctgcgcatcgccgtccccaacaagggtgcaatctccgggcctgcgatggcgatgctccatgaggcgggctaccggcagcgcaaggagtccaaggaactggtcctcgtcgacccggcgaacgaggtcgagttcttctacctgcggccgcgcgacatcgcgatctacgtcagctccggcaagctcgacatcggcatcaccggccgcgacctgctgctggactccggggccgaggccgaggagatcctccagctcggattcgcgcgttccaccttccgctacgccacgaagcccggaacggccaccggcccccaggacttcgacggcatgacgatcgccacctcctacgagggcatcgtggcgaagcacctggccgacgagggcgtcaacgcctccgtcgtgcacctcgacggcgccgtcgagaccgccatcgagctcggcgtcgcgcagatcatcgccgacgtcgtcgagaccggcaccagcatgcgcaacgcgggcctcgaagtcatcggcgagccgatcatgaagtcggaggccgtggtgatccgccgcacgggcgcccccgccgacgaccccaaggtgcagcagttcctccgccgcctccagggcgtcctggtcgcccggtcctacgtgatgatggactacgactgccgcgtcgagcacctggagcgcgccgtcgccctcaccccgggcctggagtcgccgaccatctccccgctgcaccacgagggctgggtcgccgtgcgctccatggtcgccgccaaggaggcccagcggatcatggacgacctgtacgagctcggcgcccgcgccatcctcaccacggccatccacgcctgccgcctctagggggtgtcttgccgatcacgccgggctcgcggggtccggcatcgcacctcgcggcgttgtcgtcggtcgccgacgctccgcgtcgactccctcctccgtcttgcgatgcacggcaccggcccccgctccctgatccggcctgatcc

SEQ ID NO: 2987 - DNA, 3346 bp, Unknown
  Kingdom: Bacteria, Phylum: Actinobacteria, Class: Actinobacteria, Order: Streptomycetales, Family: Streptomycetaceae, Genus: Streptomyces
cgccggcgaacggcgcgagcaccgagggcgcccagggcgagaccggcacgcagggcacgggcgacgccgcctcggtgcccccggccaactgacgcggaaccccgccccgtaacgcggacgcgggcgtacggcatgccgaaggggcgcttcccggccgggaagcgccccttcggcatgccgcgggtcgtcggccctcggcgtccttcggtttacggctcgaacttgtaccccaggccccgtacggtgacgagatagcgcggggcgcccgggtcgggctcgatcttggcgcgcaggcgcttcacgtggacgtcgagggtcttggtgtcgccgacgtagtccgcgccccagacccggtcgatgagctgcatccgggtcagcacacggcccgcgttgcgcaggagcatctccaggaggtcgaactccttgagcgggaggtcgaccttgccgccggagacggtgaccacgtgccggtccacgtccatccggaccggacccgcctccagagctgccggagtgacctcctccggctccccgcggcggcgcaggacggcacggatgcgggcgacgagctcgcgggaggagaagggcttggtgacgtagtcgtcggctcctatttccagcccgacgaccttgtcgatctcgctgtccttggcggtgaccatgatcaccgggacattggagcggctgcggagctggcggcacacctcggtgccgggcaggccgggcagcatcaggtcgagcaggaccaggtcggcgccgttgcgctcgaactcgtccagcccgtcggggccggtcgccgcgatggcgacctcgaaaccttccttgcgcagcatgtaggacagggcgtcgctgaaggattcctcatcctcgacgacaagcactcgggtcacggaagagcctccggggcagggaaggggtcaaaggtgtcggtctcgtacggcccctcgtcgtcgccgttgacgataagcggtccgccggtggtgcgctccctcgcgacgcccgattcgggcagtcggagggtgaaggtggagccctgtccctcggagctccagacggtgacctccccgccgtgcgaggcggccacgtgtttgacgatggcgaggccgagaccggtgccaccggtggcccgtgagcgggccgggtcgacgcggtagaaccgctcgaagacccgctcgcggtccttctcggagatgccgatcccctggtcggtgacggctatctcgatgaggtccccgcccggcgaggccaggcgccgcgcggcgatgccgacgcgggtgtgggcggggctgtagttgacggcgttctcgacgagattgccgagcgcgccgacgagctggccgcggttgccccagaccgtgaggccctcggctcccgcggaggccatggtgatctgtttcgagctggcctgctggcggcagcggtcgatcgcctcggcgaccagcgtctccaccttgaccggctcggcgtcctccagcgggtcgtcgttctgcacccgggagaggtcgatgagctcctggacgaggttggtcagccgggtcgcctcgatctgcatcctcccggcgaaccgctccaccgcctccgggtcgtcggaggcgtccatgaccgcttcggagagcagggagagcgctccggtcggcgtcttcaactcgtggctgacgttggcgacgaagtcgcgtcgtaccgcttctatccggcgggcctcggtgaggtcctcgaccagcagcagcaccagccgcgagcccagcggggcgacccgggcggagaccgcgagggtgtccccccggccggtgccgcgccggggcagatccagctcgccctgtcgtatctctccgtcccgccgggtgtccctggccatgttgagcatgggctcgacggccagccggccgcctctgaccaggcccagggcgtacgccgcggaactggccttcacgacgctgtcgctctcgtcgaggacgacggcggaggagctgagaacggagaggacggtgtccactccggggggaagggccgcgttgctgtccggccgcagagacgtacgcgtgggccgtttcaggtcgcgttcgctccagcggaacgccagcatggcgatcacaccggtcaggagaccggcgatcgctgcagctgcggcgaccgccgcgttcacgtccatgcttcaaggttatgcgggtgcgacgactccctcccagccgtccgagtgccatctcgaacactcgtcgcccagagttcaccgaggggtaggtaccggttcacttagggggacggatacggacgcgttccggccccaccgtgtaaccgtgggggtcggtccgagaccccggcctcagtttggaactggagagggacttcccatgcgcgacgcttaccacgaggaactcgattcgatcggagaaggcctggtcgagatggcccggctggtcggctcggcgatcgggcgggcgaccacgtccatgctcgacgccgacctgacgctggcggagaacgtgatcgccggcgaccagaaggtcgacgacctccagcacgacctggaggcccgcgccatcgcgctcctcgcccgccagcagccggtggcgaccgacctgcgcatcgtggtgacctcgctgcggatgagcgccgacctggagcgctcgggcgacctcgcccagcacgtggcgaagctggcccggctgcgcttcccgcagtcggcggtcccgcacgacctgcacgccaccattctggagatgggccagctcgcccagcgcctgatggccaaggcggccgaggtcatcatcaccaaggacgtcgatctggcgctccagctggagcaggacgacgacgagatggacctgctgcaccgcacgctgttccagcacctgatggacgaccgctggaagcacggcatcgagacggccgtcgacgtgacgctgctgggccgctactacgagcgcttcgccgaccacgcggtgtcggtcgccaagcgcgtggtctacctggtgacgggcgaacacgcggacgagatccaggcggcggcctcggtcgagggcgcgtaacggccgcttcggcagccaccggcgttccggagtatcaacggcgcacgcgggtcgcacataagttcctgcacgcgtgcgccgttgatgcgcccgaggggatgggcatgcaatggggcgggggcggcgccatggccgtgagcggtgggtcatgccgcacgtccccggcggcggcgcaccggcgtccgccgcccagccgtatgccctgaggagggaccatggccgattcccccacgaccgaaccccagcgggagaccccgaccgaagtggtgcgccgaggcgtgctcggcgcctgcggctgcggctcgggctgcgggtgcggc

SEQ ID NO: 2988 - DNA, 2147 bp, Unknown
  Kingdom: Bacteria, Phylum: Actinobacteria, Class: Actinobacteria, Order: Streptomycetales, Family: Streptomycetaceae, Genus: Streptomyces
gccccgcaccgagccgtacaagacgcatctggcgtacgtacgcgagcggcggagcgacgaggacggcgaggcgatcctcgccgaggcgctggccaaactccgcggcgagatctagagcctgtcgtcaaactgccgtctgccgggcggtgcctggcacgcacgctcgcggcgttgccgttccacggaccacccagtcgttcaccggccggacaccccacgggtgtccggccgtatcgcgttcccgcgccaccgccctcctccacgccgtcggcctcctcgatcaattaggttggaggggcagcggggatgctgagtgacgagaagaagtgggctgatatccgggatgaacgcagcaagccgaaccaagctcaaccagacgcccgagtggacggctctcgcgaagcaccgtgaggagctcggcgcaccccagctgcgcgagctgttcgcgcggcagccggaccgcggcaccgcctacaccctccgggtcggcgacctccacctcgactactccaagcacctggtcaccgacgagacgctgcgcctgctgcgcgaactcgccgacgccaccggggtcgcggagctgcgggacgcgatgttccgcggcgagaagatcaacaccaccgaggaccgggcggtcctgcacaccgcgctccgtgcccctcgcgacgcggtgatcgaggtggacggcgagaacgtcgttccggccgtgcacgccgtcctggacaagatggccgccttcgccgagaaggtccggtcggggcagtggaccggtcacaccggcaagcccgtcaagaacatcgtcaacatcgggatcggcggctccgacctcggtcccgccatggcgtacgaggtgctgcgctccttcacggaccgcgcgctcaccctccgcttcgtctccaacgtcgacggcgccgatctgcacgaggccgtccgtgacctcgacccagccgagacgctgttcgtcatcgcctcgaagacgttcacgacgatcgagacgatcaccaacgccacctccgcccgggactggctgctgaccgagctgaagaccggtcaggacgccgtggccaagcatttcgtggccctgtcgaccaatgccgagaaggtcgaggagttcggcatcgacacggccaacatgttcgagttctgggactgggtcggcggccgctactcctacgattcggcgatcggcctctcgctgatggtcgcgatcggaccggaccgcttccgcgagatgctcgacggcttccacctcgtcgacgagcacttccgcaccgcccccgccgaggagaacgccccgctcctcctcggcctcctcggcgtctggtacggcaacttcttcgacgcccaggcgcacgcggtgctgccgtacagccactacctgtccaagttcaccgcgtacctccagcagctcgacatggagtccaacggcaagtcggtggaccgcgacggcaaccccgtggactggcagaccggaccggttgtctggggtacgcccggcaccaacggacagcacgcgtactaccagttgatccaccagggcaccaagctgatcccggctgacttcatcggcttcgccgccccggtccacgacctgctgcccggactgatcgcccagcacgacctgctgatggccaacttcttcgcccagacccaggccctcgccttcggcaagacgcccgaagaggtccgggcggaaggggtgcccgaggagctggtcccgcacaagacgttccggggcaaccaccccacgacgacgatcctcgccgacaagctgaccccctcggtcctcggccagctcatcgcgctgtacgagcacaaggtcttcgtccagggcgccgtctggaacatcgactccttcgaccagtggggcgtcgagctcggcaaggtcctcgccaagaagatcgaaccgctcctgacggagagcgggggagccgacggcgggcagctggacagctccaccgccgccctggtcgacgcctaccgcaccctgcgcgggcgctgagccgatgccacagggggaggggacggcggtacgactccggccgccgcgcaacacgctgaacgagcgtgccgtcggctggtggcgggcccagtggctgctgctgacggccgtgcccgtcgtgccgctcgtggtgctgggcgcgctg

SEQ ID NO: 2989 - DNA, 7332 bp, Unknown
  Kingdom: Bacteria, Phylum: Actinobacteria, Class: Actinobacteria, Order: Streptomycetales, Family: Streptomycetaceae, Genus: Streptomyces
ttcctggccccctcggcagcactgcgtgcggcggatgccttggtggcgtccttggaggcggatatcgcggcgtggtaggcgcgggaagcggcgctgccggctgaggcagcggcggcagcggcggcttgagctgcctgtgcggcgcggctggatgctgcctgagctgtacgggaggcagatattgcggtgttggcggcggcggcggctccgttggcggcattcgcggctttgttggccgcggcggccgacttgcgtacgtcctgttgggcggcccttgcttcttctgccgccttcagagcggcggtcttcgccctttcagcagcttctttcgcgcggtcggacgccgcgaccgccctatccgtcgtctgctgcgcacgcttgccttcacgctccacgatcgcgaccaactgctcaatggtcgctgcctcttcgtcccgggcgcgggcgatgtgctgaccggaggagaggaactgacggatcgcttcagggctgccgtcctgcagagcgcgctgtgcgtacttcttgacctccggagacgcgtcgttgacaagagcgaagacggctacctggtcgtctgtctcctgcgcagtgtgctgggttgtcgccaggaatgttctgaacgcttcctcggtgttcagttccagggctttggtggcttcttgcctcatcgtcgcgccgccgtgctccagtgcggagaagacggccacgcgcagatcttcctcgacgggttgtttgaagccctcgctgaggaaggtggcgaccgctgcgtcgccggccgagagtgctgcggatgccgactcccgaacggttttgcccgcatgggagagggctgagaagacggcgaagcggttgtcttccgtgcgtgcggcagggagccctgtggccagaaaggcggtgagggcggccggcgtgccgacgagggctgcggccgcggcctcacgaacggcccggccgcccgtcttgtaggcccaaacagcctttccctgatcggtgttcggcagcccgttctccggatcgccggaggctggtgcggcctgtgcggggaccgccgtcagggtgaggattgaaggcagcgcaggaagagtcgctgccccggcggttacggcaagtattcggcgcctgctccataacgaaagcggcaaaacgttcgtcctcccccaagagggcatgtggcctcaaaacgcccatgcttttgattgcggcagcccgctgatggacggcgcgaagggaaacgcgccgtgtcgttgggcttcgcggtacattacacatcccacacatgtgttcacgctccgcaccagttgtcttcacatatgaggccgcgattgcggtgctgtttggcgtgaaagcgatgagatgcgtgagttgtgacaaggaggcggagagcaagggctggtgtgccgttctccggctgccgcggtgatgcgcgtcgggccctccggccgcaggggttccgggcgtcgccgcgtgccgtgtttcccgcagggtgtccgggagtcttcggcctgggtggtaagcgggtcgggtggacggtcgcctgcgcgaccggagcgtgccgtaggtcgacccggtttgacccccacacccccgccccgtaaccttgaccctcggtgtgtttccttaacgcgcctacccctgagcacatccctcccggtaacggtcggtgttcgcgccgtccgccaggagaggccgctcatccttccggatcgtcccgggctccggcccgtgcgagcggctggcatcaggggatccgttccgagcgagagagagatccgcgtgtacgccatcgtgcgcagcggtggtcgccagcacaaggtagctgtcggcgacatcgttgaggttgacaagatttccactgccaaggttggcgacacggtcgagctctcgaccctgctcgttgtcgacggtgacgcggtcaccagcgacccgtgggtgctggacgggatcaaggtcacggccgagatcgtggaccaccacaagggcgcgaagatcgacatccttcgctacaagaacaagaccggctaccgccgtcgccagggtcaccgccagcagtacacggcgatcaaggtcaccggtatccccgcggctgcgaagtaagggactgagaacacatggcacacaagaagggcgcatcttccactcggaacgggcgcgattccaatgctcagcggctcggcgtgaagcgcttcggcggtcaggccgtcaacgccggtgagatcctggtccgccagcgtggcacccacttccacccgggcacgggcgtcggccgtggcggcgacgacacgctgttcgcgctgaccgccggtgcggtggagttcggtacgcaccgtggccgcaaggtcgtgaacatcgttccgctcgccgtctgagtctcagcgcgcgcagaacgacacacagcaccttccgagggcggatctcagctttcccggcgaacggggaagcgggtccgccctcggcgtgttacgacagagacaatcccgtatttttccgctgtacctggaggcaccaaccatgaccaccttcgtggaccgcgtcgagctgcatgccgccgcgggtaacggaggccacggctgcgcctccgtccaccgtgagaagttcaagccgctgggaggccccgacgggggcaacggcggacgcggcggcgatgtgatcctcgtcgtcgagcagtccgtgaccacgctgctggactaccaccacagccctcaccgcaaggccaccaacggtcagcccggcgccggcgacaaccgctccggcaaggacggtcaggacatggtcctgcccgtccccgacggcaccgtggtgctcgacaaggccgggaacgtgctcgccgacctcgtcggccagggcaccaccttcgtggccggtcagggcggtcgcggcggcctcggcaacgcggcgctggcctcggcccgccgcaaggccccgggtttcgcgctgctcggcgagccgggggagagccgggacatcgtcctggagctcaagaccgtcgccgacgtggccctcgtgggctacccgagcgcgggcaagtcctcgctgatctcggtgctctccgcggccaagccgaagatcgcggactatccgttcaccactctcgtgccgaacctcggcgtcgtcaccgccggctcgaccgtctacacgatcgcggacgtccccgggctcatccccggcgccagccagggcaagggcctcggcctggagttcctgcggcacgtcgagcgctgctcggtgctcgtacacgtcctggacaccgcgaccctggagtccgaccgtgaccccgtctccgacctcgacatgatcgaggaggagctgcggctgtacgggggcctggagaaccggccccgcatcgtcgccctcaacaaggtcgacatcccggacggccaggacctcgccgacatgatccgccccgacctggaggcccgcggctaccgcgtcttcgaggtctccgcgatcgcgcacaagggcctcaacgagctgtcctacgcgctcgccgggatcattgccgaggcgcgcgccgccaagccgaaggaggaggcgacccgcatcgtcatccgccccaaggccgtcgacgacgcgggcttcaccgtcgccctggacgacgagggcatctaccgggtgcgcggcgagaagcccgagcgctgggtgcgccagaccgacttcaacaacgacgaggccgtcggctacctcgccgaccgcctcaaccgcctcggcgtcgaggccgccctgatgaaggcgggcgcccgggccggtgacggcgtcgcgatcggtcccgaggagaacgcggtcgtcttcgactgggagccgaccgtgaccgccggagccgagatgctcggccgccgcggcgaggaccaccgcctggaggagccgcgtcccgccgcgcagcgccgccgggaccgcgactccgagcgcgacgacgcggagaaggaatacgacgagttcgaccccttctaaggcgtctcccggggaagcccccggatcatggccgacggcccgtctctccggaggcgggccgtccggtagcctcggggccgggcgtcggcggtttccgccggtcacgccgggtgcacgtgccgcagatgtgcggattgagcaacacatctgtggggtcggtcaccccgggcgaccgccccgaagcgcccaacctccctggccagagggtgaactgcgggtatccgcaggacgatcggcggacgacgtccaccttgcgagacggtcacggagagtgcgaccatcacactgttcccccgtcatagcaaggtaggtcgtctgtgtctgtgccgcatgaagccaagccccggaccacagcggtcgtgctcgccggtgggaccggccagcgcgtgggcctgtcgatccccaagcagttgctgaagatcgccggcaaggccgtcatcgagcacacgctgaccatcttcgagaacgccgagggcatcgacgacgtcatcgtgctgatggcgcccggtttcgtgcccgacgtcgagaagatcgtcgcgaaggccggactgaccaaggtcacccggatcatcgagggcggcagcacccgcaacgagaccaccgagcgtgccatcgcggccctcggtgagggcctcgccgagggtgaggaccgcaacgtcctcttccatgacgcggtgcgtcccctgctgtcacagcgtgtgatcacggactgcgtcgacgcactggaccgctaccaggccgtcgacgtcgccatcccgtccgcggacacgatcatcgtgacccgcacccacggcgaggacggcgagttcatcaccgaggtgcccgaccgctcccggctgcgccgcggccagacgccgcaggccttcaagctctccacgatccgcagggcgtacgaggtcgcggcgggcgaccccaacttccaggccaccgacgactgttcggtagtcctcaagtacctccccgacgtgccgatctacgtggtcgcgggcgacgagtacaacatgaaggtgacccagccggtcgacgtcttcatcaccgacaagctcttccagctggcctccaccgccgctccccgccaggccgacgaagccgcctaccgggagctcctcaccggcaagaccctcgtcgtcttcggcggttcgtacggcatcggcgccgacatcgcgtccctggccgagagttatggcgcgaaggtctacgccctgggccgctccaccaccggtacgcacgtggagaacccggagcacgtggacgacgcgctctccaaggcgtacggcgagaccgggcgtatcgactacgtcatcaacaccgcgggcgtgctgcggatcggcaagctggccgagaccgacaacacgacgatccaggaagccctgaacgtcaactacctggcgcccgtccagatcgcccgcgcctcgtacaagtacctcgccgagacccagggccagctgctgctctacacctccagcagctacacccggggccgcgccgagtacagcctctactcctccaccaaggccgccatggtcaacctcacccaggcgctcgccgacgagtgggcgggcgagggcatccgggtcaactgtgtgaacccggagcgcacggcgaccccgatgcgcaccaaggcgttcggccaggagcccgagggctcgctgctctcctcggaggccgtggcgcgcacctcgctggacgtcctgctctccgccctgaccggtcacgtcatcgacgtacggcagcaggacccgacggcgggcgccgccgagtcctccggcttcgagcaggcgctggcctccgtgctggaccgtcaagcagatgtgtaataattcttgacaaatgtgcttttccgggcctctgttgtcgctttgtgcgacgacagaggcccgaatgcgtgaagccgcaccttcacatttccgccaatacgtgaatcaaccggcaccccctggagcaggttcttcgtgatctcgacagccattcgcctggcccgtgtgggcagcaggtcggaactggcggcagcgttgttgatggggctgggatatccctgcgtcatgcttgccgcgctcattccccacatctggttcttcgcggcggccaccgctgtcacgtatgccgccgactggtatctgcaccagaaaggcagctatctggtcaaccgcctgggcaaggtgcgcgccgggctgtcgatccgcttcctgctgcggcagttgatggtcatcctgctgctggcccggctggatctcgccgaggagccgctgttctactcggcggtggcctgcttcctgctcttctacgggctccaggcgccgcacggcgccctgacgaccctgatccggctccgccgcaccatgccggtcgtcacccgcaacgtggatctgcacgccgtgcgtatccccgacgccccgcccggtgcgctgctgcggcgctccgccgagaagatgctgcacctcgacatcccggccgtggcgggcatcctgatcgccgccgggaccggtgaggacgccatcggctacgcgggcatcggactgacgctgctgctggccctgctctacctcggagcgctcgtcccgtatgtgcgccgcggccgactggcgcctccggcccccgccgtgctcaaggccgtcgacagctggctgcgcgattaccagccgaccgtggtgctctacttctccggctccaacgagtccgcctaccagggcaacatgtggctggagaccatggcccgggtcgagggccggccgctgatcatcatgcgggagcgcggtctggtcccgcagctggccgatacgtccgtcccggtcatctgcgtcccggcgggcacccacctgatgaacctggacctctcgaccgtccgggtctgcctgtatcccgccaacgtcggcaagaacatccacatcctgcgggtcccgacgatgaagcacgtcttcatcggccacggcgacagcgacaagctcgccagcgtcaacccgtactccaaggtctacgacgaggtctggacggcgggccgggccggccgcgaccgctacgcgctggccgacgtgggcgtcctggaccaggacatcgtcgaggtcggccgtccgcagctggagcccatcaagagctggacgggcgccgtcaagaaccccatcccgaccgtgctgtacgcgcccacctgggagggctgggacgacaacccgggcaacacctccctgctgctggcgggcgagaacatcgtgcgccggctgctgaacgcggccgacccggtccggatcatctacaagccgcaccccttcaccggtatccgcagcggcaaggccaaggccgtcaacgcccggatccaggcgatgctggagaaggccgcgaccgagcgcgccgccgagccccgctgggcgaaggaggcgtcgtcggccgccgccg

SEQ ID NO: 2990 - DNA, 1952 bp, Unknown
  Kingdom: Bacteria, Phylum: Actinobacteria, Class: Actinobacteria, Order: Streptomycetales, Family: Streptomycetaceae, Genus: Streptomyces
acgagctgacgggtccccggagcctgacgttcgcggaggcggcccagctcctcggccgcctccgcgaacgtcaggctccggggacccgtcagctcgtacaccgcccccgcgtgtccgtccccggtcagcgcggccaccaccacgtcggccaggtcgtcgaggtccaggaacggctccgccgtcgtgcccgcggggaacaccacctcgccgccgagcacgccgtccagcagtgcgccctcgctgaagttctgcgcgaagaacgccgaccggacgaccgtgacctccaccgtccccgcggccccgcgcagcgcctcctcggcgacgaccgcctgcggttcgccgcgtcccgacagcagcaccaccctgcgcaccccgcacgcctcggcggtccgcgcgaaggcggccatggcctcggccgcaccgggcaccgccaggtccgggtagtacgccacataggcggcccgggcgccgcgcagcgccgccgtccaccccgatgcgtcctgccagtcgaacggcacctcgccggtgcgtgagcccgagcggaccggcacgccgagggccgtcagccgctccaccacccgacggccggtcttccccgtgccgctcgtcaccagaaccgttcccgccgccgctcccgcttcccgctccctcatccgtcccgggacccgtccgccgtcctcgccgttgctgtcgccgttgtctcgtcgtgtgaacgcgttctccgtcatggctccagactcccgggcccgcgaccgcccggacatgctccagagactcaggcgcctacttctgcgtccacgcagtcacgcgtccagtgctgtgaccgggacgattcaccgtggccgggagacgggtcacgggacgagcacggtccgcgaggcgagtggtattactggtgcatgcaggaagagaccgcgcggtccgcgatcgacacgttcatctccgcgttcaacgcctcggacgacagctatgtgactgcgctgctctcccaggccctgacctcggacgtggtcttctggggaccgttgggccgcagtgaggggatcgaggcggtcgagcggttcgtgctggacatccggcgccaccccgcggggaccggcacgatggtgcgctgttcggcggtggacatgcctgacgagtgggcccggtacgagtgggtcttcacgacgccggatggaggcccccgtctggcgggaacggacgtcgtccatctgcggcggagcctcatcgaccaggtcatcgtcttcgcgggggagatcgagccgtccgcctcctgaggccccgcacgtcctaccgccacgacgaccaacccggcgaacctgtgcggtcgcagcactaggctggcggccatggacgctctcgccggactcctggacggaccgcgcgccaggggcgcgtttctgctccgcatggtgatggagccgccctgggcggtacgggtcgaggaccgggctccgatctgcctcatgtcggtccggcgcggcacggccttcatcgtcccgtccggcggaggcgaaccggtccggctcggccccggggacatcgcggtggcccgcggccccgatccgtacaccgtcgccgacgcacccgggacgacagcccacgcgctcatcggtcccggcggcgtctgcaccacgctgcacggccggccgctctcccaggacatggtgctgaacgtacggacctggggaaacgcggccggcggcgccacggcggtcctggtcggcacctatctgctggacggcgagatcagccgccgtctgctggacgcgctgcccccgctgctcacggtccccgccgacacgcggacgcggccgctgctggacctgctcgacgcggagatcgcccaggacgagccgggccagcgcgtggtcctggaccgactgctggacctgttgctcatcgccgtgctccgcgcctggttcgcccggcccggggccgacgcccccggc

SEQ ID NO: 2991 - DNA, 9959 bp, Unknown
  Kingdom: Bacteria, Phylum: Actinobacteria, Class: Actinobacteria, Order: Streptomycetales, Family: Streptomycetaceae, Genus: Streptomyces
cacccgccctcccctgccaccctggaggaagccttcacccggcacccggacgcacgcggcgccctggtcaccagccccaccccgtacggcacggcggccgacctgcgcgccatggccgacatctgccaccggcgctccaagccactgatcgtcgacgaagcctggggagcccacctgccgttccacccggacctgcccgcctgggccatggacgccggcgccgacgtctgcgtcaccagcatccacaaaatgggaagcggcctcgaacaaggctccgtcttccatctgcagggcgatctggtggaccacgacaccctcgcctcacgggccgacctcctcggcacgaccagcccctccgtgctgctctacgccggaatcgacggctggcgtcggcagatggtcctggaaggccgcggactgctctcccgagcactcgacctcgtagcgacggtgcgccggcgcatcgaggagatcgagggcatgcacgtcaacgggccggacgacttctgcggacccggcgccgccgcggaattcgacccgctgcccgtgatcatcgacatcgaggccatgggcacgaccggctaccgggccgccgactggctgcgcaagcaccaccacatcgacatgcacctcgtggaccaccgccggatcagcgcccagttcacccacgccgacgaccaggacaccgccgaccggctgctgacggccctacgcgacctggcccgccacgcgcacacgctccgtcccgcacctgaggtgcaggtgcccactcccgcggaactccgccccgaccaggtgtgtctgccgcgcgacgcctacttcgccgagacccaggacgtccctgcagcgaaagccgtgggacgcaccgccgccgagatgctcacgccctaccctcccggcatcccggccgtgctgcccggcgaacgcatcaccgaaccccttctgcgctacctgcgctccggcgtcgaggccggcatgaacattcccgatcccgccgaccccaccctggaaaccatccgcgtccgcgtcgaggaccactgacagcctcgccgtctgctgcgggcccggctaccgccgaagccgacagagcccgcaccggaccccaaccccacacccatgagcaaggagagaatcccagcatgcgcgcactcgccctcgtctgtacgttgaacgcctcgcccgcccgctccagcagccaccacctcgccgagcaggtcatggcccggttcgcggaccacggcgtgcagggcgaggtcgtccgggtcgccgaccatgacgtccgtccggggatcggggtggacatgggcgacggcgacgcctggccggccctgcgggagaaggtcctggccgccgacatcctcctgatcgccacacccatctggctcggccacccctccagcgtctgccagcgggtcctggagcgcctcaacgccgagtcctccgagaccgacgaccagggccgaccgcacacctacggcagggtcgccgccgtggccgtcgtcggcaacgaggacggcgcgcacaaggtgagcgcggatgtgttccaggggctcaacgacgtcggcttctccctggcccccggagctgtcacgtactgggtcggcgaagccatgcacggcaccgactaccaggacctggacgagacccccgaagccgtcgcaacgaccaccgagaccctcgcggccaacgccgtccacctggcccgtcggctcacgggcagcccgtacccggcagcctgatccgcacttgcggcgagggcgagtcgtcaggaacgtcggaaggacagcggtgtacatgtcggtggaccggatcgctgagccgtggggaactcgcacgccgtacgggcgtcacgagacctggccgacgtcgcccgagccggcggcccggttgcgtggaccgactcctggcgtgacggtggtcccgggagcgcggcctccagcagcgcggtcaggaagcgaggagcgtcgatgcacgccagtccagacggccgccgggcccggagtgcacccgcccatcctctgcggggacgggtcgctgtcgtcaccggcgccgcccgcggtgtcggtgaagcgcttgcccgcagcctctccggctccggcatggaggttgccctgctcggccgggagaaggcgaccctgctgaagaccgccgcgtccctccccggcccgagcatctgcgtcgagtgcgacatcaccgaccgcgcggcgctggcggacgcggcacgccgggtggaggcggaactcgggcccgcgagcgtggtggtggccaacgccggaatcgcggcgagcggtccgttcgaccgtaccgccgccgagctctggcaacgcgtcgtcgacgtcaacctcaccggatccgccaacaccgcccgcgccttcctgcctcagctcaccacgacccgggggtacttcctccagatcgcctccaccgccgcattcggtgccgcacccatgatgagcgcctactgcgcctccaaagccggagcggagtcgttcgccctctccctgcgcggcgaggtcgaaccggacggcatccaggtcggcatcgcctacctgcactggaccggcaccgacatgctctccggcatcgacgaggactccgtcctcgtagccctgcgccgcaatcagccccgtcccgcccgccgcgtccacagtgtcgcccaagtcgcccagtggctcacccgaggcatcacccgccgcagccgtcacatctacgccccgccctggctccgctggtgccagcccctccggcccctcttcccggcccttgtcgcccgggccacccgacgcgaactacgggcccactccggcggagcgatgtcttcccgcggcgaggtcctgggcgccggggggcacgccgactggaactcccaccaggcctcccgctccgctcccccgtccgacccctaggaccagcggtccctgtgaacgaccgcggcccgagaccaggagtgcccgggaccgggcggagacgttacgaacatgcccgacgggatactcgcgtaccaggccatctctcggccgacccgaaagccgtgccgacggcatggcgcggaagagcgtggtgagcgcgatgaggagtagaaggacctcgaactcgtcgaaccgcctgtcgacgtcaggcggcgggcatgaatgacgcctcgaaagcgccgaccggcggcactgcggagactcttcgttcccccgtcgcttcgcacaatgaatgggatcctctggaggaggtcgtcgtcggccggctcgacggcgccaccaccccctcacgacattccgtcgtctcctgcaatgtccccccgtgggccgcacggttccagcggctcaccgccggattcagatatccaccggccctcatcgagccggctcagcgggaactcgaccggttcatcaagcttctccaggcactcgatatcaccgtcacccgcccggacgcgatcgaccaccggcggcggttctccacgccgaactggtcatcgcgcggcttctgcaacacctgtccccgggacagcatgctggtgatcggtgaggagatcatcgaaaccccgatggcctggccgtgcagatacttcgagacccactcctaccgcgctctgctcaaggactatttccgcaggggtgcccgctggaccgccgccccgaaaccgcagctcaccgatgcgctctacgaacccgactaccggccccccgcgccgggcgaacccatgcgttatctcctgaccgagttcgagcccgtgttcgacgcggcggattttgtccgtgcgggccgggatctcttcgtcacccggagcaacgtcaccaatcgcatgggcatcgagtgggtgcgacgccatctcggcccggactaccgggtccacgagatcgagagccgatgccgcacccccatgcatatcgacaccaccttcctggtgctcgccccgggcaaggctctgatcaatcccgagtacgtcgacgtcgaccgcctgccggatgtcctgagtacctgggacattctgatcgcgcccgaacccgacccgattcgagaccccctgctgcggctcacttccctgtgcggaaagtggctcagcatgaatgtcctcatgatcgacgagaagcgcgtcatcgcggagcggcatcacttcaccatgctgcgtgccctggagagttggggattcgaacccatcccctgcgacctgctgcactacgcgcccttcggcggatccttccactgcgcgacactcgacatccgacgtcgcggcagcctggaatcctacttcgaccggtaggtctcctccccttcctcaccggtccggtcccggcgggccagccgtcgttgagcggcggagagcacggtcgcggtgacgcgggcggagcggagggcggcgcgagcggcgttggcacccggcgcgccgtgcaccccgccccccggatgtgcggacgcggacgccaggtacagcgccttcacgggtgtttcgggccggcccgttcccggcaccggccggaacaccaactgctggtgcatcgaggccgtacctccattgatggcgccgttacgcagattggcgtccgcgtcctgcaacgacgccggggacaggatccgccggccccggatccggctgcggaagccgggagcgtagcgttccacctgctcctccacccggtcggccatccgctccctctcgtcggcgtcccacccgccggtcagcccgtccgcgccggcgtccgccttcaccgcgtggggcacatgcgtgtaggcccatgccgattccgtgtccagcggcgaccgggtcgcatcggcggtggtcatctgacccaccagcaggaacgggcggtccgggatcaggccgcgggcgatctgggacgcgcacctggtgagctcgtcgaccccttcggccagatggacggtccccgccgaggcggcagcggcgctgctccacggaacagggccgttcagtgcccagtccaccttgaacgtggcgaagtcccactggaaccgtctcatgtcgtccagaagccggccgggcaggtgctcggcggcgaccaactccccgtagaggctgggggccgacacgtcggcgagcacggcccggcgggcggggaccgcctctccggtctccgtacggacaccgacggcgcgcccccgtcgcacgacgacctcggtgacccgctgcccgcaccgcacatctcctccgcgccgccgcagccggctcaccaacgccgagctgagggcacccgcgccgccgacagggaccgggaaaccgtggaactgccccagcatggacatcagccagccgaagccaccgctgcccgccgcctccggcgccagatcggcatgcagggcgttgcccgccagcagcaaccgcccaccctccccggcgaactcctcctcacccagcctgcggaccggaaggacgaggcttcgggccagccgcagcccgcccgcggcccggagccgcgccgcgagcacggccccggcacggacgggagggaaaggcgagaagagggcgtcgacgatgtcctcgcccagtcggtcccagatccggcagagacccagccagccctcgccgtcaccgggcgcgaaacggtccaggccggcggcggtcgccgatcggtcacggtccagcaccgcgcaggcgccgtcgagcagcggatgtgcgagcacctggggcgcgtggctccagcgcagcccctcccggtgcagttccaggctggccagcacgggggaggccgcagccaggggatagaaggagctgaagagatcgttgacgtatgcggggtggacgccgcggtcgcttcggaccgcgccgcccggctcgtcctgtgcctccagcacttccaccgaccagccggcgtcggcgagcagattggccgcgaccagaccgttcgggccgctgccgaccactactgcgtcgaccatggaagcgtcgccctccgtttcgacggcgcgaaccccttcatagaagggtgcgcctacagcgggacctcatgggcggtcggacggcgcgacgacacgcccgccctcatgcgtcgccctcggcgttgtgcgctcggtcagccgggcgaggcgggccagcatcgtgcggtggcgaatctggatcagcgaatccagcaggacgttgtggagcgtgccgccgatgccgcgcagcgggtgttcgtcgacggtcacgagggtcctgtcaccccacggccggatgtccagggcgatgcgcgccgaacccagcggaccggcctcggcctccagctccagcgtccggggcctttcgaggcgccgcaccaccgtgcgcccggtgaactccttgggccccagccgcacgctgtaggtgatcgaggaatccacctcgggccagtcgccctgctccctgcgggagccggaggtccccaccacccaaatgccgtaaagaccttcgtcctccagcaccgcccacacggcggacgggggacggtcgatgagatggtgccgggcggccatgttcctcctcggttcgtcggtcggagcgtcccgaacgccggacgtcgtgccgctactgggtaccaccgattccggagaccaaacccgtccctcgggaccggtggtcccgctcgtgaacaacgcccgaaggcgacgtcagcgacacacggtggcgctactccctgatgaactggcgccacgcccgcagaagcggcgctcgctggtgacccttcaggacgctccccggcaggacggggctctccgtcaggagaggacggcggaggtcttctccggtacgaggcggcgcagttgctcgcgcgcggccgcgagagcggaggcgatgtcccgggtaccggtggtcacgcacaaggtgtagctgacatcctccaggcgccggatcacctccccggcgtcctttccgcgttcggccttcaggtcgtcgtaacggcgcagaagttcttcgagaaccgccgggtgggccatcagcatggcatcgccctttctctcacaacagaatgacagtgggtgcccggagcaccgcgaatctcttcgggacgcggccgggctgccccatggcagaggaaagcgaaagaagcaggactggccaaggaaatggtcagaggtggttcggcaaccccacggcacacctcatggaaggcggcggcaagtccgaacggccgctttcctgacctccactatcacttttcccacctcggcgccgttcatgcacatcgcaccgccgcgcccccgcgcgcctactgcgcgcaccggccgggaccggcatctcagccgccgctcccggccaccgtgaaaagggccccatccggatcgcggacgaggtaggcctcgccgcggacacccggaggcggcgcggccggaagagcttcaccgcccgctcgggtggcggccgacgcggctgcccgtgcgtcgtccacctcgaagtggacagcccaccggggacggatgcgcggatcgggcacgcttccgtcggcgccaccggacaacacagccacggggcggccgtcgacacgggccaccacctgctcctcctcgtacgtcacgtcgacaccgccggggcccgggccggcccagcagaacacctccccgtagaagagcgctgcctcgaaagcgtcccgggtccgcagttccagccacggcggcgcgccgccggtgacggccgaccagacgggggccgcgccctcccagacgccgaacacggctccgtcacggtcggcggcgatcgccgcgcgcccctcacccacggggatgggaccgaccgccaccgtcgcaccccgttcgctgatacgcgcgacggtcgcgtccacgtcgggggaggcgaagtagggggtccacacggtcgtggtcgcgagcgaggtgggccgggtgccgatacccgcgacgggacgggcgtcggccaacgcgacagtgaagccctcaccgagggtgccgcggtcgaacttccagtcgagcacggccgcgtagaacgcctgagcggcggcaaggtcgcgcaccaggaggttgacccagcacggtgcgcccggcacgggcgcgagaagcgcacgggtatgcgtcgtcgtctcttccgccggggggctcgatcgcaccgtcccgtcgctcgtggcgtttccggccggactcatgagtgtgctcccgtctctgcgaccccggtgcgtaccgcgatcatcgcgatatcgtcggtgccttcgtcagccagaccggtgagcagttcgtcgcagaacactccgaggggctcccgcgccagagccgccgcgtgctgacgcagacgggccagcccgcgatcgaggtcttcggaccggcgctcgaccaggccgtccgtatacagcaggacggtggaccggggcgccagccgctccacggattccgggcggtgttcgtccggattcattcccagcagcatgctgcggccaccgtccaggaacctcgtctccccgctgggggtcaccaggagcggcgcgggatgcccggcgaccgcgtagcggtactgccaggaccggtcggcatcatcccgttccaccagaccgtagacgcaggtcaacgtctggtggggggagagaatgtggtgtgcagcgtccagcctggccaggatcttgccaggaggttccttgcggtcgcaggcgatgccgcgcagcaggttgcgggtctgactcatcatgatcgccgcccggaggtcatgcccggcgatgtcgccgatgatcagtgccagggtgccgttgggcagcacgaaggcgtcgtaccagtcgcccccgacgcgcgcggtggccgtcgccgcccggtaccgggcggtcagttcgagcggaccgtccgccggcagttcgggaagatcgggcagcagggaacgttggagacgctctgccgtgtgctggacctgggagtgcaggcgggcgttgtcgaccgccagcgcgacccggtgcgcaaggtctgcgaccagtgtcaggtcctcgtcccccagcgccgcctcagggcgggtacgcgccagggtcagtacgccgaacacctgtcggcgcgccctcagcggcgctaccacggccgtgtcggtcgtcagccgcccgaacagcgcgagctcgcgtgcgtggagcgggtccgcagccgtgtcgggagcacggaagtcggtcagcaaaacgggtcccactccccgcagggcgcgcgcgccgtgcgcctcggagccttcggctgcgggaagaggcccttcgtacagaccggggagagcctcctcgggttcgcggtgttcgaccgcgacccgccgcagccgcccgtcctccaacaggtcgaccgcgcaccagtcggcgaggctcgggacgagggtgcggcagaggcggcggatgccggtgtccatgtccaaggtgctggccagcgcctcagcggcgttgatgaggagcgtgagccggtcgagcgcgtgttgcacttcgtcgtcgacctcgtaggaatccgttcccgctgtcaccggttccggggcctctggcgcgttcatgattgctcctcgtcgtactcactccccgcgaaccggctcacgctcacaaaccggccggcctggaggcgtggcacgcctcctcccgtcacccgccccggctgctcggcggaacgtcaggtccccggttccgtcagcggatgctcaccgcccgtgggccagcgcagcagcgcacccagacccccgaccggttccgccgacatcggttcggcgtccttccggttgtccgcttccagatcctcctcgggagcacggtcatgagcggccggcgcgccgccgaccacgacggcgtccgctccggtcaacgttgccgacctcagcagcgcgtcgtcggcgcggacggtgaagggttccggctcgccgagcgaacgggcatcggtccggcggagggcgagctgttccggcttgggaccggcccagaccactcgatgggtgtcgggtccgtcgggtcggagcagaagggtgtcgatccgatgctcacgcgccgcgtcgaccagagccgggacgccgtcggccgcgtcggtccggccgccgtcgcgggccttggccgcggtga

SEQ ID NO: 2992 - DNA, 6348 bp, Unknown
  Kingdom: Bacteria, Phylum: Actinobacteria, Class: Actinobacteria, Order: Streptomycetales, Family: Streptomycetaceae, Genus: Streptomyces
cggcggtgacggccgccgcgccgaccgcggccgccgccacgagggcggggcggggcggcattgagaaggcgggcagtcgctgcttgagccggaccggccggttgaagacgagaatcggccactcgcgaagggtcgcttcgcggcgcagcgcgcggtcggggttgaccgcgtgcggatggccgaccgactccagcatcggtacatcggttgcggagtcgctgtaggcgtagcagcgcgaaaggtcgtacccctccgataccgcgagagccttaacggcctcggccttggtcggtccgtaggcgtagtactcgacctcgcccgtgaagcagccgtcgtcgccgacgaccatgcgcgtggcgacgactcggtcggcgccgagcaattcgccgatgggttcgacgacttcggcgcccgaggtcgacacgatgaccacatcgcgtcccgccgtgtggtgttcttcgatgagggtggcggcctcgtcgtagatgatcgggtcgatcaggtcgtgcagggtctcggcgacgatctccttgacctgctggacgttccaccccttgcagagggcggagagatattcacgcatccgctccatctggtcgtgatcagcacccccggcgaggaacacaaactgtgcgtacgcagtgcgcagtacagcgcggcggttgatcagtccgccttggtagaaggacttgctgaaggtcagcgtcgaagacttcgcaatgaccgtcttgtccaggtcaaagaaggctgctgtgcgcggcgagaagcagttttccacaacgctgagcataggggcccaccattcggcgtaaactccggcgcgtgggtttgcctgagaaggccctcgggtacaccatggaagtcacggatcgttcgcgaccgtgctaacccggtccgactcctccccccccgagtcggccgtggggacgacccccgctctcccccccggcgggggtcgtcgcatgtccagacgcgttttaggggcggaaaccacctgagcctcccgtctggccgtcatgggccggatggtgcgagtcgggtgcggtgcgactcatctcgtcacagtgtgtagccagaaggctgcgctccggaagtcgctggttcgggttacggagttattcacggcccggaagttatccacagtttttcatcaagatccacatgattttccgccgtgctgcacgttgattccacccgcgaagtccgcgggtgccggaatcgcgcatctcggaaacgctccgagaacaccgcgaaccgcactgaaggggcagtgagaagggggcggagatcgtggctggatccatcgcgggagaaggggcggcggtcgccgagcggcggcgcggaggcccgctgatcgtgacggaggacgtggaactgctcgacgacctgctgcggctgtgcgcggcggccggagcggagccggaagttcatcacgggccgcccgggcgtcgtggcggctgggagcgggctccgatggtgctggtgggagacgatgccgccgcgcgttgccggggcgccggccgcaggaagggggtgatgctggtgggccgggaccaggacgacccggacatctggcggcgggcggtggagatcggggccgagtatgtgctgcggctgcccgattccgagggctggctcgtcgatcagatcgccaacgccgccgaaggagtggggcggcccgcgttcaccgtcggtgtgatgggcggccggggcggctccggcgcatcaacgctggcctgcgcccttgccgtgagtgcggcgaggtccggtaggcggacgatgctgatcgacggcgacccgttgggcggcgggatcgacgttctgctcggcggcgaacgcgccgaaggcatgcggtggccggatttcgcgcagtcgaagggccgcctcgggggcggagccctggaggactcactgcccgcgctccacgggctgagggtgctgagttggggtcgggacgacgaggtggtgatcccgccgcaggcgatgcgagcggtgttggccgccgcgcggcggctcggtggggtggtggtcgtggaccttccgcgccgggtcgacgagggagtcgccgaagcattggcccaactcgatctcggcctcctcgtggtgccgggcgaactgcgtgcggtggcagcggccaggcgcgtcgcggccacggtcggaatggtgctggacgacctgcgggtggtaccccgggggccatatgcgtcaggcctggacggacgatgggtcgcccgggccatccgtctcccgctcgtcggtgaactcccagtggaatcgggccttctggtctcccaggacgatggcgttccgcccggcggcagtgcccggagcccgttggcccggttctgttcggccttctgggaacaggtggcggcggccggtgacaccagccccgtgaccggcccgcccgggggaggggcggcatgacggacgaactgctcgacgccgtacgccagcggctggcacgcagcggtgccgctcccactccggcgggagtggccgcggctctgcgggcgcagggacggctgctgggggacgccgaggtgctcggggccgcggcggagctgcgcggcgagctagtcggcaccggagtgttggagacgttgctcgcggacccggaggtgaccgacgtgctggtctccgcaccggaccaggtgtgggtggaccggggcggtgggctccagctgacgagcgtcaccttcccggacgcggctgcggtgcggaggctggcccagcgtctcgccgcggtggccggcaggaggctggacgacgcacggccatgggtggacgcacgactgcctgacggcacacggatgcacgccgtgctgaccccggtgtccgtcggctcgacctgcctctccctgcgcgtggtgcggccacgggccttctcactggcggagttggtggacgcgggcacggtgccgccgggcggagaccggattctgcgggccctcgtggaagcgcggatctcctatgtgatcagcggcggcaccggagcgggcaagacgacgctcctcgccagtctgctgggcgcggtcggcgtgaacgatcggatcgtgctcgccgaggactccgccgaactgcggccggaccatcctcacgtggtccgcctggagtctcgtccggccaatcaggagggtgcgggccgggtgacgttgagggatctggtgcggcaggcacttcgcatgcggccggaccggctggtggtcggagaggtgcggggtgctgaagtcaccgagctgttggccgctttgaacaccgggcacgaaggcgggtgcggcaccgtccacgccaatgccgcagagcatgtccccgcccgactggaggcgctgggcactgcggccggtctcgaccgggtggccctgcacagccagttggcggccgcgctctcggtggtcgtgcatcttgtgcgggaccgtgcggggcaacggcgggtcgccgaggtgcacgtcctggagcgggatgcggcgggtctggtcctcacggttccggctctgagctggggtgtcggcggatttgttccggagcggggatgggaacggctgcggtcgctgatcgggggtgcgctgtgacgggggcgtcgttcgcgtacgcggcccatgcggtggctctctgcgcgggctcagcggtgtggctcgcgatagtgcgggacgcgggtgttcggcgggcgcgggtgctgttcgtggacgctcccatcgagccgcgtcggacatggagccggtggacatgcctgctcaaggccctgggacgcatgacggattcggtccgggggcgtcgggagtggtggtgtgttcccgtcgccgtgctgattgcggtgctgggaggttccgtgctgccgctggtggggggagccgtggccgtcccgttggtgcggcggtggctgcggaggcgggccggagcgctggcggcggagagggccgcgaccgcggtggcggcgttgtgcggagccgtggtcggggagctgcgggccggccgcgagccgggacaggcgttgctggtggcgctgcgtgaaggtcttgcggaggacggctcttcggtggcgtcggcttcaaacggcctgttgggggaggcggaggccgcggtgctggcggcggcgcggttcggcggcgatgtgccggcggcgcttcggcaggcggcggagggccctgggctgggaggcctgtccgggatggccgcttgctggcgagtggccgtggacggcggggccgggctggcgaccgggctggagcgcctggaggccacgctgcgagacgaccggcgcagacgggaagagctacgtgcccaactggcgggagcgtggtcgacggtcgtggtcctggcgctgctcccggtcgcgggtcttgggctgggagcggcactcggagccgaacccttgcgcgtattgctgcataccccgggtggcctgtcctgtctggcggtgggggcgttcctggaggcggccgggctgtactgggcctgccggatcgtgcggagaggggaggcggcgtgaacgcggcgggcggaggcgttctccacagcttggggacgtcggcggcggtgctgggcgtggcggcgcagctggcagccgtggctgccgccagatatcggatgcgggcggttcgcgggcggggagcgctgttgttggggacggttgttgcggcacggcccggcgggtggagctggctggtcgcaccgttccgggcgagcggtggttcgggtctttccgaggccggtcggcggtgggtggctccagccggggcctggctggccggatggattctggtcggcggtgtggtgggttgcgcggccggttcggttgcggcgtacgggacgtggcggtggcggagatcccgccctcgtgctcgtcccggcgatagccctcaggagagggccgtgatcgccgggcagcttccgctggccgcagacctgttggcagcctgcatcgcggtcggggcaggcccccgggaggcggccgaggaggtgggtgaatccatcggcgacccggtcggggatcggctggcccgaaccgccgccgagatccgcctaggcgtcgaaccggccgaggcgtggggtcggttcggggagataccgggcgcaggcccgctggcccgctgcctgcaccgggcaggttcgacaggggcccctgccgcggaaccggttgccaggctggccgagtcgatgcgcgccgagcgagccgctgcggcggtggcgcgggcgcaacgtgccggggtgctgatcaccgcgcccgtcggcctctgcttccttcccgccttcctggcggtcggggtggctccggtgatcatcggcttggccggcgacctgctcgtaaccggccgtccgggccggtgaggctgcgcggacaggcgtgcctgcgcggggttcgcggccggggacgacctgtcagccgttcattctttcgcagccactcacgggtgttccgtccggacgcccgctcgtcatcaatgctcatcgatcaatgttcatcgggggatgaaatggaaacgaagttctgggaccgggccgtcgaggttctgcgcggaggacggttgcccacaggtgtgccggaccggacggcgaagtgggccgcacggtgggcgggccggctcggccggtccgaccgagggatgaccacgtccgagtacgcggtgggaaccatcgccgcgtgcgccttcgcggcggtgctctacaaggtggtgaacagcgggccggtgatgtcggcgctgcagtcactggtcgaggacgcgctcgatgcgaagttctgagaccccgccggggtcctccccggggaaggggcccctggcgcgccgtggccttccccgggggcggaaccgttggcagcacgagagccggcccgcgagtggcgacgggtgcggagacaggggtgcggtgaccgcggaggcggccgtggtgatcccggtgctggtgaccttcgccatggcgctgctgtgggcgttgctggcggcttcggaccagatccggtgcgtggacgcggcgcgggcgggagcacgggcggcggcccgctcggagccggaggcgacggtactggaagtcacgcgtgacgcggcgccccacggcgcccgggtcgaggtggggcgggccggagacctgtggcgcgtccgggtggaggctcccaccccggggccgggcgtactggccctgacgttgagcgccgaggcggctgccctggcggaggacacggtccggggcggcgggttatgagggagagaagaaccgcgggccagggctgggacgggctggacgggtgtcgtcgtcggggcaggttccggcggtggggccgggacccggaccgggatgaaagcgagcgagggagaggacagggggatggggaccttggcgcggaccaggggg

SEQ ID NO: 2993 - DNA, 13914 bp, Unknown
  Kingdom: Bacteria, Phylum: Actinobacteria, Class: Actinobacteria, Order: Streptomycetales, Family: Streptomycetaceae, Genus: Streptomyces
gggccgggcagtcccggcagcccggccgtcgcgtacgggaccagctcgtcgcgcagccgggtcgccgccccgcgccggtcacgccaccacccgtcgggcaccgagccgaccacgttggcggcgtccacgatcaccagcaccgcatcgtcctcgctcatcccggcagggtgccacgaggggacggtgcgacgggtcgtcagcccccggtggcgggggacttcttcgcttcctcggggatcgtggtgtcctggcggatcgccttccacagctgacccgcctgcggctcggccgcgatcacccggttcttgtcgatcttgtcgtaggcgaccggcagcatgatcgtctccatcgaggccgggtcgacgccgttcatcgagcgggcgaactccgccagcgaggtgagcgaggcgagcccggagtcggtggtgagcgacttggtggccgacttggcgatcttgtacgagttcgccggactgcccagcaggtcctgcgacttgacctcgctcagcagggccatcaggaactgctgctggagtccgatgcggccgaggtcgctgccgtcgccgacgccgtgccgggtccggacgtacgccagggactcggtgccgttcagcttctgcgggcccgcggtgagactcagtccggaggccttgtcgtcgatgtcctgcggtacgtcgacggtgaccccgccgatggcgtcgaccaggtccttgaacccggcgaagtcgatctccaggtagtggtcgatgcgaacgccggacatcttctccaccgtcttcaccacgcaggccggaccgacctgcgcgtagacggagttgaacatgacgcgttccttggcggacaccgtggatccgttgtcgccgacgcactcgggccgggtcaccagggtgtcgcgcgggatggagacggcgacggcctccgaccggccctcgggtatgtggaccaccatcgcggtgtcggagcgcgcgccgctgacggctccgccgccgcccagctcctcgttctccgccccggcacgcgagtccgagccgaggaccagcaggttctgaccgctggtgggcagcttctccggacggtcctcaccgagcgccttgttgatgtcgacgcccttgatgttcccgtcgagctggctgtagagccagtacacggttccgccggcggcgagcagcaggacgagcaggacaccgagcgtgatcttgaggccgcgacgccgcttgcggggcttgggtgagcgtcgggaggcgcgggggcccggaggcatgacgtcgttgctcatcctgcaggagtcccttgttctcttggcccggaagggcggtgtggagttggggactcgggtggggccggtccacgcgcgtggggggctgagcgtgcactatagacagattttcgaatgttgtgtaattcttcacggactcttcgggtcccgtacacgatcgtcacccgtggcgcgatgccgccgtggattcctccgccacgtcgtcgtgccgggggagcgctgcgttccgggccgaacagagattctatgatgggtgcgtatcggtctgccgcctgtcggaacgccaacgcgttgtccggggcggggccgaggaacttctgggaaggacgacctcacgtcatgccggtcagatccaagcgcgctgcccggagaggggccccgcacccgggtgccgaggaccacgacacccgcgtacagcacgacgctcccgcccccctccgcgcccggtccaccgccggcggccggtggctcgtcctgggcaaggacggcaggctcaccgcctacgcgttggccgcacagggactcctgcgctggacggaggagtcccccggcggaccccggtggaccggcccggtgctccttccggctctccatctcacgcatctgtccgtggcccagggcgcgggcgggttcgtgcacttcgtcggccgccgcgccgtcgagcgggaccacggccaggccgtcgacctggtgagcgccacccagttccagtccggccggcccctcaccgaatggcggtcgctcgggaaccagcacaaggaacccgagaaggcggcgcgcatcggcatcccggcggccgtcgtgggccagtccggtgcgctccacgtcttcgtacggaacgcgaacggcagtctcgtcatgcggcgcgagaccgccggcggcagctggcagggatggcaggacctgaaggtcggaaaggtccgggacggcgcggccgtggccgccacctcgaccggccgcgtcgagctggtcgcccccggcgacgggctgacgatgcgctggacccagagcgagcccggcggcgccttccagcgcgaccaggacatcccgttcggccacgcacccgggagcgccgtcgccctggagaccgcgccggagcggatgacgttctactgggcggacgagggcacaggaggcgtcgtggcgtaccgtccgggcacctgggccatttccctgggcggctcggcgtcgaacgtaccggtggccgccctgcgcgccgcgctcgacggctacgactgcacggtgctcgcccaccgcggtcacgacggccaggtcatgctcgcggcctgcggtacggagaacgagggcggcggcgtgtggtggtcgcccaccggggagagctgtgcgggcggtcccgcgctcgcacacgacgtgtacgggcgtgtggtgctggccctgatcggcgaggacggggccctgcgcgtcgcccgccagcggcgcgagcccggtctcgccctggagccttccgtacgcgtgtgagacggcgacggcgggagcgccctcgggggcgctcccgccgttcgtgttccccggcccggccgggcccgtccggcgggctcaggtgaggagcttcagcccgatcgacaggtagttgctgtccgtgtagtacgggtggaatctcaccgaccggccctgcggcgtggcgacgacccgctgcgggaagacgttcacgggcttccgctgcacgatgtcgtcggcgaagcggccgatccgcagccggtgcgccgtccccgagaccgtcagattcgccgggatgctcagggagaggtcccagatggtgtcgagctcgatcaagcggtcgccgtactgcaggaggtcgatggtgaagctggcgccaccgttcgagaacgcgcaggggatcgtgaagaacgactccttgttcttccggctctgcgcgatgaggtgcgcgccgtgcccgtcggcgtcgacctgcgggccgccctgggcggcggcgactcccagagcgaacatctgcacgttgagatgggatcccgccgtctcgatcccgaggacctccgcgtgcgcgggaagctcgcgggagacgatctggagatacccgccgtcggacgagcgtgtgaacgaccggaagcgcaccggggaggaactggcgccggagatgagcgagttcgcggactgctggagttccttgaccttgatccggcgcatcactccgtcgtcctcgcggcgcagcaggacgttccaggccccggtggccagccggagctgcccggggatggccgcgtagtgcccgttggccgtctgttccgcgggacccgtcatcagggcctgccggccgtccgccgcgttcacgcacaggacggtgaaccggtggccggcggcccgggtcgggtcgacgaccagttcgaggtcccccgacgaggtggcccggcacagtgcctcggggcggtagtcgcgggccgtgagcagcctggcgagatacgtctcgtaggtgatggcctgcgactcgttgctgtaattgcgggccttctcgaccgcgttggcacccatccgcgcccgcgtctcggcgtcccccatgagccagtcgaggttcttggcgaacgtctccgcgtcgcccacgggggacagcgcgccgtccacaccgtcggagatgatctcggaagggccgtgcggtcccgcggtgctcagcaccgggacgccgcaggtcatggcttccacgatcgtcagtccgaaggtctcgtccgtcgaggtcgaggtgtgcagcgccgacttggccagctcctcacgaaggtgctgcgtgtgccccatgaggaggatgcgctcggtcgcgcccatgtcgtcgatgagcttgcggagcttcggcttctccgcaccgcttccgtagatgcgcagggtccagtcggggtacttcgcgccgagccgcccgaaggcgtcgatgagaaggtcgaaccgcttccagtcgaccatgcgccccgacgcggtgacgatgcgtgattcgcgtacgtcggaccgcatgaacgtaccggtcaccgcgttgggaacggcgtggaagtcggtgccgaccgcgccgtaggcgtcccggtgcgtctgggcgtccttcgacgtcaccgtgacgaaaccgtccagctgcgggatggcgaggtccagcatctgccgcgaggcgcggctctggtggtggtagtgcgtgtgcgcctgaccgagcgtgatgtacctgccggtgcccagggcggccacgagcgcgatggcgctgggcgacgtcgcgatgacgacgtcggcatcggcgctcttcagatactcggcggcgcgctcgtccatgagccggctgtagcggttcttgtcgtcgggcttccacccggtgccgggacagcgctcggtggcgacctggtgcagcggatgggtgagatccggcgagccgtcacgggtgtcgacgagggtgtgcagcgtgatgcccggatcgaaccgcagcggcggggtgtcgtggtactggaacgtgctcaccagctcgacctggtgctgccgggcggcgagggagttggcgagggtctgcgtggcgacggacgtaccggcctgcccgtacgcgctgtacatcaggaatgcgatcttcacaggattcccctggatcagtggccgtgcggcccggctcagtcggtctgactctcggagtggttcaggacctgcgagagcgcggattcgaaggcggagtcgggcgcagacgtcgggtcctgccgccgtacgtcgatcacatgtcccgtcatcgcggagaggagcacgtcgagcgagctgcgcgcgacctcctcggacgagagcagggacccctccggctcctgcccgaacgccttggtccgcatcggggtcgcggtgcgctcggggttcacgcagttgacccggatgccgtcctcggcccactcgtccgacagggcctgggtgaggttgaccatcgcggccttggtggaggagtacaggctgtactcggcgcggccgcgcgtatagctgctggaggtgaagagcagcagctgtccgcgggtctcggccaggtacttgtacgaggtgcgggcgatgttcacgggcgcgaggtagttgacctccatcgcctcgcggaccgtggcgttgtcggcccggtcgagccggccgatgcgcagcacgcccgccgtgttgacgacgaagtcgatccggccggtctcggcgtacgccgtggcgaaggcctcgtccacgtggtcggggttctcgacatgggtgccggtcgtcgagcgcccgagagcgtagacgttcgccccgtactcccgcgctgtccgggcgatgtcgccgccgatcccgtacgagccaccgaagacgagcatggtccggcccgccagccggtcccggtagaactcctcgccgctgtgcgccggagccgccgtggaggccagctggaacagcttgtcggcgatgaagacgtcgacgggctgggtcaccttcatgttgtactcgtcgccggtcaccacatggacggggacgtcgggcaggtacttcacgacgaccgagcagtcgtcggtcgcctggaagaacgggtccgcggcggcgtgttcgtacgcggtgcggatggtggagagcctgaagccctgcggggtctgcccccgccggagccgggcgcggtcgggcacctcggtgatgaactccccgtcgtcgccgtgcgtccgggtgacgatcacggtgtcggccgacgggatggccacgtcgacggcacggtagcgctccagcgcggccacgcactccttgaccacccgctgggacagcatcgggcgcacggcgtcgtggaacagcaggttgcagtcctcgtcggcgccgagccgcccggacaccgccgcgatcgcgatgttcgttgtctcgctgcgggtgccgcccccggccagtaccgccgacaccttgcgcagtcccgcaccggagacgatcttctcggcctcggccacatggctcggcgtcatcagcacgatgacgtcgtcgatgtccggagcgttctcgaagacccgcagggtgtgctccaggatgggcctccccgcgatcttcaggagctgcttcgggatggcgagcccgatgcgctgcccggtgccaccggcgaggacaacggcgactgtacggcgacgggtggcgcgcgtggtcaagaggagcctgcttcctgtcgaggatgagggtggacgcgaggcccgggcacggagcgtccgggcgatgcggagagtgcggcggccggacgcggtcaggccggctgacgcggctgctggccggggaagcccggctggtccgggtgctcgacggggaagtcccggatcccggaccggtacagcgtgttcgcggcctcggcgaagcggacggtcgacggcgggttgtccggtcccagcaggtattccttgagctgttcccggtacggggccatcacgtcctggtccacggagagcatcgcggtgagcgccgtatccaggccgttgcactcggcgtcgaggaggtacgaggcgtaagcggtgcgctgctcgttccggaactcggcgtcggggagtccttcgaggttgaagatggcgtacggcttacgggtcgccacgaagtccgagaccacgctcgacatgtccccgatgagcaggtcggagtggttgaagcagtcgtacagcgtgggcaccttgtcagtcacgacgtggtgcgcgtcgacgggcagcgagtcccagtagagcgcgccggcctggtggcggaacttgcggatacgggtggtccgctccgcctcggtcaggtccgggtacttggagcggacgccacgctcctggagtgcggcgaggcgcttgtcgatccgggccagccggcgggccgcggtcttcgagtcgaggagcttgcgcccgaaccggcgggtgttgtcctcctggaggagcgcgatgatccgccggtgcgcggccgccgccgcgggggagcgggtgccggtcagcgggtgcggcttgtagatgatccgcagctgctccttgtacgcgagcagggtgcgtatgaggtgctcgccggccgggatgacggaggtgtagcaggcgtcgtccgtccagccttcccaggtgggggcgtagatgacggtgggtatctcgttgtcgaccgagcccgtccagcggcgcaggggcatcagctgcgggcggccgacctccacgatctggtgggcggtcaccgcgtgcttgatgcgctcgtagcggtcgcgtccggcgcgtccggccacccagatctcgtcgaagaccttgctgacgcggttgctgctggccagcttgtcgctgtcgccgtgaccgatgaagacgtgcttgacctcgtgccgctggagcatgtgcacgttctttccggcgttgccggggtagagcgtgacgcggagctcgggcatctcgacgcgggccaggtactcggccttggggacgcagatgaccggtacggaggtggcgtccaggaagcgcagggtggcccgctcgcgcagcacgatgatgggtcgcaggtccagttcctccagcgactccagccacatgttcacctggtacatgaagtcccgggagacggcggcgaaggtgaagtacagggcgacctgcggccggtactgcccgagctgccagttcagctcgtcgagtgcctcgtcgggggtgggcaggatcagcgcgttccgggcgccgggcagcaggacgagcacggccaggaaggcgagccagaccgtggcgattccgccgaaggtcacgtacttccagtcgtccgtggcgacggtgccgatcgcgccggccaccagcgggacgtccaggtgcagcatcttgcggacgtgcttgctcgtcaggaacggatgcggcaggcggcggatgcccagggcttcgaggtccagcccgcgggtggtgaagggcagcgccgcgcgttcggacttgacccgcttgatcatcgccccgtagacgagctgcagggtgaagaggaggagcagtcccaccgccgtcatctggatgacgaacgagtcgaggtcgatgatggcgccgcagagcgcgagcagcaggaactgacggatcaggaagcggatggtgagtccgaagcgcgagtccctcagccggtccagggtggaggactcggcggtgtgcaggagcaggtcggccaggtagctgacggccgccgcgaaggcgaagacgggcagcgagaccatcacgaccgcggccatcatggccacgaagctgagcaccagagcagctgtgatcaggacccccagcacggcctgacgtttttgcttgcccatgggctgccgacccctccctcgaatgatcttgtgcggtgctggctacggtgccggccaggaacagggactgccgcacgtcacagtggggggccgttccgcggtgaggatcgggtgcggacggtgtgtaaggaacttgtgaagcatccggtcaaactttagacactgaccgcacgcaacagagaactttcaagggctaaaagtagaacaattgtggtctggataccgaacagttatgaacggttggctgtcgcgtgaccgaattgccggacttgctccgtacgtgacggcggtgacgtcggttcaggtcgtggcgcccggagccgggcacgcgtagacggcgagacgccggtgctccgatgtcttgaccgcgaagcccacgcagagctggggctccggcgcggcccgcaccgctatcccctcgggctcgcggtattccagttcgggcgcgacggtcaccttgcggcggcccgcgacctcaccggtgcgcacgtcgagcgccgacacgtaggtgtcgcccccgcccgacggagggttggcgccggcttcgtccgtgtagcccttgccggtcagctggtagatgtggttcccatgcagcgcgctcccctggacccactcgccgtcacgcagagcgccgtcgacgacggtgtgcaggggttcgtaccgcccggcgaggaagtcgtccgtccggtagaccgcgtagtggtgcgcctcgccgacccagtgactcaccaggacccggccgtccaccgggtcgaacgccggatggagccggcgactgcccggcagcggccggtggtgccgcacggccgacgacgaactgtccaggacggccccgtgacggaaaggcacccgggcgacggcacgtccgtaaccggtccgctcgtccgcgtcggactccacccagagcagcacgtcctcgccggaggactccacgcccatcgagaccccgtggccgaaaccccgtagatacatgtgcccggcggcactccccgagagggacaggaccgagacgcacatgtcgcccgccatcttccggtcgcgaccggagacgggttcctcctcgtcggggagccggagcccgtccgccatcacctgcagcgcgtacacccggtcgcccgcggcgtcgaaggcgaacgactggggcccgctgacggtccgcaacgggctcggcggcagcagcgtcaccgcctcgtccacggcgaacagcccgacggtcgccggggtcggtacacggtcctcgcgtccgctcacccaggtcagcacgccacccgtcgcggcgatcgccgcgcccccgcccgcgaggaggaccgctctgcggccgatgtgtttcctggtgccggtcataccgtgtgtgaacgccgttccgcccgtggacggcaaccgtccacttcccgggctgctcaggggtgagatcagggcattctgtcatcactccgccgggaccggtccgggcaggcacgaagggtacgactcgtcgccgagtcgtacccttcgtggtccgtccgtggtgagaccgagcgttacgcgggcacgctcgccacgccccgctccaggaacggcttgccgttcacccgctgggagacgccctcacggtccaggtacggcgtgatgccgcccaggtggaagggccagcccgcgccggtgatcaggcacaggtcgatgtcctgggcctcggcgacgacgccctcgtccagcatcaggccgatctcctgcgccaccgcgtcgagcacgcggtcacgggtctgctcctcggtgaggacggtgtcgccctgcttgaggagcgctgcgacctcggggtcgaggaccggagcaccggagtcgtagacgtagaagccgcgcttgcccgccttcacgaccgccgcgaggttctcggagaccgtgaagcgctccgggaaggcgcggttcagggtctcggagacgtgcaggccgatggccggacccaccagctccaggagcaccagcggggacatcggcaggccgagcggctcgacggccttctccgcgacctcgaccggggtgccctcgtcgatgacgttctggatctcgcccatgaagcgggtgaggatgcggttgacgacgaacgccggagcgtccttcaccaggaccgcggtcttcttcagcttgcgggccaccgcgaacgcggtcgccagcgaggcgtcgtccgtctgctcgccgcggacgatctccagcagcgggaggatcgcgaccgggttgaagaagtggaagccgacgacccgctccgggttcttcagcttcgacgccatctcggtgaccgacagcgaggaggtgttggtggcgaggatcgcgtgcgccggggcgaccgcctcgacctccgcgaacacctgctgcttgacgccgatctcctcgaagacggcctcgatgatgaagtccgcgtccgcgaagccctcggccttgtccaggacacccgagaccaggcccttgaggcggttggccttgtcctggttgatacggcccttgccgagcagcttctcgatctcggcgtggacgtagcccacacccttgtcgacacgcgcctggtcgatgtccgtgaggacgaccgggacctccaggcggcgcaggaacagcagcgccagctgcgaggccatcaggcccgcgcccacgacgccgaccttggtgaccgggcgggccaggttcttgtccggagcgccggccgggcgcttggcgcgcttctggaccaggttgaaggcgtagatgccgctgcgcagctcgccacccatgatcaggtcggccagcgcctggtcctcggcgtcgaagccggcggacaggtcgccgtccttcgccgcggcgatgatgtccagcgcgcggtacgcggccggggccgcgccgtgcaccttggagtcggcgatggcccggccgcgggcgacggcctggtcccaggcctcgccgcggtcgacctcggcacgctcgacctcgaccgtgcccttgagcacgttcgcggtccagatcagcgactgctccaggaagtccgcaccctcgaacagcgcgtccgcgatgccgagttcgaagacctgcttgcccttgagctgacggttctgattcagcgagttctcgatgatcaccgagaccgcgcggtccgcgccgatcaggttcgggagcagcgcgcagccgccccagccggggaccagaccgaggaagacctcgggcagggagaacgccgggagcgccttggagacggtgcggtaggtgcagtgcagaccgacctcgacaccgccgcccatggccgcgccgttgtagtacgcgaaggtggggaccgcgaggccggagaggcggcggaagacgtcgtggccgcccttgccgatggccagcgcatcctcgtgccggccgagcagctcgacgcccttgaggtcggcgccgaccgcgaagatgaacggcttgccggtgatgccgacaccggtgacggtgccctccgcagcctccttctcgacctggtcgatcgcggcgttcaggttcgccagcgactgcggtccgaaggtggtcggcttggtgtggtccaggccgttgtccagcgtgatgagcgcgaaccgcccggcgccgcccggcaggtccaggtgacgtacgtgcgcctgcgtgacgacctcgccggggaacagctcggccgcacccttcagaagctcagtggtggagctcacttgttgcctccgtcagcattgaagtgcgggttctcccagacgaccgtggcgcccatgccgaagccgacgcacatggtcgtcaggccgtagcggacctcgggctgctcctcgaactgccgggccagctgcgtcatgagccggacaccggaggaggccagcgggtggccgtaggcgatcgcgccgccgtactggttgacgcgggcgtcgtcgtcggcgatgccgtagtgctccaggaaggcgagcacctgcacggcgaacgcctcgttgatctcgaagagaccgatgtcctcgatggacaggccggcctgcgccagcgccttctcggtcgccgggatcgggccgtagcccatgacctccggctcgacgcccgcgaaggcgtaggagacgaggcgcatcttgaccgggaggcccagctcgcgggcgacgtcctcggcggcgagcagggacgcggtggcgccgtcgttgagacccgcggcgttaccggccgtcacacggccgtgggcgcggaagggggtcttcagaccggcgagggactccatcgtggtgcccggacgcatcggctcgtcggcggtgaccaggccccagcccgtctcaccggcttcggcgttggtgcggcgcaccgagaccggcaccaggtcctgctggatcttgccgttggcgtacgccttggcggccttctcctgtgaacgcaccgcgtacgcgtcggcacggtccttggtgatcgtggggtagcggtcgtgcaggttctccgccgtcatgcccatgaacagggcggactcgtcgaccagcttctccgacacgaagcgcgggttcgggtcgacgccctcgcccatcgggtggcggcccatgtgctcgacgccaccggccacgacgacgtcgtacgcgccgaaggcgatggaaccggccgtcgaggtgacggcggtcagcgcgcccgcgcacatgcggtcgatcgagtagcccgggacggactgcggcagaccggccaggattccggcggtacggcccagcgtgaggccctggtccccgatctgcgtggtcgcggcgatggcgacctcgtcgatcttcttggggtccaggtccgggttgcggcgcagcagctcccggatggccttcacgacgaggtcgtcggcgcgggtctcgtggtagatgcccttggggcccgctttgccgaacggggtgcggacgccgtcgacgaagacgacgtcccggatggtacgaggcacggtggctctcctccagggtgcgggatggcactgctgcggggcacgccacgggggcgcgccgcctgtcctcatgctacttgcgggtaaccagactgcccacccctcacggccggagcgtcgaaggtcacaccgccccggcgcccggtgcaggccgccgaagccgccgcacggtggaggaaagggtccagaacctggcgcgatttcgaccatcggttcggtccgtgggcgggacccgggcagcggaaaacccccggccggtgaccgggggtgtccgctgcctcacgggatcaggaggtgccaagcgcccgcaccaggagcggggcgacctgctggatctgccagttccgcgccccgtacccggcgagggtgtcctcgacggcgcccggggtcgggttcttcggcggctcccagcagacccggcgcacggtgtccggggtgatcagattctcctggggcatgtggaggcgctcggccagctcggatacggcggcacgggcggccgagagccgggcggcggcggccgggtccttgtcggcccaggagcgcgggggaggcggtccg

SEQ ID NO: 2994 - DNA, 5505 bp, Unknown
  Kingdom: Bacteria, Phylum: Actinobacteria, Class: Actinobacteria, Order: Streptomycetales, Family: Streptomycetaceae, Genus: Streptomyces
gcgacgacgccgaggtcgtgcgtgatcatcagcagggcggtgccctcctggtcgaccagttccttcaggagctccaggatctgggcctggatggtcacgtccagggcggtcgtcggctcgtcggcgatcagcagccggggggcgcaggcgaccgccatggcgatcagagcccgctggcgcataccgccggagagctggtgcgggtactccttgagccgccggtccgggtcggggatgccgacccggtcgagcagggacgcggcttccttgcgggccttctcacccttcagcccgcggtggcgctggaggatctcggtgacctggatcccgatggggacgaccgggttcagcgaggagagcgggtcctggaagatcatcgcgagctggctgccgcgcaggtcgcgcagcttgcgctcgttcatggccagcaggttctggccgtcgaactcggcacggccgccgacgcgcacgcccttgcggggcagcaggcccatcagggcgagcgaggtgacggacttgccgcagcccgactcgccgaccaggcccacgacctggccctggtcgacctcgaaggagacaccgtccacggccgtggcgtccttgcggccgcgggcggtgaaggtgacgctgagttcctcaacggagagcagtgacatgggacttcagcctcgcaacttcgggtcgagggcttcgcgcatggcctcgccgagcagggtgaagccgagggcggtgatgatgatcccgacggccggataggcggccatcatcggctcgttgtcgaagaagcgctgtgcctgggagagcatcacgccccactcgggaacggccgggtcggggttgccgaggcccaggtaggacagggccgcggcctcgatgatcgcggtggccaggctcagcgtggcctggacgatcaccgggctcagcgagttcggcaggatctgcgtgagcacgatccgcttgcgccggatgccgaccgccttcgcggcgagcacatagtccgcgccgccctggaccagcatcgaaccgcgtagcaggcgggcgaagatggggatctggacgacacccacggcgatcatcacggtggtcagcgactggccgaggaccgcggcgatggagaccgcgagcagcagcgagggaagcgacagcatgatgtcggtgaagcgcatgatcacagtgtcgacgcgctggccgaccttgccgccgagggtggcggcggctccggagagcacaccgaccagcgcgccgacgatcaggccgatgagcatggagacgacaccgacgagcagcgtctgccgggccccgacgagccagcgggagaacatgtcgcggcccaggtggtccaggccgaaccagttctcgccgcgcatgccgacgaacttgccctggttggggaagacctcgctgcgccagatctgcgcggtgggcccgtgcggggcgagccaagggccgacgatcgcgacgaggacgaacgcggcgatgatcgcggcgccgatgatcgccatcttgctggaccgcatccggcggaacgcctcgcgccacaggctgctgccggtgacggtctcggagctctgcgtcagctcggcgagacggtcgatcttgtctgctttgttggtcaggatcgtcacgtcagtgcacccgcactctcgggtcgatgatgctgtacgcgaggtcgaccagcaggttgatcagcacgtacaccatcgcgatgaagagaatgaacccgacgaggaccgggtagtcgcggccgtcgatcgcggtgcggatgaaggagccgatgccgccgaagtcgaagacggactcggtgagcaccgcaccggacagcaggctgccggtcagcaggccgaccgcggtgatcacgggcagcagggcgttgcgcagcacatggcggccgcgcacgacgcgcttgtccaggcccttggactcggcggtgcggatgtagtcctcgccgagcacctccaggacgctggcgcgggtcattcggacgatgacggcgagcgggatcgaggccagcgcgacggcgggcaggatcaagtgcatgatcgcgtcccagctcgcgtcgaactcaccggtcaacaagccgtccaggacggcgaatccggtgatgtcggtggcgttgagtccggtggtgagccggccctggctcgggaaccagcccagctccacggagaagatcccgcgcagcagcatggccaggaagaagaccgggatgcagatgccgagcagcgatccggagacggaggcgacgtccagccagccgccgcggtgcttggccgccaggtagcccatggggatgcccacgaccacggcgatgaggatcgcggcgacgctgagttccacggtggccgggaagcgcagggtgaattcgtcccacaccggctggccggtctgggtggaggttccgaggtcgagctcgaagatgcgcttgaggaaccgccagtactggacgtggaccggctcgtcgagcccgagtgctctgttgattctcgctacttcggcttcggtggcccgctcgcccaggatcgctgaggcgggtccgccgggcagtcggttcagccagaggaacagcaggaccgacaggccgagcagggtgggaatgagctggagaagtcttcttacgacgagtcgcagcaccccgcatgcccctttctcacgtgcgtcgatgcgggtccgcccggccacctggttgctgtggccgggcggacccgctggtgtgcgattacttgaaggagacctcggcgaagttctcctgcgtcagcggggagaccttcggcgggttgacgttcttggcgaacgcgatggccggcggcgacgacgagatcggcacgcccgggacgtactccgcgatcgcctcgttggccttctggtaggccgcggtgcgggcggccgggtcggtgaccttggaagcggcgttcacggcgtcgaagaccttctggtccttgaagccccactgcttgtccggcccggcgaaccaggtgccgatgaagttgtagccgtcgttgaagtcaccggtccagccgagcatgtgcagggcgcaggagcccgcctcggtggcgtccaggtagtccggggcccacttcatggccttcggcttgacggtgatgccggccttctccaggtcggccttcatcagctcgaacatgtcctgcggagcaggcatgtacgggcgggtgacctcggtcgggtagcagaagtcgatgctcagcttctccgcaccggcctgcttgaggaggtccttcgccttggcggtgtcgaacgggtacgtcttcaccttgtccgagtagccggcgaccgtgtcgggcatgaactgggtcgcgaccttgccgccctcgggcagctgggtgttgacgaggttctcgcggtcgatggcgtgcgtgatcgcctgacggacctcgggcttcttcagcgccgggttcgccgactggctcatgccgaggtagaagatgttgaagacgtcacgggtcgggacctcgtaaccctccttctccagggtcgtcacatcggccggcgcgaccaggtcgtagccgtcgatgtcacccgcctggagcgcctggcggcgggtctcctcggtggagatggtgcggaagaccaggttcttcaccttggccttgtcgccccagtagccgtcgaagcgttcgagggagacttccttgtttcccttgttccacttggtgatcttgtacgggccggtgccggcgaccgtgccggcctcctggctgtacttggggtacgtgatcgcgtcgcccttggcggtcgcgtcctgcttctcgtactccttgatggccttcggcgagtggatcgcgagcgcctggagggagaaaccgcccggcaggttcgccgagggctcgttcacctcgatgacggccgtgttgtcgtccttggcggtgcaggacttgtagttgggcttgggcgcctcggcgtcctcgttcttcgcgaacccgcccatgatggtctgccagtagtaggagaccgcgctggactggtacgtgcccttccagttgaaccagtggtcgtagttcgcacagaccgcggcggcgttgaacgcctcgccgtcgtggaacttcacgccctggcgcaggttgaacgtccagaccttgccggccgggtcgctcgaccacttctcggcgagaccgccgacgagcttgctcccaccgggctcgtgctccaggagcgcctcgaaggcctgacgggtgacgcggaacgtctcgccgtcgctcgcgagggccgggtcgagggaaccggggtcaccggctccggcgaagacgaaggtgtccttgtcgccccccttggagccgccctcgtcccgctcgctggaacagcccgtggcgatcagaccgacagcgaccgctgtcgtgatcgcccggacagcccgggacttgaatattcgcatgggtccacccctggttcgccatgtggtgaggtttgatggccgcacactacagacggtgcctgccgcaagagaacagtccggatagcggtgagacctagtcgagacccggacagttaacaaaccgtccagttccgggacatcctcgcgtgggcggttaacaagccggacatcgtggggtgttcgacggagggtgaccaggaccccgcgagaccggcatcatccgagcgaaggcgccgggtcccgctcgtcgcagctcagcgtggctggggcgggtatccgtatccgggggcggcgaggggcggcgggccgacgggggcgtgcgcctcgcggtcgtagaacgggcgggcgttcgcgcgcagccacatgccgaccgggtcgtactcgtcggacatggcgacggtcgagacgggcagcccctcggggaccgcgccgaccgactgccgcatcatctcgcgcaccgattccacggaggcgcggccggtgtcgtagaggtcgaggccgatcgcgagatacgggacgccgaccgcggggtgcacccaggcgcggcgcagggagcggatcgcgggggtgcggtgggcgttctgcgtgagcagggcgtagaactgcgggagttcgatggcggggtcggagagccggagcggcccggcgggcagccggtccaggcccgtggcgatgcgccgcaggtcgagccaggggatgccgacaccgccgccgggggcatgcggattgagccagataccccagcggtcggggaacagggagcgggcgatgtcgcgtccggtgaccagctcgtgtgcccggttccagccactggcggagagctcctgggcggaggtgacgcagggggcgtagccgaggccgtcgatctccatgttcccgtactgggcgtccggtgagccggccgtgccgtgccagagcagcatccagacccggccctcggcgaccgccgcgagcagcgcctcgtaggcgtcgtaacgcccgggggtcacctggcgcagcatgtgctcgactttcccggccgccgcggtgcctgacgcactcaccctgggttccgcccctcgtcgatccatcgcgttcgcgccaccgctcccgggcacacgggagcggtggcgcgaacg

SEQ ID NO: 2995 - DNA, 6817 bp, Unknown
  Kingdom: Bacteria, Phylum: Actinobacteria, Class: Actinobacteria, Order: Streptomycetales, Family: Streptomycetaceae, Genus: Streptomyces
agctgctgttctggttcaacctcgcctatctctacaaggagttgcagttcggcatccccttcggtccgggcttcttctccttcgacacgatgaacctcgtcggcgcgacgagcgcggccgtcctcggtctcgccctgcaccaggcggcgtacgcggcggagatcgtgcgcggaggcgtactggccgtcgacagcggccagttggaggcggcgtccgccctcggcatccccaggatccggcagctgcggcggatcgtgctcccgcaggcgatgcgctccatcctgcccaacgccgccaacgagatcatctcgctgttcaagggcacctcgatcgtctccgtcatggcgatcggcgaactcttctaccaggtgcaggtcgtctacggccgcaacggccgggtggtgcccctgctgatggtcgccaccgtctggtacatcctgctgaccaccgcgctctccgtcctccagcactacgtcgaacgtcactacgccaagggggccgtgcgatgagcgcacccagcgatgccatggtcgagatccgctccgtgcacaagaggttcggctccctggaggtgctgcgcgggatcgacctttcggtccggcccggcgaggtgaccgtcgtcatcggtccctccggatccggcaagtccaccctgctgcgcaccatcaaccacctggagaaggtcgaccggggctggatcagcgtggacggcaccctgatcggctaccgcagggacgggaacaagctccacgagctgcgcgaacgcgaggtgctgcgccagcgcaccaagatcggcttcgtcttccagaacttcaacctcttcccgcacctcaccgtcctggagaacatcatcgaggcacccgtctcggcgctgcgccgcccccgcaaggaggccgtcgcggcagcggagaagctgctcgaccgggtcggcctggccgacaaggcggcggcctacccgggtcagctctccggcggccagcagcagcgcgtcgccatcgcccgcgccctggccctggaaccccggctgctgctcttcgacgagccgacctccgccctcgaccccgaactcgtcggcgaggtcctcgacgtcatcaaggacctggcgcacggcggcaccacgatgatcgtcgtcacccacgagatcggcttcgcccgcgaggtcgccgacaccgtcgtgttcatggacgagggacgcatcgtcgagcagggcccgcccgccgacgtgctcgaccaccccacccaggagcgcacccgcgcgttcctctccaaggtcctctgacccgcctcatgcaccgcacctacgcaaggagtacgtacgtgtccgtccgccgcgggaccaccctcgccctcgcccttctcaccgccaccggcctgctcaccgcctgcggcgcctccgacccctccaccgacctggccgctccgaagggccggcaggacaccggggtcaacatcgggcccgaccaggaccgcctcagaggcacgaaggtcgcggccgccgccgacctcgtaccggaggcgatccgtgagcgcggcacgctgaggctcggggccagtgcggaggccgtgccgccgctcggcttctacgccaccgacgacaggacgcggatcggctccgagatcgacatcgccacgctcgtcgccgacaccctcggcctgaaaccggagttcgaacaggtctcctgggagaacctcttcgtcggcctggacagctccaagttcgacggggtcctctccaacgtcaccgtgaccgaggagcgcaaggagaagtacgacttcgcgacctaccggctcgacaacatcgccttcgaggccaagaagggctccggctggaaggtgaaggagcccgccgacgtcgcggggaagacgatctcggtctcctccggcaccaaccaggagaagatcctcgtggagtggagcgagaagaacgtcgaggccgggcgtgagcccgtggacatcaagtacttccagaaggacaccgactactacctggccctccagtccggccgtatcgacgcccatctcggcccgagccccgtcgccgcgtaccacgtcgcctcggccggccagtccgagatcgtcggccagctctccggcgccggcggcggcctccagggcaagatcgccgccaccacgaagaagggcagcggtctggtcgaggcgtacgccgccgcgatcgaccacatcgtgcgggacggctcgtacggcaaggtcctggagcgctggggactcagcggcgaggccgtggagaagtcggagatcaacccgcccggcctgccgaagacgaagagctgacgaggaggcccaccggtcccgccaccccggccgcgcgcccctcccggcgcgctgccggtgagcggccgccgcgcagccccgaccgaccgtcgacccgagaggtccccgcatgtccgcacgcacatccctccatctggccgccgagatcggcggcccgccgcactacgacgccgggcactacctccggctcgcccggctcgccgaggacggcgcgctcgactacgtcaccctcggcgactcgttcgcccgccccggactcgacgcgctcgccgtcctcgcccgcgtcgcgcccgccaccgaccgcatcggcctcgtcccgaccctcacgaccacccacaccgagcccttccacgtctcctcggccgtcgccaccctggactgggtgagccggggccgcgccggctggagcgcggacgtctccaccaccgaggcggaggcacggctcttcggacgccgccgggcggcgccggccgaggagctgtggcaggaggccggagaagtggccgacgtctccgggcggctgtgggacagctgggaggacgacgccgagatccgggacacggcaaccggccgcttcatcgaccgggacaaactgcactacgtcgacttccgcggctccaccttcaccgtgaagggccccgcgatcgtgccgcgcccgccacagggccgccccgtcaccgtcatcgacgccagtaccggcccggcccgcgaggcggccgcccggcacgccgacgtcgtccacatccgggccaccacccccgagcaggcggccgccgtccgcgacgaggtacgggccaaggccgcctcccacgggcgcgaccccggagccctgcgggtcctggtcgcgctgaccgtcgacctcggcgagctggagaccgcgccggaacccggtctggagagcggaccgcggctcgccgggcacggcacctacttccggggcggcccggtcgacctcgccgacctcatcgcccagtggtaccgggcaggagcggccgacggcttccacctcacgcccatcacccccgaacgcgacctcgaaaggatcgtcaacggcaccgtggccctcctccagcaccgcagcctcttccgaaccttccaccccggcggcactctgcgcgaacacctggggctcgtgcgccccgcgagccggtacgccgccgccaggaccacagcgaaggaggtctgaccgtgccccgtccgatgcacctcgccgcccacttccccggcgtcaacaacaccaccgtgtgggccgatccccgctcccgcagccagatcgacttctcctccttcgagcagctggcccggacggcggagcgggggaagttcgacttcttcttcctcgccgaagggctgcggctgcgcgagcacaacggccgcgtccacgacctcgacgtggtcggccggcccgaatcgctgaccctgctgaacgcgctggccgccgtcaccgaccggctcggcctcgccgccaccgtcaacgccaccttcaacgagccgtacgaactcgcccgccggctcgccaccctcgaccacctcagcgcgggccgcgccgcctggaacgtggtgacctcctccgacgccttcaccggggagaacttccgccggggcggctatctggaccgggccgaccggtacacccgggccgccgagttcgtcgccaccgctcgcgagctgtgggactcctggacgcccgacggcgcgtcacggcccttcgcgcacgagggaccgcagttcacgatctccggcgagttcaccgtcccgcgctcgccgcagggccatccggtggtcatccaggccggggactccgacgagggccgggagttcgccgcctccgccgccgacgtcgtcttcacccggcacggcaccctggaggcgggccgcaccttctacgccgacgtcaaggcgcggctcgcggcgtacggcagggagcccgccgacctgaagatcatgcccggcgtcaccgtggtgaccggcgacaccgacgcggaggcgcaggagcgcgccgccgggatccgccggcagcaggtctcgccgcagaacgcgatcctcaccgccgaacagatctggggcgccgacctctccgcgtacgaccccgacggaccgctccccgacatcgaccccgtccccgactccgagatcacccagggcagggtccgccatggggaccccttcgcgaccgtcgcccgctggcgcgctatctccgaggccaagggactgtccctccggcagacggtcatcgagacgaccacccggcagtcgttcatcggctcgccccggaccgtcgcggcggagctgacctcgttcgtcgacgaacgggccgccgacggtttcatcctcgtcccccatctcaccccgagcggcctggacgacttcgtcgaccgggtcgtcccgctcctccaggagagcggagcgttccgctccgaatacaccggctccacgctgcggtcgcacctcggcctgccggagccggtatggaaaggttgaccgcatgagcacggacgcacagcagcaggagcagggcggcgggccggacgccgcacaggactggcagcgttggcacgaaggccgcgtcgtcgccgtcgccgccccgtacggccccctctccctgaccggaacccactggctctcggattacccggaagggcgaattccggccgtcccgggacactggcgcgagaacggcgacgaggtggtcctcacggccgccgccgaggacggcatcgtcgtcgacggcaagccgctgaccggcgaggtcgtgctcggcgcggaccgcggtccgatcgacgactcccgggtggcgcagggggagcggcggctggtggtgctccgccgtgaaggactgtgggcggtacgggacttcgacccgggatcaccggcccggcacgccttctcgaccatcgaggccaccccgtacgacccccgctggagactgccggggaccttccgtcgctacggcggagaccggaccgtgcaggtggtcaacgcggacggggtcgagcgcggtctcgggctcggcggcgagatcgccttcacggtggacggcgacgagcacacactccaggtcgcggtcgagcccgacgggtcgctgtgggccgtcttcgccgacgcgaccagcggaaacggcagctaccgcttccgtttcctgcggcccggcgcgcctgccgccgacggcagcgtgagcgtcgacttcaaccgcgcgctgctgccgccgtgcgccttcgccgatcacttcatctgccccttcccacccccgggcaacacgctctccgtggcggtcccggcgggagagcggaaccggatcgacgcctgatcgcgagaggtccctccggccccggcagccccacggctcccggggccggaggcgtaagtgacccgcgtggccgaaaggcattcttgcgccccctgtccggccccctcgatactccggtcagcgattgtcaggggcacggcaactccggaatccggacaggcccccgactgcgcctcacgggcccgccaccccacaggagggcccccgattcccctcggaggaacccgacgtgaggatcaagcgcaccagcaaccgctcgaacgcggcgagacgcgttcgtaccacggccgtactcgcggggctcgccgccgtcgcggcgatggccatccccaccgcgaacgccgaaaccccccggacgttcagcgccaaccagctgaccgcggcgagcgacgccgtgctcggcgccgatatcgcgggcaccgcctggaacatcgacccgcagtccgaccgcctcgtcgtcaccgtcgacagcacggtctcgaaggcggagatcaaccagatcaagaagtcggcgggcgccaacgccgacgcgctgcgcatcgagcgcacccccgggaagttcaccaagctgatctccggcggtgacgccatctactccagcaccggacgctgctccctcggcttcaacgtccgcagcggcaccacctactacttcctgaccgccggccactgcacggacggcgcgaccacctggtggtcgaactcggcccgcaccaccgtgctcggcacgacctccgggtcgagcttcccgaacaacgactacggcatcgtgcgctacaccaacaccaccatccccaaggacggcacggtcggcggccaggacatcaccagcgccgccaacgccaccaacggcatggccgtcacccgccgcggctccaccaccggcacccacagcggttcggtcaccggactcaacgccaccgtcaactacgggggcggcgacgtcgtctacggcatgatccgcaccaacgtgtgcgccgagcccggcgactccggcggtccgctctactccggcacccgggcgatcggtctcacctccggcggcagcggcaactgctcctccggcggaacgaccttcttccagccggtgaccgaggcactgagcgcgtacggcgtcagcgtgtactgacccgtcggcgtgtactgaccggtcccgccccggccgggtacggagcagtccgtacatacgtgcccccgtccggaattccggacgggggc

SEQ ID NO: 2996 - DNA, 1377 bp, Unknown
  Kingdom: Bacteria, Phylum: Actinobacteria, Class: Actinobacteria, Order: Streptomycetales, Family: Streptomycetaceae, Genus: Streptomyces
cggtgggcgctgcccggcggcttcgtcaggatggacgaggacctgggggccgcggcagcgcgtgaactcgtcgaggaaaccggcctctgcgcgcacgacccggcgaaaccggccgtgggcaacggagcgcatctggagcagttggccacgtacggagatccggcgcgcgacccccggatgcgggtggtcagcgtcgctcacctcgccctcgcgccggacctgcccgcgcctcgggcgggcggcgacgccaacagcgcgcgctgggcgccggtcgaggatctgctgcaccccggcgccgggcgggagggggagcaggcggcgccactggccttcgaccatgcgcggatcctggccgacggagtggagcgtgcccgctccaagatcgagtactcctcgctggccacggcgttctgcccgccggaattcacggtcggcgagctgcgccgggtgtacgaggcggtgtggggagtggtcctcgacccccgcaacttccaccgcaaggtcaccggaacgcccggattcctggtgccttccggcgggacgaccacgcgacagggcggccggcccgcgcagttgttccgggccggggcggccacggtgctcaatccgccgatgctacgacccgaggtctgattcacggggcgttccgctgcgatggccccgcggaacgcctgtcggcccacccctgcaccaaaagtctgaaatgtcgcgttatgttgctgcggtaccccctgccgccgagcggtctcaccttccgcgagagacgcgagagaagcgatgctccaggccatcggactcaccagtaccccccgtcgcgacgctccgcccgccgtgaacgatctgaccttcgaggctccccccggccgtgtcacggccctcctgggcgccccgcgatcgggcaagaccacggccctgcgcgccgtcgccgggttcgtccggcccgcctccgggcgggtgttcctcggcggccgggacgtcaccgccctgcccccgcaccggcgcggcatcggcatggtcgtccagagttacgccctcttcccgcacctcaaggtcaaggacaacgtggccttcgggctcaaggcccaccgcaccccgaaggccgggattcccggccgggtcaccgaggccctcgaactcgtcggcatggccgcgtacgcggagcgccacccgcgcgaactctccggcggccagcagcagcgcgtcgccatcgcccgcgcgctcgccatccgccccggcgtcctgctcctcgacgaaccgctctccgccctcgacgcccggctccgctccgggatgctcgccgaactggcccggctgcaccgcgagctgccggacgtctccatcctgtacgtcacccacgaccaggtcgaggccctcacc

SEQ ID NO: 2997 - DNA, 13692 bp, Unknown
  Kingdom: Bacteria, Phylum: Actinobacteria, Class: Actinobacteria, Order: Streptomycetales, Family: Streptomycetaceae, Genus: Streptomyces
gtgccggccggcgcgggttcactgtcgggcgccgccttcgcggcacgcgcgccggggtggctggctccggagctcggcgggacccgggtcacgcgctgacggggcgcaccgggggcgttcgggcagtcctcggggattcccgccggggtgatccgggggagaatcgtggaggaacgtcacgtccgctcctcaagcgtcacgtccactcctcaacggaggtccgtcatgcagctgcgcagcaggaagctcccccgggacgccgtgcaccacccggtcttcgcccgcttctacgcacgggtgagcgtgaccgccgacctgaagggcggcatcgccgcgtaccgcgaggagctgctgtcggggctctccggccgggtcatcgagatcggcgccgggaacgggctgaacttcccccactaccccggcgcggtctcggaggtggtggcgctggagccggaacgctcgctgcggcagctcgcggtccgctccgccctgcgtgccgaggtgccggtggacgtggtgccgggggccgccgaggcgctgccgctcaagagcgaggccttcgacggggccgtggcgtccctggtcctgtgcaccgtacgggatctgccccgggcgctcgccgagatcaggcgggtcctgcggccgggcggcgaactgcggttcttcgaacacgggccggcgccgggccgggcactggccacggcgcagcgggtggccgaccggaccttgtggccgctgctcttcggcggctgtcacacggcccgggatccgttggccgcgatcgcggcggcgggcttcgagatgggcacgtaccgcaggctgcggatcccggagacaggcctccaagtgccctcctccccctgcgtcctgggcgtggcgcgcaagccgttcaccgaggactgagcgctggggcgggggtgtttcgtccggcctcacacgctccactgccgcagctcgtcggcgatggcccgcacgtccgccttgccctgcttcaccagcagcgccagatcgcgaacctgctcgggcgaggtgatgaccttgagcccggaggcgacgaggtagccgtacgcgacggccgaggcgaacatcgcgttggagtgttccagtgcgggcacatgcagcagcagctgcaacagggcggccgcccgcgcgtgggggtcgctgtagacggtgctgccgaagatctccgcgtcgtgccgtgcgacggcggcgacgagcgcaccccagtcgacgacctgcgggtctccgggcgtcttgtgctcggcgaccatcagcaaccaggaaaggtcgatgcgaaggttcaacgggtgccttcgcgctccgggccgaactcctcggcgaacaccgactcgtactgcttcatgaagtcggccgcggcctcgacgaaggtgtgtcccacctcgcccgcgtcctgctggacgagttcctctatgtagcggttcacgctcatccccctctgcagcgcgcgctgccgcgcggcctcggcggtggcctcgtccactcgaacgttcagctgagtcttgggcacccgaccacgctagcgcggccgtgctagtaccggcaagaggaggggtcggccgccggtgaaatgcgatcgacgccccgtcgccgcggatggtgggatggccgtcatgaacgatctttcgatacggtccgcgaccccggccgatctggacgaggtcctcgcattctggaaggtggccgccgagggcaccagcatcagtgacgacgggaacggggtcgcacgcctggtggaacgggaccccgacgccttgatcctcgcggaacggcagggcgcgctggtgggcaccgtcatcgtgggcttcgacggctggcgctgccatctctaccggctcgcggtccacccggaccagcggcgccggggtgtgggcggcgccctcctggcggcggccgaggaacggttcgtcgcgctgggcgggcggcgcgccgacgccatggtcctcgaccgcaacacgtcggcccaccacgcctggcgcgcggcgggctacgatccccagccgcagtggagccgctgggtgaagcacctgacgggctgaggagtacgccggacacgcacgcggcaggacaggtaccgaccggtggagcgggtaccggcgcggtgcggcggacattgacgcggtgggcggagcgctgctgggcagacgccctacgatgacatgcccctccgcccccttgccgaaaggtgtgagcgtccgcccatgggcgagcctcccagcagccgtttccgccgacaccgcgcggtccccccgcccctgcccgatcatgggacggaggtgaaccgatgatcgaagtgcttctgctgctcgccgccctgctgctctgcgtcgcctgcggcgcgttcgtcgctgcggagttctccctgaccacggtggagcgcggcgagctcgaacgggccgtcgagcggggcgaacggggtgccgcgagcgcgctcaaggccgtccggagcctcaccttccagctctcgggggcccagctcggcatcaccgtcaccaatctggtgatcggcatgctctccgaaccctccatcgccaagctgatccgcggccccgtcgaggcggcggggctgccacccgccgcggcgtccaccctggcgctcgtcctcggtacggcgctgtccacggtggtgctgatggtggtcggcgaactggtcccgaagaactgggcgatctcctccccgctggccgtggccaaggcggtggccacaccgcaacgagggttcaccgcgttgttccggcccttcatcagccacctcaacaacacggccaaccggatcgtgcgccgcttcggtctggaaccgaccgaggagctggcctccgcccgcagcccgcaggagctggtggcgctggcccggcactccgcgaaggaaggtgcgctggaggcggacacggccgaactgttcgtccgcacgctgaacctctcggaactgaccgcggagaacgtgatgacgccgcgggtgcaggtgaccgcgctggagctgcacgcgacggccgaggacgtcgccaacgcgacgcgggcgaccggcctgtcccgcttccccgtctaccggggcagcctggacaccgtggtcggcgtggcccacatcaaggacgtcctggcgatccccgccgaccggcggccccgcacccgggtatcggaactgctgcgcgagcccctgctcgtgccggagacgctcaccgttgaccggctgctggaccggttgtccggaaggctcgccatggccgtggtgatcgacgagtacggcgggacggccggggtcgcgacgctggaggacatcgtggaggaagtcgtcggcgaggtccgggacgagcacgatccgcacgagacgccggacctcgccgccgccggcgaggacgccgacgggcggaccctgtggtcggccgacggcgcggcgcgcaccgaccagctccgcaggatcggtctgcgggtgcccgacgggccctacgagaccctcgcggggctgatcgccgcagagatcggacggatcccgacggtggacgacagcgtcgagctggaggggtggcggatcgacgtggtcgacgcctcgggccgccgtgccgcgcgggccctgctgcacgccccgctgccgggggccgaggaccggacggaggacgaacggtgatcgttctccagctcttcatcggcctgctgaccctcgtggccaacgccttcttcgtgggcgccgaattcgccctgatctccgtgcgccgcagccagatcgaaccggaggccgaggccgggaaccggcgggcgcgccgtgtcatctggggcctggaacacgtctccgcgctgctcgccgccgctcagctcggcatcacgctctgcaccctggtgctcggcatcgtcgccgaaccggccatcgcgcatctgctggaaccggccttcgacgcggtgggggtgccgcacgggctgatccacccgctgtcgttcgtcatcgcgctgggcgtggcgacctatctgcacatgctcctgggcgagatggtgccgaagaacatcgcactggccgaaccggcgcggagcgccctgctgctgggccccccgctggtggcgatggcccgtgccctgcggccggtgatcttcgcgatcaacgcgttcgccaacaccctgctcaagctgttgcgggtggagacgaaggacgaggtctccgcgacgttctcggacgacgaactggcccggctggtccaggacgccggggacgccggactggtcgacgaccgctccgcgcaacgcctccaccacgctctggagctgggccgccggccggtacgggacgtggtcatgccggtcgaccgggtgctgtacgccagggtcggcaccactccggaggagctggagcggctctcgtccgagtccggcttctcccgcttcccggtgatggacagcgagcagcgcatcctcggctacctccatgtgaaggacgccctggacgcgacgccccgggacgtccccttcccggtgacggcgatgcggccgatcgcccgcgtccgggcggcgactccgctggacgacgtgctcaccgctctccggcgcagccggacccatctggcggccgttctcgacgaggacggccggctggccggcatggtcacgatggaggacgtgctccgcgaactcgtcggacggccacagtcccgctgacctgccggcacgctgacccgcgtcctgccccccggcccgctcggcgggcgggccggggggcttcacggtaggatcgccgggccatggaattgaatgcctcctacaccagtctcgtcgcggtgggcgactcgttcaccgagggcatgtcggacctgctcgccgacggcacgtaccgggggtgggccgacgtcctcgcctcccggctggcgacccgggtcgccggcgaccggtccgccgacgaccgttcgcccggtttccggtacgccaacctcgccgtacgcgggaagctcatcggccagatcgtcgacgagcaggtggacgcggcggtcgcgctccaggccgatgtggtgacgctcgtcggcggactcaacgacaccttgcggccgaagtgcgacatgggcatggtcaagggccgactggaggaggccgtggagcgcctggccccctcctgcgagcaactcgtcctgatgcgcagccccgcccgcaacggaccggtgctcgaacggttccggccccgcatggaagagctgttcaccctgatcgacgacctggccgcccggcacggagccactgtggtcgatctctacagcgcaccgtcgctcagcgatccccgcatgtgggacgtggaccggctgcacctgaccgccgagggacaccggcgcgtcgccgaggcggtctggcagacgctgggacttccggccgagctcgactggtggacgccggtccccgcgaccgcgccgccacgttgggcgtcccgccggaccgaggacatccgcttcgcccgccggcacctggccccgtggatcggacgacggctcaccggccgctcctccggcgacggacgctccggtgcgcagttcgacgccgcgacgggcggggccttctggatcacgcccgcggacgccgagacccctggcccggtgacgggatggcaccgcgccgtctcccccgacgccgcggtgcgcaccgccgaagccgactgagctcacgacggcgaccgggccttcccggcctttcgtagcaagccacaaacaagggcgcgtcgctggcctgcacaaaccgccagtagaatccctttacgtgactgctgtgtctgcgaagcctcgcatccccaatgtcctggccggccgctacgcctccgcggagctggccgtcctctggtcccccgagcagaaggtgaagctggagcgtcagctgtggctggcggtgctgcgcgctcagaaggacctcgggatcgaggtgcccgatgcggcgctggccgactacgagcgtgtgctggaccaggtggacctggcctcgatcgccgagcgcgagaagatcacccggcatgacgtgaaggcccggatcgaggagttcaacgccctcgccggtcatgagcaggtccacaagggcatgacctcccgcgacctgacggagaacgtcgagcagcttcagatccgcctttcgctggagctgatgcgcgaccgcaccgtggccgtactggcccggctcggcaagctcgccgcggagtaccgcgagctcgtcatcgccggacgctcgcacaatgtcgccgcgcaggcgacgacgctgggcaagcgcttcgcgaccgcggccgacgaactgctggtcgcccacggccgcctggaggaccttctctcccgctacccgctgcggggaatcaagggaccggtcggcacggcgcaggacatgctggacctgctcggcggcgacacgggcaagctcgccgatctggaacaacgcatcgccggacatctcggcttcgccgaggcgttcacctctgtcggtcaggtctacccccgatcgctcgactacgacgtggtcaccgctctggtgcagctcgccgcggcgccctcctcggtggcgaagaccatccggctgatggccggccacgagctggtgaccgagggcttcaagcccggccaggtcggctcgtccgcgatgccgcacaagatgaacacgcgctcctgcgagcgggtgaacggtctgatggtgatcctgcgcggctacgcctcgatgaccggtgagctggcgggcgaccagtggaacgagggcgacgtgtcctgttccgtggtccgccgggtggcgctcccggacgcgttcttcgcgttcgacggcctcctggagaccttcctgaccgtgctggacgagttcggcgcgttccccgcggtcgtggcgcgcgagctggaccgctaccttccgttcctggccaccaccaaggtcctgatgggtgccgtacgcgccggggtgggccgcgaggtggcgcacgaggcgatcaaggagaacgcggtcgccgccgccctcgcgatgcgggagcagggcgccgagcgcaacgagctgctcgacaagctcgccgcggacgagcggatcccgctggaccgcgcgcagttggacgagctgatggccgacaagctctcgttcacgggtgccgccggcgaccaggtgtcgtcgctggtcgcccggatcgaggagatcaccaagcagtaccccgaggccgcgaactacactcccggctcgatcctctgaccggcaccgcccgcaccgcatgacccccgaagagctgagcgccgcccgtgaccgcctcgtccccgatgtggccgcgggcggtctgcgcgtgctcttctgcggtatcaacccgagcctgatgaccgcggcgacgggccaccatttcgctcaccccggaaaccggttctggccggtcctgcaccgctcgggtttcacaccccggcagctgcgtccgtcggagcaggccgagctgctcggtctcggactcggcatcaccaacgtggtggcgcgggccacggcccgggccgacgaactcggcgcggaggagttccgggagggtggggccgcgctgacggcgaaggtcgaactgctcgctccgcagtggctcgcggtggtcggcatcaccgcctaccgcaccgccttcggggagccccgggcccggatcggcccccaggaccgcacggtcggcggcgcccgtgtgtgggttctccccaaccccagcggcctcaacgcccactggacggtccagagcatggccgatgagtacgcccgcctccgggacgccgtcctcacccggcccccgaccgaccggcccgctcccggccccggctctacagactgagccgctccggcccgcgctcctcgccaggcctcacgcgtcccggttgcggaccacacaacggcccgcctggatcgctgaagacccatgtcagctcggtcccggcgaagttggggccaggggtcgcacccgggcggtcattgccgcacatgagtccgggttcgtcgctccggggtgaccgaggttgcggctcgataccggcttccctcgctggtcgcagggctcccggccagcgagtacgatccggctgacatgcgcacgagctgggaggacataccgtgggccggctgaccggtggggacccgtcgctgttgcgacggatcaattccgcggtagttctgcacgccctgagaggggccggcgcgccgacgctgacggacctgacgcggatcacggggctgtcccggccgacggtcgaaggggtcgtcgaggggctgttcgaagcgggtctcgtggtcgaggccctgcccgacgagagcgaggcgcggcgtcaggggcgccctgcccggaggttccgtttccgggccgaggcggggcacctcctcggggtggagatcggtccgcaccgggtgtcggcgctcatctcgggtctcgacggccggatcgtcggagcgggctcccgcacggtgtcggagaccgccggcgcggacgaccggctcgaccaggtccgggccgtcatcgcggacgtactgcgacgcaccggggtggcccggagcagcctgcgtgcggtcggtgtggggagtcccggaatcgtggaggccgacggcaccgtgcggctgggtacggcgttgccggactggaccggcctcgcgctcggggagcggcttcgccgttcgttccgctgcccggtactcgtcgagaacgacgccaacgccgccgcggtggccgagcactggaagggtgcggccaccgagtccgacgacgtggtcttcgtgctggcggggctgagccccggagcggggtccttgatcggcgggcgtctgcaccgggggttcggcggggccgccggggagatcggcgctctgcacctgctgggcagggacgtgacgccggagcatctgctgtcgacgacggacacgccactggacccgctggacgagcttgcggtggcggcggtgttcgccaaggcccgggaaggcgatgcgggggcccgggcggcggtcgagcgattcctgcagcggctggtgcacgatgtggcggcgctggtgctggcgctcgacccggagctggtcgtggtcggtggctgggccgccggactggacggggtgctggaaccgctgcgcagagagctggcccgctactgcctgcgcccgccccgggtgaccctgtcgctgctcggcgaggccgccgtggcgacgggggcgttgcggctcgccctggaccacgtcgaggagcagttgttcgccgtcgagggagccgtgacggcccgccgctgaccgcggtaggggccggcacacggaccgcgtgcgcgtgggtggatcaccggcgctgtcccccggagccggctcgggcgggaacgcgcgcgcccgccgcttcccgggagcgaagtccctgagaagtggcgggcgtggggccgagcgggccggaggtgtcaggaggcctggcgcggctgctcgtcgtggctgatctccagcgcgccggagtccccgaaggtgagccggcaggtgtccgcgcggtaggtggcgacggacacggccgccgtaccgtccgcggtgaagtagcgggtggtgacgacgaggacgggggcgccggggagccggtccagttccttggcgtcgtccgcccgcgccgaaccgagctccaccgagcggtcctggccctgcaggccgagccggtgcagctcgcgcagcacgctccgggcgcggacggcgccggacgcggcttcgatggcggagaggtcgggcaccgaggaggcggggacgtagaggagttccgccgctaccgcctgcccctgggtgtcacggatacggcgcaccacgtgcaccggttcggcggggttcgctccgagcatgacggccaccgccgccggggccttgcccatggtgctgtcgaccggctgccaggcctcgccgctgacgccgcccgtccattcgtgctgggcggtggagacggcgatgcccacgcgcggcggagcgacggtcgtcccgacaccacggcggcgctgcagtctgccttcgagttcgagctgctccagggcctgccggagcgtggctcgcgcgacaccgaaccgcgccgcgaggtcccgctcattgggcaggatctcccccaccgcaaagtccgagtcgagtgcctcactgagcacggtcttgaggtgccagtacttcggctcctgtaccgattccagctgcgtggtccccaccctgtcctccgcaatcgcccagcgtcttttccgcgacgttatttattaaaggttcctgccttaagtggagacactaggacggcatacccccttggtcaagaccaatcctcatgcgtaacggaacgaaacgggactctggcgcagagcgttcacacgacgttcgtggcgccgtgcggcgagcgcagcacaaagccccgtcatcagtgcggatgacggggctttgaccaggcctgcggcggacctgtggggtgctgggggccgaggtggccggtggtgcttctgactatacggcgggcagcccggaaagcttgtccggattacgaatgatataggcgcattggataacgccttggccgacttcgatctggaagacggtgtcggccttcccaccgacgaagtagacggcggcgggcccgccgttgagctccatgatgcggatctccccgtcggggccgagttcccccgccaccgcgaagaggaagcggccgaccttgtcggcggtctcgatgatccgccgcggcgccttcgccttgccaccgctgtcgctgaccagccggacgtccggtgccagcagtgcgagcagttgctcgatgccgcccccggaggcggcggccaggaagcgctcggtgagatcgcggcgctcggccgggtccacgtcgtagcgcggcttgcgctcctccacatgccgcctggcacggccggcgagctgccggacggcgtcctcggtgcggtccagggcgttggcgatctcggcgtacgggaacccgaaggcctcccggagcacgaacaccgcgcgctccagcggcgagagcgattcgaggacgaccagaacggcgagcgatacggaatcggcgaggacggcacgctccgcggtgtcgtgcaccgcgggtccgaattccgtgaccaccggctccggcaaccagggcccggtgtacgactcccggcgtgaccgcaggtgccggagccggtcgatggccagccgggtggtgatccgcaccaggaaggccctcggctcccggacgtcctcgcgcgccgccgccgaccacctcagccatgcctcctggaccacgtcctcggcatcggcgacgcggccgagcatgcgataggcgacaccggtgagaacgggccggtgttcttcgaagagctcggtcgcggcgtcgacggtcatcggtccatcccagcccaccggtcacgcgctgtccagcgggaatcgccaagccccttgaactacaagctacccggcggtaattgttgttgacgatatgtctacccactccagggagcagcagcatgacgaccacggcctccttcaccgtcgcaacggccgacggcccccggccggtccgggtcgcgtacgaacggaccggctcgggcgcaccgttgctgctcctgcacggcatcgggcaccatctgagggcctgggacccggtgacacggatcctggccgccgagcgtgaggtcatagccgtggacctgcccggcttcggcagctcgcccgcgctgccggacggagttccctacgatctcgcgaccgtcggccgggtactcggagccttctgtgccgaactcggcctggaccgcccgcatgtggccgggaactcgctgggcggcctgctcgcgctggaactgggccgcaccgagctggtgcggtcggtgaccgcactgtccccggcgggcttctggaccgaggcggagcggcgctacgccttcggcaccctgtggacgatgcgccggagcgcgctggccctgccggtgccgctgatcgagcgcctgtcgcgcagcgcggccggccgggcggtcctcaccagcaccatctacgcccggcccggcaggcgttcaccggaggccgtcgtcgccgagacgctcgccctgcgtggagcgaccggcttccaccagacgctggagtccggcaggggcctgctcttcggcgatgacgtgaagggcgtccccgtctccgtcgcctggggcacccgcgaccggatactgctgcgcaggcagggtgtccgcgccaagcgggtgatccccgacgcccggctcgtgcggctgcccgggtgcgggcacgtcccgatgaacgacgacccggcgctcgtggcccgcgtcattctggacaccagccgctgagccggcccgtcggggcgccgtcgccccgacgggcagtcgcgctacggcggcgccgcgccgcccgaagacgccggaaccgtacgccacacccgcaccgaccaggagactccccacgccctgtgcgaggccgtacgtcccggctccgaccagaggtgcggtcagggcggcggagaccgggatcaggccggagaagagcgtggcgcgttcggctccgatgcgctgcatcccgctgtaccagcagacgaatccgatcacggtgacgacggcggcctgccacagcagggccgccgcctcgccgcccgtcgggatgcgcaggaacgatccgccgtccatcagcagaccgagcagggccgactcgacggccgcgacgccacagaccgtcgcggagagcagcttcgggccgagcggccgcagcaccggaacggcgagaaccgcgaagccgacctcacccgcgagcgcgcctaccgagaacagcacgcccgccaggtcggtgcgcccccagccctgaacggtgaacgccccgacggcgacgagtccggccgcgtacagcgtggtgcgggacggtcggcggccgtccaacagcgggacgagcacgccgaccacgatcggcgcacaccccacgaagacgccgggaacagctggttccgccgactgttcggcagccaggaccgccaggttgaacccgaccatgcccacggcggcgagcaacgcgagccgcccccactggcggcgggtgagccgacggagccgcgccgtcgaggaatcggggtcgcgccgcaggagcgggacgagcaggagcgcggcgagaccgtagcggagcgcctggccgcccgcgaacgggtagtcgccgaggacgctgttggccgtgaaggatgcccccaccagcacgcacgcgagggccgcgaggagagccccgcgcagagaggttgcgttcatggggtcgacgctagggtcggcgacggacccgtttaaggtccacttccatgacgtcttcggggaccaattcacatcgtccgtcggcggaatccctctctccggcgtgggagttgctgctgccggccgctgccgcgccggcgcgcggacgggggcgcgcactccggtccgcactgcgggaagcggtccgctccggccgcctcgcggccggtacgaggctgccgtcgagccgtgagctcgcggctgatctgggcgtgtcgcgcggactggtcaccgaggcgtacgagcagctcaccgcggagagctatctgcgcagcggccaaggtgcgggtacctgggtgagcgagggcgtacgcgcggcggagcgtccggtacgcgaccgcgcgccgcgcgcggccggcgcactggtggacttccggcccggcacccccgacctttccctcttcccgcgcagcgcgtggagtgccgcccagcggacggtgttcggccggctgccgcacgg

SEQ ID NO: 2998 - DNA, 11406 bp, Unknown
  Kingdom: Bacteria, Phylum: Actinobacteria, Class: Actinobacteria, Order: Streptomycetales, Family: Streptomycetaceae, Genus: Streptomyces
ttcctgcgggccgacgcggtccttggacggctcgatgatccgtaccgcgtcggcccgcaggaagcgggagtccgtgtcgccgtcggtgaccttggcgatgatcttctcgccggggagcgtgtggcgtacgaagagcacctggttctcggcggtgcgggcgatgcagtggccgccgtgcgcgacgggcccgacctcgacctcgtactcctccccgaccagcgaagacgtgggttcgttctgcatgaggggaggctccagggagaaagggggtaaacggtcgggcccgcggccggacgacagcccaccagtctacgcggacggggtcggggtgcttaccacgaccggccccgccgcctcgcgtcttccggacgggctcgtgacgcccgcacgtcaccgtcccggaccgtcgcccatggggagcgacctcagcccttgcggttggactccttgcggtgcggctccttgtgcccccgttccaccggaccgcggcggaccgaacccggagcgctccagtcggcgcgcttgcgggcccgcttcttcgccgcctcggaggactggagctggtacgggacagaggtcaccatgacgccgggtgtgaagagcagacgacccttcaggcgcagggcgctctggttgtgcaggaggtgctcgtaccagtggccgaccacgtactcggggatgtagacgctgatcacgtcgcgcgggctctgacggcgcaggctcttcacgtactcgatgaccgggcgggtcacctcgcggtagggcgagtcgaggatcttgaggggaacgttgatggcgcgccgttcccagtcctcgcgcagcgccttcgtctcgtccgggtcgacgctgatggagagcgcctccaggtggtcggcgcggatcagctgggcgtaggcgagcgcgcgcagcgtggggcggtgcagcttggagacgaggacgatggcgtggacgcgggagggccgcacgctctcgtccgcgggtgtctcgtcggcggcgatctcggcggcgacccggtcgtagtgcttccggatcgcggtcatcgtgccgtagaagatgaccatgccgagcagggccacccaggcgccgtgggtgaacttggtggcgaggacgatcactaggaccatgccgcagaagaaggcgccgaaggcgttgatggcgcgggagcggaccatgtggcggcgcttggcctgatcccgttcgtcgcccagcaggcggttccagtgccgcaccatgccggtctggctgagggtgaaggagacgaacaccccgacgatgtagagctggatcaaccgcgtggagtcggcgccgtagatccagacgagcaggatcgcggcgcccgccagcagcacgatgccgttggagaacgcgaggcggtcgccgcgcgtgtgcagttggcgcggcaggtagcggtcctgggcgaggatcgagccgagcagcgggaagccgttgtacgcggtgttcgcggcgaggaagagcaccagggcggtggcggccgcgaggaccatgaagaggaaggaaccgtggccgaagaccgcctcggcgacctgggcgatgaccgggtcctgggtgaagtccgcgccgaccgggacgccgtcgcggatcaggtcggccgccgggttctcggccatcttgacgtcggtggccagggccaggccgatgatgccgcagaacatggtgacggcgagcaggcccatcatggcgagcgtggtcgcggcgttcttgctcttcggcttgcggaaggcgggcaccccgttgctgatcgcctcgaccccggtgagggcggcgcagccggaggagaaggcccgcaggaggaggaagacgagcgcgaagccggccagccctccgtgttcgggcttgatctccaggtcggaggtgggggcgtgcatcgcgtcgccgaggaccactccccggaacgcgccccacaggatcatgaggaagacgccggccacgaaaaggtaggtgggaatggcgaagagcttcccggactccttgacgccacgcaggttcatcagggtgagcaggacgatggcgccgatggcgcagagcgtcttgtgctcgatgacgaacgggatcgcggagccgaggttctcgacgccggaggagatcgacacggcgacggtgaggacgtagtcgacgagcagggcgctggcgacggtcagtccggacttggggccgaggttggtggtcgcgacctcgtagtcgccgccgccgctcgggtaggcgcggacgttctgccggtaggaggcgacgaccgtgaacatgaggacgacgacagcgacggcgatccaggggctgaagtggtacgccgacacccccgcgatggacagcacgaggaggacttctccgggtgcgtacgccaccgaggacaacgggtcggacgcgaagacggggagcgcgatgcgcttggggagaagggtctccccgagtttgtcgctacgcagcgcccggccgatcaggatccgtttgggcaggtcggtcagtttggacacgctgaggatcgtaagcggagcccgtggccggaacgcacaccctttcgacgtggccccgcaatctcctgcggtcggcggagaacgtccccctattccttaacgcaatccttgcgctcgttcggcctattttgctttccctttgccggagtacgcgaagatgcggacactcggatgagggattgaccaccccggcgcttaagctcgtctccgggccgcgccgctggtgtgtgtcccgttgtttgcccagcaagctgagagagaagtgtgagcagcgtgttttcgcaggtcagccggatgaccaggacggcggggtaggcgcacagtgcacatcgtcatcatgggctgcgggcgcgtcggagccgctctcgcacagaccctggagcagcaggggcacaccgtcgcggtgatcgaccaggaccccacggcgttccgtcgcctcgggtccggattcggcggacgccgggtcaccggggtcggcttcgaccaggacaccctccgcgaggcgggcatcgaggacgccggggcgttcgcggcggtcagcagcggcgacaactcgaacatcatcgcggcccgggtggcccgggagatgttctccatcgagaacgtcgcggcgcggatctacgacccccggcgcgccgaggtctatcagcgcctcggcattcccaccgtggcgacggtccgctggacggcggaccagatgctgcgacgtctgctgccttcgggcgccgaacccctgtggcgcgatccgagcgggggtgtgcagctcgccgaggtgcacacgacgccgtcctggatcggccacaagatcagcacgctccaggaggagacgggcgttcgtgtcgccttcctcacgcggttgggcgaagccatactgccgagttcgcagaccgtcctccaggagggcgacctggtccacgtgatgatgcgtacggacgagatcgccaaggtcgaagaggccttcgcccagggtcccgaggaggacggtcactgatgcgtgtgtcgattgccggggcgggcgcggtgggccgttccatcgccgccgagctgctggagaacgggcacgaggtgctgctgatcgacaaggcgccgaccgccatctcggtggagcgggtcccgatggccgagtggctgctcgcggacgcctgtgagatcacgtcgctggacgaggcggcgctgcagcggtgcaacgtggtgatcgccgcgaccggggacgacaaggtcaacctggtcgtctcgctgctcgccaagaccgagtacggcgtgccccgtgtggtggcccgggtgaacaacccgaagaacgagtggctgttcaacgagtcctggggcgtggacgtggccgtctcgacgccgcgcctgatgtcggccctggtcgaggaggcggtgagcgtcggcgatctggtccggctgctgcgcttcagccacggcgacgccaacctggtggagctgaccctgccgccggagtcggcgctggccggtacccgtgtcggggacgtggcctggcccgaggacacctcgctggtgacgatcatccggggtacccgggtgctcacgccgagccccgaggagtccctggaggccggtgacgagctgctgttcgtggccgcccaggcgcgcgaggagcagttggaggacctcttgtcggtccggcgcgatccgtcggaggactgaccggcagaaccatgggaagggcccggaaccgctgagcggttccgggcccttcctccgcgatgccgggtgtacgggtcaggcgtccgggtcacggagtgccgcggcggcccgcgtcttgcgctccttgtcggcctgttcctcggcctccatctcggcgaagacgtcgatgggcgccggcgccttcgcgaggaagacccaggtcagatagaccgcgagcaggaacggcgggatcttcagcgcgatgagcacccagccgaactcggtggtgtcggcccaccagtagagcgggaagaggatcgcgcacttggcgagcaggatgaagccccaggcataactggccttggtgtacgccttcttccggcccgggttacgggtccgccaggagaggttctccttgaagaccgggccgaggatcaggccgatcagcggcaccccggccacggcggtgccgatataggcgaccgcgagacccagggtgtagagcatgcccggcaggtagaagtccttggcgtcgcccgtcatcttcgcgaagaggacgccgaaggccaccccgaagacaccgctgaaggcgtgcttgacggtgtcccggcggatcagccggacggcgacgagggccagggacaccgccagggccgcgatggccgaggcgttcaggttcttgttgatggtgaagatcgtgacgaaaagcagtccggggaggactgtctccaccatgccgcgcacgccgccgaaggcctcgaagagtgcggcctcggtgacggccttcgcctcgtcgtcctgctgggcggcgtgcctcccgccgccgtgctgcgggtcggtgcggtggggctggtccgtttcggacgtcggcttgtcgagagacgtcaccggctactccttggcgagcggtcggagttcgtatgtggggttgaacagcacccggcggccatggctcatggcgacccgccccgaggcaatgatcctgcggccgggctcgataccgacgatggaacgacggccgagccagaccacgtccagcggctcggtgccgtcgaagagctccgcctccagggcgggcactccggcccggggacggagggtgacggtccgcaacgtaccagccaccttcacgatctgccggtcggagcactcggagatccgggtgcagccggtggcctgcgcgtcctcctgcagctcctgggactccaggtcctgctgggaactggagagccggtcgagcatacggcggaagcgcccggaaggtctcgccgcctgcccggccttcccggctttctcggatcggggaacagcactcatacccgaagggtaccggtccttcggtctgtgcacggaggccctggaaaccactcgaaagggcgacccggagcccgtcagccgcgctcgaagcggtagcccatgcccggttcggtgacgaagtgccgggggtgcgaggggtccgcctccagcttgcggcgcagctgggccatgtagacccgcagatagttggtctcggtgccgtaggaaggaccccagacctcctggaggagctgcttctggctgaccaggcggccgccgttgcggacgaggacctccagcaggtgccattcggtgggggtgaggcgtacgtcgcggccggaccggtgcaccttcttcgccgccaggtcgacggtgaagccggccgtctcgacgagggcgatgtcctcggctccgccgtcctgaccgaccggttccgcccggcgtaccgaggcgcgcagccgggccagcagctcgtccatgccgaacggcttggtgacgtagtcgtccgccccgaggttgagtccgtggatgcgcgagcgcacgtccgcgcgggcggtgaccatgatcacgggggtcgcggtgcgtctgcggatcttcccgcacacctcgtagccgtcctggtcgggcaggcccaggtcgaggaggatcaccccgaagggctccttctcggcgggcagcagcgcgcgcaaggcttcctcgccgttgcgggcgtgcacgacctggaatccgtgccgggcgagcacggcggacagggccgccgcgacatggtcgtcgtcctcgacgagcagcagtctcatggccctcctctccgtgtctcccggggccgtgcggctctcgggtctccgtgcttccccgggcgccgtgcggctgctcgggctcgttcgcttcgccgtcccgttcttatcaccgtcgcacggcgtcaccgggcagagcccgacattaacccgcgcttcatccgcgagatcccccgagagccccgatgagacttcccgttctgcggtgtttcacgtcctcctcgctcaaggcatccacgccgatgaagggcacaccagtcaagagcctgccggttacagcagggtttccgttatgcacccggtacgccctcggagcgcgcggggcgtcccgttcacgcggagtgtccggttgccgccggatcgttatgctcaatttccgctcagatgtaatgacgctggtagcactgcgtcattactgtccttgttcaaccgaggaggacggagcaagaagccgatgagcggagtttcagtgaccaaggccgccgaggatgccgcgcccgcggcgaacgacctggtcgtactgagcaacgtcaacaagcacttcggcgcgctgcatgtgctccaggacatcgacctgaccatcgcccgtggcgaggtcgtggtcgtcatcgggccttccgggtccggcaagtccacgctgtgccgcacgatcaaccgcttggagacggtcgattcgggagcgatctcgatcgacggcaagcccctgccccaggagggcaaggagctggccaggctgcgtgccgacgtgggcatggtcttccagtcgttcaatctcttcgcacacaagacggtgctggagaacgtcatgctgggccaggtcaaggtccgcaaggccgacaagaaggcggcggaggagaaggcccggaccctgctcgaccgggtgggcgtcggcgtacaggccgacaagtacccggctcagctctccggtggccagcagcaacgcgtcgcgatcgcacgggcgttggcgatggaccctaaggtcatgctcttcgacgagcccacgtcggcgctcgacccggagatgatcaatgaggtcctggaggtcatgcagcagctggcccgggacgggatgacgatgatcgtcgtcacccacgagatgggcttcgcccgttccgccgccaaccgcgtcgtgttcatggccgacgggaagatcgtcgaagaggcggcccccgaccagttcttcagcaacccgcgcagcgaccgggccaaggacttcctgtcgaagatccttcaccactgacgaccacgaccaacgacctaaggattgttcacatgaagctccgtcagtccgccgctgtcgcggccatcgccgtcctcgctctgaccgcgaccgcctgtggcggcaaggagggctccgccggtgacaagcccggcggcacgaagcccggttcctccgaggctcccgcgctgcccacgtacaccgcggccaaggacgtcgccctggactccccggtcttcaagaaggccaaggagcgcggcaagctcgtcatcggcgccaaggccgaccagccgtacctcggcttcgaggaccagtcgaccaaggagcgctcgggcttcgacatcgagatcgccaagatggtcgcggccgacctcggcttctccgacaagcagatcgagtggaagaccgtcgactccggcgtccgtgagacggccatctccaagggccaggtcgactactacgtcggcacgtacacgatcaacgacgagcgcaagaagcaggtcggcttcgccgggccgtactacaaggccggcgcggacctcctggtgcgctcggacgagaagtcgatcaccggcaaggacgcggtgaagggcaagaaggtctgctcgatcgtcggctccacgccgctccaggagatcaagaagccggagtacggcgcgagcgtcgtcgagctggccaagtactccgactgcgtgcagcagctgctgaccaagcaggtcgacgccgtcacgacggacgactcgatcctcaagggctacgcggccgccaactccggcaagctcaaggtcgtcggcgacccgttcaccgacgagccctacggcgtcggcctgaacaaggacgacaaggtgctccgcgaggccatcagcaagtcgctggaggagcgcgtcaaggacggcacgtacaagaagatctacgaggccacgctgggtctgtccggttcggactacgtcgagccgccggccatcgagcgctactgacgccgtcggctcccggaccgcgggctccggcccgcggtcctacggccggcacccccgtcatcccgtcacgacgccccgcgagtgacccaggcgtcccgtacgccaccgccgtcccggctcccccgggcacggcggacgtacggggcgccccttcccctgccctgatgccgctgaccgccgacgcggagacctcatgaacgtactgctcgacaatttcccagagttccgcgacggcttcataggaaccgtgtcgatcaccgccgtcagctcggctatcgccctggtcctcggtgtgctcatcgccggattccgggtctcgccggtgccgccgctgcggtacttcggcaccgcctgggtgacgctgatgcgcaacaccccgctgacgctgctcttcctgatcttcttcttcgtcgtgcccgagatcctcttcccggggatgagcccgttcgtgctcggctcgctggcgctcggcttctacacctcctcgttcgtgtgcgaggcggtccgctccggcatcaacaccgtgccgctgggacaggccgaggccgcacgctccatcggcatgacgttcgcccagacactgcagatcgtggtgctcccccaggcgacccggaccgtgatcccgccgctgagcagcatcttcatcgcgctgacgaagaactccgcgatcgccggcgccttcagtgtcgccgagctgttcggctggcagaagctgatgagcgacaagggctacgacatcgtccccgtcttcatctgggtggccatcggctacctgatcgtcacgtttaccatcagcggcctcttccggctgctggagcgtcgcatggaggtcgcccgatgagcgccagcgttctctacgacgccccgggtcccaaggccgtcgtccgcaaccgcctctacgcggtcgtcggcagcctcgccatcgcggcgctgatcgccatcagcatcatgcggctcgccgacaaggggcacctcgcccccgagatgtgggacatcttcaactacgcgggcatccggcagaacatcgccgacgccctgctcgccacgctcaaggcgttcggtcttgccgcgatcggctcgctggtcctcggcgtgctcctggtggtgggccgcctctccgaccacaagccgatccgctgggcggcgaccaccttcatcgagctgttccgctcgctcccgctgctgatcaccatctacgccatctgggtcggcttcctcaccgactactcgatgtgggcgctggccgcgggtctttccgtctacaacggctgcgtccaggccgaggtgctgcgggccggcatcaactcggtgcccaagggccagagcgaggcggcgtacgcgctcggcatgagcaagacgcaggtcatggtcagcgtcctgatgccgcaggccgtccggtcgatgctgccgacgatcatcggtcagctcgtggtgaccctcaaggacacctcgctcggcttcatcatcctgtacccggagctgctccagaccgcgcgactgatcgcctccaacacgcaggtgaacggccagtacccgtacgtctcgacgatcgtcgtcatcggcacgctctacatcgcgatgtgcctgctgctctcggcgctggcgacgtggatcgagaagcgcggccgccgcgccaagaccggcatcaaggtggcgcccggcgccccggccgccggcatccccgcggtggaggccgttcccggcccggacgcggggggcgcagggggcgcaggcccgacggccggcggtgccggcgtgacgaaggactgaccgtcccgggcccttgccggcccttgcgagcaggagcattcgaggcagcggcgcacgcgtcgctgcctcggtcacttgacgcaagcaccaccagtgggttgcatacgttctgtgatcacgcacccggcttcctatgccacgttccgcatgaccgtacgggccggagggtacgcgccgtggacccggtgatcgtcgtcggcgccgggcccgtcggcctgacgctgtcgctggccctcgccgcccagggcgtcccctcggtcgttctcgacgagggccccggcgcggaggagccccgtccggcccgcacggtcgtgctgcgcgaggacaccgccgacctgctgggccgcctcggctgccgggagctggaccgggtcgggctgcgctgggccgggtggcgttcgatgcgccggaagcagctggtccggaacgtaccgctgagcgggggccggagggacgaggacgaggccccgctccccgggctccttcccgcgccgctccatgttccgcaacatgcgctgagcgacgcgctgcgtgcggcggtggacaaggcgccgctggtccagcgggtgccgatgagccggatcgacacgctggaacaggaccccgacggcatcacggtgcacaccagggagccgggctcgacctggtggcgcgggagttatctggtcggctgcgacggcgcccggtcgacggtgcgcaagctgctggacatccggttccccggtcgtacggcggtggagcggcatgccgtcgccgcactccgggccgaactgccctggcccgacgaggccgtgtcgcaccggcagcctccctggcggaccgggggcgccgaggtctccgcccggccgctgccggacggcgtctggcggctggactggctgctgccgccgcggggcgagctggtcacccccgaagctctgatcacccggatccgggacaccctggccggctggtgcggcgagaccccggcgtacgaactcctggacaccggtgtccacacgctgcaccaccggctcgcccggcgctccgcctgatagctgtcgaggaggtgctcggccggaccgtggtgccaggcgtgggccagcttccaggccaggttctcggcgtcccggatcccctcgtccagcccctgcgtgcccacggcgcccagcaggtgcgccgcgtcccccgccaggaaggcacgctgcttgcgccagcgccgggcgagccggtgg

SEQ ID NO: 2999 - DNA, 4059 bp, Unknown
  Kingdom: Bacteria, Phylum: Actinobacteria, Class: Actinobacteria, Order: Streptomycetales, Family: Streptomycetaceae, Genus: Streptomyces
acctgctcaaacccgtctgagctcaacccctgaaaaccgaatcgcgcgtcgcgacgccgcctggagccggtcagtcgggctgcttctccatgtgcgtgaggacgcggttcgcgatgcgggagagggagtccagctcttcctgggtgagggcgtcgatgaacagccggcggacgtgctcgacgtgcaggggggcggcgtcctcgatggccttccggccggtcggggtggcgacgatgaacgctccgcgtccgtcgtcggggcagtcctccttggtcaccagtccgcgtttcgccatccgccccacctgatgggacatacggctcttctcccactccaccagcttggtcaggtccatgaagcgcatccgcccgccggcctcggtgagcttggccagcacgatgtagtcggagggggacatgtgggagtcggcctgtacctggcgtgagagccgtccgatgagcttctcctgcatgcggatgaagctgtcccaggcggcctgctgctccggggtcagccagtgtggcggtgcgtccatgcgaggagcgtagcgaggcggtcggcggctcagccatctcctggtcggggccggttcccgcatcgggggaccggactcccgtacgcctcggcaaatcggctgccacgacgactagttgacgtgtcaatcatcgatccctagtgtggatgacacgtcaactaaatggttgtggcaggcgcacgtgaaactccagaaggggaatcccatgagcactcagagcacccagagcaaggccggactcggcgcgctgctgacgccggaggagagcgtcctggtgctgatcgaccaccagccgttccagttcgccaatctgaacagccatgagccgacgatgatcgtcaacaacgtcgtggggctcgccaaggcggccaaggtctacgacgtgccgaccatcctgacgaccgttctggaggagcgcggcggcctgctcatccagggcatccaggacgtgttcccggagcagaagccgatcaaccggaccttcatcaacacctggcaggacgagcgcgtcgtcgccgccgtcaaggcgaccgggcggaagaagctgatcctggccgggctctggacggagatctgcctggcgatgccggccatccaggcggcgggtgaggggttcgaggtctacgccgtcaccgacgcgtcagggggcgtgtcggccgaggcgcacgacatggcggtgcggcgcatggtccaggcgggcgtcgtgccgatcacgtggctggccgtgatgggggagtggcagcgcgactgggcccgtgaggaaaccatcccgggggccgccgaggtccaggcccagcacgggggcgccacgggtgtggccttcgcctgggagacgcagctcctcgccgggagtgctcggagcggtgtctgacaccgaggcggaaccgaggacgagtaccgtcctgaccaggacgttgtggacgaaagaacggacagaggacacatgacagtcgaagtgaaggacgttcccgaggccaagcggtacgaggcccgggtcgacggagagaccgaggtcgcgggcgtcgcggactacctccgtacggcggaactcatcgcgttcctccacaccgaggtctcgcccgcgtacgagggcaggggggtcgggtcggcactggcccgcacctccctggacgaggcgcgcgccgccggcctgcgggtactgcccacctgcccgttctacgcgggatggatcgcccggcaccccgaataccaggacctgctgtaccagtcgcgcagcaaggtcagcgactgaacggccgcgcggcagggccagtgactgaacggccggacagggtggcgacggaggcaggtatgagcaacggaacggagaagaagtcctacgaggggcggtcgatcaccgtgaccttcgaggccgggcgctgcgagcacgccgccgcatgcgtccgaggcctgccggaggtcttcgacaccggcaggcgcccgtggatccggcccgacggcgccgatgccgggcgtctggccgaagtggtgcggagctgtccctcgggcgcgcttcagtacgaacgggtggacggcggggaaaggtcccaggcctctcccgcgtagcggacggcggggggagaggtgccaggcgtctctccccccgccgtcgcagtgctcaattcggtccgacccggcctcggcacggtgccgcctacggtggtggccatgaccgctactgacccgtcgcccgacttcctgaacgccacccgggcctcgtacgacaccatggcccccgcctacgtcgagttcgcccgcggcgagttggcggccaagcccctggaacgtgcgctgttgagcacgttcgcggaactcgcggcggccggcggtggcggcctgcccgtggccgacgtcggctgcggaacgggccgggtgaccgcacatctgcatgaactgggcctgggactcgatgttttcgggatcgacctcgccccgcagatggtcgccgtggcgcgaaaggagcacccgggcctgcgcttcgagcaggggtccatgctcggcctcgggctgccggacgcctcgctgggcggcctgctcgcctggtactcgaccatccacgtcccggacgaggaactgccgcgcgccttcgcggagttccaccgcgtgctggccccgggggcgcacgtgcagctgggcttccaggtcggggacgagctgctgcggtatacggaagcgtggggcctggagatctcgctcgacttccaccggcggcagccggagcggatcgccgcgctgctgcgggaggcgggtctggaggtccggtccgtggtgtggcgggagcgggacacggacgggccgttcccggagcggacgccgcaggggttcgtcctcgcgcggaggccgctcgcggtctgaccccccccggttgtcgtcccatctcggtctgaccccggctgtcgtccgattccggtctgaccccggccgccgtccggcctcgcgccgcctgtcccgccctgcccgctgtccgcggccggggcgggcggggtgtcgcaccaccggctcacccaggatgcggagcggcccatagtgaccagactggtcactatggcagaccaacgttcagcgcgcgccgaacgctcctccccggggacccggaagaagtcctcggccaggaaggggcccgagcacgcggcccgcgccgcttgtcagagcctggaggcgctgatcagccacccggccgagggcgtctccgcgatccggcgctccgacgacgacggctggtgcgtcgtcgtggacgtcctcgaagttccccgcatcccggacacgaccagtctcctcgcctcgtacgaggtgcggctcgacggggcctgcgaactcgtggagtacacccgggtccgccgctaccggcgcggtgccgccgacgagtgatccgacttcgtccgacagctggaaggacccccccatgacgaccacgagctacgtcgacggcaccgctccgtgcccgcctcgcgccggcacgctctacgacgtgctggagctcattctcgaccggggcatggtgatcgacgtcttcgtccgtgtctccctcgtcggtatcgagatcctcaagatcgacgcgcgcatagtcgtggcgagcgtcgacacctacctgcgcttcgccgaggcgtgcaaccgtctcgacctcgaacgtgactccggcagcaccaccgtccccgagctgctcagcggttccgccgcccggtccatcggcaagcggaaggtgcgcaaggcggcggagtcggtcggcgacaccgtacgcaaggcggtcggggccggcgaatccgacgacgacgagtacgacgaggaagaggcggaggaacggccgcagcgcccgaagaagcgccgcgcccccgcccgcagcagcagtagtggcagcggtggcacgagccgtcgccgcagggcggaggcctgacgtgcgcgcggacggcccgggaacgggtgcggccgacgggccgggtctctacgtgtacgcggtcgtccgggcgggaacgccgcccccccggaagtccgggggcgtcggcagcccgcccgccacgctgcggacg

SEQ ID NO: 3000 - DNA, 8785 bp, Unknown
  Kingdom: Bacteria, Phylum: Actinobacteria, Class: Actinobacteria, Order: Streptomycetales, Family: Streptomycetaceae, Genus: Streptomyces
cccgaccccggagcccgccccgtgaccactgtctccggctgccccgtcacccacgggtccgtcccgctgtccgggccccgcttccagagcgaccccgtccagctctaccgggacatgcggcgcgaccacggggccatcgccccggtcgtcctcgacggcgacgtccccgcctggctcgtcctcggctaccgcgaactgcaccaggtcaccggcgacccggtcctcttcagccgggactccgagctgtggaaccagtgggaccgcatccccgacgactggccgctgctgccgatgatcgggcgcaggcagccctcgatcctctacacggtcggcgaacgccacagcgtccgcgccatgatgatcagcaacgcgctggaaggcgtcgacccgttctccctgaagcggtacgcggaggagttcgccgacgagctgatcgaccggttctgcaccaagggctcggtcgacatcatcgcggagtacgccaagctgctgcccgccctcgtgctggccaggatctacggcttctccgacgagaacgcccacccgctggccgactcgatcaacgacatgatcgacggccgggagcgggcgctcgccggacagcagcacctggggacgtcgatgttccagctgctggccgacaagcacgccgagcccggagacgacgtcgccagccggatgctcgcggactccggcggcttcaccgacgaggaggtcgcccaggacctcatggtgatgatggcggccgggcaccagccgacctgcgactggatgggcaactcgctgcgcctgatgctcaccgacgaccggttcgccgcctcgctctcgggcggccggcacagcgtcgccgaggcgatgaacgaggtcctctgggaggacacccccacccagaacgtggccggccggtgggccgcccgcgacacccacctcggcggccgccacatccgcgccggcgacctgctgctcctggggatcgccgccgccaacggcgacccgcaggtccgcacccacgcctcggcgctgaccggcggcaacaacgccttcctctccttcggccacggcgagcaccgctgcccgttcccggcccaggagaccgccgaggtcatcgcccgtaccggcatcgaggtcctcctcgaccggctgccggacgtggacctggccgtccccgccgagcagctcacccgtcgcccgtcgccgtggctgcgcgggctcaccgacctgccggtgctcttcacacccacccccgccgtcggaagacccggaagcttcggaggccccgcatgacccgcatcgcgctcgacccgttcgtcaccgacctcgacggcgagagcgccgcgctgcgggccgccggcccgctggccgaggtggagctgcccggcggtgtacacgtgtacgcggtcacccgccacgcggaggcccgcgcgctgctcaccgacagccgcgtggtcaaggacatcaacgtctggaacgcctggcagcgcggcgagatacccctggactggccgctgatcggcctggccaacccgggccgctcgatgctgacggtcgacggcgcggaccaccgccgtctccgtacgctggtggcgcaggcgctcacggtgaagcgggtggagcggctgcgcgccgggatcgaggcgctgacgaacgcgagcctggagaggctggcggccctcccggccgggcagccggtcgacctgaaggccgagttcgcctacccgctgcccatgaacgtgatcagcgagctgatgggcgtggacgcggcggaccacccccggctgaaggagctgttcgagaagttcttctcgacgcagaccccgccggaggaggtcccgcagatgatggcggacctcgggaccctcttcaccaagatcgtcgactccaagcgggcgaacccgggagacgacctgaccagcgccctgatcgcggcctccgaggacggcgaccacctcagcgacgaggagatcgtcaacacgctgcaactgatcatcgccgccggacacgagaccacgatcagcctgatcgtcaacgtcgtggaggcgctccagacccaccccgagcagcgcaagaaggtgctgaacggggagatcgggtgggacggcgtgatcgaggagacgctgcgctggaacaccccgacctcgcacgtcctgatccgcttcgcgacggaggacatcgaggtcggcgaccgggtcctgccgaagggcgagggcctgatcgtctcgttcggcgcgttgggccgggacgaggagcagtacggcccgacggccggcgagttcgacgccacccgcaccccgaaccgccacatcgccttcggccacggcccgcacgtctgccccggcgcggcgctctcccgcctggaggcgggcatcgcgctcccggccctgtacgagcggttcccggaactggacctggcggttcccgcctccgagctgcgcaacaagccgatcgtgacgcagaacgacctgcacgaactgccggtggagctgggctgcccgttcggccacacgtcctgatcgctcgtcgtgggtgacgcccacgggccggagcgcgcgtctcatccgacggacacggttgctgagccgtgccaccgagggactacgctccgtcccgtggccgacatccagattcccgctgacatcaagcccgcagacggacgcttcggcgccggtccttccaaggtgcggacggaggcgctcgacgcgctggccgccaccggcacctctcttctcggcacgtcccaccgccaggccccggtcaagaacctggtcggcgaggtacgggacggcgtgcgcagcctcttctccctccccgagggatacgaggtcgtcctcggcaacggcggctccaccgccttctgggacgtcgcgacgcacggtctgatcgagacgaagtcccagcacctgaacttcggcgagttctcgtcgaagttcgccaaggccgcgaagctcgcgccctggctgtccgaccccaccgtcatcgcctccgacccgggcacccacccggacccgaaggccgaggcgggcgtcgacgtctacgccttcacccacaacgagacctccaccggtgtcgcggccccggtcaagcgcgtcgcgggagccgacgagggcgccctcgtcctggtggacgccacctccggcgcgggcggcctgccggtcgacatcaccgagagcgacgtctactacttcgccccgcagaagtccttcgcctccgacggcggtctgtggatcgccgtgttctccccggccgccctggagcgcgccgcccggatccacgcctcgggccggcacatcccggagttcttctccctgccgacggcgatcgacaactccctcaagaaccagacgtacaacaccccggcgctctccacgctcttcctgctgaacgagcagctgaagtggatgaacacccagggcggcctggacttcacgacgggccgcacggccgcgtcctcccggaacctctacggctgggccgacgagtccaagtacgccaccccgttcgtcacggacccggcgaagcgctcgcaggtcatcggcacgatcgacttcacggacgagatcgacgccgcggccgtcgccaaggtgctgcgcgccaacggcatcgtggacaccgagccgtaccgcaagctgggccgcaaccagctgcgcgtggcgatgttcccggcgatcgacccggcggacgtccaggcgctgacggcgtgcgtcgactacgtgatcgagaagctgtagcccttacccgctcacggctccacgaccgtacgaaacggcccggcaccccaagcggtgtgccgggccgtttctacgccaacccctgcacagacgagctggtgcgggcgggccgctcgaaacgctgaggacgccgcctcactcccccggcgtgccctccagcaccgcgcgcagggcagctatccccgccagccactcctgatccgcgccggcgtcctcccacaggtccagcggttccgcgttcttctcggtgaggcggtccagcgcacggacggccagcgggcgcagatcggcggggagcggcggcaggggtttcttcgggccgtacgcggtggtgacgggctctcccccggggcactgggcggcgatcagcgcggcggcggccaccgcctcctccccgcagtccgcatagtcctccggcccggtgtccgcgacggcggtcaggacgtcccggagcacgtccgccttcttcccgggctccgcgtcgtcgacccgtccgccgaagtcggccgcggtgtcgttgtcgaagtggccgatgtcccaggcgcccatggggtccccctcaatccgctgtgccggtcaccccgtcgtgccggtgtccccatcctcacagccgccactgacaatcggccggtccggactcggctcaccgcacgcgggacattcggggtaccggcctcagtcgcggggcagcagcgtccccagcggtccgaggtccaggttgagatcctcgggtcgcacgccgtgctggtcgcagagctccttcatccgctggtcgagcagcatgagcgtggtcccgatctcctcgacctgctcgtcactgaggtcaccctgttcgacccggcggatcgcctgccgctccatcaactgccggagaagctccaccacggtgaggaccagggccaccaggtcccgccccatctgctcggagtccaggtcgacccgcgagccgggggcccgacccgagcccgtcacagcggccccccgtcggcccagggcgccggaacccgctcgctgaccgaggacagcagggcgtgcagtgacacccgcaccagaggtacgtcggcgatggcgatcaccaggtctccgctgacgacgacaccggtcgccagaacacggtccagcaggtccaccagcggcacaccgatgggcccgctcaagggctccgggctgtcccagggcaccaccgcgcgctccgccgccacggctacacctccccgacgaaggagtacggcacccaggggccggtcagctcgatcagcgccccggtccgctcgcccaacccccgcaccagcacgcccagttcctccgaccggtgctcggcgacgaggtaggtcgcgttgagcacgtgcaccctgccgtcacctcccggtacggctccgtgcgtacggaggcggcgcgacgcggcggccagctcacggagttcggcgtccacggattccgcgacggacagagcccgttcccggcgctgctcgcgtcgctcctggaccccgcgtctgcggttcaggtaggcgagtcccgcaccggcggcgggagcttcgggcccgccgcctccgacggtgacgggttccgctgcctcgggggcggacgcgggctcgtacaccttcactccccactcggcgtggtgcgcgatgcgcttcagcacccggtggaagcggtgtgcctcgtcgtcgagagcgcggcgggcccggtcgtcgtcgtggtagagcgtggcgaggggcagcggtacggcgggcccgtgagcggccgcggcggagacgacctcgtggtgagcccgcgcgtatcgctcgatctcacgcgggtcggagagccgcgactgccagacctcgtccgtgaagtcggcggcagggacggtctggaccacagcggtcagcggtccggagggcagcagccggacggccgcaccgccgggcatgccgaccaggccggtgacatcggccgtgcgcgtggcacgggtgccccgacagacggcgaacacgtacgtggcaccggtgtccggaccccggtcccggtgggcgtgatgcgtcatctctgcccggtctccttgctgtcgtccctgtcgtccctgtcgtctatgtcggcgcttcggtccgggccggggtcgcggtcctcgtccgtcgccggttcgagcgcctggaggcgttcccgcagccggcggttctcgtcctccagggcattgcgcgaggctcgggaactgagggccgggtcggtctcccaccagtcgatgcccgccttcttcgcggtgtcgacggatgccacgaagaggcggagccgaatggtgaggagttcgatgtcgagaaggtcgatcttgatgtcaccggcgatgacgatgcccttgtccaggacgcgttcgagaatgtcggcgaggttggtggtcccggggccgttggccggcggccctccctggcggaagtcgaggtcggtcaccgcgaggcccccgaccgacgcctgcggccgcgcctcggagcgggcggctcctcctcgtcctcctcctcctcctcctccggctcctcggcctcgtcctcctcgtccggctcctcttcctcgtccggctcctcctcttcctcttcctcgtcctcctccggctcctcttcctcgtcctcctccggctcctcgtccccctcgccgtagtcctcgtcctcgtcctccccgtcctcctcctcgggctcctcttccccgtactcctggtcctcgtcctccccgccctcggcctcttcctcctccgcctcctcgcgctcgacggcttcctcgtggctgaccacgacctcgccgtcgcggatctcgccacgccacccctcgggctcttcttcggtgagggtcacgtaccgctggaagtgcttgaagtccagccgtacgcggcggccctgggcgcgccagaggttgcccgtcttctcgaagaacccggacgggtagtactccatcaccagcacgatccgggtcaggttgggggccagctcgtggaagctgatcgccccgcgcgtgctgcccttggcgccctcggaggtccagacgatccggtcgtccggcacctgttcctgcaccgtggccttgaagctgcgggaggaggggccgaccttgaccttccagtcgctctcttcgtcctcgcccttcgagacgctctggacgcccttcatgaagccgctgaactcgtcgtactgcgtccaggcgtcgtaggcggtacgcagcggcacaccgacgtccatcacctcgatgatgttcatgaacttgccgccgccggccttgcggttgcccttgccaccgcctccgccgaacgcgctcttcgccttgtccaccaccgcgtccttggcccccttggccttctccgagacgaatgccttcaccggcgattcgccctggagcacgcgagaaccaatggcgggcagcgaaccgccgttctccgccgagtcggtcaactgcccggtgagatccttgagtttgccgcccgccttctcggcgagctgctggacctgagcgctggcgaatttcgacagttcttctttgatgcggtcgacacccgactccgccggagcctcggattcgtccttgtccgtcgttgccatggctgactacctccggcggtcggcgcgcttggatgccgaccgcttcgacgttgctgtcttcttggcggcagacttctgaggggcggacttcttggccgcggacttcttggccggcgacttcttggccggggccgtcttcttcgctgccgacttcttggccggcgacttcttcgctggagcggccttcttcgtcgccgccttcttggccggcgccgccttcttggccggggccttcttggctggggccggcttcttggctggggccgacttcttggctggggccgacttcttggcaggggccgacttcttggcaggggccttcttcgctggagcggccttcttcgtcgctgccttcttggccggagcggtcttcttcccggccgacttcctggccggcttcctggccggcgccgccttcctggcgggggacttcctcggccgggacggttgcggcggggcctcctccttttcctcctcgggctcctcttcctcctcgggctcctcttcctcctcgggttcctcttcctcctcgggttcctcttcctcctcgggctcctcgccttcgccctcttcgccctcttcgtcctcttcctcttcgtcctcttcctcttcgtcctcttcctcttcgggctcctcgccctcgtactcctcgtcctcgtcttcttcctcttcctcgccctccggctcttcctcgccctccggcccttcctcgtactcgtcctcgtcctcttcgtccgcctcgtcgtccggcgccgccgtgaggcgggccgtccgttcgccgatggcgtccgccagggaagccatggagcggttggcggcggctgtcaccgcgtggcgtcccgcgtcgagaacctccccccgcaactgctcctgcaactcggcgacttgcggtacctcaccgagccgtcgcatcccttcggccgccagctgacggggttcgagtccgaaccggcgccccgccaggtacgtcgcgacgctcagcgccaaccggcccttcttcgaccgacccagcacatatccacccactacggcggctgcgagcgccacctttgcctggtcatccatgtctgtcaccttctgtcgtcggtgtccggccggtctgcgcggcgtacagccggtcgagcagcctctcctcttctgcctcgaactcgtccagcccgatgtgcccctcgtcgagctcctggttgagtgcggccaactgcgtgcggatcaccccggggtcgtacagttcgcgctcggctgcgtcctgcaaccgctccgcgatccacatcacgccccgggcgggcgcgagggggagcagcagcactccggagatcagccccatcgtcagcccacaccgaccggtgcggtcgggctcacgccaccggcaccgacgaagctgtagcagggcagcgggcccgcgacgcggagctcgacgtggtcgcgatgggccgccgcgaaacgctcggcggtcgcacggaaccggtcgctgtcggcctgcgccacgaggaaggacaggttgag

SEQ ID NO: 3001 - DNA, 12022 bp, Unknown
  Kingdom: Bacteria, Phylum: Actinobacteria, Class: Actinobacteria, Order: Streptomycetales, Family: Streptomycetaceae, Genus: Streptomyces
tccgcagccagaacggcgcggaggactcgcgccgttctggctgcggatgcaggagcgcacccgggatctctcggggcatgctctggtggtggacggcgaggacacgttcaccgcgatgctggcccatctgctgcggtcgtcgggactggacgtctcggtgcgccggtacgacgagccggggttgcgcgaggtggtccgagcacaccgggggcccgtggtgctgggtccggggccgggcaatccgggcgatctcaccgatccgaagatgcggctgctccgtgagatcaccgccgagctggtgcgggaccaccggcacgggctgctgggggtctgcctcgggcacgagctgatcgcggcggagctgggccttgagatcgtgcgcaaggccgtgccgtaccagggggcgcagacccggatcgagctgttcggccggccggagacggtgggcttctacaacagcttcaccgggcggtgcgacggtccggccgccgtcgagctggccgcgcacgggatcgaggtgagccgcgacgaggacagcggtgagctgcacgcgctgcgcggtcccggtttcgcctcggtgcagttccacccggagtcggtgctgaccgtgcggggatcggtgatcgtgacggagctgctggcggggctgccggtggtgcggagctgaggggagccttcacactctcggcacgaggacgttctcgctgtggcggcgggccagatagtcggtgacgttccgcccggtcgcgtcgatgatctggcccaccgcgtcctcggtgtaatacgcctggtgggaggtgacgacgacgttggggaaggtcaccagacgggcgagggtgtcgtcgtcgatgccctccagggacttgtcgaggaagaacagcccggcctccgcctcgtacacgtcgagtccgacgccgaggaagcggcccgcgcgcaactcggtgaccagggcggcggtgtcgatgaggccgccgcggctggagttgacgaggatcgcgtcgtccttcatcgccttgagggccgcctcgtcgatgatgtggtgggtgctgggcagcagcggcacatgcaggctgatcaggtcggcctcggcgaacagccgctccttgtcgacgtactccatgcccagctcgacgcaggccgggttctccgccacgtcccagccgagcaggttcatgccgaagccgtgggcgatgcgggtgaacgcctcgccgatcttcccggtgccgagcaccccgacggtccggccgcgcatgtcccggccgagcagcccgtccagacggaagtcgaagtcccgggtgcggctcgcggcgcggatgatgcgccggttgacggccatggcgagcgtccaggcgaattcggcgaccgagtacggggagtagtacgagacccgggcgacgcgcagggcgaggcgctcggcgacgtccaggtcgatgttgttgaagccggtggagcgctgggcgatcatctgcgtgccgccggcggcgagcgtctggagcacctgggagccgaggtcggcgttgacgctggtggagacgatctcgtagccggccgcgatgggggcggtgtcccggttcaggaagacgtccaggcagcggacctcgtgcaacccctcgaaggccttctcgatcaggggcttctcgtcggactgcacaccgaaggccaggatttccacgggtactcccgatctgtttccgcgggcggggccggacatcgcgaatatacggctccgcccccggacccgccggtcagacgtcgtcgaggccgcgctcgatggcgtaccgcaccagctccacgcggttgtgcagctgcaacttgccgagggtgttctgcacatggttctgcacggtgcggtgcgagatgaccaggcgttcggcgatctgcttgtacgagagtcccttggcgaccagccgcagcacctcggtctcccggtcggtgagctgcggggccttgggttcgttcgacgccacggggacggggtcggaggcgagccggcggtactcgccgaggaccaggcccgcgagtcccggggtgaagaccgggtcgccggccgcggtggaacggacggcgtcggtcagctcctgggtggaggcggacttcagcagataaccggtggctccggacttcaccgcctccaggacgtccgcgtgttcaccgctcgcggagaggaccaggacccgcaggcccgggtgggagccgacgagctccttgcagacctggacgccgggcatgccggggaggttcaggtcgaggaccaggacgtccggggtcacggccgtggcccggcggaccgcctgcgggccgtcccccgcggtcgcgacgacgtcgaagccggcctcggccaggtcgcgggcgaccgcgtcgcgccacatggggtggtcgtcgacgaccatgaccctgatgggccggccggtgtccccctgctcgtcctgtgctgcgttccgcgtactcatcgggccgatcctgccttcccccgggaaattttcggtgctttcggaaccttcaactcgacctcgcagccctgtccgggcaccgagatcagctctgccgtgccgcccagatctcgcagccggccgcggatggacagcgcgaccccgagccgcccctccccctccgcctgggcgagacgaccctccgggatgccggggccgtcgtcccggacggtgacgatcacctcgtccggctcgtcctcgaccaggatccacgcctgcgcgtccgggccggcgtgcacccgtacgttgtccagcgcggcgctgacggcggcggccagctcccgggccgactcggcggggagcagcaccggggcgcccggctcggcgaagctcgtgcgggatcccgcgtgcggggcgagcagggcgcgcaggtcgcagacggtcccgtcgccggagccttcctcgtcgtccacgtcgaccgcgcggaccacggctccttcggcggcgtcctcggagacccgcgtggggggcaccagaccgctggagaccagggtgcgcagagcgacctcctgttccccggccattcggcccagctcggcggcctcgccgccgagcgcggtgcctcggcgctggaccatggcgaggacctggagcacgctgtcgtggatgtcgcgggcgagccgttcgcgttcgcgggtggtggcctcgatctccagggcgcgggccagggtgcgttcactggcgcgggcgacctcgacgacgtaaccgatggcgatggaggcgacccagaccagcaggacgttgtggtaggtgtcccggctgggctcgccgcgctggatgatgttggcgacggcgacgaaggtggaggcgaaggccgcccaccgccagccgcccttgatcgcgaaggcgaggaccgagccggccgtccagatcgacggcagcgtcgggccgtcgaacgactgcgagtcgaagtcggcgagcggggtgagcaggatgccggtcagcgcgacgaccaggtccgcgacgaggaagcgtttggtgcagctcgccgccgagcggaccttcggcagcgtggcgagcgtccagacgaagaggaacgccagatacgcgacggccacccagggccgctcgaacctctgctggccgaagttgtccttcccgaagatcgcgagcagcaccgcgtagagcatcgtcaggacgcggtagcccgtcagcgcgcgccacagcggcagctcgaccgacatccgtacgacccgttcacgcttggccatggccccacaccccccggacggtgaacgacgcggttacgcgtcggaccgttccgttccgttctcgttgcccgcggcggcctgcttctgggcgcgcttggcctcttcgaccctggccttcgcctcctccgacctggccttcgcctcgtcggcgatctggcgcttggcggcggtggcgtagatgtccacgtactcctggccggagagcttcgaggatcgcgtacatgatctcgtccgtcacggcccggatcgcggccttctggttctccatgcccgcgtagcgggagaagtcgagcggttcgccgaagcggatcgcgacccgtttgatcctgggcacgacctggccgggcggctggatctcgaaggtgccgaccatggcgcaggggatcaccgggacctgcgcggtgatcgccatcaccgcgaccccgaccttgcccttgtagagccggccgtcgtgcgagcgggtgccctccgggtagatccccagcagctcgcccttgctcagcactccgaggccctcgcggatggccgcctgtcccgcgtccttgcccgaccggtccacagggatctgcccggcgctgtggaagaaggccgcggtgagccggcccttgattcccgggcccgtgaagtactcggccttcgccaggaaggtgatgcggcgcttgatgatggccggcatcaggaaatggtcggagaaggagagatgattgcccgcgacgatcgccgcgccgtccgtgggaatgttctccaggccctcgatccggggccggaacagcagccgcagtacgggccccagcacgacatatttcaggacgtaatagaacaccttgcgggtgcacctcgctctgccgggtcggcgtcagggctgtactgccgggttcagggctgcgtactaccaggtcacggtggtgccggggcccacagcgtggagccccggcgccaccgtgcgaccgtagcggaccggtcacccggctcgtacccgcctccgggtccgtcagacgtcctcatccgccgcgagggtcaggtgtcctgcgtggccagcatgccgagggtgcacaggcccagcaccacccagccgaaccagagccagccgctgctccccagcgccaccgtgtacgcggtcaccgctatcagtgcaccgccggtcatgtatcccatggtcttcgtcgatccggacatgcgcgcacgctcctcgtcggccgcgcggccgttgtccccatggtcaccccgtatgcgccctccgcgctactgtccgcgcgcctgcaaagacgcgagataggcgttgtacgccgccagctccttgtcgccgtcgcggtccgccgcccggtccgagcgccgggcggtgcgctgctcggagcggtaccactggaagaccagcgcgatcagcaccagcacggaggggatctcgctgaacgcccacgcgatgccgcccgcccagttctggtcgctcagggcgtcgatgccgagcgaggccggcgggttcttgtacgtctccaccatcggcgtcgacgccatcatcagcgcgatcccgaagaacgcgtggaacggcatcccggcgaacagctccagcatccgcatcagatacccgggccggtgcgggcccgggtccacccccatgatcggccagaagaagaccagaccgaccgcgaggaagtgcaccatcatcccgaggtggcccggcttcgaacccatcaggaagtcgaagatcggcgtgaagtacagcgcgtacaggctcgcgatgaacagcgggatcgtgaacacgggatgcgtgatgatcttcatgtaccggctgtgcagcagcttcagcagcagttcgcgcggcccggtccgcccccgcccggcgggcggcagcgcgcgcagcgccagcgtcaccggggcgcccagcagcagcaggatcggcgacagcatgctgatcaccatgtgctgcaccatgtgcacgctgaacatgaccatgccgtagtcgttgagcttggtgcacatcaccagcgcgatactcagcacgcccacggtgaagaacacgatccggttcaccggccagccgtccccgcgccgacgcagccgcaccacgccgtacccgtacagggcgagcgccaggacgcagctggtcaggaagaacgggtcgacggagagctccagcccccgccccagcgtgaacggcggcagatccatgttcatgccgtgcccgctgtgatccatctgttcactcccgatggggacacgtccccgtttcgtgccggttgtccggtccagagtagaactgcccccggccgcggttgcggccgggggcagttctggacggcacgtttctacagcacgcactccgcctcggcgtaccgctcggcggggaccgtcttcagcgtctcgacggcttcgcccagcgggaccatcacgatgtcggtgccgcgcagcgcggtcagcatcccgaactcgccccggtgcgccgcctccaccgcgtgccagccgaaccgggtcgccaggacccggtcgtacgcggtgggcgtgccgccgcgctggacgtggccgaggatgaccgggcgggcctccttgccgagccgctgctccagctccccggagagctgtgtggccaccccggcgaaccgttcgtgaccgtagatgtccttgacgccctgttcgaactgcatggagccctcgcggggcttggcgccctcggcgaccaccacgatggcgaacttcttgcccgccgagaagcgcttgccgaccagctcggtcaactcgtcgatgtcgaagggacgctcgggcaccacgatggcgtgggcaccggcggccatgccggagtgcagggcgatccagccggtgtgacggcccatgacctcgacgatcagcacccgctggtgcgactcggcggtggtcttcagccggtccagtgcctcggtggcgacgccgacggcggtgtcgaagccgaaggtgacgtcggtggaggcgatgtcgttgtcgatggtcttggggacgccgacgatcgggagaccggcctcggagaggaggttcgcggccttgagggtcccctcgccgccgatcgggatgatggcgtccaggccgaggtccttcacatggccgcgggctcgctccacgccgtcgcgcagatgcgcgggctggacccgggaggaaccgaggatcgtgccgccgcgggccaggatgccgcccaccgcgtcaaggtcgagcttgcggtagtcgcactccagcaggcccctccagccgtcgtggaagccgatgacctcgtcgccgtggtccaccaccgcgcggtgcacgacggaacggatgacggcgttgaggccggggcagtcgccgccggaggtgagtacgccaatgcgcatggcccggaaaccctttgcaacgttaagtcgacgaccggaccacgtcgtccgggttggatccccgccaccctaccggcgcagggtggcgggaccgaaccggccgtccgcctgctggactccgctcaaccgagcggaaatcgcctcagacggacaccgctcaagcgagcggaaagagcctcaggcgggctgtgtcgccgcggcggtccgctcggcgcgcagcgcgtcgtaccagcggtcgtcggtgggcggcagcgcgttcacgtcgagggccagcttcagcagcagatcggcgatctgcgggttgcgggccatcacggggccgtgcatgtacgtcccgaagaccgtgtcgttgtacgcgccttccgtgccgtccccggtgccgttgccccggccgaactgcacccgcgcgaacggccgtgccgtcgggccgagatgggtgacaccctggtggttctcgaacccggtcagcggcggcagcccgaggtgcgggtcgatgtccgccagtacgtcgccgacgcaccgcgcgccctcgccacgggtggagaccacgtcgagcagaccgagaccgggctcgcgctcgccgaggtcgttgacgaactcgtgcccgaggatctggtagcccgcgcagaccgagaagatgatcgcgccgttggacgcggcacggctcagcccgccgtcgcggcgcagccgctcggccgcgaggcgctgcggccggtcctcaccgccgccgatcagatagatgtcgccggacgtcggcaccggctggtcgctgcgcacgtcgacgcgctgcacgtccagaccgcgctgccgggcacgccgctccacgaccagggcgttgccctggtcgccgtaggtgctgagcaggtcggggtagacccagaccagacgcagaccgttgttgctcatgcttcgtcctctccggaggtggccggggccggggtcagttgccgacacgacggcgcagatcctggaaggcggtgtagttggcgatgacctcgatgcggccgggcggtgcgtgactcacggcctcgtcgagcgtctcgcagacccggaagtcgagaccggccacttcgagacggaccgcgaggtccagcttccggtcgccgagcacgaagatcgggtgacccgccagctgcgtgtagtccacgtcccacagccaggaggtgtccgtgccgtccgcgccgcgcgcgttcaccgagaggatcaccggcgtcggcggcgggtcgatcagcgagaacgtctccagccagccggccgggttcttcgccagcagcagacgcagctcacggttctggaaggtgacgacgtcgtagcgaccggccaccgcctgcacctggtacatccgctccagcgcgacctgcggcggcacgccgaagacggcggcgacagcggcggaactggtggcgttcgccttgttcgcgcggcccggcagctggaggtggatcggccacgccgaaccgtgcgggtccaggacgtagtcgccgttcagcgcccagctcggggcggggcggcggaagccgcactgcccgcagaaccagtcgtcgcccgggcgctgcatcacaccgccgcaggacgggcaggaccaggcgtcgtccttccacgcctgaccggccgccacccacaccacgttgggcgaggaggaggccgcccagacgaccagcgggtcgtccgcgttcgcgatgaccacggccttggagccggagaggccctcgcgccactgctcggccatcatccgggtctccgccgcgcggtcgagctggtcgcgggagaggttgagcagggcgatcgccttgggtgtggtgtcgcgcgcgacacccgccagatacttctcgtcgacctcgatcacgccgaacttcgcgtccgagccgccggccagcgccgaggtgatgcccgcgggcatgttcgcgccgagcgcgttcgacacgacgggcccggcggcccgcagcgcctcggcgatcagccgagtggtggtcgtcttgccgttcgtcgccgacacgaggatcacgtccaggtgctgcgccagccgccccagcaggtcggggtcgagtttgagcgcgacccggccgccgatcaccgatccgctgccccgccccgcggcgcgtgacaccgccgccgcggccttgcccgccgtcacggccagtttggcccgcggcgacaacggctccgtgttgcctgccatcgtcctagatcctccttgcatcggtccgcgcccagcctatcgatgtccggcgcggcgaccgcaccgcggcaccacgggaactccccggccccggcggaacgtacgcttaccgccatgcgaaaccgcccgatccccggcagttccggactcgtccgtgagatgagtcttctcggcgacccgttgctccaccgcgcctgcgaggacgtcacggacttcggcccgtcgctggcgaggctggtcgaggacatgttcgccacgatgtacgccgcacagggtgtcgggctcgccgccaaccaggtcggcgtcccgctcaaggtgttcgtctacgactgcccggacgacgacgatgtccgccatctgggacacgtggtcaatcccgagctggtcgaggcggacggactcaccgtacgcggaccggagggctgtctgtcacttcccggtctggaagcgggcacggatcgcttcgaccacgcggtcgtcgagggcctgacgatgaccggcgagccggtccggatcgccgggaccgggtggttcgcccggtgcctccagcacgagtgcgaccacctggagggcacggtctacaccgaccggctgaccgggctgcggcgcacccgggcgctgcgcgcggcgcgccgcgcaccctgggcgcgcaagggctgagcgcgccgggctcccggcccggtggccggagcgggtcagaaccccggaccgccctggaggtcgcccgcctccgcgagcctgccccacagcagatcggcgaggctgctcaccagccgttcgcgggagcagggccggtcgccgagccaccagtcgcccgcggcgtgcatcatgccgacgatcccgtgcccccagatgcgggagatctgctcgctgtccgggcccaggtcgacccgctcggcgatcacctggcccagttcctcgccgaggcggcgcagcagcggggcggagtgccggccgacatcgaagccctgctcgggggagggtggggtgtcggcgctgtcggacgggtgcatcaggaagcggtagacctgggggcgggcctcgatcgcggcgagataggtgtcgagcgtcgactccacccgctcgcgccggtcggcgggcgcgtcgagggcggctcgcagggcgctgagcagcgcgtcggtgtggcgcttggcgagggcgcggtagaggccgcccttgtccccgaagtggcggtagaggatgggtttggtgatcccggcctcggcggcgatggcgttcatcgaggcctgcggtccgtctctgagcaccacccggtccgccgcttccagcaactcgcggcgacggcgctcggccgcggtccgctgtcgctcggcgcttcgtgcggtctccatgtcgtctctcccacccctggccacgcgatgccgtcgcatcgcctctgcacgcccgcgcaacgtaacactccgcagagcggacgcctgatcggctccgtggtggttgacagtacctacttgccggtaacagactgtggttaccgcaagtaacgcatggttttcgccgcagtgcctggaggggaacatggccgagttcacgcttgagctcaacgacgaccagaagcaggtcaaggactggctccacggcttcgcggcggatgtcatccgccccgccgcctcggagtgggacgagcgtgaggaaacgccctggcccgtcatccaggaagcggccaaggtcggcatctactccctggacttctacgcccagcagttcttcgaccctacgggtctcggcatccccatggccatggaagagctcttctggggcgacgcgggcatcgccctgtcgatcgtcggtacgggcctggcggccgtcggcgtcctcgccaacggcaccgaggagcagatcggcacctggatcccgcagatgtacggcgacgccgacgacgtgaaggtcgccgccttctgctcctccgagcccgacgcgggatccgacgtcgcctcgatgcgcacccgggccgtctacgacgaggccaaggacgagtgggtcctcaacggcaccaagacctgggcgaccaacggcggcatcgccaacgtccacgtcgtcgtcgccgtcgtcgaccccgacatcggctccaagggccacgcctccttcatcgtgccgccggacacacccggcctctcccagggccagaagttcaagaagcacggcatccgcgcgtcccacaccgccgaggtggtcctggaggacgtccgcgtccccggacactgcctgctcggcggcaaggagaagctcgacgagcgcctcgcccgcgcgcgggagcgcgccaagtccggcggtgagcgcgtcaagaacgccgcgatggccaccttcgaggcctcccgcccggccgtcggcgcgatggccgtgggcaccgcccgcgcggcctacgaggtcgccctcgactacgcgaagacccgcagccagttcggccgcccgatcatcgacaaccagggcatcgccttccagctcgccgacatgcgcacccggatcgacgcggcccggctgctggtctggcgtgcctcctggatggccaccaccggaaagccgttcacctcggccgagggctccatgtcgaagctgtacgcgagcgagaccgcccgggacgtcaccgcgcaggcgatccagatcctcggcggcaacggcttcacccgcgagtacccggtcgagcgcatgcaccgcgacgcggccatctacaccatcttcgagggcaccagcgagatccagcgcctggtgatcgcccgcacgctgtcgggcatgccgatccgctgacggcgacaggaaggggacggtccgggacgcacgtcccggaccgtccccttc

SEQ ID NO: 3002 - DNA, 1716 bp, Unknown
  Kingdom: Bacteria, Phylum: Actinobacteria, Class: Actinobacteria, Order: Streptomycetales, Family: Streptomycetaceae, Genus: Streptomyces
gccggtctccccacggccgccggactcctcaccgccctgtgcgcctccgcggcccgacgcgatcgcgatctcttcggccgtctgctccctgccgacaccgacggcttcgccacctactggctggccgccgcccgctacacggccgccgtggccgagtccctgtgctcggcggcctgggaaccgacgcgggagggcgtccgatagacgttggccgttccggccgtccccgctcacgacgtccgaaccgtcacacggcatcatgcaggcatgatcaccattcacctgaagtacgagatcgacgcggacaagctcgaggatttcgaggagtacggccgccgctgggtccggctcgtcaaccgcttcggcggaacgcaccacgggtacttcctgccgagtgagggggacagcgacatcgcctacgccctcttctcctttcccggcctggccgcgtacgagcagtaccgcacggacagcatgtccgacccggagtgccaggaagcgttccaactggcccgtgacacccgctgcatcaagcggtacgaacgccgcttcctccggccgctcgacggccagtcctagggtgaccggccgccgtggtcgtccatttcggcagggtggcggaacgcttgtggaccgcgggcatcgacgtcgtcgtccccgagcgccaccgaggctcgctgtccgccgacaccgcagcggtccaggccgctgtcgactcactggcggagcctccgctggtgctcggctccccgttcgtggggcaccccggtcccctcgtggaactcctgcgggaactgctcgccaccactaccaccccgcacagctgagacaggaaggcgctgcaaccacgctccgccactcgccactcgccactcgccacccgccgtccggacggcgggcccggcgcgcgccgggcgtacggtcggcgttaaccgatccgtcacggcctcttccgttctgttcggttctcttggaacatcctgttcgcttctgttccccacactccaagaggcccctcactcatggctgatatgaatcggcgccgcttcttccggatagccggtgcgacggcgggattcgccgcactgtcgggcagcatcgaccgtgccgccgccatccccgcccaccgggcttccgggacgctccaggatgtcgagcacatcgtcgtcctgatgcaggagaaccgctccttcgaccactacttcggagcgttgaagggcgtccgggggttcggtgacccgcggcccgtgacgctgccgagcgggaagtccgtctggcatcaggccgatgcgacgggaaaggagaccctgccgttccacccgaccgccgacgacctggggatgcggttcctccagggcctcaaccatgactgggcgggcggccaccaggcgtacaacgacgggcggtacgaccgctggatccccgccaagacgccgacgacgatggcccatctgacccgggacgacattcccttccactacgcgctcgccgaccggttcaccgtgtgcgacgcctaccactgctcgttcatcggggccaccgaccccaaccgctactacctctggtcggggtacaccggcaacgacggcaccggcggcgggcccgtcctcggcaacgaggagcgtggctacggctggacgacgtaccccgaacgtctggaggaggccggggtttcctggaagatctaccaggacatcggcgacggcctggacggcc

SEQ ID NO: 3003 - DNA, 2186 bp, Unknown
  Kingdom: Bacteria, Phylum: Actinobacteria, Class: Actinobacteria, Order: Streptomycetales, Family: Streptomycetaceae, Genus: Streptomyces
  misc_feature (2045)..(2046): n is a, c, g, or t
gtgggatcgctgggcccgcccgcccccgtcgagggagtccggcgcaccaagacccgcaagccgccgcccttcccggccgggcccagcgatcccaccctgctcgcagaggcgctggcgcagctggagcgcatggtgggtctcgaaccggtcaaacggcaggtcaaggcgctctcggcgcagttgaacatggcccggctgcgggccgatcagggcctccccgtccagccgccgaagcgtcacttcgtcttctccggcccctccggcaccggcaagaccaccgtggcgcgcatcctcggacgggtcttctacgcgctcggtctgctcggcggcgatcacctggtcgaggcccaacgatcggatctggtgggtgagttcctggggcagacggcggtgaaggccaatgagctgatcgactccgcgctcggcggggtgctgttcgtcgacgaggcgtacagcctggccaactccggttacagcaagggcgacgcgtacggcgacgaggcactccaggtcctcctcaagcgggccgaggacaaccgggaccatctcgtcgtcatcctcgccggctacccggagggcatggaccggctgctcgccacgaacccgggtctctcctcccgcttcaccagccgggtcgacttccccagctaccggccgctcgaactcaccgcgatcgggagcgtgctggcagccgagaacgacgacgtgtgggacgaggaggcggtggacgagctgcgctcgatcagcgggcatgtggtggaccagggctggatcgacgagctgggcaacggccgcttcctgcggacgctgtacgagaagagctgcgcctaccgtgatctgcggctctccggctacgcgggcgagctgacccgggaggacctgtcgacgctgcggctcccggacctgatgcaggcgtacggcgaggtgttgtcggggcgcggtccggtgggccggggcaagcaggaaccgggcgcggtgtgacgccgcgccgggggcgttcgctcccggcgcggcgcggcctcacctcagtgcacgagggccccggacgccggcaggtccggcgccttcggcacgtccaccgtgcggcgggccaccgtgaccgtccggtgggcggggtcgcgcacctcccccaccagcgtctccaggacgtcctccatggcgaccaggccgaggatccgtcccgaggcgtccgcgacctgcgccaggtgcgtcgccgcacggcgcatcacggtcagggcgtcgtccagcggcagttcggcccgtacggtcgccatcggacgccagatctgctgcgggaccgcgcggtccgggtcctccagctccaggacgtccttgacgtggaggtatcccatgaaggggccgccgccgtccgcgcagaccgggaagcgggagaagccggtgcgcaccgtcagctcctcgatccggcgcggggtcacggacgggtcgaccgtgaccagggacgcccgctccagcaggacgtcggcgacgggcctgctgcccagttcgagggcgtcctccagccgttcggccgcctccggtccgaggagaccggcctgtccggagtcctccacgagccggttgagctgctcgctggtgaagacggcctccacctcgtccttcggctcgacgccgaacagtcgcagcaccaggccggcgcaggcgcccagtgcggtggtgaccggacggcagagccgggcgaacgcgaccagaccggggctcagccacagtgcggtccgctcgggtgcggccatcgcgaggttcttcgggaccatctcgccgatgaccaggtgcaggacgaccaccgacaggagcgcgagcgcgaagccgagggggtggacgagcccgtcggggacgtgcgccgcgtggaagaccggctccaggagatgggcgacggtcggctcggcgacggctcccagggtgagggagcagacggtgatgccgaactgggcggcggccatcatctgcggcaggttctccaggccgtgcaggaccgtgcgggcccggccggagccctgtgcggcgagcggttcgatctggctgcggcnnaactcggcgccgacgaagaagccgttcgccagcacgaggagtgcggcgaggaggagttggagcatgctcatcgcgcggcctccagcagtgccggtgcggccctgtccggcagcgggtcggccgcccgggtgaaacggacc

SEQ ID NO: 3004 - DNA, 2213 bp, Unknown
  Kingdom: Bacteria, Phylum: Actinobacteria, Class: Actinobacteria, Order: Streptomycetales, Family: Streptomycetaceae, Genus: Streptomyces
tcggcatgcccgcaccgccgatgagcagacatctgatcttcgccggcccgcccggcaccgggaagaccaccgtagcccgcctctacggggcgatcctggccgagctgggctcgctgcgcagcggccacctggtcgaggtgtcccgcgccgacctggtcgcccaagtcgtcggcggcaccgcgatcaagacctccgagaccttccaacgagccctgggtggcgtcctgttcatcgacgaggcgtacaccctcaccgccgacagcggcaacggcggcgcggacttcggccgcgaggcggtggacaccctgctgaagctcatggaggaccaccgcgacgacgtggtcgtggtcgccgccggctactcccgcgagatggagtccttcctcagctccaaccccggcctcgcgtcccgtttctcgcggaccgtggagttcgagaactactccgtccccgacctggtcgcgatcatggagagcatgtgcacccagcaccagtacgagctgggggaggggacggatcaggcgctcgccgcgcacttcggggccatggaccgggacgccggattcggcaacggacgtgccgcgcgcggggtgttcgaggagatggtggaccggcaggcgatccggctctccgcccaggcccaggtcagcgagcacgatctgcggctgctgctccccgaggacgtctccgccaccgccgccgcgtcggcctccgggaccgccgcaccggcggacgacccgctcacccgcctcggcgacatgatcggactggccgaggtgaagcgcgaggtcgccgacctggtcaacctcatcaccaccgcccgccaccgggccgccgccgggctgcccgttccctcgctcagcaaccacctggtcttcaccggcccgcccggcaccggcaagaccaccgtcgcccgcctctacggcgaggtgctcacccagctcggcgtgttgcagcgcggccagttgatcgaggcggcccgcgccgacctcgtcggccgctacataggccataccgcccagttgacccgcgaggtcttcgagaaggcgcgtggcggcgtgctgttcatcgacgaggcctacaccctcaccccgcgcggcggcggtgccgacttcggccaggaggcggtggacaccctgctgaagctgatggaggaccaccgcgacgaggtcgtcgtcatcgtcgccggctacaccgacgagatggaacgcttcctcgcctccaacccgggtctctcctcccgcttcccgcgccggatctccttcgcggactactcctccgaggaactggtcaccatcgtgcgcgcccaggccaccgcgatggggtacgagtgcggacccggcaccggcccgctgctcaaggagtacttcgacgcggtaccccgcgaccggtccttcggcaacgcccgcctggcccgccaggtggtcgagtcgatggtcacccgccaggcgggcaggctcagttcgctggccgcgcccaccctggacgatctgcgcgtcctcctcccggcggacgtcacggccgcggccccgaaggtggttccccggtgaggccgcccgcccgcctgctgtacggcgccggactcgcggccgctctgctgctgcccgtggccgtacccgcccaggccgcgctccccgtccgtacaccgacggacctcaacgcggccgacgggaagaagggccaggaactgcccggcatgccctccgtgctcgacccgcgggccgaggaggcgctctgcacctccgcctccaaggagcaggcgaagaagcaggactggtcgcgccagcgcctcgacctggaccggctgcaccggcacaccaccggtgcgggcgtgaccgtcgcgttgatctccaccggcgtcgccccgggggccgaaggactcgacggccgtgtcaccgcccagggcgaggccgccgacgactgtgtcggacaggggacgttcctggccgggctgatcgccgggaacggcggccccgccccgcgcctcgccggggtcgccccgggagcgaaggtcctggccctgcgcggcaccgatcggcgcggacagcccgatcccgcgctcgtcacggcggcggtacgggcggcgacgaccgcccgtgccgacgtgatcgcggtcgcggtggccctcccgcgcaaggacaccgcgctcacccgagctgtcgccgaggcccgcaaggccggcgcggtggtggtcgcggcggccaccccggagc

SEQ ID NO: 3005 - DNA, 3892 bp, Unknown
  Kingdom: Bacteria, Phylum: Actinobacteria, Class: Actinobacteria, Order: Streptomycetales, Family: Streptomycetaceae, Genus: Streptomyces
tcgacgacgccgaacgcgccgtgctgcgccgcctctccgtcttcgccggaggctgctccctcgccgccgccgaggaagtctgcgcactccccgcccccgacgacggcgtcgccgtcgaccccctggacgtcgccgccctgctcgggtccctggtcgacaagtccctcgtcgtcgccgcgcccggtgacgacgcggagatgcgctaccggctgctggagaccgtcggggagtacgccgccgaacgcctggacgaggcgggcgaacgggacgccgtcgagcggcgccacctggtccactaccgggaactggcccggatcaccggaccgcggatgcgcggcgccggacagcgggactccatcgccgtcttccaacgcgagtacgagaacctgcgtaccgcgctccgccacgccgtcgccgtccgggacgagcacgaggcgctctgcatcgtgctgtcgatgtcctggtactggatgctgcgcgatctgcgcgcggacgcccgccagtgggccgagtccgcctcctcgctcggtcccgaccccttcgccgcgcccggcgtccgggctccctcgctcctggaacgggccaccgaccggccgccgcccatgaacgacgaacagctcgcggaggcgcggcgcgggtcggcgctgatccaactggccggcgtggacctcgcggtcaccgagtggtcgacccccgaaggcaaggagcgcctgagcatcatcgccgacgcctaccgccccgggatgccgcagacctgccgtatgcccggaacgctgtggatgttcgcgatcctgctcagcggtgacatggaccggctgtacgagctgctggacgagacggtccgggcctcccggacgttcggctacgaatgggagctcggctccgcgctccacaaccgcgccaacttgctggccaacaaccccgagcgggtggccgacgcgcgcgccgacgccgacgagagcctggagatctacacccggctgggtgacgactggggcgccgccgaagcgctctcctcgcggggcgagaccaacgagagcgccggtgactacatggcggccctggacgactacggggcggccgtggagtacgcgcagaagatcggcgcccagagccaggtggcactgctgcgcgcccggtacgccggagccctcatcgagctggaccgtctcccggaggccgaggccatcctgcgcgacgtcaccgagaacgggcggcagtcgggccacgaggcgacgccgatggcgcggatgcacctggggttcgtgctcgggctccaggggcgcgtggacgaggcccgcagtcagacgcagctggtccgcgaggacttcaggggccgcgacgtcgccattttcggcggattcgtctacggggtgctggcctggctggacaacctcgacggcgcgtacgcctccgccctggacaacgcgctgaccgcgctggccagttcgcgggacccgctgtcgaggatggtggccccgcagatgtcttcggcccacctgacggccatcgcccacgcgctcgccggattcggcggccccggagcggcgaaggacgccgcccggctgctggcgttccaggcgaccctcctcccgaagggacatgtgccgagcatgatggagcgccgcaacctggcgcacgccgaggaggccgcccgcgcgtggatcgacgacgcggcgtatacggcggcgtacgcggagggcggcggcctcactctcgacgaggccaccgccctggcggagacgtaccggcgcagccctccggcgtaacgcttccgcgcgctcaggccttcttgcggaacttggacaccgccagcggagccatcaccagtgtgatgcccgccgcccaggcgagcgtcacccagaccgacccggcgaccgggccgcccatcatcaggccccgcaccgcgtccgccagattggacagcgggttgtagtcggtgaacgtctggagccagcccggcatggtcgtcggcggcgcgaagatggaggacccgaactgcagcggcatcagcaccagcattcccatcccctggaccgcctgggccgtcttcatggccagcccgagcacgatgaagatccacatgatggcggcgccgaacaccgccgacagcgccacggcctccaggagcccgagcaccgacgtgcccagggacatgccgagggcgaagcccatcgcgagcaggatgacgatggcgaccatcatccggcccagctcgaccacgatcttggcgatcagcaccgaggagcgggcgatcggcatcgtccggaaccggtccatgacgcccttgcggaagtcgtcgttgaccccggtgccgacagccatggcgatgttcatgcccatcatcgccatcagcccgggaacgaggtagttcaggtagtcctgccggttcccgccgaggctgccgccgaccgagccgccgaagacgtacacgaacagcagcgtgaagatgatcggcatcagaaggacgtcgaacatcgactcggggtccttcttgatctggagcagattgcgccgcgccagcgccccgatgtgccgcagattggcccgcagtccgatccggccctcgccggccaccgccggcttcgacggtgcggtgcccgcggacccggcgggggcgggggtcagtgtcgtggtgctcatgcggcgacctcctggggagcctggtcggagaggggtgcggccttgtcgccggtgatcgcgaggaacacctcgtccaggctgggcagagcggtggagacatgggagagggagaacccccggacgcccagcagcccgatgacggcggtcagctgctcgtcgctgaggatcggcacgtacagcaggccctcgtccggtaccgcctgcgcaccggcgacgccgtcgagccccgcctcccggatcgcccgagccatcgcggccagctccgccgggtccgagggccggatctggagggtgcgtccgccgaccttcgtcttcagctcgtcgacgccgccccgggcgatgatcttccccttgtcgatcaccgtcagctccttggcgagctgttcggcctcctccatgtactgcgtggtcagcaggacggtcgcgccctccgcgaccatccgctgcacctcgtcccagacctcgttacgggtccgggggtcgagacccgtcgtcggctcgtccaggtagagcacggacggactgccgatcatcgaggcggccaggtcgagccggcggcgcatcccgccggagtactccatgcaggcccgcttggcggcctcggtgagcgagaaccgctccagcagctcgtcggcgcgggcccgtgcacgcttgcggggcagatcgagcagccgcccgatcatgtagaggttctcccagccggagagcttctcgtcgaccgaggcgtactgcccggtgaggccgatggtgcggcggagctgccggggctgctcgaccacgtcgaagcccgcgacgaccgcgcgcccggagtcgggggtgatcagggtcgagaggcagcgtacgagggtggtcttgcccgcgccgttggggccgagcacaccgaggacggttccttcgcggacgtcgaggtccacgccgtccagcgctttggtctcgccgtagtgcttgaccagcccccgcacctcgacggcgttccggccgctgttggggttcttgtcgattcgttccatgtccaccagcagaccagcgcccaccgacagctcgccgacaggccgccgacacggcccggcgccgggccccggacgggcgacagcccgccgatgggggatgtcggcgggctgtcggtggtgcgggaaatggctggtggcgcacgatgaaggcgcgtcgggaaagcccgtacggtcagtgcgcgggcatcagtggaaggtgtgctccggcgccgggaacgtgccgccgacgacctcgtccg

SEQ ID NO: 3006 - DNA, 8751 bp, Unknown
  Kingdom: Bacteria, Phylum: Actinobacteria, Class: Actinobacteria, Order: Streptomycetales, Family: Streptomycetaceae, Genus: Streptomyces
aaggggtccctggtgggcgggggcctcgccgcgaacgatcgtggcatggccatctttccgcagacccggaccaccgccccgccgctctcggcctcttccgccccgcgcccggagtccccgcgcccggagtctccgggtccggcggtggtggcgtcttccggctcgacgcggctgccgtccctgcggcacatcggcccgaactggtacgcgagcgtcatgggcaccgcgatcgtcgcgagcgccggcgcgatgcttccggtggaggttcccgggctgcgcgccgcgtgcaccgtcgtatgggtgttgtcggccctgctgctcctggccgtcctcaccgcgcgggccgggcactggctctgccaccgcgaccaggcgcgcgcccatctgctggatccggccgtggccccgttctacggctgtctgtcgatggcgctgatggccgtcggcggggccaccctgacggtgggccaggacgtggtgggcgcgcgggcggcgctcgcggtggacgtggtgctgttcgtggcgggaacggcggtcggtctcgtggccgctgtcgtggtgccgtatctgatggtcgtacgccaccgtcccgtccccgggaccgcgtcgccggtctggctgctgccgctggtcgccccgatggtgtcggcatcccagggcgcgctgctggtgccccatgtctccgccgggcaggggcgcgaggcgctgctgctggcctgctacgcgatgttcggcctgtcgctgctggccacgctggtggtgctgccgctggtcttctcccggctggtccaccacggtccgctgccgctcgcgctgaccccgacgctgtttctggtgctgggaccgctcgggcagtcgacgaccgccgtcaaccagctggccgacgccgccccgggggcggtcggagctccctacgcctccgcgttcggcgcgttcgccgtgctgtacggggtgccggtgatgggcttcgcactgctgtggctggccctggcgaccgcgatggtggtgcgggccgcgcggaacgggatggggttcgcgatgacgtggtgggcgttcaccttccccgtcggcacgtgtgtgacgggtgcggcgggtctggcgcggcacaccggtctcgacgcgctgacctggctggcggtggcgctgtacgtggccctggccgcggcgtgggcggcggccgggacccggacggtgctcggcgtgctcagcggagcgctgacggcagcacccgtgccgcctcggccagcgacggcccgtaccacgtgagcagccgcccgtcgacgagtgcggcgggcagggcggggaaggcctcgggcccgtcgtccgcggtgaagcggtagggctcgtcgggcagcacgatcagctcggccccggagccgttcagctcgtcgagcggaacgcgcgggtagcgctcggcgtggtcggcgtacacgttgcggatcccgaggcgggcgaggaggtcgccggcgaaggtgtcgtggcccagcaccatccagggccttcgccagatcggtacggcggcgggacgcggcctcccggagggcgcgggcagcgtggcccaggcggcctcggcctcgtccagccagcggggccgggcgagtccgcagccgtcgacgaggacgcggtgcagttcggcgagggcctgatccagggtgcggacctcggtgaccaggacgtcgagcccggccgcccggagcgcgtcgaggtcgacggcccggttctcctcctcgttggcgatcacgaggtcgggggcgagagcggcgatcgcggccacgtgcgggttcttcgtgccgccgatccggacggcggtgagctccgcggggtgcgtgcaccagtccgtgaccccgacgagcagcccgggtgcggtgacggcgacggcctcggtgagcgaggggaccagggagacgacgcgcacggacgggcctttcgcggagggaggggtcggactcgccaccggacggactctccccgtacgggctctgccccgtacggactcgcacccgcgcggaccgcgttcgggctcagcggcgcgagtcgaacgtggcgtcgatgtgttcggccaccgcgacgaccaggagccgggtgccgggcacggtggcgcgccagcggtggcggacgccgccggagaggaacagggtgtcgccgtgctccaggcggtggacctggccttcggcctcgacgtcgacggcgccctcgacgacgtacatcagttcgtcgttgcggtgctggaactcgcgcccgaggtccggttcgccggtgaactccagggcgctgagctgatgcctgccgcgcaccaggcggcgtacgccctcgccgtcctcggcccggacgacgtccacggcgcgcgcggagtcggcggcggcgtgaagcttcttggtggtggtctccagcgcttcggcgacccggtcgagggaacgggcgctggggcgggcgcgctcgttctcgatctggctgaggaagggcacggagaggccgctgcgggacgcgaccgcggcgagcgtgagtcccagggttctgcgccgtcggcggacggcggcgcccacccgcggtgtgtccttgtcgtccatgtcccggctccctcccgcctacgccatcctcccggttgccagcaccttacgcacatggttgcgcacgacgtccggtaaacgacccccgggcagccggaaggggtggccccgcccgaaggcgggatccacccctttcgacctgtgctttcgtgcccgtgggccctactggggcgccatggtgtccgcgatgcccgggttgtcgtccatccaggccttcacggcttcctcctcgtgacccgcgccacgcttctggatctcgttctccagcccgccgagctgcttctcggtgagcttgaagtccttgaaccacttcgtcagctgcgggtactgcttcgggaactcctcggaggcgatggtgtgcagccggtcgccctcaccgaacgccttcttcgggtccttcagcttggtcatgccgtactcgttgtacgcccagtgcggggtccacagcaggaccgcgacgggctccttcttggcgtacgcgcgcttcagctcggccagcatgccgggcgtggaggagtcgaggacttcgtactcctcgtccaggccgtactgcggcaggacgttcttcttgaggttctccatggtcgcggtgccgggctcgatgccgacgatccggcccttgaagtcggagcccttgcccttgaggtcgtcgagggtcttgacgtccttgacgtagtcggggacggcgacctcgatggaggtcggcccgtaccaggagccgatgtcggtcagcttgtcgccgtacttgtcccagtaattcttctgggtgtacggcagccagccgtcgaactgcacgtcgatctggccgcgcgacatcgcggcgtacatcgggccgacctcgaactgcttgaggttgatcttgtagccgcgctcctccaggaccgccttccacaggtacgtggcggcgatgtcctcctcccaggggaaccaggcgacctcgacggcacggtcacgctcgtccttgccgccgtcggcctgggcgtcctcggggaccggggaccacttgtcggcgacgcccgggttgtccttcagccaggtgcggacggcttcctgctccttgccggagccggacttctggatctgggcctcaaggctggtgagctgcttctcactcatcttgaagtccttgagccacttgctgaccacggggttctcggcggagaagcccttgcgcgccagggtgtggacgccgtcgcccttgccccagagacccttggggtccttgagcttggtgaggtcgtactcgttgtacgcccagtgcggcgaccagagcggaaccacgatcggttccttcttggcgtacgcgcgcttcagctcggccagcatggacggcgtggagccgtcgatgagcttgtactccttgtccaggccgtagcccggcagcagcttgtccttgagcaggcccatctcgccggcgctcggctcgatgccgacgatccggcccttgaactcggacgcccggcccttcaggtcgtccatcgactggacgtccttcatgtacgcggggacggcgagctccagcgaggtcggggcgtaccacgcgccgaggtcctccaggcggtccttgtacttcgcccagtagctggcgtgggtcaccggcagccaggagtcggtctggaagtcgatctgcccgttggccatgccggtgtacagcgcgccggcctcgtactgcttgacgtcgacctcgaagccgcgctgctccagcatctccttccagaggaaggtggaggcgatgccctcgtcccacgggatgtagccgatgctgaccttcttgccgtcgccgatccgcgcggccttgccggcggtgtcgtccttggagccgccgccgaagacgctcatgctgcccgcgacgagcgcgaggacgacgatgccgacggccgcgatgcggggctgcgggcgataggtccagatcttccagccgtccgccatggcctgggccttggcgaccgcgcggcggcccagcggggagacctcggtgccgagcgctccggtcatccggtccaggtacatggcgaggatgacgatggagatgcccgcctcgaagccgaggccgacgtcgacgttgccgatggcgcggtagacggagccgccgaggccgccgccgccgaccatgcccgcgatgacgaccatggacaggccgagcatgatgacctggttgattccggccatgatcgtgggcagggcgagcggcagctggacgcgcagcagggtgttgcgcgaggtggtgccgaaggcctcggccgcctcgacgagttcgccgtcgacctggcggatgccgagctcggtcatccggacgcccgggggcagcgcgaagatgatggtggcgatgatgccggggaccacgccgacgccgaagaagatgacgccggggatcaggtagaccatggcgggcatggtctgcatgaagtccaggaccggccgggtgatcgcgctgaccgtcctggaccgggaggcccagatgcccaggggtacggcgatgaccagggtgacgagcgtcgcgacgagcaccagggtgagggtgtccatcgcttcgtcccacagttcgacggagtcgatgagggcgaacccgacgaaggtgagcagtgccgcgggcaggccgcgcagccaccaggcgatgacggcgacgatgcccgcgaacagcagcggtgcgggggcggacaggacggcggctatgccgtcgaacatgccgctgacgatggagctgatggcgtcgaagagccaggcgagatgggtctgcagccagtcgaccgcggagtcgacccattcgccgagggggagcctaaacactggccaccttcttcacgccgtccgctgccgcggactcggtgtcgcggggggcctcggccggggtcatcggctcgccgagtacggcgagcagccgggagctgggaacgacgccgacgagcttgcccttggcgtcggtcacggcgaccgggttcgagctctgcgagcagggcgtgaacaggtcgatgatcggcgtggactccgggaccgtggcgggggccgcggccagcacgtcctgcggggtgcgcagttccctgccgtccgccgccttggtgcccatcacggtgtgcgcctcggccatgatcgcgcccgcggtgagcacccgggagcggtcgacgtcctgggtgaaggaggcgacgtagtcgttggccggggtgacgaggatgtcctcggcggtgccgagctggacgatctccccgtcgcgcatcacggcgatccggtcgcccaggcgcatggcctcgttgaggtcgtgggtgatgaagacgatggtcttcttcagacgcttctggagctccaggagctggtcctgcatgtcacggcggatcagcgggtcgagcgcgctgaaggactcgtccatgagcagcaggtcggcgtcggtggccagtgcgcgggcgaggcccacgcgctgctgcataccgccggacagctcgtcgggccaggacttctcccagccttcgaggccggtcatccgcagcgcctcggcggcgcgcacctcgcgttcctcgcgcgccacgccctggacctccaggccgtacgcggcgttctccaggacgctccggtgggggaagagcgcgaagtgctggaacaccatgctgatcttggtggagcggacgtgccgcaggtcgcgggggctcagggcggtcaggtcctggccgtcgaacagcacccggcccgctgtggggtcgagcagaccgttgagcatccgcagcagggtggacttgcccgagccggacaaccccatgacgacgaagatctgccccggctcgacggtgaacgaggcgtcgatcaccgctgcggtcgttccctcggcgcgcaactcgtcgcggtcggaaccgctctcgagcttccgcactgcttcgccgggtcgtcttccgaagactttgtacaagtgttcggcttgcagcctggacacatacacctcacgcgttgaaccgaaaaacggtctgccaccccctccggcagaccgtggagcggtgcgggctctgtccgcgtggcacatgcactagttgaaaatgcgacgtggttcgctccgatggcgcgcctgccctcacttacacagcccaaacacaacagtgacccaggtcaccgacctgcgacggagcggcagtaagcggttacccggagcgactgtgggcgcggtgcggcatcatcgggtctgtgacgcgacgcctgatgctcctcgacaccgcttccctctacttccgcgcctacttcggcgtgcccgattcggtgcgcgcgccggacggtacgccggtgaacgccgtgcgcggcctcctcgacttcatcggccgcctggtgcaggaccaccggccggacgatctggtcgcctgctgggacaacgactggcgtccgcagtggcgggtcgacctgatcccgacgtacaaggcgcaccgggtcgccgaggagacgcccgccggacagacggacgaggaggagatccccgacacgctgtccccgcaggtcccgatcatcgaggacgtgctggcggcgctcgggatcgcccgggtcggcgtcacgccgtacgaggcggacgacgtcatcggcaccctcacggggcgggcgaccgggccggtggacatcgtcacgggcgaccgcgatctgtatcagctggtcgacgacgcccgtcaggtgcgcgtgctctacccgctcaagggagtcggcacccttcaggtgaccgacgagtcgtggctgcgcgagaagtacggcgtggacggcgcgggctacgtcgacctggcgctgctccggggcgacccgagcgacgggctcccgggcgtccccggcatcggcgagaagacggcggcgaaactgctggacgcgtacggcgatctcgacgggatcatggcggcggtggacgacccgaaggcgaagctgaccccgtcgcagcgcaagcggctggacgagtcgcgcgcctatgtggccgtcgcgccgaaggtggtccgggtggccggggacgtccccctgcccgacttcgatccgtcgctgccgcgcgagccgcgcgacccggccgccctggaggcgctggcggagcagtgggggctgggcggtgcgctccagcggctgctgaccacccttcagcactgaggtgttaacttaggcatacctaagtgcaactcttcgaaccagggagtacctcgtggcagagcggccggcccggcagggacccaaggcccagggggcgcaggtcgtgcgcaccgagcagatcaccccgcacatggtgcgggtggtcctcggtggcgaagggcttgcggacttcgccctctccggcttcaccgaccactacatcaagctgtgcttcgcgcccgagggcgcggactacgcgcacccgttcgacatggccgcgatccgggagcagtacccgcgcgagctgtggcccaccacccggacgtacacggtgcgctcgtgggacccggtggcccgggagatggccgtcgacttcgtcgtgcacggcgacgcgggcctcgcgggtccgtgggcgcagcgggcccgggtgggcgagcaggtgaccttcctcggccccggcggcggttacggccccgaggcgtcggcggactggcatctgctggtcggcgacgagagcgcgctgccggcgatcgcggcggcgctggagcagatgccggcgggtgcgctggtgcacgctttcatcgaggtgtcggacgcctcggaggagcagaagatcgtgacgcccgaaggggtggccgtgacctggctgcaccgcggtgaccggcccgtcggcgagctgctgaccgccgccgtgaagggtctggacttcccggagggcgaggtccaggccttcgtgcacggggaggcgggcttcgtgaaggagatccgccggtatctgcgcgtggagcggcagatcccgctgtcgcggctctcgatttcgggttactggcgtctcggcaaggacgacgacgcctggcgcgccgtgaagcgcgagtggaacgagcaggtggagcgggagcaggagagcggcacgaccgccgcgtagaccccctccggcgtcggccccgccggagcctccgcccgggccggccctggtcaccccaggccgcccgggtcccccgcgagcagaccaccggaccccgctcaccgcagccgcggcgggcggggtccgtgcgtcgggatgcggcggacggaccccggcgcggcccccgctccggagccgccacgcacacccaccggg

SEQ ID NO: 3007 - DNA, 15182 bp, Unknown
  Kingdom: Bacteria, Phylum: Actinobacteria, Class: Actinobacteria, Order: Streptomycetales, Family: Streptomycetaceae, Genus: Streptomyces
ccccaccccctcacccggaaggtccgcacactcatgaccggcaccgccgtatccgccacccagcaggaccaggacatcccggaaaccgtcgtacgcctgcggggcaccttcgactcgggcatcacccgcccggccgcctggcgccgacgccagctccgagccctccgacgcctcctgaccgaccacaccccggccatcgaggaagccctctacgacgacctgcgcaagggacgtaccgagtcgcacctcaccgagatcggcggagtcctcgccgagatcgaacacgccctgcgccacctcgaccgctggatgagaccccggcgagtcgccgtgcccatgaacctgaagcccgcgacggcccgcatccaccccgagcccctcggtgtctgcctgatcatcgcgccctggaactatccgctgacactcacgctcaaccccttggtcggggcgctctcggcgggcaacgccgctgtcgtcaaaccgagcgaactcgcgcccgccaccagcgccctgctcgcccgcctcctgcctcgctacctggaggcggtcgctgtcgtcgaaggagccgtcgaggagaccacccaactgctcgcgcagcgcttcgaccacatcttctacaccggcaacggcacggtcggccggatcgtggccgccgcggcggcgaagaacctgacccccatcaccctcgaactcggcggcaaatcacccgtcttcatcgacgagacggccgacatggccgtcacggcccgccgactggcctggggaaagttcaccaacgccgggcagacctgcgtcgcacccgactacgtcctcgtcacccgggccgcccgcgacgcgctgctcgccacgctgccgggcgccgtccagcagatgtacggggccgacccccggaccagctccgactacgggcgcatcgtcaacgaccgccacttccaacgcctgagcggactcatggcggagggcgacccgctcgtcggaggcgcgtccgacgccggggaacgctacatcgcccccacggtgctgaccgatgtgccgcccggagcccccgtcatggtccaggaggtcttcggccccatcctcccggtcctgaccgtacgcgacgtccacgaggccatcgatttcatcaacgcccgggacaagcccctctccctgtacgcgttcacccgcgacaaggcggcctggcaggccctcctggagaagacctcgtccggcggactcgtccgcaacgccccgatgatccacctcggtgtaccgaacctcccgttcgggggtgtgggcgaatccggcatgggcgcctaccacggccgcacctccttcgacaccttcagccaccgcaagccggtcctctccaagcccacgcggcccgacaccctgcgcctcatctacgcaccgcacaccacccgctccttcgccctcatcgccaaggccgtctccaggactcatcccctcctggggcggaagcgatgacccgccgcatcgtgtacggagacccctggcgcgagcagcgctactggagcgactgatgcacgggtggagccgggcccgcctcaccgagcggacgaaacagacggcgaccggccgcacgctgacgttcgaggtcccgcactggccggaacaccgcccgggccggcacgtcgacgtacggctgaccgcggacgacggctaccaggccgtacgcagctactcgatcgccgctcccgcggaggccggcgaagccgagatcgagctgggcgtccaggcggcgttcgggggagaggtgtccccgaaccttgccgacgaactccccgtgggcgccgacgtcgaggtcatggggccgctcggcggctggttcgtgtggacaccgcacgaccgcggcccgctcctgctgatcgccggaggctccggtgtcgtacccgtgatggcgatgctccgggcacgagcggcgtcggtgtcggacgatccgtgcacgttcctctactcggtgcgtgcccccggaggaggtctggtacgccacggaactcgatgccgccggggagggcgttcacgtccggcgcctctacacccgtaccgcaccggacggttcgcggtgcccggccgacgcatcgcggaccacgacctgctgggcctgccggcccccacgggcacccgctgctacgtccgcggcccgaccgccttcgtcgagcacgtcgcacggcctggcgcccgtgtcccacctgccgtctgcccgcgaccttggcccagttgcacgtctacggccccgatcccggcctgaccgcccgctgtcggggctgcgcgggcgtcgccctgcgcgtcgtcacccagcccgagtgcctctggctccaactcggcggcggggcaggcgcgttccggtttacccttccctccatggcgccgggcgtcaggcgtccttcagatcgatccccctggtctcccgcatgaggtaggacgcgatccccggcgtgcctggagcatgcctcgatggctggaccggctgctcccggacgtcgacgtcgaaggcgcacgtctgcccgcctcggcccggactgaaccggccgtgggcacggaagccgagaggaaggacgtgccgaacggcaaggcggccgcccggatctgaacgacctcagcgaactccggcgccgccgacgtccgggggacatcgacggcccggccgcaccccgtgcctctcccgggagagatgcggggtgccctggccgcaccgctccagttcagcgaccgtcaccacatccgtccccaggctcgacactcctgatcagcatgcactccggttcggcctgcccatgtgcccgggcctcagaagctggaggaatgggcaggggcggcggggtacgcacggcggtgccccgccgcgagcgcggggtccctgcctgtggggccgacggttcgctggagcagcggagagccaccggcgcttcaatgttgacactgcatactctcctgcgtaatgtgtgtggcgtaaacattctttcgagggagctgccgtgaaggctgtatcgatcaaggagccgggtggccccgaagttctggagtgggtcgaggtcgaggacccttcgcccgcccccggcgaggtgatcatcgatgtggtggccagcgccctgaaccgggccgacgtcatgcagcggtggggtctgtatccgctgcagccgggtacctcgccctatccggggcttgaggtctcgggccgcatcagcgccctcggcgagggaatcaccggatggcgggtgggcgacgaggtctgtgccctgctggccggaggcggttacgcgcagaaggccgccgtcccggtcgggcaactgctcaccatccccaaggggatcgggctggccgaggccgcaggacttcccgaggccgccgccaccgtctggtccaacatcgtcatgaccgcgggtctgaaggcgggcgagacgatcctcgtgcacggaggcgccggcggcgtgggcacgatggcgatccagatcgccaaggcgctcggcgcccgcgtcgtcaccacggtcggcgggcgcgagaaggtcgcccgggcacgcgagctgggagccgaccaggcgatcgattaccgtaccgaggactttgccgagcacggtccttatgacgtgatcctggatgtcataggtggcgactacctcgaacgcaacgtccgttcgctggccgccgacggccgcctggtcgtcatcggcctgcagaagggcctggaaggctcactcaacctggccgagatcgtcttcaagcgggtgtccgtgcacggcactacgctgcgcacccggtcgaaggagcagaaggctgagatcgttgccgaggttcaggagaacgtctggcccttgatcgaaagcggatccgtgcagctggtcatcgaccggagggtgcccatggccgaggctgccgatgcccaccggctcatggaggcaggcggtcatatgggcaagatcctcctcatcaacgacgagaccgcatgaggaagagccgctgaacgaggcgggagcctgcaggcaaggctgacggcttcggcaggaggagtgtcgaaggatgacgcttccgaagggttcagcggcaggtgccatggcgtctgccgcaggcaggagtcgtgaggcgaagggtgaacgccggatcgacctgaacgtcgatgcgcaggggtgccgcacgatgaagaggtggtcgcgcgctggccacacgcatcgtctgcgcgggcatcggcccggctgcgcgacagcctgactccgccatgcccgccgtactgctcctgcatttccggcatgcggttctgagcagccctggagcaccactgggctcgtagatgtctgcggctccagaggtgccgagccgagcagggccgccggctccggcccggtggacactcccggccggagcgcctcggaccaccccgacactgtcctgcccacctgttctcgctcaccacccgtgctgccgcaagaacggctgacaggcttctgcgcgggttgcagtggacgaataggacataaaggatggaatcgctcctcggtgcctggaacggacacagcttctacagccgatggttgcgcgaacagatgcacacacgtgtgtgctaccgaccgggctctgggtgcgcccacgaaatggagtcgacatgaccgatcttcctcctccgatcacgccctacctcgagcctgcggcgaaggaactgtgcgaggccacggatccgcatccgcggatctacgaggttcccccggagaagggccgcgacatcctgctcggcctgcagagcgacccgagcgtgccccgcccggaggtcgacgaggagtgggtcgacgtggacgcgggcgaatggggtacggtccggacccggatcatccggcccaagggggccaccggacagctgccggtggtgttctacatccacggcgccggctgggtcttcggcgacgacaagacccacgatcgcctcttccgcgaactggccgtcggcgccggtgcggcgggggtcttccccgtctacgaccgggcccccgaggcgaagtaccccacccaggtggagcagaactacgccgtgggccagtgggtcctcaagcatggcgcggagcatggcctggacacctcgcgcatcgccgtcaccggcgagtcggtcggaggctgcatgtccgccgtcttcgccttgatgaacaaggagcgcggcggcatcgacctcaaggcccaggtcctgctgtacccggtggccaacgcggacttcgacaccccttcgtacctccagttcgccgagggctactacctcacccgcgacggcatgaagtggttctgggacgcctacaccaccgaccccgcccagcgcaccgaggtctacgcctccccgctccaggcatccctggaacagctccggggacttcccaccaccctcgtcatcaccgacgaggccgacgtcctgcgcgacgagggcgagcaatatgcgaacaagctccgtgaagccggtgtggacgtaacctccgtccgcgtggcgggcatggtccacgacttcctcctcctggacagcctgcgcgacacccgcgcggccaacgtcgcccgcaagctcgccgtcgacgcgctgcggaccgccctgcgcaagagctaagacgaccagactcgccgcagcgcccggatgcgatgctgcccagaagcagccaggcatcgtcgtcggctacgccggggacgcgaaggcggaacagcagggggtcgaaatcccggcaacgccgggatttcggccccctgtttcgtcgaatcgacggccgggcgcaccgggcgaaccgacccagctacgcgcgcgcctcttccgatggttcccatacgcttccagcgcctccgggcgtcatgtagagacgagagtggtacatcccatgcatacggttctgggcgccaacggaccgatcggtgaagagctcgccaaggagctgtaccgcagcttcacgcacgacatccggctggtcagccgcaaccccacgaagattcacaccaccgatcaactcgtcaaggccgacctgacggaccccgaagcaacggaacgggccgtcgagggcagcgaggtcgcctacctcaccgtgggtctgccgatggactcggagctgtgggagcagcggttccctgtcatgatgcgcaacgtcatcggcgcctgcgcgaagtacggcaccaagctcgtgttcttcgacaacacgtacatgtacccgggcacgaccaccccgcagaccgagtcgacgggcttcgagccgaacggccgcaagggccgggtgcgcgcggagatcgcgacgatgttgctgtccgcgatggcggcggggacggtggacgccgtcatctgccgggcgccggagttctacggtccgggaaagaccaagagcctgaccaactcgctcgtcttcgaccggatcacaaccggcaagcgaccgttcgtccccgtcagcgcgaagacggtccggtccctcgtctggacgccggacgccggccgggcgatggccctgatcggtaacacccccgacacctacggccagacctggcacctgcccgtcgacccgcaccgccttacctacgccgagttgatccaggtggccgaagaggtcactggccgccgcatcccgtacaccgtgctgcctctggcggtattcaccgtcggcggccgcttcatcggcccgctcggcgaggtcaaggaactgctgccgcgctaccgaggggacaacgttttcgacacccagaagttcacgaagcgcttccccggcttcgccgccacctcctaccgcgagggtattaccgaactccttagctgactcggcgtcgccccgccgcggcaggaccgaagtactggaacggccgcgccttcgatctggccagtagcctgccgcatcgcgcgcatgcgcgtaccccatggagccggttgccctccccgtgcgtgctggcccagatcacccgtgcgaccgaagagccgacgactcaggtggtgtggtcgtcgttgacgtactcggcggggtccagcccctttgttttcgaaagcggcggcggtgcaggtggggtagaccgctcgttcctggcctgccctcaccccccgcccgacgacaggcgcgcaggctcgggcgatttgatggccggacggttatggtcgaggcaaagcccgctctcggtcgcgcacgtcaaagcggttcctattttcgcagccgcctcgggaccgggcggttttcccggcccatgaggcggggacgcgggagcctcggacgctgacccgattgtgctcgggctctccgctttcgagtacgcgcagcattaactgatcgtttcggaattccatctgacctctcggctgacacggcgctgagtggtgcgacggaactggtaactctggctgcgcaactctgccggcaggccggcgtgcaggcgtggccggacgccggcgtcagtccggtcccgaagccgacgccaggccgtcatttctgagcagaccaccgtttcggccgggacatcacgccatgcgactccggtccgcagtacatacatgcccgggcggccatcggccccgagggtgccgctcagctcccttcgagttcccggcgtacggtagcggcgatgcgggtcagtgcggcctcgaggtggcggcgctgagcggcgctgagtggatcgaacacgagccgcttcacctgcgcgacgtgttccggcgcgctctcgacgagcttctgccggccggcgtcggtcagggtggcgagggtgtatcgaccgtccccggggtcggttcggcgggccacccagtcgcgggcttcgaaccgatccatcaccttcgacagccggggcagggtgctgtcgcagagccgggccagttcgctgagccgcatcgtggcctcgtcggccatggacaactgcgccaggaccccgtactcgaagttggagatgcccgcctctcgctgcagttggcggtcgagggccgcggggagggcgatgacgacggtgagcagcgcctgccacaggtcctgctggtcgtcgtcgagccagggcgactgagtatccatgaaccccatcatacttgcccgagcaacccgaatcacttgcctgggcaacccttcgtgggctacttttcaacttgcctcggcaagtgaaaacatttgcccaggcaagtgaaggagttgatttcgatgacggccaagagcagcctggctcggcccctcccgtcgcgtgctccagccgcggcctacgacgacctgctcgcccgggtcctgccaaaggcgcgcgaacagcgggtgtggaatccctccgacgggtccctgcccagcctcttcgtcagccacggtgcgccgttcactctcgacgatccgcggtggctcggcgacctcttcgactgggcctctttgatgcccaagccccgagctgtcgtcgtcatctcggcccactgggaacgggcgccggtcgcgatatccggggccgaggccggtaccccgctccactacgatttcagcggcttccacccccggtacaagaccctgccctacgcgaccccggacgccaccgacctggctcggcgaatcacgggcctgctggggcggacgcctgtgcacgcgttcgccgaccgcggcctcgaccacggcgccttcatcccgctcatggccatgtatcccgcggccgacgttccggtcgtgcaggtgtcgatgcccagcctcgaccccggcgccctgctcgaactcggggcacgtctacggcccctgcgtgaagaaggcgtcctcgtgctcggctcgggcttcatgacgcacagctccgccgtcttccaccgacccgagctcgccggcgacaccaaggccttcgacgaatgggccgtcgacgccctagcccggggcgatgtcgacgccctcaccgactaccgcaccaaagcacccggcgccgcggtcgcccatccgacggccgagcacttcgtcccgctgctcctggccgtcggcgccgccgatgaaccggccagtgccgtgagcgccatcgaccacatggtgctgggcaactcgacccggtcggtgcagctgacctgaggccccgatccgcttcaccgttctgcctgatcgcctcatccctgggcggcggcatcaacacatcctggaggaagtttcatgaaggcaatacgtttccacgagttcggcagcagtgaagtcctgcgctacgaggacgtcgagcgtccggtccccggcgccggccaggtgctggtgcgggtggcggccacgtcgttcaacccggtcgacgaccacatccgcgccggtttcctggccgagatgatcccgatcgcgctcccgtacgttccggggatcgacctggcgggcaccgtcgctgaactcggttcggacgtgaccgggccggcggtcggcgaccgtgtcgtggcgatgttgcccctcgactccgccggcggcgccgccgagtacgtgctcgtcccggccgcgtctctggccccggcgccccggacgaccgaactggtcgacgccgcggcgctgccgctgaccggtctggcggcctggcagacggtgttcgagctcgccgagctgaagcccggtcagacggtgctggtcaatggcgcggggggcgcggtgggcagcctcgtggtgcagctcgccgtcgacgccggggcacacgtgacggcggtggacgcaccgcggcatgccgagcgccttcggggctacggggcggaccgggtcaccggccccctcgacctcgccgcgggtccgggcgctgtgggcggcccgttccaggtcgtggtgaaccatgtgcgcgtctccccggaggagctcgcgcggctgacgaactacgtcgccgacggcggggtctccgccagcacggccggtccgatccccgaggatcccgcccggggagtgcgcagcgcgagcctgtgggtccgcagcgacggagcccagctgaccgagctggtcgccaaggtggacgccggcaagctccgggtccacgtcgccgcccaccgcccggtggcagagctggccgccgtccatgaggaggccggcgccgggctgctgcccggcaagaccgtcgtactcgctccctgatcgcacccgatcgggccgcccgctgctcgctctccgcgcctccgcacggacagcctggcacccgggcacccgggcacccgggcacccggtcagccgggccgagggtgccgaggtctcggtgccctcggccttcggcgtctcctcgcttccggtgttccggcggtcgccgcggcgggttcccgtggtgtggcagaccggatctcggcgcgacggcgggcacgaaggcggtcccgctggaggcgcggtccgcgggacggatgaggagggtgtccgaacgcgttgtcactggggccgcctagagtctctcccactcgtcacggtgcgttgccgtcgacgggtctcatcagcgtgccaccggttcggcggccgttcggaaacaggggagaacagcgcatggggtgggtttcggcaggcgattatgaagtcgccctggaggcgggcaaggtggtctgccgcaacgggaagggacggcgactgaagtccgttccggccaagttgaaggaagacccggcggtcgtcggtctccggcagttgaccgagtggctggagcggcacgagcgccggtgcctgaccgacgtggagcagtggatggtgcgttcgctgcccgttcccacggccgtgctcgcccgggtctggcccgacccggcgtggcaggcggccctgcgggacgtggtggtcaccggcgtcggcggtggggtcgcgggatttctgcgcgatgtcgattccgagcgtggtctcggcctcgtcgacctggacggtgacacggtccgcatcacccccgacgtggtcagcgtgccccaccccgtcctcctcgacgacctcgacgacctgcgggagttcgcggtcgaactgggggtgagccagaacgtggagcagctgttccgagaggtgtggcaccgcccgccgggcctcgccccggagaccacctccgtggatacctacgccggtggcgtgttcaaggaactgcgcttcctgcacggccgcgtcactcagctcggttaccggtcgcgcgggggatacgcggtctgcccggtcgtcgaggacggcgccaccgccgaggcgcgcatctggatcggcgagcacgacggatacgacgcatacggcaccgagacgggccccctgggctggaccgacccctcggggcgcgcgctgacggccgccgaggtcggtcccgttgcgtggtcggagggcatgcggatggcggcggcactctacgccggccgtgacgtggaggacgaggagcgggcggcatgagcaccacgacgacgaacaccgacgcgagcacgacggcaccggacgccgccgtccttcccggccaggcccggggggagagcacttccggcctcgccgccgaggcccgcgcgacggccctgctggacgcgggcgccattctcccggccggcaccagcggccgggacgacgccgacgcgctgaccgcccgtacctacacgcacaccgccctcggcgaccgccccgtggtccggctcgtgcccggcacgctcggcgaagccgaggacctggccctggagttcctcgggctggcccggacctccgaggcccccgtcgtgggtcaggtgcgccgcgagacgctgggtttcccggcctgggcgctggtcaacgacccggccaacgggcaccacgccctggccctggtcaaggacatcgagcggctgggccggcaggccaagggccgtgccggagcggccaaggagggcttcgacgcactcggcgcccggctcggccgggccgtgccccacttccttcccacctactacgagcaggtggcacgcctcttcctccaggccgagaaccccacctacgccgcctcgttcttcggcaaggcccgcgaggccgagcgggtgcacggactggtcgtggacgaggagcggcagcgggctgtcttcctggagttcgccctcgtcggcgcgctgaccgtgaaggcgctccggcagtacgtacgggacctggtggcccggctcgaaccggcggacgcctgggcgcagttccgccgtctgctggtcgagcgctgcgcggccggcatgccgccgtacgcggcgctgccgcaggacgtacgcgccctggtcaaggccgccgggctggaccgcgaggccgccgaacgtgacctggtggccgatctgatcggctccccgggagtcgtccgcgcaccctcctcgttctgggagacctaccgctccgcgctcgtcgatctcgcccgacgggacgcggtcgtgcgggcgcggctcctcggcttcttcccggagaccttcagcgagagcggcggggacgcggacggcgaacccggctggctcgccctgctggccgagtccggcgccgatgagctgctgaccgccctcccggatacctccggcaacccttccgacgccaccgccctctccgccccgtccgtctccccggcggactggctcgcccgctgggaggcacaccgagggcgcagccgggtcacctccggccgctgcccggggaccctcgacctggccgcccggatggcggaccggctccgcgccgacgggcaccccgtcgaactgttccagggccgctggcagcgcaccgccgatctggaccttctcgacctctgcctggcctccggcatccccgtcgccgagccggacgaccaggacgcggggaccgcgcggtccctcgctgtcccgatcggcccgtggctcaccgacaccacacccggcgcgcgcgatctcaccgccgtcgccgaacggccgttcttccgcgccctcctgagccggaacgtgggggacttgggcgacgggcatcgccagcggctgagcgacgccggcctggcgaaggtcgcggcgcacccggtgctctccgtcatcctgcgggagtggctgaccgcccgcgccgaggagtacacggccgcgcgagggctccccgggctgcgcaccgccctcaacaggctctcgtcgttccgttccgtggtcgcggacgtcgccccggaaaccgtacgactcatcgagagccacgatgtcgtgccgctgctcgcctccaccctgcgcaccggcatcctcgacgaactgggctggcccgcgctcgacgagacgtacgccgaactggccgccgaggccgctgccgccgcgcgccagcaacgcaaccggcgggagagcgtcggcgtcaccggcgcttggccggcgctgatcctcaacaccctcgaacgggccgtcgtcatcggcccggaaggcgttctgctgcggcacaccctgcggctgcccgccaccgtcgaccactggcggacgatcgccctgcgttacgtcgacggcgagttgctggtcatctggtgggaggacggcaagcagcgcggctactggtcgcaccgccccgccgaggtgttcaccgtcggcggcgagcagatcccccgctggggtggctccggcccctccgacgacgtctgcctgccactgcccggaggcggccgcgccacgggcggaaagggcctgcacgccggcgacacgtccctcccgccccagcgcgccgtcatctccgacggcaccggttactggcgagagggccaccagggcacgcagcgggtgtggctggagtacgacccggcaggcggcacgcacggccgtgcttccctccccgccttcctccgctccggggtgcgggacggcgcccggctgctcgccgagcactgccaggtgctgcctctccagcccggtctggagaccaccccgttcggcacggacggcacggtcctcggccgctgggtccgccgcacggtcaccgagaccggcacggccgcccccgccgacgggcaccggatcgtcaccggcacccccgacggccacacggtcaccctgccgcacccgctgcccggcggcggctccccggtgccgctcggcgccctcaccctgcccggcgggtcacggccggtcgcggccctgaaccgccgttccgtggaggcgcacccggcggactcggacggcgccggtggcagcctgtggtccgtcacccccgactcctccggtgggaacgacgccgcgggcaccgcctatgtgcctcccgtcgcctactggcacgccctgcgcccgagggacgaacggggctccatggccctgcggaacctgacggacgcccgggcggaggaactgtttaacgaggtcgccgccgcggtcgcccggcacctggaggcgttccgggccgtcgaggagtacaccgggccctcctcgcgggagctgaccgaggaggccgccgcccgggtgctccccgaggtgtccgacgcacggctcctcgcgggcgtcaccgcgctcgtccggaacgcggtggaccgggctgtcgcggccgcccggtatctggaaccgcccaagcccgtgcagccggccgctccccgggacaccgcgcgcaccaagggcatgttcttcgaccacgagcccgagcacggcgacgacacgacgctgcggaacgcctccgcctggggctccgagcggatgcacggcggcacctggtggggcggcgggaaccggtggaccgtgatccggcagatcctcgccgtcaaccacgtcctcggcggtgagccggcgttcggtccgcccacgccgtcgaaggtcccgttcacctccgtggacggctggcagcgggacgagtacaccgtgcccggcgactccctcacctggacctccgtcctcgacaagctgcccgaactggcctaccgggccgcctcggccaccacctcccccgaacaccgcaccgggctcctcatcctgctggaagccctcgccgcgggcccgctggccgacccggcgggcacggtgcggctggtggagctcgtcgaaccgctcggcggagaagcacccgggcggggacgccccgaggccgtgcaccgcctcggccaggtgctccgcaagggcgcccgcacgatcgtggtcctcgccgaccgaggccggaacaaccgggacgacgcggcacgctggctcgccctggaccacgatccgaccggcgtcttcggtcccgtccccggtttcaccctggaccgtgagcgcgttcaccggcagggcatcgcccgcgaccggctcacccggctcaccgcgctggtacgggagcagggcccggcaccctggcgacccgaggcggccgaggcgttccacacggccaccggaatcggtcccctccagtccgccgccctgctgtcggcagccgtccaggaacccggcgccgagg

SEQ ID NO: 3008 - DNA, 2519 bp, Unknown
  Kingdom: Bacteria, Phylum: Actinobacteria, Class: Actinobacteria, Order: Streptomycetales, Family: Streptomycetaceae, Genus: Streptomyces
cgacccgccgtcgggccgggtcaggacgacgaccagcacgaccgcggcgaccagagccgtcgcgatcgccgcgatccggggcaccgaacgccaccagggacggcccggcccgacggcgggtcgaaggcgggtggcgaggtcttcctccaggcggcgggcgactccgggccggatccgttcacggagtccacggcccgcgacggcgaccccgaacccggcacggccagcccctccgtcgcaccgagcgcgtcgaggaccggcgcgcaggcgacccggggcgtggacggcgcggccccggggctgtacgggggcacccggaaggtcgccagttgcgatgtggagcagcagatcaaggtgttgaaggcggctccggacaagaaccgggcgttcgcctcggtccaggacgtcgaaccgtccgccgtgcccggctatctgcgagggctcacccccgtgacgctgcgcatggacacccgcgtcaccaaccacggctaccaggacggcgaggccaacgcctatcaggcggtgctccaggcgggtacggcggtgctcgtggacgaccggggcgtgccccgggtgcgctgcgcctgcgggaacccgttgctgccgcccgtcgcccaggaggagactccgcgcctgacgggcaaggcctggccgggctaccgggcctccgacgtggtcgtggtgacgccgtcggagaaaccggtgaaggagttcgtgatggtcgatccggagaacggcgactggttcgaacggccggccggagacacgggcgacggcgacgagaagacggatccgccgaaggacgcgtccgcctccccctgcccgcccggatccgaccgtccctgcccctcgtcgtccggggccactccgtcggagtcctcgccggaggacccggcgtcgcggccgggcgacgatccggcgacctccgaaccgccgccggaggacccggcgacctcggagccgccgcccgacgacccggcgaccgaacccgcgccggagaccccgcccgactcgcagtcggccccgcagccacccgggccggactccccggacccgcaggatcccggaccggggacggccccgcagggggctccctcgttcagctgagcaggccggggtccgcagggtgcgcggctcgccccgcggggccttcagcccacggcgtcggggcggctctccagcggagggttctgcgcccggttgcccgaacgcactccggcggccgacgccgccgagtggagggagcgcagggcgacgagcaggaaaccgatgtcgtcgaggtagacggggtcgggcagcaggtcgaccggtgacacggtgtagatgacggccgcccagacgagcgccttgctgcgcagcgggatcccggcgtcgaccagcagcttcctggccttgaagacgcgcaccagaagcacgacggccgaggccagcatgatcagcacggccacggcgccgagaacgagccaaacggtggtgtccatggctcatcgtgtacccacttgtccccgtatgacgaacccgtggcggcacagtcgccgttccggggccggggtatcccgcggtgcgggtcacgccgaaccgcgtccccgggcctccgcccgcctgcggctgcggcgcttcagggcccgccgctcgttctcggacagtccgccccagacgccgaagtcctgcttgttctccagggcccactccaggcaggcggcctgtacggggcaggtccggcagacggccttggcctcctcggtctggacgacggcggggcccgtgctcccgatggggaagaacaggtccgggtcctcctcccggcaggcggcgtgcaggcgccagttctccatgctgctcaactccgctcactcccgatgtcgatgtgccgtacgtcgcttgccgtacgtgtcttccgtgcgggtgaccgacgatcggcacctcaaacccgtaccgggcgcgtgtgttgggcggcgccgcgacgcgtggcggccgttacgcgcgcgggcgggcccgggggcggtgcagggcgaggagcgcctgatcgtcctggatccggccgccggtgtgatgccccacgtcctcgatcagcaggtggaggatctgcgccggggtggcggggtcgccgatcagcgcgcggtggtggacgaggaagggcagccggacggacgcgtcgtagaagaccccggactcgtcgcgggcctcggtgaccccgtccgtgtagcagatgagggtggcgccgggtgggaacgggaacgtgtcgaccggccacgaccaggtccccagcgcgctcatgccgagcgggggcgcctcctcggagggtccgaggacggtggcccggccctcggcgtccagcagcaccggcggcggatgcccccggttgacgacgcgtacgacgccgaggtcttcggcgaactcggcgatcagcgcggtggtgaacccctcgtcctgttcctggccgccgcgtcggccgccctcgcgcaggagggcccgctccagcgcggccaccaggccgggcaggtcctccgcctcgtccg

SEQ ID NO: 3009 - DNA, 23108 bp, Unknown
  Kingdom: Bacteria, Phylum: Actinobacteria, Class: Actinobacteria, Order: Streptomycetales, Family: Streptomycetaceae, Genus: Streptomyces
ccggggcgcccacccttttccgtcatccaagacgcgtacgcgtacgggtcaggggccgttctgtccgccgtcctggcctcgtccgccgccaccgcccggtccgccgccgcccggtccgccgatcacgccgtccgggagttcgatgccggggaaccggtcgtcgtcgccgccgggcttggcgtcctcgcggtcctcgtcgccgcggtcgcggtcccggtcgcccttctccttttccttcttctccttgccccgggggacggcgaccgggttgaacccgggggtctccgccgcgtccagcgctccggtcatcgcgatgcgccagatcggaccgggcaggcagccgccgcagaccttgtcgtagtactggccgccgatggtgacgccgaacatcgagctcttctcgccgacgtcgtcaccgacccacaccgcggtggagaggttcggcgtgtacccgacgaaccaggcgtccttgcggtcgttggtcgtaccggtcttgcccgcgttgtcccggtcgctgagtccggcctgcgtaccggtgccgtcctccacgacgcccttgagcatctggttgatcgtgtccgcggtcctctcgctcatcgcccgcgagcaggacgtcttcggcacggagatcttcttgccctgcgggtccttgatggactcgatggcgatcggcgtgcagtacgtgccccggttggcgaacgcggcataggcgccggccatggagagcggggtgctgacctcaccgccgagggtgatcgaggggtattcgccgaccttcttgccgtcgccgcgctcgtagccgaccttcttggccatctccacggtctcgcagaggccggccttctgctccagcagcgcgaagtaggtgttgatggacttgccgagcgcgctcgtcatgtcccaggtgcccttttcggactccagctcgttctgcaggggccagtccgcgtagccggcgggggagccggcgcagttccggaagtcccgctccttgagcgtcatcttccagtccgtcgagaacgtcgtcgccggggtgatgcccttctccagcgccgcggccgcggtgaacggcttgaacgtcgagccgacctggaagccgtacgtgctgccgcccatcttgttgctgacggcgaggttcagcacggtctcgttctgcttctggtccaggccgtacgggcgggactggcccatggagaggatcttgccgctgcccggctggacctgcaccacggacgccgcgaacttgtcgtccttgttgaccttcgcggtggcggcctcgttggcggccttctgggcgcgcgggtccagggtggtccggatggtcagaccgccgaggttccagagcttggcccggtcctcgtcggtcttgccgaaggcggggtcggtgaggatcgtcttgcggacgtagtcgcagaagaagccggagccgctgacggcggtgatgcagccgttcttcggccgggagaccttcagcttgatgggcgtctccatggccttgtcggcctcggcccgcgagatgtccttgaccgcggccatccgcgccagcacgatgttgcggcgcttggtcgcttcctcgaggtcgttgaccgggtcgtagcggctcggcgactggaccagcccggccagcagcgctgcctcctccagcttgaggtccttggccggcttggagaagtagcgcttggacgcggcctcgacgccgtacgcctgctgcccgaagaacgtgatgttgaggtagttctccaggatcttcttcttgccgagttcctcctcgacctggatcgcgtacttcagctcgcggaccttgcggccgagcgtctgctgcgtggcctcggcgaccttctccgggtcgtcgcccgcctcctcgacgaagacgttcttcacgtactgctgggtgagggtcgacgcgccctgtgccgccccgcccgcctgcacgttgcggttcatcgcgcggaggatgcccttgaggtcgaccgcgccgtgctcgtagaagcgggagtcctcgatcgcgatgatcgcggactgcatgtacggcgagatgtccttgagcgggaccaccgtgcggtcgcgggagtacaccgtggcgatggtgccgccgtcgcggtcctggatcgtggtccgctgactgagcggtggagtcttgaggttggaggggatctcgtcgaatccttcgaccgtccccttggcggcgagccccagcgctccggctgcgggcagcgcgatgcctgccaggacagctccggagagcgcggcgacaccgaggaacttggcggcctgctgggtcgtggtgagacccccgcccgagcgcttctttggcatagggggcagcctaatccgtcgtggtgaaggtgtcgcaggagcaggggtctctcggagcgttcgggtaccggaccgtgacatccggacggtccgaccacctgctgaccgcctgccgaccctctaccgaacgcctgctgaccgactgccgcgcggaccggccgcggccttccggcgggagcgtgccgggcatcgtggcacgggcgcgcggacgcgaggcgcctacgttctcattcgccggacagacggacaggccttggcctaagctgctctcaactgtcacagcagtccggttccgtatcaagccccctgcaatcccatgcgcatcttctggtcattcttcgcccggcggatgagcaaccgcattgtccttcacgtagccatcgaggcgctcccgaaatcgccccgtatgtcgcgagaagtcccttgcaacttgagtgcactgtccccttttcacggagatagtcgcgcatgtcctcggctcactcccctgggtgatctgccgcatacgcatagtccgttcggaccattcaagattgggcccgaagggggtgttgtgctgtccccaccttccgtaacgtcctcaactggcagcggtgaatatgccgctaccgccgtgggggagcctcgattcgggagaggacggcgccgggatgggctgggtaaccgactggagtgcgcaggcagcctgccgcactaccgatccggatgaactgttcgtacaaggggcagcgcagaacagggccaaggcggtgtgcaccggatgtccggtgcggaccgagtgcctggccgatgcgctcgacaatcgcgtcgaattcggcgtgtggggcggaatgacggagcgggagcgccgcgcactgctgcggcgccggcccaccgtcacgtcctggcgccgactgttggagaccgcacgcagcgagtacgagcggtccaccggcattctgcccggagtcatcgggctggaggacgaggaactgcacgagacgtacgcggccgtcgggtaggcgccggcaccggtgagccggccccgtgtcaccggggcagggccgctgtgccatcaggtccagggcgctgtgccatcaagtcggggccgcgtcgctccggatggtgctcgcgctgctccggcggtgatgtctgcgctgctcccgcggtgatgtccgcgtcgctccggtgggtggtgactacgtcgctccggcaggggccggcgcggaacggtccgccagtcggtcgccgatggtccgaaggccgttcaggtcgtgtacgtcgccgggcagcgccgccacggccgtcaccggcacctcggggtgcagcgcggtgaagcggtcgcgggtacggtgctcgcgggcgacgacctgcatgcgctcggcgtgcagacgcagcagacccgccgtcagttcctcgacgccgacggcctcgtcagcggtcgcgccgacagggccggccgcgtccgcagggctcgtcgcgtcgtcaggggtggtcgcggatgtcgcgatgttctcgtggggcggctcgttctccgtcgtgtcctggtgttcggctacggtctcggggccggacgcctgcccggccgcgggggagaggggcggctcggtcggtccggaagcggtgaccgccgggtcgggggcttcctggtcaccaaggccagctttcccggccctctgatccacaatgcgggcgtcgccaagattttctgcggcggtcagcgcctgctcggcggagagccgcgaagcctcgctgccgtgcacgcggttgaggaccagaccggccagcggcatcttctcggcggccagccgctccacgaaatacgcggcctcgcgcagcgcgtcctgctccggcgtcgccaccacgagaaaggccgtaccgggcgcctggagcagcttgtacgtggcgtccgcgcggctgcggaagccgccgaacatggtgtccatcgcggcgacgaacgtctggacgtcccgcaggaactggcctccgagcagcttgcccagcgttccgctcatcatcgacataccgacgttgagaaacttcatcccggcccggccgcccaccttcgcgggcgccatcagcagccggatgaacttcccgtcgaggaacgacccgagccgcttcggcgcgtccaggaagtccagcgcggagcgcgagggaggggtgtcgacgatgatcaggtcccactcgtcgcgcgcccgcaactgcccgagcttctccatcgccatgtactcctgcgtaccggcgaagccggccgacagggactggtagaaggggttctccaggatcgccctggcccgttcggcgtccgcgtgcgcctcgacggtctcgtcgaaggtccgcttcatgtccagcatcatggcgtgcagttcgccctcgccgtcgatgccgtcgacccgccggggcacgttgtccagccggtcgatgcccatggactgggcgagccggcgggccgggtcgatggtgaggacgacgaccttccggccgcgctcggcggcccgtacgccgagcgcggcggcggtcgtggtcttgccgaccccgccggagccgcagcacacgacgatccggatgcccgggtcgtccagcagtgcgtccgtgtccagacccgcctcggccgcatccgtaccggatgtctccgctgtcatgcgtccccttcttcccccgcgccctgcttacggagctccgtggccaggtcgtgcagcgcggcgagatccaccccgtcgccgatcagcggcagctcggccgtcggcagcccgagaccggccagcaccgcgcgctgctcccgctccaggccgacccgctcggcgtgctcggccgcctgttcgaccaggggtcgcacgagcgccgcggaaccggtcactccggcccgggtcagcgctttggcgatctccttgcggcggccgcccgcggcggtgcgcagggcgtcctcgtccagcaggtgcgggcggaccatgttcacgaagacgctgcccacgggcagttcggcggcgcgcagctcggcgatgccgtccgcggtctcctggaccggcatctcctccaggagggtcaccaggtggaccgcggtctgcggggacttcaggacccgcatcacggcctgggcctggttgtatatggggccgatcctggccagcccggcgacctcgtcgttgacgttcaggaagcgggtgatccggccggtcggcggggcgtccatgatcacgtggtcgtagacgaaccggccctgcttgtccttgcggcgtacggcttcgcacgccttgccggtcagcaggacgtcccggacgccgggcgcgatggtggtggcgaagtcgatcgcgccgagcttcttcagggcccggcccgcgctgccgagcttgtagaacatctggaggtagtcgaggagggcgcgctcggcgtcgatcgccagcgcgtacacctcgccgccgcccggcgcgacggcgatcttgcgctcctcgtaggggagcgcgtcggaaccgaagagctgggcgatgccctgcctgccctcgacctcgacgaggagggtgcgcctgccctcggccgcgagggcgagcgcgagggcggcggcgaccgtggtcttaccggtgccgcccttgccgctgacgacctggaacctgctcacgtattcgagcctaaccagtccggccccggcctacgcacgggaccgtacgtgccaggcgttacagtcgggcccatgaccaagtgggaatacgcgaccgtgccccttctcgtgcacgcgaccaagcagattctggacacctggggcgaggacggctgggagctggtccaggtcgttcccggcccgaacaaccccgagcagctcgtggcctacctgaagcgggagaaggcgtagtggcgggcgccgtcgaggcgaggctcgccgagctcggcctgaccctgcccgccgtcgtgccgccgctggcctcgtaccagccggccgtgcggtccggggtgtacgtgtacacctcgggtcagctgccgatggtggacggcaagctcgccgtcaccggcaaggtcggcgccgaggtcacgccggacgaggcgaaggagctcgcgaagacctgcgcgctcaacgcgctggccgccgtgaagtcggtcgccggcgacctggaccggatcaagcgcgtcgtgaaggtcgtgggcttcgtcgcttcggcctccgacttcaccggtcagcccgccgtgatcaacggcgccagcgagctgctgggcgcggtcctcggcgacaagggcgtgcacgcccgcagcgccgtgggcgtcgccgtgctgccgctggacgcaccggtcgaggtcgaggtccaggtggagctcgacgacgcctgagggccccttttcgctcgtccttccgatcccgtccggtcacctcgaccgggcgggatcggtcgtgtgggtacgaggcgtgccgggcgagtccggggcatgtcgggccaccgcgacgatcggggagcctctcgaacggcgatcagggagcctctcgaacatcggcgcggttccggatagcctccggccatgtcccaaggtcagtggtaccccccggaatggcccgaccggatccgggccctcgccgccggtgagctgacggccgtgacaccccggcgggccgccaccgtgatgctgctccgcgacccgggcgggatcggtggcggtccaggcgggaatggcggcgatgtcggcgggaacggcggcacgcccggtggccctgtcgtgcacatgctgcggcggcggacctccatggcattcgccggaggcgcgtacgcctatccgggtggcggagtcgatccgcgcgacgacgaccggctgatcgggtgggccgggcccccgctggagcagtgggccgcccggctcggcgtggcgacggtcaccgaggcgcaggccgtcgtctgcgcggcggtgcgcgagacgttcgaggaggcgggcgtcctcctcgccgggccgaccgccgggaccgtggtcggggacacgaccggggaggactgggaggccgaccgggaggcgctggtcgcccgggaactgtccttcgcggagttcctggaccggcgcggcctggtgctccgctcggacctgctgggcgcctgggcgcgctggatcaccccggagttcgaaccgcgccggtacgacacctggttcttcgtcgcggcgctccccgagggacagcgcacccgggacgtctccaccgaggccgaccgcaccgtgtggatcgctcccgccgatgcggcccgccgctacgaccggggcgagctgctgatgatgccgcccaccgtgaccacgctgcgggccctcgcgccgtacaggacggccgccgaggcgctcggagcggccgacgggcaggacatgaccccggtcctcgcgcaggcccgcctggagggcggtgagctggtgctgagctggccggggcacgacgagttcaccaaacacgtgcccgcggcgggcccgggaggcggtggagcgtgagcgacgcagcggccctgcccggacagccgcgcgggaccgtggcctccggccccgcgaccgcccgtacggtcaacatcctcgcgcccaatccgtccgcgatgacgctcgacgggacgaacacctggatcgtggccgagcccgattccgatctcgcggtcgtcatcgatcccgggccgctggacgacgtacacctgagggccgtgatcggggccgtggagcggtccgggcggcgcgtgggactcacgctgctcacccatggccaccccgaccacgcggagggcgcgggccggttcgccgagctgacggggacgaaggtgcgggccctggacgcggcgctgcggctgggcgacgagggcctcgcggcgggggacgtgatcaccaccggcggcctggagctgcgcgtcgtgccgacgcccgggcacaccgcggactcgctctcgttccatctgcccgccgaccgggcggtgctgacgggcgacacgatcctcggccgcggcacgacggtggtcgcacacccggacgggcggctcggtgactacctggactcgctcaggcggctgcggtcgctgacggtcgacgacggcgtccacacggtgctgccgggccacggtccggtgctggaggacgcgcagggggtggtggagttctacctggcccaccgcgcgcaccgcctcgcccaggtggagacggcggtggagtccgggcaccgcacgccgtcggaggtggtggcgaaggtgtacgccgacgtggaccgctccctgtggccggccgccgagctgtcggtgcgggcacagctggagtacctgaccgagcacggactgatccagagctgacctggagccggcccggggacgaccggggtccggcacggcgaaggccccgccgacggacgtaccggagcgcgtactccggcacgtgctccggtcggcggagcccttcgcgtacgggggcgggtcagcgcgaacgcttcgccagccgctccacgtccagcaggatgaccgcacgggcctcaaggcgcagccagccgcggccggcgaagtccgcgagcgccttgttgaccgtctcgcgggaggcgccgaccagctgggccagctcctcctgggtgaggtcgtgcacgacgtggatgccttcctcggactggacgccgaagcggcgagacaggtccaggagggcgcgggcgacacggcccggcacgtcggagaagaccaggtcggacatctggtcgttggtcttgcgcagccgccgggcgaccgcgcgcagcagcgcggtggccacctcgggccgggcgttcagccagggctgcaggtcgccgtggccgaggccgaggagcttgacctcggtcagcgcggaggcggtcgccgtacgcgggcccgggtcgaagagcgacagctctccgatcagctcgccggggccgagcacggccagcatgttctcgcgcccgtcgggcgaggtgcggtggagcttcaccttgccctcggtgaccacgtacaggcggtcaccctggtcgccctcgtggaacagcgcgtctccgcgcgcgagggtcacctcactcatcgaggcgcggagctccgcggcctgctcatcatcgagcgccgcgaaaagcggggcgcgccgcagaacgtcgtccacgagttctctccttgtcggcctgttcagggaaccgtggtccccatcatgccggacggtaaaacagtgcgatcaatcacaaaccagtttgacgcacgggagtgccggaccctacggcagggggccgatcgggggcggatgtgccgtgacagcggtggttgtcggtgcctggctctaggctggccgggtgtccagaacgccggggagagcgcaggccaagggggctgacggagtgctgaagggcggtgattccgctgtgggcgaacagccccggccgcgcccggagaatgccgcgaatggctcccccggaggcgcgcacggctcccccggagagccggggaagccgctccggaagtcggccaggaggtccgtagtgtcatcgtcgtcatcaccaacgcccagcaaatccagcaaacccgacaaacctggcaaggctggtaagtctggcaaggctgccgagatgcgcgaggcggccacgaccgaggcggccacgaccgcggcggcctcggcgcgtacggcagccggagccaaggcggccaccacggcgcgcagggcgccgaaggcggagtcgcatctcgcgatggtccgccgggcgcgccggatcaaccgcgagctcgccgaggtctatccgtacgcccaccccgagctggacttccgtaacccgttcgagctccttgtggccacggtcctctccgcccagaccaccgacctgagggtcaaccagaccaccccggcgctcttcgccgcctaccccaccccggaggacatggcggcggccgtgccggaggagatggaggagatcctccggccgaccgggttcttccgggcgaagaccaagtcgctgctcggcctctcggccgctctccgggacgagttcggaggcgaggtcccgggacgcctggaggacctggtgaagctgcccggcgtcggccgcaagaccgccaacgtggtcctgggcaacgccttcggcgtccccggcatcaccgtcgacacgcacttcggacgtctggtgcggcgctggaagtggaccgacgaggaagacccggtgaaggtcgaggcggtcgtcgccgggatcttccccaagagcgagtggacgatgctctcgcaccgggtggtgttccacggccgccggatctgccacgcccgcaagcccgcctgcggcgtctgtcccatcgccccgctctgcccttcgtacggagagggcgagaccgatccggagaaggccaggaagctcctcaagtacgagatgggcggctatcccggccagcggctcagcccgcccgcggactacccgggaaagcccgcacccgcgctcggggcggagtgagggtcacgccctcgcctccgccttcactcctcaggacggaacggctcggaacgaaatggccgacgacaggcgttgtgaatcaacgggggtgcccatgacgcacgcgcagacacacggcacgacacaagccgggaacggctccgccgaacggctggggcacagcagcccaagaaggccgggacagggaggcggggtcgccgagaccggggtcgcggtgaccacggacggcctccccgcatggctcgaccccgtcgcgcgcgccgcgcgcagtgtccagccgcagcagctcagccgcttcctgccgcccgagagcggggccggccggcagtccgccgtcctggtcctgttcggcgagggggaacgcgggcccgagctgctgctgatggagcgctccgggaccctgcgctcccacgccgggcagccgtccttccccggcggcgcactggatcccgaggacggcgaccaggccaccaccggacccctgcgtgcggcgctgcgcgaggccgaggaggagaccgggctcgacccccgcggcgtacagctcttcggcgtgcttccccggctctacatcccggtcagcggcttcgtcgtgacacccgtgctcggctggtggcgcgcgcccagcccggtcggggtggtcgatccggccgagacggcccgggtcttcacggtccccgtggcggatctcacggatcccgcgaaccgggccacggccatccatccgagcggtcacagcggtccggcattcctggtcgaatcggctctggtctggggcttcacggccggggtgatcgaccggattgtgcactacgcgggatgggaacgcccctgggacagggccagacaggtgccgctcgactggcgcgcatgacacgctggctgttctgctgcgctgttccgggcccggcccggaccccgtcaccaccgacgggccaggtgacgaaactgcgaggctacagacggtgaacgtgctggacatcctgctgctgctggctgccgtgtggttcgcggtcatcggctatcgccagggtttcgtcgtcggcatcctgtcggtgatcggcttcctcgggggcggcctcgtcgccgtctacctgctgccggtcatctgggaccggttgaccgaggacgccgaggtctccaccgccgtcgccatcggcgcggtcgtcatcgtgatcgtctgcgcctcgatcggccaggccttcaccacccacctgggcaacaaactccgccggtacatcacgtggtcgccggcgcgcgccctggacgccaccggcggtgccctggtcaatgtggtggccatgctgctggtggcctggatgatcggcctgctgctggcgggcacctcgctgccgaccctcggcaaggaggtccgccaatcctcggtcctgctcggcgtcgaccgggtgatgcccgaacaggcgcccagctggttccaggacttctcttccgtcctcgcgcagaacggcttcccgcaggtcttcagcccgttcgccgacgaaccgatcaccgaggtcaaggccccggacccggccctcgtgggcagcccggtcgccgcccgcgccaagaagtcgatcgtcaaggtcgtgggcacggccccgagctgcggcaaggtcctcgaagggaccggcttcgtcttctccgagcgccgggtgatgaccaacgcccatgtggtcggcggcgtggacgagcccaccgtccagatcggcggtgagggccggctgtacgacgcgaaggtcgtcctctacgactggcagcgcgacatcgcggtcctggacgtccccgatctccgggccaggccgctgcagttcaccggctcggacgacgacgcggagaccggcgacagcgcgatcgtcgcgggcttccccgagaacggcgcgtacgacgtgcgctcggcgcgcgtccgcgcccgcatcgacgccgacggcccggacatctaccaccggggcacagtgcgccgcgatgtgtactcgctctacgcgacggtgcggcagggcaactcgggcggcccgctgctcactccggacgggaaggtgtacggagtggtgttcgccaagtcgctcgacgacccggacaccggctacgcgctgacggccgacgagatccgcgaggacatcgagatcggccgcgaggccgaccagcaggtcgacagccagggctgcgcactctagggctgtcgtcacactgccgtctgccgggcgccgacggcagtgtgacgacaggccctggggcctgtccggcgggatcgtcagttacgggggtgtcgaagccgtgccgagacccagcgggcccgacggcggaggatgcgcggaatcccgagacgggaacggtgaaggtcatgcacatcgtgcacccggccgcgagggccgcccccctcatgagtgctcacaccggctgacgcggtggagcggcggttgcgtgcttcgtcagtgaagtcgtgcgtccagcccataccccgacgtctgcccgtgacccatggtcggtaatcgtgtgccagtcagccaattggcctatgcggcaggcaattggctgttcgtcggacacacgtgcccgtgacgggcgggcggctaccggtcgggctcggggtccttgagccagttgatgagttcggtggagaagccgatcggatcctcctcgtgcgggaagtggccgacaccatcgaaaagtcgccaccggtagggcgcctcgacgtactggccggacccggccgaactgcgggtgcggaccgccggatcgagcgacccgtgcaggtgcagcgtgggcacccggaccggacgcttcatccgccggttgaactggatcccgtccggccgcgccatcgaccgcaccatccagcggtacggctcgatcgagcagtgggcggtggaggggatgctcatggcccgccggtaggcgtccagggtctcctcgtcggggaactccggggtgcggggacccgcccagtcctggatgaggcttccgaccagggcggcgtcgtccgcgaggagctgacgctccggcagccacgggcgctggaagccccagacgtacgaaccggcccgcgactgcgcgaagtcggacagcatcgacgagcgccagcggcgcgggtgcggcatggaggagacgacgagccggcggaccagcttgggccgcatcacggcggcagtccaggcgaggtaaccgccgaggtcgtggccgaccagggccgcgtcggactcaccgagggagcggatcaccccggtgacgtcgagggccaggttggcggggtcgtaaccgcgcggcgtgcggtcgctgccgcccaccccgcgcaggtccatcgcgacggcccggaaccccgcgtcggcgagcgcgggcagctggtgacgccaggtccaccagaactgcgggaagccgtgcagcaggagcaccagcggcccctcgcccatctccgcgatgtggaaccgggcgccgttggccgccacgtcgcggtgggtccagggcccgtcgaggcgcaccggacccccggccgtggtccggcccgcggggctcggggccgggtcggccgaaccctgcgggcccaccggacccgtcgggccgaatgcgctggaatcgggaaccgtcatgtggacgagcgtgccacagcgtcggccttgcccttaccggagtccttgccggagccgctctcgatgctcttcttcgccagggagctgccggagcgctcgatgatcgcgtcggccgcgatcgacgggcgcgggtgcggcttggccttctgcaggacggcggcggtctgcttggcggaggcgatggacttctccggcggcttgatcttcttgaacttccgcaggccgatgaatccgatcagggcggccaggaggatgaaggcgccggccacgatcaggaaggaccacgccaggcccaggcccaggttgtggatcccgtacgcggccgcgaagctcagcatcggcatcgtgaacagcagcagcacgcccgcggcgatgaacgccgcgctgccgatcgccccgcgcttgacgtcctgccgcacctccgccttggccagggcgatctcgtcgtgcaccagcgcggacatctcggccgtcgccgaggcgaccagctgcccgatgctgcggtccgtactgcccgcgtagttgccggggtcgctcatccctgactccctctccgtcttcgacacatccgatgtcagatcatgccggactgttcggcttgttgcgcgctgcccccgcccgctcttcggcgatacggcggtgttcggccgccttccgctcgtgaatggcggccatgcgcaggtgataatccggatcatcctgctcatagacgtcgggtaccccggattcgtcctcgtccagctcctcggcctcgtacagctccttgtacctgcgtacccggagtttgagcagtacgcaggcgaacagggccgcgatcagcgaaccgagcagtacggcggccttgatctcgttgatcatctcagggtcgccctcaaaggcgagctcgccgatgagcagcgagacggtgaagccgatgccggcgagcgaggcgagtgccaggacatcggcccaggccaggtccttgttcagctccgccttggtgaagcgggcggcgaggtaggtgccgccgaagatgccgacggtcttgccgacgacgagaccgaggacgacgccgagcgtctcgggccgggtgaagacgcctgccagcgcctcgccgttcagcgcgaccccggccgagaacagggcgaacagcgggacggcgaccccggccgacagcgggcggaccaggtgctcgatgtgctcgccaggtgagtgcttctcgccctcgcgacgggtgcagcgcagcatcaggcccatcgcgacaccggcgatggtggcgtggatgccgctgttgtacatcaggccccagatgaccagagcgagcggaacgtagacgtaccagccccggacgtcgaagcggaggaggaggtagaagacggccaggccgaggacggccccgccgagcgccaggaagttcaggtccgaggtgaagaacaccgcgatgatcaggatcgcgaagaggtcgtcgacaacggccagggtgagcaggaaggcgcgcagcgcggacggcagcgaggtgccgatcaccgcgaggacggcgagggcgaaggcgatgtcggtggccgtggggaccgcccagccgttcgtcgagccgccaccgacgaccgtggtgaggaagtagacgagcgcgggcaccgccatgccgcacagggccgccaccaccgggagggccgccgccttcggatcgcggagttcgcccgcgaccagttcgcgcttgagctcgacgccggcgacgaagaagaagacggcgagcagtccgtccgccgcccagtgcgccacggagaggtccaggccgaggtcgccggggccgaagtggaagtggctgaccgcttcgtacgagccgccgaaggtgttcgcccagacgagtgcggccaccgccgccaccagcagcagcacgccgccgaccgtctcggtacggagagcctccgccacatagttccgctcggggagcgagagcctgccgagcagcgggcgccggggcggtacgggcggcgcgggtgtgggcgggttgggcggtgccacgagaggacctccaggtcagggcggcatgagggcatgacggatgaacatgccgaccagacttcccggcgcccctgtggagatgttctctgcagttgtcggtgaagcgcccactctaccgggggcgtaaagagcgggatcgtattgggtgatcttcaggctaaatgcccgatgggcacccggcgcgttgccggatgcccatcggagtcgtactcatgcgtctgttctgtgctgtcagtcctcggacgaggaggacggcagctgggtggtgatcaggtccatcacggaggagtcggtcagcgtggtgacgtcgcccagttcgcggttctcggcgacgtcgcggagcagacggcgcatgatcttgccggagcgggtcttcggcagctcggcgaccggcagcacccgcttgggcttggcgatcgggccgagggtcgcgccgacgtggttgcgcaggtcggcgaccagttcgtcggaggaggtcgcggtgccacgcaggatcacgaacgccacgatggcctggccggtcgtctcgtcggcggcgccgaccacggcggcctcggcgacggacgggtgggagacgagggcggattcgacctcggtggtggagatgttgtgcccggagacgagcatgacgtcgtcgacccggccgagcagccagatgtcgccgtcctcgtccttcttcgcaccgtcgcccgcgaagtacttgccctcgaaacgtgaccagtaggtgtcgatgaaccgctggtcgtcgccccagatggtgcggagcatcgagggccacggctcggtgaggacgaggtagccgcccccgccgtccggtacctcgttggcgtcgtcgtccacgacggtggcggcgatgcccggcagcgcgcgctgggcgcttcccggcttcgtctccgtcacaccgggcagcggcgagatcatcatcgcgccggtctcggtctgccaccaggtgtccacgatggggcacttgtcggcgccgatgttcttccggtaccacatccacgcctcggggttgatcggctcaccgaccgaacccaggacgcggaggctgctcaggtcgaacttcgcggggatgtcgtcaccccacttcatgaacgtacggatcgcggtgggcgccgtgtagaggatcgtgacgccgtacttctgcacgatctcccagaagcgtccctggtgcggggtgtccggggtgccctcgtacatgacctgcgtcgcgccgttggccagcgggccgtagacgatgtacgagtgcccggtcacccagccgatgtcggcggtgcaccagtagacgtcggactccggcttgaggtcgaagaccgcgttgtgcgtgtacgaggcctgggtgaggtagccaccggaggtgtgcaggatgcccttcggcttacccgtggtgcccgaggtgtagaggatgaagagcggctgctccgcctcgaaggcctcgggggtgtgctcggcggactgccgggcggtgatctcgtgccaccagacgtcgcggccctcggtccacgcggtgtcctggccggtgcggcggacgacgaggacgtgctcgacgttctcgaaacgcgagacggcgtcgtcgacggcgggcttgagcgcggacggcttgccacggcggtagccgccgtcggccgtgatgacgaccttggcgtccgcgtccttgatacgggcggcgatggcgtcggccgagaatccgccgaagaccacggagtgcgctgcgccgatgcgggcgcaggccagcatcgcgatggcggcctcggggatcatcggcaggtagacggcgacccggtcacccttgccgacgcccagctcggtcagcgcgttggcggcccgggagacctcgtccttcagctccgcgtaggtgatggcccggctgtcgcccggctcgccctcgaagtggatggcgacccggtcgccgttgccagcctcgacgtggcggtccacgcagttgtacgcgacgttcagcttgccgtccgcgaaccacttcgcgaagggcgggttgctccagtcgagggtctcggtcggctcggtggcccacgtcaggcgtcgggcctgctcggcccagaagcccagccggtccgcctcggcctgctcgtacgcctctgcggtgacgttggcgttggcggccagctcggcaggcggagcgaatttccgctcttcccgaagcaggttggccaggctctcgttgctcacgacttctcccagtcccagggtgtccgttgtgtcccgggcatagctcatcaggcgcggggccaggtgacaagggcctgccgggaattggtttagacctgtgtcttcgtgtatggagccatgatcccgctccgcggtcgagggccgccgtgcgacgcgtggtgcacggcggttccgtccccgccgggcgcgtcggggtgcgatgcggggcggggccacctgattgcacgggcccgggactcgcccggttcaagccggaggcgtacgggctagttggtaactcttattagtgaataggcagcttttcattcggtatgtcgcccttgctgtgcggaaccgcgtgcgaatttggccgcgccgtgtcggcacttcaacgcaaataacctgcaaggaagagggtgggcggatgatggccgccacgaagaggatcgccttgggcgtcatgtccacggccttggtcgcggttctcgcgggctgttccggaatcgggtccggtggtgccggagccggtgcggagaagggcgcgcacggtgccaaggagaacccccgggccgccgctccgaagaacgcggtcaagctcatcggggacggatccaccgccttcaccggggcccagccgaagatgccggccgtcgaacgcctggcacccggcgagaagcctccccagttcgtggtgttctcctgggacggcgccggagaggacagccagaagctcttctcgcacttccgcagcgtggccaaaaagtacaacgccaagatgacgtacttcctcagtggcgtgtacctgctgccggaggacaagaaggacctgtacaaccctccccagcacgcgccgggccgctccgacatcggcttcaacgacaccgagggcatccgcgacaccctcgccgaggttcgtgccgcctggctggaaggcaacgagatcgggacccacttcaacggccacttctgtggcaaggacggcggcgtcgggacctggtccgtcgatgagtggaagagcgagatcagccaggcgaaagctttcgtcaagagctggaagaccaacactccggagctgaagagtgaggccccgctccccttcgactacgacaaggaactggtcggcgcccgcaccccctgcctcgaaggccagaagaacatggtcgccgccgcccggaccatgggcttccgctacgactccagcggcgtcggcaaccaggtctggcccaagaagaaggacggactctgggacattccgctccagctcgttccgatgcccggccgcgccttcgagaccctctcgatggactacaacttcatggtcaaccagtccggcacggccacacagggagacccctcccagcacgagtactggggtaaccagatgcgggacgggctgcttcaggccttcgaccgctcgtacgccggcaaccgtgcgcccctgatcatcggcaaccacttcgagtcctggaacggcggcacctacatgcgcgccatcgaggagaccatcgcgaaggtgtgcagcaaggagggcgtgcgctgcgtctccttccggcagctcgccgactggctggacgcgcaggacccgaggacgctggccaagctcaccacgctcggtgtcggcgaggcgcccaagacgggctggtcgtcctacctcggcacccagcaggccgccgcgcagcccgcggacaagggcacgcagaaggccccgggcgaggacgccaagaaggccccggaccaggccccggccgaggccccggaccaggccccggccgaggacaccgataagggcccggacggggacgcgggaaatgcttcggatcaggacccgggcgtgggagccggggatgccccggatcaggacccgggccagggtgacgcgggttcggctcccgcaggagcgactggctgaagcaccgagtgaacaccggccgaaacatcggccggccgcgctcgccgcgtctttcgccgaccactcgccgaccacctttcggtggccggcgattgtggggtggcagacgcggcgggacggggtgcgagggcggcgcgtgggggagccgagggcggccccccacgtgaggcgtcaggcgggtgcggtcacgcccgctccggtgtgccgttcgtcgagtacgaaggcggggtcgacctgggcggccaggtcggcgccggtcttctcgttgccccagctctcggcgttcttcaggtggaagtgcaccatctggcgcgtgtagcgctcccagtcgcgcagcccgtacgagtcctcggcggtgtcctgcagcgtctgcagggccattcggttgtcggcctccagcagctcgaacctggacggccgccccttctccatcgaccgcacccagtcggagtggccgatcccgatcagcaggtcgtcgccgacttccgcgcgcaggaactccaggtcgtccgggccctgcaccttgtttccgacgaccttcagggcgacgccgaagtcacgcgcgtactccttgtactggcggtacaccgacacccccttgcgggtcggctccgcgaccaggaacgtcatgtcgaagcgcgtgaacatacccgaggcgaaagagtccgagcccgccgtcatgtcgaccacgacgtactcgtcggggccgtcgaccaggtggttgaggcagagttccacggccccgaccttggagtggtagcaggccactccgagatcggactccgtgaagggccctgtcgccatcagccggacgtccccgtcgtcgagccgcaccgtgcgcgagcaggccgcgaaaatcgggttgtcctcgcggacccgcaacagccgggagccctcgccgggcggagtcgtcttgatcatcgtctcggcggaagcgatacgggggttggcgccccgcagatagtccttgatgagggggaggtgcgcacccatggcgggcagcgcggcggcctctgcctcgtccaggccgagagcggcccccaggtgctggttgatatcggcgtccacggcgatgacgtgggcttcgttggcggcgaggtggcggatgaagagcgaggacagcgtggtctttccgctgccgcccttcccgacgaaagcgatcttcatgttcacctagggtagtggttccattgcggtgcgctgtcactgttcgtgaagaaggccacttgggggtggtgcgggtgtggtgggcgcgtagcctcgctacttatgagtacgactgcctcaggccccctcgccgcgctcggttccctgcccggtgttcccgatgctgtggactccgtgcgcaaggccgttgaccgggtctacggtcatcgcgtcatgcgacgtcgcagcaatgaggtcacggccgaagccgcactgcggggttctcgtggttcggccgcgctggccggtgccgactggaacctcgaggaggtgcgtcggcgtaccgacttcagcggtgagggcgaggcgcgcatggtcggcgccgcgctgaggcttaccgcggaagcgggacaactcctttccatctggcggcagtcgccgctgcgggtgctggctcggttgcatctggtggcggccggcggggcgactcccgacgacgcggtggggcgtcctcgactggcgggtgagtccgtcgacgagccgctgatcgaggcaccgcttcccggggccgaggaggtcgccggacggctcgaagggctttcgcggctgatcatcgcgggtagcagcgcacccgcgctggtcacggccgccgtggtgcacggcgagctgctggcgttgcgccccttcggctcgcacaacggtctggtggcccggacggctgagcgcatcgtgctgatcggcagtgggctggacccgaagtcgatctgcccggccgaggtggggcacgcggagcagggtcgggcggcgtatgtcgcggccttcgagggctatacggccggaaccccggagggcatggccgcctggatcacccactgcgggcgctccgtcgagctgggtgtgcgcgagtcgaccgcggtgtgcgaggcgcttcagcgcggcgctgcctgagaggccccctcgcggcctgggagcacggtggcacctggtgcccgatggtggcctcgggtccgaggtggcctcagcggcggatgcggcctcggggtccgacgcggccccaggtcccatggggctcaggtccgatgccgcctcgggtccgacgcggccggccgcggaggggcggggccggcatcggaagagagtggctcccgggcggccgaggggttatggcgcggggcaagggttgcggcggtaccgatgtgcggtaccgccgctggcacgtccgcccagttaccaagcgtcctcgtagtttgcccatcaggtcgggtactttgcccgtcacctggtgcggctggcccgtaatcgacgggtcgacgtcgcgtgggtgctcggctttcgtgctcggtccgtgggccgttctgcgttacaggtcatcctcgcggatgtccttggtctcgcgggccgttaaatcctttgtactccaggaccagaggaagggaaacccctggtcctgcttctttacttttaggttcaatcaagggcgaatcgggcgacgtgcggctcggctggagtgccctcacctcaccccgctgtgcactcgccccgcctcaccgggcagggcggctccggcggtgcgtcgacggctggcgtaccagaccaacccggcggtgacggccgc

SEQ ID NO: 3010 - DNA, 3222 bp, Unknown
  Kingdom: Bacteria, Phylum: Actinobacteria, Class: Actinobacteria, Order: Streptomycetales, Family: Streptomycetaceae, Genus: Streptomyces
cccgcagctgcggggacgccccctccaccagcgagatcagccgggccaccgcacgcggcctgcctgctcgcgcctgctcgaccagtgtggggacgtccacgtccacgttcaccgctccgtatctctcgctctgccccggtacccgtacgggtccggaatccgtacgggtactacttgcccgggacgcggatgatcagcgcgtcgccctgaccgccgccgccgcacagcgccgcggcgccggtgccgccgccgcgccgcttcagctccagggccaggtgcaggacgatccgggcgccggacatcccgatggggtggccgagcgcgatggcgccgccgttgacgttgaccttgtccgaggtgacgcccaggtccttcatggactggacggcgacggccgcgaacgcctcgttgatctcgatcaggtcgaggtccccgacggtcaggccgtccttcttcagggcgtgccggatggcgttggagggctgcgactggagggagttgtcggggcccgcgacgtttccgtgggcgccgatctcggcgatccagtcgaggcccagctcctccgccttcgccttgctcatcacgacgaccgcggcggcgccgtcggagatctgcgaggaggtgccggcggtgatcgtgccgtccttggcgaaggccgggcgcagcttgccgagggtctccgcggtcgtctcggcgcggatgccctcgtccttggcgaagaggaccggatcgcccttgcgctgcgggatctcgaccggggtgatctcggcctcgaagagaccgttcttctgggcggcggcggcccgctggtgggactgcgcgccgatctcgtcctgggcggcgcggtcgagaccgaggcggccgttgtgcttctcggtggactctcccatcgggatgttctcgtacgcgtcggtgaggccgtcgtgcgccatcgagtccagcatcccgatcgcgccgtacttgtggccctcgcgggacttggggagcaggtgcggggcgttggtcatggactcctggccgcccgcgaccaccacgtcgaactccccggcgcggatgagctggtcggccagcgcgatggcgtcgagcccggacaggcacaccttgttgacggtgagcgcggggacgttcatcgggatgccggccttgaccgcggcctgccgggcgggcatctggcccgcgccggccgtgagcacctggcccatgatcacgtactggacctggtcaccgccgataccggcccggtccagggcggccttgatcgcgaagccgccgaggtcggcgccggagaagctcttgagggagccgaggaggcggcccatgggcgtccgggcgcccgcgacgatcactgaggtggtggtaccggtcgttgctggcatgggcacggccccttgggatcggatgtgaacgagggtttacctgaatgtactgagaggtaccgcgcccgtcatccggcaaccggtgtgacggcgcgcacgttgcgtaaccatggcggtggcgctgcactggatccatgctgacgcgaatcgaccacatcgggatcgcctgtttcgacctggacaggacggtcgagttctaccgtgccacgtacgggttcgaggtgtaccactccgagatcaacgaggagcagggcgtccgggaggcgatgctcaggatcaacgggacctcggacggcggggcctcctacctccagctgctggagcccacccgggaggactcggccgtcggcaagtggctggcgaagaacggggagggcgtgcaccacatcgccttcggtacggaggacgtggacgaggacgccgcggacatccgcgagaagggcgtccgggtgctgtacgacgagcccaggacggggtcgatggggtcccggatcacgttcctgcaccccaaggactgccacggtgtcctcaccgaactggtcacgagcaagacggagcactgaccaccgcatacccggcccggtagagtgggcggttccgggccggggccgggtcggggccgtaccgcgtcctcgtcgttcgtctgtcaccattccccgggggactctcgccgacgagcagctcgtgcggagagtcgcgaccagggttggggtctcccccgctcgaacgaagttgagagctcggggaaggatgggaccgcgcagtgcggggctacgaacgccaggagagccaccgggctgaagacgaccatctctcgcggttcgaagccgagatggaccggctgaagaccgaccgggagaaggccgtccagcacgccgaggacctcggttaccaggtcgaggtcttgcgcgccaagctgcacgaggccaggcgcaatctcgcgacccgccccgcctacgacagcgcggacatcggctaccagaccgagcagatgctgcggaacgcgcaggtccaggccgagcagatgcgcagcgacgccgagcgcgaactgcgcgaggcccgtgcccagacgcagcggatcctgcaggagcacgccgagcaccaggcgcgcctgcaggccgagttgcacgccgaggccgtccagcgcaggcagcggctcgaccaggagctggcggaacgccgccagaccgtcgagtcgcacgtcaacgagaacgtcgcctgggccgaacaactgcgcgcccgcaccgagtcgcaggcccgccggctgctggaggagtcccgcgccgaggccgaacaggcgctggccgccgcgcgcgacgaggccgcccggcttgccgaggagacccgtcggcgcgccggcgcggagaccgagaccgccagggccgaagccgaagcgatcctgctgcgcgcccgcaaggacgccgagcgtctcctcggggccgcctccgcgcaggcccaggaggccaccagccacgcggaacagctgcgctccagcacgaccgcggagaccgaccaggcccgccagcagaccgccgagctgaaccggtccgccgagcaacgcctctcggaggccgagacccggctgcgcgagtcccgtctggaggcggagaagctcctctccgaggcgaaggaggccgccgccaagcagctggccgccgccgagtcgcagaacgaacagcgcacccgtacggccaagtcggagatcgcccggctggtcggtgaggccaccaagagcaccgaggcgctgaaggaagaggccgagcaggcactcgtcgacgcccgcgccgaggcggagcgactggtcgccgaggccggcgagaaggcccgtacggtcgccgccgaggac

SEQ ID NO: 3011 - DNA, 6175 bp, Unknown
  Kingdom: Bacteria, Phylum: Actinobacteria, Class: Actinobacteria, Order: Streptomycetales, Family: Streptomycetaceae, Genus: Streptomyces
taacccgcacccgccaacggagaaggggcggaccgcctggtggcagtccgcccctcgccggggatgtaccccggttacatctcgacctcgcggccgccgacctcgaccgcgggaggctccggcgccttcacgacttcgggttcgtcgcggcgggtccgctcggcctcctccatctgtcgcgtctcctcgcggtccgccaggatctccgttgcccgcccggcggtccggactgcttcctgcagctcctcgcccgtgagcttcggcgcggtctcgtgggcccgctcgcgcgactgccgaagcgcctcggcctcgtagtgctgccgcatctgctcggcttcctgctcctgctgcacgcgggcgcgctcggcctggcgctcctgttccagctccggttccacggccgccggctgcacgtcctccggcagttccacggcctccggctccggcgcccggagttccagctgccgctgcgcctcctgcgcctgctcgcgcgtcggctcggtgtgctcgtgccacgcctgccgcgcctcgtgcaccttttccagcttctcgcggtcctcggcaagcgaagcggtcagggcctcgtacccctcgacggcctcctgcagctcctgcgcctgctcgggcgtctcggcctccatcgccttgatgtacgtctggaccgactcgcgctcggcgtccgacagggactcgctgacctcgcggagctgcccggcgacgtgcggcggcgcccactcggtctcgcggtcgtaccgctcgaccatgcgccgcagcgtggcgtccgacgctccgaccagctccatccggtcctcgggctcgcccagcgcgcggtacgcgcggtcccagtcctggcggacgtcgaccgcaccgcggcccggccgctggccgatcgcgtcgcgctcgttctcgtgctggtgcgcctctcggtacgcggcgaccgacccggcccgctcgatccagcgctcccgccaggtcgggtcctcggggaccggtcccagcttctgcgcccactgcggcagctcgccggcctcggcctgttccaacagctgctgtcccagttccaggcgcttctgctcggccagctccgcgacgccccgggcgtactcgccttccgggccctcgatctcggcggcccggttccgccagtcggcgcgctcctcggcggcggcctggcgctcctccacgatgcgggcccgctcctgcgactcctgcccgccgtgcagcacctcggcgcccagcgacatggccatggcctggtccatggcttcctgctgccgcgcctgctcgaacgctgcggcctccgctgcccgctgggtctccatcgggtcgatgacctgcgccccgatgaccgcctgctgcgcggccagggcgtcctcctggctgccgttccaggccaggaccggagcctgcgacatggcctcggcctgccgcatcgcctcggcctgcgcctcctcgctgatcgcccggtccacgtgggcgacgggcgccacggacagctcggccatcaggtcgttgaccgtgcgttcctgggtctcgacggcctcgcgcacgcgggcctcgtccgcctggacctggcgccggtcggcggcctccagctcccgctccgcgcgccagtgcagcaccttcgccacgtccttggcgtcggccaggtcgcccccggtgatgctgcgcatcatctccatggcgtcgtggccggcggcctcggcgctgcggcccagacggatgagggagccgtacgcctcgctgtcgcggaccttcgagaacttgtcgcccagtttctcgaacaggacccggccgaacttcttctccgcgtccttggtcgacaggtcttccagctcgtacgagtgcttcgccagggagctggaccattccagctcctcgcgctgaacctgcgtcgcggacttctcgacgctggaattctccagcgtctgcttgaagagggtcatcggctcgggccgctgctcctcgggcacgcccggcatgtccgtggacatgtacgcggtgttccgctcgcggccgcgagtcatcgcgacgtagaacgcctcccgcgaaccggagccgtcccagtaggagtgggccgttccaacggtccgcccctgggtggaatggatcgtgcccgcgtacgccaggtccacgtgcttctgcacgtacgaggacggcagggtcacggtgtccccgtcgtcgtaggcggcggtcacggagccgtcctccgcgatgcccagcaccttgaccacatcgcggttggtggcgaagcggtcgccggacgtgctggtcagacggcggttgttgtcccggagctggatcatgtcgcccttgccgaccgtgaggccgcgcccgtccagttcgatgccgtccgcctcgacctccccgagccgaacgaggtcggcgcgggcgcgggcggccagctcgtcggcctgggccgtggtcggcgcgatgagtaccgcgtccttcccgcccgtgtggtcgaccagccacgactggtacgaggcttccaccatctcctcgcgcgttccagcgcgcagacggccgcgggtctcgtactccgcgagcacgtccacctcgcccttgcggagcttcagggacgcctgcttctcccactcggagttgaagcgcatcacctcgtccaggcggtggacgttcggcagatcctcggtcagctgggagaacaccccgccgctgcccacgctgctgagctgggcgttgtcgcccacgtacagcaccttcgccccggccaggtcggcgtaccggcggatctcgtccagctggcccgtctcggccatggacgcctcgtccaccaggatcagctggcccggccggagctggcaggcgttccggtcctcgtccgacaccgcggtgcccgattccaaccggcggttggtgtccaggaacttcgcgatgttcgcggcgttctccacgccctcgtcggacagcacgcgggcggcgcgctggctgacggtgaggccgatcacggggccgcattcctgcgtccagacgtcatggatcgcgcccgccagacggctctttccagttccagcgggggcggccacgacctccatgcggcggccgctggccaggatggagcggaacgccttctcctgtccctcgttcagcccggcgccggccacggccgcctcgatcgcctcgcggcccacggcgggggctcccagctctgtggccttggcgatgatgcggccctcccgctccaggtgggcctccgtggcgtaccggcgggcgccgtggcgggcgtagaccgacagcccgtcctcgcggcacagctccggggggagcgggacgaggttgcgggcggtcagccggaccacggccgtgtccgccccgggctgcagcgcggcgtcggccagctcgttgacgagggcggtcacctggtggcgttccagccctccgagacagtccggaagttccttggtgatctccacgatcaggtcgcctcgacgccacgtcgacttctggtcttgggcgttctcgatcgcctgctgcacgaccttcgtcgggtcgaattccaggcccgattccagcgtacgtccgtcgcgttccagttcggcgctcgcgcgttccacctgcgctggaatgtcgcccagcgactcgcgggtgtcggccaccatgtcggcctcccagcgctccagcagctgctcgcgcgggacggcttccaccttgttcttccgctcggtcaggttgacccactgcgccatgcgggccagctcgtgagcgcccggcgcgcggccggtccgctcctcgtacgccttggccagctcggcggtgcccttcgtgatggtccgccggcgggagctgtacttgtcgcgcttctcctcggagatgccgacgatctcccgggccatgccgtccgggcgggtggccacgcgaaagcccatcttgcggtacagggcctcgtccgacaccttctcgaagatgtgcccggctgccttggtgtgccggtagatctcctgtccgtcgatggtgagccacttcgacatgacttcgccggtcacggggtcgacggacgaggattccacgcggttccagatcgcgttgtggatgtgcagctgcgggtcggaatcgcggctggtgtgctgccggaacgaagcgatcgtccacgcgtgcgcgtcgacctggcggcccatcggggccccgtccgggtccttcgcaccgtggcgtccgtcgcgggcgtacccggcctcttcctccaggaattccagcccggcctggacgccctccatcaggcactcccagacctgatcggccttctcggcggcggcggccgcgccctccaggtccccggcctcgcggagccgcgcggcctcgatctggaacccggcgtgcagcaggctgtacgacttcggcgcgctgaacgtgacgtcgtagtacgagcggctggagggggcgttctggcgcaccttcagctccgccgcacggcgctgctcgggcgtcgaatccgggcccagcttctccagcgcggcctccaccttctgctccgtcgacttggtgtagtcgtacggcttccggcccacccgcgcctcgtcgtagatggctgccacctgggcgttgtactcgtccgatcccggctcggccgtgatcgcagagagtgacgcccggacctccgcgtggaggcccgggtgcgtgaacttcgagtacatgtcgctcatcagctcatggtcgacttcaccagtcagaccaagatcgtttgcggcgctcccgagccagatcccggccggctctccggcctgctcgatggacttcaggtagtagtgctcaccgccgcgaccgaccgcgttcatgaggtatcccgggtctgatcccgggctcacagtagcggtcatgtgatcacggtacgggccatcggatggtaatgcaagggtgtgttgaagttagtaggtagctcaggtttcaagatcagggaagagaagggggtggagagggcaagtaggcagatgggagaggagatcgacaagggcaagcaagagaggacagcagggggagacgagggaaggacgcaaggagacatcagccggggatcgggagagcgcgagagggtgcccctctcgcaagtgttgaccgcgaccggtgggcgcccggtaggctgcgccacagacgacatgaggcccgacccccggactgggggtcgggcctcgactgttaccaagcgtgtttttcggcggcggcgtcgcccgggtggccggcggccgcgaacggcggacggtctagcgtggacatgctgtgaaccgcacgcccggcgggccctcgcgcggtccgcgaaaccggcccccggccacccgtacgccgtagcatgtccacgctgtgaaccgcccacggtggcggcctgtacggcaaccgctacggtgggccggtccaccccgtacgtcgtagcgtggacacgctccgaactggcgtcggcctcgaacgcccggcgggacgaagcggaacgggtgcgcctcgacctgctacagcatgtccacgctatgaaacggccttcaccagagggtgtcctggtgctcccccgaggggtggccggccgcgagcgcggccgcgatggcggcggactccgcgcccggctcggcggccaggatcgcgtcccgtacggcgaccgcccgtcccgccgcgccccgcacgtccgcgagcgcgtgaccggtgagcccccggcgggccgcgtagtccacgatgttctgcagccgctcccccgccagccagtggtccgggttctgacagctgctctcgtcgcaggtgtgccggaccacagcgccgttccgcagtgcggccgcgccgtggcagatgacgaacccgagcacgtgggccgacaccacgcgggaggtgcccgccgggcggctgcccgcccggagcttcccgtgcccggagtcgctgatggccccgagccaccagtggcacggcgtcgggccggggccgcggtacaccttcgcctcgtaccgggcagcggtcgccgggtcggcggccaggcggtcccagggaaccgcgggggtcgactcgctcacgcggcggcctcgtccggctcggcgtcctcggcggactcctcggcctcgaacggctctcggcactccccgcacaggatcgccccgccctccaacagcttgggggtgacctgcatccggcggggcgggtcgcactcgcacgccacggccaggcgcttacccgcccgtcccttcccgcc

SEQ ID NO: 3012 - DNA, 12478 bp, Unknown
  Kingdom: Bacteria, Phylum: Actinobacteria, Class: Actinobacteria, Order: Streptomycetales, Family: Streptomycetaceae, Genus: Streptomyces
gttgagctgccgggcggcggcggtctgccggttgatgtcgtcgtccgacatgcggcccgggttggtgagggcaccgctgtgggcgacctcggacagcaggttggcggcggcctgacgctcagcgggggtgctgcgtccgaacatggggttctccttgggcgctagttggcgatcaggttgagtgcggcggtgacagtgccggggagggtggtgcagaccggcacgttgtggcggcgggccacgtagtccaggtagcggttgcgttcggggttggggcagtcgtccgggataccgaggaccaccggccgggcggtgccaacgtccagcccgaactcgacgttggtcgtcatgccgggcatcgtccgcatgtcccgggggatccagaagagaatcgcgttggccgaggcgcgggcgtcggtctcccagtcgacctgcgtctcgtaccggtcggcccgaactccgttccgggactcagggctcagcacggtcaacgtctgcgggccagcccactggtcggccagcatcttgagggctgcgggccgccacgactcaaccgggttgctcttgtccggagtcggcccggccaaaaacacggacgtgccggcgggcaggggttcgcgggccatgaccagcttgacgatgctcacgcccccgactccttcgcggcggcgcgggcctcgtgctgcggggtccacggcaggggcaggttgtcgccctcccgccgggggacgatgtggacgtgcaggtggaagacgctctgcgtcgcctcgacacccttgctcgtgatcaagttcgcggcgggcagctcagccatcagctcggccgcccggcgcatcaccgcgacagtcacctcgatgtccgtgccggcgtcctcgacgtgaacccgcggcaggacgaagacgtggccgtcggtgcagccaccgctgcgggggcggatcgcgatggcgtcgtcccactcgcgcacgatggtggcgggcgcctgaccggcgacgatgcggcagaaaacgcagtccgacatgaagaactccttgatccggatcgggtgggctgaggcagatttaggcgtggttgggcttccaggtgccgttgttcagctggttgagctcgtcgaggttctcgtcggcggcctgccgcatcgactcggcaagccggtgctgaccgtgggcggcggcgtcacgctgcgcctgccggctgttctggatgtcggcggtgatgtcggcgcgggtctgctcggtggactggctcttgaagaagtgacgggcgctggccatggggttctccttggtgctgggtccgggtggctcccgggccactccgccgccaccaacacggggttggggacgacagggcaggccgggggtcagaccatgtcgcggagctcggagaccatgtcgtcggcgtaggccaggcccttggcggccttcttcaggagcacggcctgctcggcggggtcggtgctgctggcggcgtcaaccaggtacgtggccgcgtcctccaactcgtcgatgccgttgatcccggcgagctcgaaggtgcggacggcgtccctcatctgggcggcaaagtcgtcgaccgtggtggcgagctgttcctcggcggcgaacgcaatgccgtccgcgtgctcggcgatgagtccctcgacggtgatggccttcgtgacgggcatgccggtctccttctgggtcagaacggacactgggtgaggtcggccggcggggctttgatcagcgggtcgtagaccgatgcgtcacggctctgcgctgccacttgctcgcaggtggggctacagaacgggccggcgggggccccacagttctggcattcgtccatggcgggtcctttcaggtgccggtgatggcggcggaggcagggtcagcggcggttgtgctggtcgtcgcagtcctcagcccatgactggtgcgaccagcaggtcttccggtcgtcggcgtgcatcccggcgtcctcgcgctcgttgtcgcgctcgatggccttgtagaggttctgggagaggttcggcccgaactgcaggtgcttcggcatggcaggggtcctttcaggtgccggtgatggcgggcgaaggcttcggaggcaggccgggggtcaggccgctgccggggtgttcaggccgcggatctcgtccatcagccgcggctcacccggggaggtctggtcgaggtcgatcgcggcgagcatcaccgccgacatgccgtcgcggtcaccgaccgaccaggccgcacggaactccgacaggagcgacaccgccaggcggtcagcggccagctgctcggcctgagcgaccgtgatcgaagcccgccgacgggccgccagcgaggagacggacgccgtgtcagcgtcggacagggtggccaggtcggtcgtggacatcaggtacggagacatgggggtgcctttcgagtgggtggtggggtgaagaagaggtgggggtggagtagtaccgctcccgcccgggacgggggtcggacaccgggcaggagcggcggactgtggggtgctacttgcggcgggcttcctgccgggccatctgtgcccgaacatcagcagccgcctggtaatcgcgcttgcacgcggcgggggtggcgggctccgcgacgatcgtgttctcgcggggggcctcgtcggcggccatcagagccgccgctgcgccatcagccggcggcgagcagccggatcggcggggaggatgaccgtctcctgggagaccacgaccgggcggcggacgtaggaaccggcctcgtgggcctcacggtccgccgcggacatcggggcggccggcggggtgatcggcgaggtcatgccgccacctcgacaatctcggcgacggggccgcgacgcatgcggtcggcgatgacgtgctcggggatgcggatctctccgcccctcttcttgctgccctcgctggggctcttgccgtagcggacagcggtgagctcaccttcgtccacccagcggtagatcgtcgacgggtgcacgtccagggcggtggccgcttccttgacggacagcgtcggcagcttttggggaagcgccatcgcgaagtcctccaatccgaggttggtgtcgggctgacttcgcaaccgtatcgctatatctaaaaagcagcaagcttctcgtgacatccgtgtgcccaacctcctcacctatcgtgagaaccagctaggttcgtactacggagaaggagacggagacgccagtggccagcgaaaacgagtgggtcagcacgtcggcggactacaccaagccccgccctccaggggcagcagacgcctggacggaagaggccaaccgccagtccacgaagggcagccaggcgctcaccagcaccggcgagacggttccacccccggccgtggctaacgctttcggcctggcggccggcgagaccgcgatcgttcgcgggcgcaccatctacgccgacgacgcgctggtcgagctcgccgacacgtactacccgcgcgacatcgcagagggcaccccgcttgccgagccgcgaaagatcaagggaggtgccgtcaccttgctcgccgagctgggccacgtcgccacccgtgtcattgaggacgtcacagcacgcccggcctcgcagatcgagcagcagcagttcaagctcgccgcccacgagcctgtcgttgtcatcgaacgactctcgctggacggggcgggtaagccggtccaggccgacgtgatggtggcccctgccaagctccggagactccgatacgaaatgaaggtgcactgagatgccggaagcgacgaaccgcacccccagcgacgcggcagaccccaggccccttcacgagcgaatcgcgaccgaccttcggcgagcgatcctcgtgggcgacctcccggccggcgacccaatccccagcaccgggcagctgaaggagcgtttcagcgcgtccagcgccagcgtccagaaagccgtctccatgctcaaggacgaggggctactgcaagggcgcgctggttcatccgtcaaggcgctggaagtacgccgccagacgatgacgccagcggcttactcgaagcccgccgaggatgggcagccgtaccggtggctgagggaagccgagaagaacggccggcgccccagcatccgcctgctagaggtgaccgagacgacccctccggccgatgtccgggcagccatgggcctggagccggacgggaaagcagttctgcgtaagcagctcctgtcacttcagggcgaaccatgcgagctcgtgcactcgtactacccgctggagttggcggcgggcaccgcactggagggaaaggcgaagatcaagggcgggagcccgaccctcctcgccgaccttgggtatccaccactgcgcaccgtggaccacgtgacagccgaggaggctacgaacgaggagtacgaggcgctgcaactgcctcgccaggtagccatcctccggacgcttcgagtggtctacagcacggacgaccgcgtcatcgaggtgacgaccatggcgaaggcgggccacctctactcgctgcgatacgacttctgacctgcacactaagcgccccaactcttcgcgagctggggcgctttctcgttcttctcatcagatccgctagcaaccattcacaaataccgatacggttctttctgtagccgcactccacggcagcggagggaccatccatgcccacactccccgagcgcaccgcgctctaccgcctctacggcactgacgaccgcctgctctacatcgggatcaccgataaccccgaagcccgctgggagcgccacgccgccttcaagtggtggtgggtgcaggtcacccgcaagcaggtcgactggctcaacgcatcttggcgcgaagctctcgacatcgagaaggccgcgatccgggaggagcgacccgcctataacggcacccacaatcacggggttgcgccgttcgacgcggcagcgtggcccaggatcgaagcgcagccccgtcagaagttctcagccctggcagacctgattcgcgccgagatcgcgtcaggcaggtggcaggcgggcgacagactcccggacgctgagaacctggctacagcctccggcgtcggcgagggcaccgtgcagcgcgccttccgtgagctcgccgatgaggggtcgatcatgcggctccacggactcggcactttcgtgcgagccaggatcgtcacgatcgcacccaaccgaatgctgcggccaacgtagaggcggccggccgcctcatacacacctcctccgcaccgggttgcggttctgtgtgatggtcggtctcgcgaccagctagccatcatcctgctggtcgcgtgtggtcgagtttcggtcaggattgggggcccgagatgcgttgcgttaacgcaatgcccctgggtgttgcgttaacggaattgccgaggtcagaagatcgctttgtctattaagactgtactgacctgcggttcgggctccctctggactatcaaggttgatagcccagagggcattcgaggggtctcaatgttgcgtaggcatcccgtggcttgatctaggttcgttccacgtcgtcggcctcaccagccggcgctgcaaggccctggggttcaccaccccgggacgtcaagaggccgggcggtcatcatccgcccggcctgtgaccagcggcaccacccgtctggtcatgagtcctgtcccgatcaaaggagcactcatgagcatggtagcgccctccggcgagtcgatcgcggtgtcctcgccccacgtctccacctcgatgtcctccccctcctccgccccggtgttgtcggccccggttcctccgcagccgccggccccgtccgcccttaccgcgcatccgacgtcctgcccgtcgtggtgcaaggaccggctgcatccggcgggtcataactcgtcgccgcgggacacagcccaccggtcgcgggccctggagctgaagctgtcgggtgagacggcgacggtggtcctggtccgtgcggagttgttccgcctggatgagctggacgacgtcggcgagacggtgttgtacgtgcagggcgaggacgagcagggctcgtcgggtcctgaggtggagatgttcgtggcgaatctgatcgcgttcacggagaacgtgcggatcctgcgcggacagatgggctgatcagcccctgcggttccttcacggccgggcagctggtgctgcccggccgtttctagatcggcgggcgggtgctttggatgccggctgggtggagcaggacttgaagacgtacttggatcttgggggtgcggcggtgaacagcgctgcggcggtgtacgtgcaccgcctggctgcggatgagctcccggacccggtggccttccgtgaggcggcgagacggcccctggagggcacggacgccatcgtggacgggtggatgcagctcgccgggcgttccggcccgcacaggccgtaccaggactcgtgggggcgcctggaggaagaggggcggaacgggtcacggccgcaggggtgggagaaggtgccgcactgcggggacccggactgcgacgaggtcacccgccgacgggatgtgaccagttgggacggattgccgacagcctcaccatgtcagcgatgccacccggccatgaggttctgatcgctcatgccgccgcgaggtagagcgcgtgcagccgctgatagacgtccggttcggtggacacggcgaacgagggcgcccagacttcttcgacgccgggcgagatgccctcatgcgccggcttgccgacatggacttgcgtgctccatcgattccatcgcggagcttcaacgagcacccaggtgtctctgccgcgcttctcgatgcgcttgatcttgacctttaccgtcccgctgttgccgggaaggcgcagttccccagcgggcaaggggtccggtacgtcaaagtgccgagcaagctgtgtcatgacttcgttacggcacgagggagcggctagtttcgctctgctggccgagttcacccgaacgccgcatcccggccgccagggctcgttccgctcctacaccccttgttgtcctggcacggatgcgacgacgacggacggcggcgcgggggcgggttgcggcccggcgaccatggcttggacgagggcggagaggatttccccacgctgctcctgggagaggtctccgtcggcgacgagccgttccgcggcaaggtagcgggagagctccagcggctggtcgaagtaggaccggaggtgtgtggcggcggactcctgtgaccgcacgaacgtcttggcgacgtatccggcgagtgccgctgacacggccccgagcccacccgcgacgattgcgccggctgtcgtgcttgcccagagggccaagcccgcgaagagcacaagcagcacgaagcccgccaccatggctcgctgtgcgttgttgaacgacttcgttgcttgatcggtagcgatctggtgatacaggccgagccttgcgtgggtggtgtcccacagtgctgccagttccaagggcgagcgtcgggtggtctctccgctgtcggggtccctctgtcccggcacggtgatcgggtcttcgtcggccaatgcgtccgtcgcggccgggctcgactgaccgctccggatcgcctcggctagggcggcctcggcgcgtgtcaggcgctcgcggctttcgctgacggctgccctctcgttctgggtcatccccttcagtgcagagcccgtcagccagagcatgagggctgctagcaataggctcgacaaaagcgcccatacgggccagtccctgccctcaggcccccattgagcgaatccggcggatgaggcagcgatcatcaaggctccacccaccatcatggtgagcagtcgcctcagggacggccgaggactgcgcaagtcagggggcgactctgggtcgatctgtggcggcatggatcaagaggatgccgggtgggggtcggggcgtccaccggttccggtgaacctggccgcggcggggcggccccgagcccaagatgcgcgggcgacggtccggggccagcctgggaggagacttcgccccccacgttctggagagccatgatcgtcaagatgctgcatgacaagggcctcaaggccgagcacgcgtacacggccggtttcgtgtcgatcgggttgtcgatcgcgtcgtggtgcgggtcgatgaaacttgaaccgatgggggtgtcccgcgccgaccggtgggggatcttcgtcggcgagtgggcgcccacgttcttcggccttggtctggccctggcgcattacgaacatgacgaaaacacgctgcactcggtgacgcactgacggcgcaccctggctgcggcgggcccctgccgaccggcgggggcttcgtggcgtggcgtccgccggctacccgacaatgcggttcagaatagcgccccgcctaccagaagcggcgaaacggggccgccccggagtagccgcggactctcttgtggccatcgtcgaacggggcggctgccttggggccggctgctcggatcgcttctttccggatcgggtcgatcggggtctcgctctttgcgtactccgtgagacgttcgatgcgtcggtcctcaatccctcgtttctgctgtggtgtcaggcgcttggtacgtcgaggcggtgcggcttctcgcatgtccgccaggacgtggcgggagcggagctgctgcgccttccgggtcttgaggcgtttggccgcgtgggatgcccagggcagattctgcccctgcccgacggcactgatgggccgccaccccttggatactgacgcccattcgtcgatgacgactcttcgcccttcgctggccagcttgctggcgcgacggatggcggcatcgagggaggcgacgtggccgtaggtgaccttggtgttcggcaacttgatgctggcgattctgtggctgtgctgcgttgatgcggcccgtgtcatctgccccccagcagcaatcacgccttcgcaggctctgtggcgggacagtactgggggtgctggcattgacgccaggctgcggttcctccgaagttacgggttgccaaaagttcagtccttgcgggtgacttttccccggggcggcaagactgttgtcagtggctgctgcttgactgtggccatcgaacccggggagcgagttatgccgactgtgatccatcggacgcgcagcgagcttgaggcccagcgtgagcagctgctggcgagcgtgaatatgagctacgacgagctcgcccagcgcgccgcaacgtacagcctgagcatgaacgaactcgatgtgtggcacacgatcgaaggtctcgactaccttctcgaaggtgactgctgaagaggctaaggctcttgtcgggctggccgaaggtttcgcggaccagctgactgacctgacgcggggtgtccttggtgagggcaccccgcgttttcatgcgatcaacatggggtcgaaggtccaggtctcaccgatagacaacaacgagatcattcaacggatcccggtcttcattgggggcgaggaacgcctcagcctcagcgtgcggtacttctgctgctgggatggttccagcacgttcatggctacggacctagccgacgtgcacgtcttctacgcgggcattccggacccgctagtccggttcgagtacgtgcgcagcggcacggagccacctggcgctcatctacacgtccatgctcatcgcgacgagatggcgtacctgttgcgtctgtcggagaagggccggccgaagcaggggctgcggcgggatcgactgccgcggttggcagagatgcactttccggtgggcggtcatcggatgcggccgtcccttgaggacgtgctgctgttcctggtgcgtgaattcgccatcgacactgcggacggctggcgggcggtggtgcaggagcacctgcggcgctggcggttgatgcagctgagggccgcggtgcgggatgcgcccgacacggcagccagggtcttgcggacgctcgggtacacggtggtggagcctgcggagcaggctgaaccgactgtcccaggcgctcgcaaggcagccgaggaacccaacaagctcttcctgccctaggcgcacgactgcggcccccacccaggcgggtgggggccgcggcacgtccggggtcagcgggttcgcttcttccgtgctgctcgccgcgcggcccggttgggcttcggctcgggctcgttgtcggctatcagctgttctcccgtgctgcggagttcggtgtcccaccgggccccggggcggccagcgtgctcgccccggggtgtggtggatggccggctcaagccgctgtttcggttgccgcgcaggtgcaggcgcagtggaggctgacgctgccggtggggcagggctggcatgggccggggtcgggccgcccgcacccgcacaggtcggccgacgggttgagtgcggcacggatgaggtgggcgcagcaggacccgacgggcccggcgtccaccactcggcggacccgggcgacgacggcctccagttcgcggatgcggatggcctgcgaaagcacctgcgtcttgtgccggtcgtcggagcaaacgagcggtacgccaagggtgagggcatggatctcggtgcggagttcgtcggcgagggtcatgcctgctccggctgcctgcttccagtcgtcgagccgctgctcctgcttccggacgagctcggcgagctgctctccttcggcggggaggatgacgccgcgtcgggcccggtcgaggaggtggtggaggcgctcgggctgggtggtcaccgggccccctcggtggcggcgtgttcgtcgcacgttggacggttgcaggggcgccccagggcctgccagtagtcgcggtgtgcggcgagtccggcggccagccagtcgtccccgaacaggaactgggggcgtcgttcctcccagaacgcgcgggcctgcgccagtggagcctgctcgtacatggcgttgaacccgtggctcttgatcgatcggatccacgaggtgcgggcgttgtcgtaggaagcgcgggacgtgctgtacccggaggccgggtcaatgtcgtcgagcgtgttgcccatggcgatgcacagggctatacgtgcgtcggccatggacgtccggtggtccgtgacctgttccggagtccagcccatggcctgttgctcacggtgagacatggcgagccgtttgatacggctggccgcgtcgtaccggggcttccggtcgttctgctgctgctcgggcgagggcgcagcatcgccggggcgcggtggtgcctgcgggtagtcggacaggtcgaacaggacgtccgtctgccgtctggcaagggcgcgttgcatgccgtggtcctttcggggttggtggccgccctggggtggggcggccacacagcagacggtcaggcggcgggggtgtccatggcttccatcgcggcgtcaactccggcgcacgcggcgggccacagcgtgcaggagcagtagctgtgctcgttggtgtgccactcgcagtcgtcgacgtgtccgacggtctggtcggcctgggcgcgggcggcgtcgtagaggcgggtggcggccgtgctctgccaggcgggcgggcgggctccgagaccaaggcggcggcgggtgaggacggcgaggttgtagcccgtgcgggcgggcttctccatccaccgggtccacggcgaccactgcggtgcgtcggagtagggcgtggagagggtgggcttgacagtgatagcggccttggcgatggcgtagagcgcgtccacgagttcgcgttctgtgtcggtcatgtggtgtctcctcggtgggccgggatcacacggcagcaggggcgggggcgggctacgcggcgtcgaacagggcggccggggcggactcggccgggtcgagggcgtcggtgaagtcgatggcgtcccagcccagaagccagttcctggcagcggcgaggtggcgacggcgaagcatcggggtcacttcgcggcctacgccgtcggcccgctggccgttgggctccagcacgatgtgcccttcggtgtcgagggacacgtcgagccagcacggggtgcactgctgccaccaggcgagtgggcgggggaacggtggggcgcccttggtgacgagacgagggtcgatgcggatcttcgactggtcgagcacgaggcaggcgggcgtggtcatcgtgtgggctcctcagtggtgtggaccttgagcaatgccttcggcacgccccagctgtgcagtagcgcggccagccactgcgcgtgggcacggtcgtcgcacgccacgtcgattaggtcgcccggcatacggaccgcgacggtggtgaaccggccaggcatccgggaccgcatcagctcccaccggtgggcgccctcccgagtggcgaactgagcgagggcaccctcgtcgacacggagtacagcggtggggacggcgcgttgcggtgggatgtcgagcgcgagctgcgtggtcatcgtgtgggct

SEQ ID NO: 3013 - DNA, 5411 bp, Unknown
  Kingdom: Bacteria, Phylum: Actinobacteria, Class: Actinobacteria, Order: Streptomycetales, Family: Streptomycetaceae, Genus: Streptomyces
tcggtcacggacgcgcgggcgacgggcccgtggcccgcgcgtccgtgaccgacggatccatcgtcgtcgtatgacgctccgtgaccggcgcggggtgcacgccggaggccgtgcctgccggggcgctcggcccttcggaggttccgctcaccgctcgctcccgctgtgaaggtcgtcgtgaactggtggggtcggactggccaccgggtggcggtcccgtgaacgggcccgttccacgcgggaaagcgtggtgaagcatagagggtgccgcgtcggccgttccagctcaccgtccggtccgggccatcgtgcgggtccgcgaggggccgggagcagacgttccgctttgcccgatcctgatcatttctgtgcggatctgtttcattggagggctggaacgactgtcggtgactttccgtgaaggtgtgggcggcgattttgaccgctgacccgtgtggggcagcacaacagggcgtggcgtggtgaagcggcacagggtggacgggaaggaccgtgttttccccacccggaggtcgatgtgccgtgccgtcgcggacccgggggagcggaacggccgccactgcgcagtctggccgccgccgccacctccctcctggcgctcgccgccacgtccctcgtcgcgggccctgccgcggccgccgcgagggacgccgctccctgcgccctgccccggacggcggtgcaccactcgctcggcctgaacacctggaacacggggtacccgcgccccgagcagggtctcgacgcggtcatgatcttcctgtccttcccggactccgagccgacgctcacccccgaggcgctcaccgccgaccacttccccgccacgacccgcttcttcgagcgcgccagctatggccggttcacccttcgcccccacccgcaacgggcctggacgcagatgccccgcgactccacctggtacggcatagagcgtgactggaacgccgagcggcgcaccgcctacctgcgcgacgccatcgacgccgccgacccggaggtggacttctcccggtacgacgtcgtctacctggtggccgacccggacgcccccggcgtcgactccgacgccaccaaggtcgtcaacttcgaccggccgctgcgcgccgacgacagcgacatccggcgcgtcgtcacggtcttcgagcagcacccgcccgaccgcaacgtcctcgcccacgagaccggacacgtcttcgacctcgccgacctctaccaccggcccaccgacggcaagggcgactgggacacccacgtcggcgactgggacgtcatgggcagccagttcggcctcgccccggacctgttcggctggcacaagtggaagctcggctggctcggcggacgccaggtcgtctgcgtccagggctcggccgacctcaccctggaaccggtcgccgccgccccggtgcccggcgggtcgatcgggacccggctcgccgtcgtccgcaccggcgccgacaccgccctggccatcgaggcccgcagcgccaccgggaacgaccggtccacctgcgccgagggcatcctgatctaccgcgtccgcagcgggacggcctccggcggcggtcccgtcgaggtggtcgacacccacccgaacaccggggcctgctgggaccgctcggtctacccgccgctggccgacgctccgctcggggtcggggagaccttcaccgtgccgggcgacgacacccgcgtcgaggtcgccgaccgcactccgtccggcacctggaccgtccggatcgccaccggagtctgagacggcccgggcggaggcctccgcacacgaagaagccccccgcttccgcggggggcttcttccgtctgtgcgccgtcagggactcgaaccccggacccgctgattaagagtcagctgctctaaccaactgagctaacggcgcctggtgacgtcgtagacattagcaccctgatccgcccgaggaaaaatcgcatgcgcggtgccccgggaggacgcggagcggctcacccgcacacacgcccagagcagcacatcggggccgggcagccatggattacgggtgtcgggggcgaccacccagcgcggcccgccgtcggacgacgcgcaggtcagcggcggtacggtcacggcgtccccggtgccgtggcagagcaggggcggcaccgtgccgcgctgctccccggcgtccccggcgtccccggaatcgttggttccccactcctcccaggcgagcagtgaaggcagccgctgggccgttccgggggcggcgaacagcagcatgcggccccggtgcgtggcgaccggaccggagccgggtccctcggcccagagctgctccagcatccgccgtccgaacagcgccggcacgttcaccacgtcgaaagcggaaccgcaggggagcactccgggggccttgggtcgctcctcccagtgggcgagcgtgctccgcgggtagggggcggcccccgccagccaggcggcgccggccgccgtgacctgtgcggcctgggggccggactggtcccgcagcagggcgaagatgtcgacgccgtggtgcggggcggcaccggcctgcagggtcgtttcgtctttcagccatgcgctcatggagccaggtctaccgggagtgacggaaaggaatccgagagttgccggaaaccgggacaggccgggagggggaggggtatcttgcccgccggaatatgccacgggacctgacctccggtctggcgtagcagcatctgccccgaccgccccgaccgccccacaggtcacatcggccccgtggaccccgtggaccccaggttccgtggccttcgcaggctccgtaggtcaggctccgggccggaccccgtaggtcaggccctgggcgcgtccagcagggagcggccgaactcgatcatcttcttcgcgtagtcctcggtccactccgcccgctccgcgacgtccgccggggtcagccggtcgaaccggcgcgggtcggcgagctgggccgccgccatcgcctggaactccaccgaccggtccgtcgccgcccggaaggcctgcgtcagctcggtcgcacgggccagcagctcacgggggtcctccaccgactccaggtcgaagaagtgctccggatccgccgcggcctgagacggctcgaaaagcagcggcgcggggcgcagccgctgccgttcgttccgctcggactgtgtcatgtggtgtttcctccctcgggcgacctgatgaccggaggatccggacggccaccctccattgtccaaccccgcgcaagggggccggggcgtgcggcgggggcgcgtcccgggctcaggggcgccaccgcacccgtcgttccgagaggtgggccagcaccgcgtggttcgcctcccagccgtcggggaacttcaccgtgacgcccagttggaccggctccgtggacgggtgctcgtccagcaggtccgccaccccctcccggcacaccacgatgcaggcgtgccggtgccgcgaggccagcacgcacaggcggcccgtctccaggtggaacgcggtcgcgtcgggacgccccgacagcgggtgcagcaccaccgtgacgtcgaactcgcggccctggagccggttcgccgtgtccacggcgacccccgtgacgcccagctccgtgagggccgcccgcaccgccgccgcctggtcccggtgggccgtgccgaccgccacccggtccgccgtcaccggcaccggatcctcggcccgctcgctcgtcgcgaccccgccccggtccagcagccgccggaccaccagcgccaccgcccgtaccgcctcgggatcggtgcgcggggtgtgccgggcgggcagctccagcagtccccacccggactccgccgcctcgtccagcacccggtcgggtcccgaaccgtccgacgccaccccgaaggagagcttccggtccccgtggtccgtaccgctgcggaagggcgtgtacgggtagaacgcgtccgacaccaggggggcagccgacgccgggagccgccacgacacgggcagccggtgctgcggcagctccggattgtgcgcgagcagcgtggacaccgcgctcgccgacgggtcgtagctcagccccgcccactggtccgcgccgacgatcgagaacgggtccagctgacccgggtccccgacgaacagcgcccgctcgaacagcccggccacggccagcaacgcgtccgagcgcatctggtacgcctcgtcgacgatcgcgtgcccccacggctccacgttcttcacgtgcgcccacttggcggccgtcgagatcaccacgtccaacccggccagatccgccgccttcgccgacttcgtcacgttctccagcccgtccaggaccttgtcgtacgggtcggagtcgttgctgtgcagccggcccaccggcagctccgggtccttctccgcgagccgcaccaccaggtcgtcgacctgggcgttggtctgcgcgatcaccatcagcggatgcccggcggcggccagctccagggccgcccggaccaccagcgtcgacttcccggcgccggggggcgagtccacgacgatgccccgggcgctgccgcgcagggtgtcgtcgaggatcgcgccggtcgcgcgcgccgcctccgcgcccgggtcgaagacggtcctcacagcaggtcctccggggtcacggggtcgggtcgctccgcgcgcgcggcggcgtccgcgcccggcgggccgccgtgggtccacggagtctcctccgggtccggcagcttcgggccgccgcgctggtcgtgctcgaacagggtccaggcgatccgctcgccgggctccggcaccgaaccgggcgcgggctccttgccccggcccatccggtccaggatccgcagcaccagcgggatctccccgtcgtcggccggagggccgtccgcgtaccgcacgaactccgccgtctgcggcttgccctccagcgagcggtagaccttcgtccgctcgcccaggtgcggacgctcgtccgtgcggacggtgaccagcgggcgcggggagggccgcttggactcggtgtacgccatctccacctccgacaccgtggcgaggaacgcctcgcccgccagccgccgacccgccagcaccagcggatcgtccagcgcctcctgcgcctccagctgggcctgggcggtctcccgggaggccagcttctgggccgccgtcaccgcgtcgtcgcggcgcggctgcggcggctcgccggagcgcacccggtcccggtgcgcggtgaacgaccaccggtcccgggtccagcggccctcggcccgggacccctcgggcagctcccgcagcaggtcgagaccccgccagaccgcgtcccaggtcggcagcatgacccgcgccagcagcgagcggatctcccgctcggcggcgctcagctcaccga

SEQ ID NO: 3014 - DNA, 24587 bp, Unknown
  Kingdom: Bacteria, Phylum: Actinobacteria, Class: Actinobacteria, Order: Streptomycetales, Family: Streptomycetaceae, Genus: Streptomyces
cggcgcgggaggcgggggtggcggcttcggtggtggcggtggtggtggctcggagaccgcgacacagtccccgtcgcccgccacggcgaccgacgaactgccgtctccctgcccgatcgtggccaccgcgcagctgtcggcggtggcgggcagcggtacggctgtcagccagagaagtgcggcgaccgtcgtgagccgcgcgatgcgtgatccgtacacgtccgcgagcatgatccatgcttccggggaacacgcgatacctgccggtgattcgcctgatcgtgcggttaatgggccattcgtgtttgtccggtggacggtgcacccccgcattcttctcggccttcctttgaacatgaccccgtcggcgtcccgtacctagggccatgaacggcgcggtcccgcgccgccatcggaagcggtacgacgaagcaccacgggagtcgacatgaacacctggcgcaacgcctcgctcgcggtcaccgccgcggccctgctgacgctcacgacggcgtgcggtcaggagcagggcgacgcatcgccgcgcggccaggccgtgggcaacgccgccccggcccagcagcccgccgacagcgggtacggatcggccggcgggggatacggatcgggggccggcacggaggcggcggagccgaaggaggccggtcaactcgccgtccaggagagcaagaagctcgggaaggtcctcaccgacagcgcgggcttcacgctctaccggttcgacaaggacaccgcgaacccgccgaggtcgacctgcgagggggcgtgcgcggcgacctggccggtcgtctccgcgggcaacgccaccgccgcggccggcaccgaccccgagctgctcggagaggtcacccgcgccgacggcaccagtcagctcaccgtcgacggctggccgatgtaccggtacgcgaaggacagctccccgggacaggtcaacgggcagggtgtcggcggcacctggttcgccgcggcccccgacgggaagaaggcggcgaagaacgccgacggcgccggcgtgagcgaaccggccggccccgcggggctttcggtccgcaaggacccggaactcggtgacatcgtggtggacggccggggtatgacggtttaccgcttcaccaaggactcggcctggccgatgaagaccgcgtgcacgggtgactgcctcaagaagtggccggtagtggcccccgtggccaaaaatgcggtggatggtgtgacgacgaagggattcgtcaccttcgaccgccccgacggggtcaagcagcagaccatcgattgctggcccatctacaccttcgccggtgacgccgagcccggagacatcaacggacagggagtcggcggcacctggtatgccgtttcccccgattccgaacttgtcggcgcttcccggtagtcgggcccggtcgcacatcgcccaggtgcctcaagtggcccccaaccgccgggaaacggcgtccggagtgccggtccgtcgctgcacgcatacgcgcagcgacggaccggccgcagatgccaccggagtgtgaccaataacggatcgctaatttccgtttccactcgctctcttggcggccgatcagtagcctctggtcaacactgaccatgaacatggccggatcgccgtggcgacttgttggagacatcgatggagcgtcccgcctgggcaccgcaaggcatagacatttcggtgccaagcgtgtctcgcatgtacgacttctatctgggcggatcgcacaatttcgaggtggaccgggaagccgcgcgcaaggccatggagttccttccgggccttcccaagatcatgcaggccaatcgcgcctttatgcgccggaccgtccgctacgccgtcgacagcggcatcgaccagttcctggacatcggttccggcataccgaccttcggcaacgtccatgaggtcgcccaggccgcgaaccccggggccaaggtggcctacgtcgaccacgacccggtggccgtcgcccacagccaggccgtcctggagggcaacgaccgcgcggtcgtcgccgccgccgacctgcgccgccccaaggagatcctggcgagcccggagatcaccggactgctcaacctggaccggccggtggcccttctgctggtcgcggtgctccacttcgtggaggacgccgacgacccgcgcgccgcggtcgccgaactgcgtgagtcgctggctcccggcagcctgatcgtcctgacccacgcctcgtacgagggcatcccgctgcccaaggaggaggcggccggcacggtcggcgtctaccagaacatccgcaacccgctgatcatgcgctcgcgcgaggagatcggtcagttcttcgagggttacgagatggtcgagccgggactcgtgtcgatgcccgaatggcggcccgacaccccgcaggcgccggagcaggaagacccgtacgccttctcgggctacgcaggggttgggcgcaaggcgtgagcattcccgcccaggcgtccggggaaccggacgcggaacctgacggtccggaaggccggctccggagattcgccagaatctggagccgggccatcttccccctgacggccacctctctcacccggccggagttcgaacagcatctgctgcccctggcacgcgagctgaacggcgtcctgcacgcccaccccttcgacgcctcgcccgcccagcggatcggcgaggccctgatcgacgcgcactgcaccgacccggacgccctcagctccacgctcggcgtcgtcgactcctacctcgtcctgtactgcggcggcaacggacccggcgtcctgtccaccgaggacggccgggcccgctgcgcacggatccagcacaccctcgccgccggcttcacccgggccctgcgggagcgcacgctcgccgagcaggaggccatcgcccgctcggcgctgaccgcccgctcggacgccgaacaggccctgcacgcgacggaggcccggttccgcgcggtcttcaaggacgccgccatcggcatcggcgtcgccgacctggacggcaacatcctggagatcaacgacaccctcaccaagatgttcggcgggctggagaaccacgtccgcagccacaaggtgaacgagtgggtccaccccgaggactcgccgcaggtgtggaagtactacgacgagctcgtacgcggcgaacgcgaccactaccgggtcgagaaggcgtactaccgcaacgacggcaccgtcctgtggaccaacctcaccgtctcgctgctgcgggactccgagggccgtcccgagtaccagctcgcgctgatggaggacaccaccgagcgacggctgctcaacctgcgcctgcgctacgaggccacccacgacgcgctcaccggactgcccaacaggaccctgttcttcgagcgcctggagaaggcactcgccgcccaggaggggatccgcttcggcctctgctacctggacctcgacggcttcaaggccatcaacgacagcctcggccacgccgccggcgaccgtctcctggtcgaggtcgccgaccggctccagagctgcgccaccgcacccggcgagatggtcgcccggctcggcggcgacgagttcgtcgcgctgaccaccggaccggacaccgccgacgaggtggacgaactggccggccgcatcctgaacgcgctcgcctcgcccatccgcctcgacggccgcgagctgaccgtccgcggctcgatcggtgtcgtcgagggtccctccggggagcgcagcgccgccgaggtgctgcgcagcgccgacatcacgatgtaccgggccaaggcggcgggcggcaaccgttaccagctcgccgacgccgaggccgacgcgcgcgccatcacccggcacgggctgaccaccgcgctcccggccgccctggaccggggcgagttcttcatcgagtaccagccgctcgtgcacctgggcgacggcacggtgcacggtgccgaggcgctcgtacggtggtgccatccgcagcacggggtgctcggccccgaccggttcatcccgctcgccgagcacaccgggctcatcgtgccgctcgggcgctgggtgctggaggagtccgtacggcaggcgaacttctggcaggagcggcacagcgacggaggtccgctgcggatcaacgtcaacctctcgccgacccagctgcaccatccccgcctcgtcgccgagacggtcgacgtgctggaacgttccggtctcgaaccgggagcgctctgcctggaggtgaccgagtccgccctgatcggcgccgacgacgatctcctcaagccgctgcggcagctcgcggagatgggggtcgacatcgcgctcgacgacttcggcacgggctactcgaacctggcgaatctgcgcaggctgccggtgagcgtgctcaagctggaccgttccttcacccggggcatgcagcaacacccggcggacccggtcgatctgaagatcgtcgaaggcatcgtgtcgctggcccacagcctagaactggccgtcacggtggagggcgtggagacgggtgcccaggccgagcaactgcggcggctgggctgcgacaccgcccagggctggtactacgcacgccccggggctccggaccgcatccactccctgctgctggcggacgcggtctgagccgggccggggtgcggaggtccttcgcgccccggccggtcagccggggaacggccggtgctccagcagcatccgctggagctcgcgcgcggcccggggcggagccacgtcactgcggtgcgcgagggcgatggtgcgccgcagcccggcgccggccagcggagtcctccgcaggtcgtggcccgcccgggcggcggccatgctcggcaccacggcgatgccgagccccgcccgtacgaaaccgagcaccgcgtccatctcgccgccctcgacggtgaacgtgggctcgaagccttccgctcggcacgcggccagggtcagctcccgcaggttgtacccgtgccggaacatcacgagcggcgccccttccagatccgcgatccggatccggccgcgccgccccgggggaggctccgccgccgaggacaccaccacgaggtcctcgtgcagcagctccaccgtggtcagcgcgggggaggcggccggcaggggcagcaccaccagtgccagatcgagcgctccccgagccagctgacgcaccaggtcgtgcgagccgccctcctccagcagcagccgcacccccggatgtcggtcgtggaaggcgcgcagcatgtccggcagcagcccggtgcagaggctcggcgtcgcacccagccgcacccggccgctgcgcagcgagaccagctcctggacctcctgccgcgccgtctccgcgtcggcgaggatccgccgggcgagcggcagcagtgcctcgcccgcgtcggtgagggtgatgttgccccgggcccggctgaacaggtcggcgcccaactccgtctccagtgcgcggatctgctgggagagcgagggctgcgacacatgcaccgcctcggcggcccgggtgaagtgccgggcctcggcgacggccacgaaataggtgagctgctggaagtgcataagccgacgatagcctccctcgatagctgaggcctatggagatcagccggaccatgtcttggaccgatcaggcctctcgcccctaccgtcgtgtccatggcattggcaacgcggacggaccgacggccgtcgatgacgcgtacgctctgggactcgaccgtcggcaagaagacgatcatggccgtgaccggtctggtcatgctcggatatctcgtcgcccacatggtgggcaacctgaagatcttcttcgggcccggcgagttcgacgcgtacgcgcactggctgcgcaccatgggcgaaccggtactgcactacgagtgggggctgtggatcgtccgggtggggctggtcgcggccgtcgtgctgcacggcgtctccgcgtaccagctgagccggcgcgacatcagggcgcgcccggccaagtacgtccacaagaaggcccggtcgagctacgccacccggaccatgcgctggggcgggatcatcctcgcgctcttcatcgtctggcacatcctcgacctgacgaccggcaccgtgcacaccggcttcgaggccgggcacccctaccagaacgtgatcgacaccttctcgacctggtacggcaacgtcatctacatcgtcgccgtgctcgccatgggcctgcacgtccagcacggcttctggagcgccgcgcagaccctgggcgtcggcaacgcgacccgcgaccgcattctgaaggccctcgccaacctcctcgcggcagggctgacggcgggcttcatctccgtacccgtcgccgtcatgaccggagtggtgagctgacatgcccgactacacgcagtaccgcacgggcgagcccgtgaccgacacgaaggcccccgacggccccgtcgccgaacgctgggacacccgccgcttccaagcgaaactcgtgaaccccgccaaccggcgcaaacacaccgtcatcgtcgtcggcaccggtctcgccggcggagcggccggcgccacactcgccgaacagggctaccacgtcgtccagttctgcttccaggactcgccccggcgcgcccactcggtggccgcacagggcggcatcaacgccgcgaagaactaccgcaacgacggcgactccatccaccggctgttctacgacaccgtcaagggcggcgacttccgcgcccgggagtccaacgtccaccggctcgcccagatctccgtcgagatcatcgaccagtgcgtcgcccagggcgtccccttcgcccgcgagtacggcggtctgctcgacaaccgctccttcggcggcgtccaggtctcccgtacgttctacgcgcgcggccagaccggacagcagctcctcctcggcgcgtaccaggcgctgtcccggcagatcgcgtcgggcggcgtcgaactccacgcccgcaccgagatgctggacctgatcgtggtcgacggcaaggcgcgcggcatcgtcgcccgggacctggtcaccgggaagatcgacacctacttcgccgacgcggtcgtcctggccaccggcggctacggcaacgtcttctacctgtcgaccaacgccatgaactccaacgccaccgccgtctggcgggcgcaccggcgcggcgcgtacttcgccaacccctgcttcacccagatccaccccacctgcatcccgcgcaccggcgatcaccagtccaagctcacgctgatgagtgagtcgctgcgcaacgacggccgcatctgggtccccaaggccaagggcgacgaccgcccggccaaccagatccccgaggacgagcgcgactactacctggagcggatctaccccgccttcggaaacctggtaccccgcgacatcgcctcccgcgccgccaagaacgtctgcgacgaggggcgcggcgtcggccccggcggacagggcgtctacctggacttcgccgaggccatcggccggatgggccgcaaggccgtcgaagccaagtacggcaacctcttcgacatgtaccagcggatcaccgacgaggacccctacacggtccccatgcggatctaccccgccgtgcactacacgatgggcggcctctgggtcgactacgacctccagaccaccatccccggcctcttcgccatcggcgaggcgaacttctccgaccacggcgccaaccggctcggggcctccgccctgatgcagggcctcgccgacggctacttcgtcctgccctccacgatcaacgactacctcgcccgcaatccccacaccgacaccgtggacgagcggcaccccgccgtcgcggaggccgtggcggagaccgaggaccggatcaacctgctgctctcggtcgacggcgaccgcacccccgactccttccaccgcgagatcggtgaactcatgtgggagtactgcgggatggcccgcaccgaggacggtctgcgcaaggcgctcgcgaagatcccggagatccgcgaggagttctggcgccgtatcaaggtccccggcaccggcgaacagttcaaccagtcgctggagaaggcgaaccgcatcgtcgactacctggagctcgccgagctcatgtgcctcgacgccctgcaccgcgccgagtcctgcggcggccacttccgcgcggagtcccagaccccggacggtgaggccgagcgacgcgacgaggagttctcctacgccgccgcctgggagttcaccgccaccggcggcgcccctgtcctgcacaaggaagacctcgtcttcgagtacgtccaccccacccagcggagctacgcatgaagctcaccctgcgcgtctggcgtcagcggaacgccgaagagcccggcgccatggccacctacgaagtcgacggcatctccgccgacatgtcgttcctggagatgctcgacaccctcaacgaggaactcaccctcgccggggacgagcccgtcgccttcgaccacgactgccgtgagggcatctgcggcgcgtgcagcctcgtcatcaacggcgacgcccacggcccggagcgcaccaccacctgccagctccacatgcggtccttcgccgacggcgacaccatcgacatcgagccctggcgggcctccgccttcccggtcatcaaggacctggtcgtggaccgctcctcgttcgaccggatcatccagtccggcggctacatctccgccgccaccggcaccgcgccggacgcccacgccaccccggtgcccaagccggacgccgacttcgccttcgagcacgccgagtgcatcggctgcggagcctgcgtcgccgcctgccccaacggctcggcgatgctgttcacctcggcgaaggtcaaccacctcaacgtcctgccgcagggcgcccccgaacgcgagacccgcgtcctggacatggtggcccagatggacgacgagggcttcggcggctgcaccctgaccggcgagtgcgccacggcctgccccaagggcattccgctgccctcgatcgccgcgatgaacaaggagtggctgcgggctacccgcaaggtccgccgctgacccggaagccgatcccgtacggccccggagccccgagcccggggccgtacgcgatcacgacggcgcgggatcggagccggtacggggtcagcgccgcagcgccttcgccagatacggcgccgtacggctcccggccgcacccgccacctccgccggggtgccggacgcgacgatccggccgccccggtcaccgccctcgggtcccaggtcgatgacatggtccgcgcccgccaccacggccatgtcgtgctccacgaccaccaccgtgctcccggcgtcgaccagggagtgcaactgccgcatcagcacctccacatcggccggatgcagtcccgtcgtcggctcgtccagcagatacagcgtgtgcccgcgccgggtgcgctggagctccgccgccagcttgatgcgctgcgcctcaccgccggacagctccgtggcgggctgaccgagccgcagatagccgagacccacgtccagcagggtggtcagcgcgcgctcggcggccggcgtcccggcgaagaaggacgccgccgactccacggtcagctccaggacctgggcgatcgtcagcccgttgagggtgacgtccagggtctccgggttgtaccgagcgccgtgacagtccgggcagggcgcgtaggtgctcggaaggaacagcagctccaccgagacgaagccctcgccctggcacgtctcgcaccgccccccgctcacgttgaacgagaaccgccccgcgccgtaaccgcgctcccgcgccgtctccgtccgcgcgaacagtttccgtacggcgtcgaagagaccggtgtacgtggccagattggaccggggcgtacggccgatgggcttctggtcgacctggacgagccggtccaccgcctccaggccggtggccgccgcgcagtaccgctcacccggaccggggtcctcgcccgcctgccggtccgccagcaccccggcgagcacctgtccgaccagggtcgacttgcccgagccggacaccccggtcaccgccgtgaacacgccgagcgggaacgccgcgtccaccccccgcacgttgtgccgctccacgccggtgatccggatccacccggacggcacccgtggctcccgtacgggcgcgggctcctcctcgaacaggaaccgccgcgtcgccgactccggcacctgggcgagcccctcgggcggcccgctgtgcagcacccgcccgccgtgctccccggccagcggtcccacgtccaccagccagtccgcctgccgcaccacgtccatctggtgctccaccacgaagacggagttcccggccgccttcagccggcccagcaccccgagcagcgcctcggtgtccgccgggtgcagcccggccgacggctcgtccaggacgtagacgacaccgaagagtcccgaccgcaactgcgttgccagccgcagccgttgcagctcgccggaggagagcgtcggggccgtccggtccaggctcagatagccgagtcccagctccgtcaccgtcccgatccgcgccagcagatcgcccgtcagcacccgggccgtctcctcgccgcccgcccccgtcccggacagcacctcggccagtgcggacaacggcagcccggccagctccgcgatggtctgcccggcgaaggtcaccgccatcgcctccggccgcagccggctcccgccgcacaccgggcacggggcactggtcaagaagcgctccgccttcgcccgcagcgcccggctcttggtgtcggcgaaggtgtgcagcacatagcgccgcgcgctcatgtacgtaccctggtacgggcgttggatccggcccgcgtcccgcaccggatgcaccgtcaccaccggctgctcatcggtgaacaggatccactcccggtcctccgcgggcagctcgcgccacggccggtcgacgtcgtggcccagcgcgtccagcacatcgcggaggttcttgccctgccacgcccccggccacgcggcgatggccccctcccggatcgacagtgagggatccgggacgagcagctcctcgtccgtccggtggatccggcccagcccgtggcactccgggcacgccccgacggcggtgttgggggagaaggagtcggagtccagccgctcggcccccggcggatagtcccccgcacgggagaagagcatgcgcagcgagttggagagcgtcgtcaccgtcccgacggacgaccgggcccccggggcggagcggcgctgctccagcgagacggccggcggcagcccggtgatctccccgacggcgggcgcgcccacctggtggatcagccgtcgggcgtagggtgccacggactcgaagtagcggcgctgggcctccgcgtagatggtcccgaaggcgagtgaggacttcccggaccccgacacgcccgtgaacacggtcagggtgtcgcgggggatgtcgacccggacgttcttgaggttgtgctcgcgggctccgcgcacgcggacgtacggatcgtgaggggagtgcatggggctcggctccgtacgggtggggttctgacgcctggtgggacaaacagtccgattctaggcgtcggcgcccgcagtgggactccgggacccggaggaggtcgtgcccggtccggcggctatcggacgtcggggctccgccgcggggccggctcgtcggcccgggcgcggggccgggtgatccgggcgagccgccgcagtgagtccaccagccccgcgcggtcgtacgtgctggtcgtgacgagcacctcgtccgccccggtctcctcgatcgcgcgctccagctgaccggccacctggtcctcggtgccgtggatatggccgtcgaggccccgctcgtacagcgaccgctccttggccgtcatggcgagggcctcgatgcgctcggccggggccagcggcggaaagtccccgtgcgtacgggagtacgccatggcccatgcctccggtacgagcagccgccgggccgcctcctcggtgccggcgacggccaccgtgcccgcgacgatcacttcgggccgctcggcacgggcggaggggcggaagtcgcggcggtagacctcgacggcgcgcagcaccttctcccggccgcgcagatcgccgatgacgagggggagcccggcggccgcggcgaccgacgcgccctccccgatcgccaggacgtacgcggggatgcgcaggccctccgccggatgggcgtgcaccccggggtgggcctgctgggtgccgtcgatccagccgagcagttcggtgagccgcccggggaagtcctcggcgtcctccttgccgcggccgagcgcccggcggacgccgtcggtgaatcccacggagcggccgagccccatgtcgatccggccgggaaagagggaggtgagcaccccgaactgctcggcgacgaccagcggccggtggttgggcagcatcactccgccggtgccgacccggatggtggaggtcgcggcggcgacggcggccgccagcacggcgaacggagtcgccctggccgcacgggccagacggcgcacccccgtaccgatctccgcgtcgagcacgaactccacccggtcgccgcgggtgctcagcaccgcgggccgtgggcggtcggtcgggaacgacgactcctccggggcgtcggccagagccttcctccaatactccatgcaggcatcggacggtgcccgctgttgttcggcataggggccgaactgcagcggaatctcgggcagaccgctctccgtcccggtcagtgcggagcggtagagcgcgctgaactcggtgtccagcagcccccagacccagccgtcgatcaccgcgtggtggacggccacgaccagtacggcgtcgtcatcggccacccgcagcagcgtcgcccggagcagcggcggacgatccaggaccacgggccgtccggccgcctcggccagtgcccgggacagctccgccggggtgaccgagcacacggtgaggtcgacgggggacgggcgaaggacggtctgccggggcactccgtccacgaggtggagccgagtgcgcagcgcctcgtggcggaccacgatgccgtccagcgccgcctggacggcgtcgggcacgatccgggcgccccgcagacggtacgtccaggactccagatagcgcgaggcgccatcctggaactggtcgttgagccagaccgactcctgctcgaaggacatgggatacgtggggttcatgggaccgagctctccggggtgggtaagaaatgcgggcgagcgggtggcgacgcgccgacgcctggtcttccgactgccgatcggataacggctccggttcagagcgaagcgctcagggcgcggtggtcgagctttccgttggccgtggtgggcagggcggcccggtgctcgacggtgcgcggcaccatgtaggcgggcagaagggcggccagcgcacgacggaccgcgcgggagccgggatcgtcgccctcgtcggccgtgtagaacatcgcgagccgctcgtacccgccgctcctggcggccatcggtacgaccacggcttcgcgcaccccggggatgttccgggccgcggcctcgacctcggccggctcgatgcggtgcccggagatcttcacctggcggtcggcccggccgtgaaagtgcagcacgccgtcggcgtccaggtgccccaggtcgccggtgcggtacacccggaccggggtgccgtcgagtacgacggtggggaaggccgcggcggttgcctcgggtgcgttcacgtagccgtcggccaggccgtgtcccgacaggcagatctccgctcggtcgcccggggcggccgggcggtcgccatcgaggagatggacggcggtgccgtgaacaggggtcccgatcgggaccccgtcggcgcggacgcagtccgccgccgtgacccggtgggtggtggcgaacacacagctttccaccgggccgtaaccattggtcagggcggtctccggatacctggtcaggaaccgtgcgacatgctcgggcgagaggcgctcgccgcccgtgaggacctggcggacgcccgcgaagcaggggcggcgcgggtcgtcctcgtccacgaacaggttgaacacggtggacgtcagccagacggtatccacaccggtcccggcgaccaggtccgcgagggtgtcgggcagcaggtagtccccgggcgcgatgacgcaggtgccaccactggtcagcgggccccacagttccatgccgaaggcgtcccaggccggcggggcggcctgcagcacgacccggccggggccgaagtcggcgaaggctccggggccaccgaacagacgggtcgtggcacggtgcggggagaggactcctttgggggttccggtggtgccggaggtgaagaagaccgcggcgggagcatcggggccgatgtcggtcgcgggtcccgccgtgcggcgggcggccacccgcgccaacgattcggcgggcggcggccagcggcccgggccggactcgtcggagaccaggacgggtgagcgcagtgcggcggtcacatgggcgactcgctcccggggccagcgcaggtccagggcggcgtaggccgcgccgcacttgaggacggcgagcagagcgaccgccaggcgggacgagcggggcagcaggacggggaccacgacgcccgggcggacgcccgcggcggcgagttcctgggcgtagacatcggacgcggcgtcaagtgtcgcgtagtcgaggtgctcgcacccgtcgatgagagcgggagcggcggggcgtatgcgagcctgttccgccacggcggcgtggatgaggcgagcgggcatggagtgctctcctgagcggccgggaggttatgcgacgaggacagcggcgaaatcgcccagcgtgtccgcctcgaagagggcgtccggagcggcgtgcacgccccagtccttgttgaggcgcgcacagatacgcatggcctgcagggaactgccgccgacgtcatagaagttgtcgtcgggcgtgacctgggggacgtcgagtatctcggcgatgatctcgaggacgcccgcggtggtgggggaagggggtgcgtactgcgtcacgggggttctccggatgggtgaaggcggttccgacaggtggcgtcgatccgagcatcgcaagagccggcaccacctcaggtgaatcatcgaacaaggtgacgattgagcgaaattcacggccacgaagcatgtgacatggcctcggtgaaaggtgccgcggacggctcctcacggggtcgcagttggcagggaccggccataggtcccgaggcccttgtccgcccggcggccgacggctgatccttgcactcctgcgcctcgtcggggcgcggaggccgggtacccgggaacgtgaacggagtcgtacatgagcgggatgaagagagttctgcgccgcacggcggtaggggcgagcgcgctgctcacggcggtgggtatcaccatgacgggggcgtccccggccgcggcggtggactactactacgagctgccgtacccggcgggggaggcctacacggtgacccaggggccggagggcacatactcccacaccggtccctacaacgagtacgcgtgggacttcgggctccccgccaactacgaggtgtccgccgcccaggcaggcaccatcgtcttctcgaactggtcgccgtactggcagaacggcatcgaggtgctcatccggcactcgaacggccagtgcacccactacgcacacctgaaccggtcgttctacgagccgggtgactgggttccgcagggccggatcgtcggctggtcgggcagcacgggcgcctccacggccccgcatctgcacttccaagtgatcgactgcaacagccgcgtgggcctgcccgccaccatccagggctggacgccctacacgggtacgcgccccgtgagcgtgaacaactacgcctgatcgggcgaccgtccaccgcccccggcccgcccgaggggccgtacgccgcggacgaggctcggctgtcgaccggcgtcccttctccggtcgacagccgagccaaggtcatcccagccgtggcacggcttcggagcgcttcgaccggccggatccgcacacggggacctctcggcggtcgggctgccgagaggtccgtagtggtccgaggtcagtagggggccgagggggtggccgcgatcagaccaggtcgaaccggtcgaggtccatgaccttgctccaggcggcgacgaagtccgtcacgaacttctgctgcgcgtcgtcgctcgcgtagacctcggcgagggcacggagttcggagttggagccgaagaccaggtccgcgcgggtgccggtccacttgacccggccggccgcgtcgcgggcctcgaactcgtcctgcaccgacgacgtcggcttccaggtgatgcccaggtcgagcaggttcacgaagaagtcgttggtcagcgtgcccggacggtcggtgaggacaccgtgcttcgagccgccggaattggcgcccagcacgcgcagacccccgaccaggacggtggtctccggcgcgctcagcgtcagcaggttggcccggtcgaggagcaggtactcggcgggcaggcggctgcccttgcccgcgtagttgcggaagccgtcgtacacgggttccagggctgcgaaggactcgatgtccgtctggtcctgcgtggcgtcgacccggcccgcggtgaacgggacctccacctcgacgccggcgtccttggccgcctgctcgacgaccgcgttgcccgcgaggacgatcaggtcggccagcgagacctgcttgccgcccttggcgttgaaggactcctggacaccttccagggtgcgcaggacctgggccagctcctccgggtcgttcgcctcccagccgcgctgcggctccagacggacccgggcgccgttggcgccgccacgcttgtcgctgccgcggaaggacgcggccgaggcccaggcggtcgagacgagctgcgccaccgtcagatccgtggcgagcacctgctccttgagcgcggcgacgtccgcggcgtccagcagttcagccgtgcgcgcgggcagcgggtcctgccagagcaggacctcggaggggacctcggggcccaggtagcgctggatcgggcccatgtcgcggtgcgtcagcttgtaccaggcacgcgcgaaggcgtccgcgaactcctccgggttctcgtggaagcggcgcgagatctgctcgtacgccgggtcgaagcgcagcgacaggtcggtggtgagcatctgcggcttctgcttcttcgacgcgtcgtgcgcatgcgggatggtcgcctccgcgtccttggcgatccactgcttcgcaccggccggggactcggtcagctcgtactcgtacgcgaagaggttgtggaagaactcgttgccccactgcgtcggcgtgctggtccaggtcacctccagaccgctggtgatggcgtccccgcccttgcccgtcccgtacgagctgcgccagccgaggccctgctcctccagcggggcgccctcggggtccgcgccgacgctctcggccgggcccgcgccgtgcgtcttgccgaaggtgtggccaccggcgatgagggcgacggtctcctcgtcgttcatcgccatccggcggaaggtctcgcggatgtcgcgggcggccgcgaccgggtccgggttgccgttggggccctcggggttgacgtagatcaggcccatctggaccgcgccgagcgggttctccagctcacggtcgccggtgtagcgctcgtcgtcgagccaggtggtctccgggccccagtagacgtcctcctccgactcccagacgtcctcgcggccgccggcgaagccgaaggtcttcaggcccatggtctccagggcgacgttgccggtgaggatcagcaggtccgcccaggacagcgcctggccgtacttcttcttgaccggccacaggagacggcgggccttgtccaggttgccgttgtccggccaactgttcagcggggcgaagcgctgctgtccggcgcccgcgccaccgcggccgtcgctgatgcgatacgtgccggcgctgtgccaggccatccggatcatcagcggcccgtagttgccgaagtcggccggccaccagtcctgcgacgtggtgagcacctcggcgatgtcccgcttcaccgtgggcaggtcgagcgcctggaacgcggcggcgtagtcgaagtccgcaccgagcgggttcgccacggcggggttcttggcgaggatcttcaggttgaggcggtccggccaccactggcggttcccgccgccctgcgtggggtgcggtgcgcggccgtgggccacggggcagccgctcgcctgtgcctcgggcacctcggggacggccgtctcgggcgaatccggggtgacgggatcaaagacatgcgactcgtggttctcggtcatggcaatccttccggacccggtgggtcgtggggcgctgaacggggaggaggattcggtccgcgcagaaggggcacgatgtatgccaggtctcgccgcggccgaccgaacgcctcaacggaccaccggaccggacggtcccgggcggtgctacgagggcggcgctcggtcggcgtcgcgcggtctgccgacggtgtcccacgcgtttctctgctgccgtaccggagtcttcctgtctcttggatgtcgccgggatcgatcctacgatggacttcgtccaagtcaagaagtgcgctaaaacgataatggccgacgacgcgaagcgggtgaaacgagatgagcgacctccttcgacggctacggggccgtgactggcggttgacctcgcagcggcgtgtcgtcgcggaggtcctcgacggcgaccacgtgcacctgacggccgacgaagtgcatctgcgggccgccgcgcgactgcccgagatctcccgcgcgaccgtctacaacacgctgggggaactcgtcacgctcggagaggtgctggaggtctccaccgtgggccgggccaagcgctacgacccgaacgcgcgcagcccccaccagcacctggtgtgctccggctgcggcacggtccgcgacgtccacccggtcggtgacgcgctcggcgacctgcccgaggccgagcggttcgggttcgccgtcggctcggtggagatcacctaccgaggcctgtgcccggcgtgcgcctgaccgccggcgcaggtcagccggaccgctgcggggagcggagcacgagcagggtgatctcgctgggggcgaagacgcggaagggcgggccccagaagccggtgccgcgactcgtgtagaggagggtgcgagcgccgtggcggctgagtccggcgacggccggctggtcgaggcggaccaggtagtggaagggccagatctggccgccgtgggtgtggccggagagctggaggtcgatgccgcgggctgccgcgcggtcgatgaactcgggctggtgggcgaggaggaggacggggtggtcggggtcggcgccctggagggctccggcgaggtcggcgcggtggcccgccagtccggaggactcggcggtgacgtcgtcgacgccggcgaccacgagggtgtcgccgccgcgttcgagcagcagatggcgattgcgcagcggctcccagcccagccggcccatcaggtcgacccagccctgggcctcgctgtagtactcgtggttgccggtgacgtagacacgggcgcgcgtcgcctgcacggtgcccagcggggcggcctgcgcgcgacggcgttcggccgtgccgtccgcgatgtcgccggtgtggcagaccaggtcggcctccagggtgttcaccgtctcgcagacccgagcggaccagcgggcgcggtcgagcggaccgtagtgggtgtcggtgatcaggacgactcgggttccgtccaacccggcgcccaggcgcgggagttccacgtcgagccggcgcacgcgcggcacccgccgggcctcggcgtacccccaggcgagcagcacggcggcgacgccgaggacggcccaggtgacgatgcgcgcccggccctgcccgtcgccgacgccgcccacggtcagggcgagccgcagcaggacgccgagcagcacggaccaggcgaacaggacccagacgcagcccagcagcgtgtctccgacgatcgccgcccggtcccgctggcgtcggccgtggccgtgcaccatcgcgagcggcataacggccaggccgagaacgaacagcgcggtgccggtcagagcgacggggagcggccagcgctggccggtgtgcagaagaacccagcacggcacggcccacaggaggacgggagcgatcagggggatgtagcgcatcaaacgccgcagtcggctccgtggcgcttcttgcgcttcaccggcggcggatcgggtgtcactggtctcggtcacgcttcccctcctgaggttctgtccggcggacagctcattgtgcgccgtcgaggaaagcgcggtcccggtcacggcacccggtgaaggaggggccgatgacgcgaagcctccgaggaccacgggggcttcgggcggcctcggtcgagaatccccggccgggccgggaacagcggtcaggtcggcgcggttgcatccttcaggggaccggcgccgtgcgggcggggaacacggaggccgcagggcgtccgccccgtcgggatccgagccctgggatcgcggcacgcatgtccgccgtcgacccggaccacaacgtattcctgcgggaggaccctttcatgaccgaccggcccttgactctcatgacagtgcacgcccaccccgacgacgaggccaccggaaccggaggagtcctggcgcgatacgcggcggaaggcatccgcacggttctcgtgacctgtaccgacggcggttgcggtgacggaccggggggcgtcaagccgggcgatcccggacacgacccggcggctgtcgcctcgatgcgccgccgggagctggaggcgagctgcgacgtcctcgaggtcagcgatctggagatgctggactacgccgactccgggatgatgggctggccgagcaacgaggcccccggatccttctggcagaccccggtggagaagggcgccgcccggctcgcggaactcatgcggcactaccgtcccgatgtcgtcgtcacctacgacgagaacggcttctacggccaccccgaccacatccaggcccaccgcatcacgatggcggcactggagatgaccgagctgacgccgaaggtgtactggacgacgatgccccgctcgacgatgcagcggttcggggagaccatgcgtgagttccacgaggacatgccggagccggatccggccgaggccgccgcgctggccgagatcggtctccccgacgacgagatcaccacctgggtggacaccaccgcgttcagcggccagaagttcgacgcgctggccgcgcacgccagtcagggcgagaacatcttcttcctcaagatgggcaaggagaggttcggcgagctgatgggcatggagaccttcctgcgcgtccaggacgccaccggcgcggccgtgcccgagaaggacctcttcgccggactccgctgaccgtccgcccgctgtgccgcggacgtaccggcgcctatgccgaggacgttgcggcgcgcatgtccgcgccgtacgtcgtgcggtagtcggggacgacgatccggctcgtgggggactcccggtggacctgggcgacgaacccgtccaggtccatcaccggatcgcggctcgggggttcgctcagcggctcctcgaagttgtcccagtggacgggcacgacgacgcccggccggtccagggcgcgcagcagcctggacgcatagcggaacacggcggtgccggccggcacggcgaccatcgcgagatcggggctcagtccctgcacggcctgctcggagaagtcgctggcgcccatcaggaacgccgacgggccgtcgttccccgccgtcacctggaaggccagggtgtcgccctccggcagatcggagatggtcctcggagccgccgcggggggagcgttcagcgtgcccggcgcgaagtaggagtgccgcttgttgcggctgtgcaggctcgacacgacctggacggtgattccgtcgaagtccaggacctcgccgcccttcaccaccgagatctgaccggggtcgaccccgaacgcgaccagcagatggaacgtggtctccgtgccgacgacccgcgcgccggtggacttcgcgatgtgcggcacgtcggcgatgtgatcccagtgcgagtggctcaccagaacgatctcggggtggccgatgtgctcccggaccagatcggggtcggacctcaacttcgtacccggcttgagtcctccgtcgaacaggccggtcctgaaccgggtgatgtaggggtcgaagagcaccgtccgaccgccgacgtcgatgcgccagccggaggtgcccagccagcggaaggacgccgaaccggccgccggggcaccgcggtgcgccgcggcggcggtggtcgtggtggtgagcagtggggccgccgcgccgatcgcggcgccgcgcagcagtgcacggcggccgaatgcctggatgcgccgcttcggacgctgtacgtctgtgtccttgtccatggcgtcaggagatcagggcgcgagcctcttcgtccaagatcaaaatctgggtgtactgatacgcgaacgcatatgagtacacgtcagagcccgttgtcacgcaggtggtcgacggcgattcgggccgtggcgccgatcgccgcgtccaccgccgtacgcgaggcggccagctcgcgcgtacgggcgaagacggcgaccgcgtagaggccgccgtcgggataccggacgacccccgcctccatgtgcagtccgggcagggttccggtcttcgccgcgatcgtcacgtcgtcgggaaaccccgacaccagccggtgccggaacgcctggcgggccatcagctcccgtacctgcgcgcaggcttccggcggacctgcctcgtcgcgccagacgagacgcagcagcctggtgatgtccctgggcgtggcggcgttggtccgcagcggatccagcacgctcaggcgccttttgcgatcgtccggcagcgtggggtaccggagcgcgaactccgcctcgtcacgtgcgccgacctcggcgagcatcgactccagtacgtcacgggggccacccacgatgcgtgtcctgtggagcccgagctcctcggcgagaagccgcaccgtgtccagtccgacgcgtgccagcagcagatccgccgccgagttgtcgctcaccgagacggcgaagaacgccagatcgcgcagcgacagctcgacgtcgtccgcacagcccgccgtgccccagccgccgagccggtcggccgccgtcacccgcacccgctcgcgcgggtcgagctgaccggcggccacctgccgggcgaactccaggaccagcagcaccttgaagaccgaggcgatcacgacgggctcgtcggcacccacggccacctccccggcgcccggctccccctcgacggggaccgcgtgcaacaacccctcggcacccgcctccgcgaacacctcgcggatccgtttctcgaccatcggttcgcccctcgcataaggtcactggttgtggatctcttgcgccacctgcgtatcttcgtcgccgtcgccgacgagctgcacttcagccgggccgccgaccggctcggcatggcccagccacccctcagccaggcggtgcgcaggcttgaggaggacctcggagccgcactgttcgaccggtcgcaccgccaggtccggctcaccgccgccggcatggttctgctggacgaggcccgtgaactcctggcccgcgaaaagcggttgcggacgctggcccgccgcgccggcgacggcggcctgggcaccctgcgcgcgggcgttcctcccgacaccaccgtccccacgctctccgcgctgctctcggcctgcgcgcggcactccccgggcctgtccgtcgatctgcaggagatcaccaccgaggaacagctgcggctgctcgcttccggcgggctcgacgtcggcctcgtccaccagcccgtggacgccaccgaactcagcctcggcccggaggtgcgcgcggagctcggtgtcgtccttccccgcacgtcaccgctggcccggctccccgaggtggcgctcgccgaactgtccggccacgatctcgtgctcttcccccgcgcgcaggccccggggtggtacgaccggatcctcgattgctgtcgtgccgagggcttcgtgcccggccgggtccggcacgcgtccaaccccgagttcctgctggcccttgtccacgcgggccacgggatcgccttcgaccaggggccggtggcccgcaaggagccccgcgtggtctggcgtcccctggcgggccgcccgctcacccggcggacgaccggcgcctggccctccggccgttccgcccacccggccgcaccggacttcgcggagctcgcggccggtgtgctggcc

SEQ ID NO: 3015 - DNA, 2021 bp, Unknown
  Kingdom: Bacteria, Phylum: Actinobacteria, Class: Actinobacteria, Order: Streptomycetales, Family: Streptomycetaceae, Genus: Streptomyces
  misc_feature (379)..(446): n is a, c, g, or t
gcgcgactgaccggtgcgagcagttccgcgggccggcccggcgccggcctctcggctggagccgccgcctatgagccgcgccgctcaacggctggtggccgagtgtccgcctgcctgcggtggtcggggaacgagttcagccgccgtccgctctcccccgggtcccttccagcagaccgaggtcgagtgctctgaccaccgcgtgcgtacggtcgccgacgtcgagtttggcgaagaccctcaacagatgcgtcttcaccgtcgcctccgcgatgaccagccggcggccgatctccacgttggacagtccgtccgccaccgctcccagcacatccacctcccgtctcgtcagcgtcaccggcgcgggcctacgcatccnnnnnnnnnnnnnnnnnnnnnnnnnnnnnnnnnnnnnnnnnnnnnnnnnnnnnnnnnnnnnnnnnnnngcgcccgcctcgacggcgcgctcgatctccgcgtcggtctcgtacgtggtcaggatcagcacgcgggtccgggtgggcccggcgacgatctccgcggtggcactcgtcccgtcgaggacgggcatccgcagatccatcagcaccacgtcgggctccagccgttcgacgagaccgacggccgccctgccgtcctcggcctcgccgacgatctcgatggtgggttcgtccgccagcagggcgacgaccccggcgcgcatcaccgtgtggtcgtccgccacgaggatccggagcttcttctcgcctgtcggcccgtatgtcatctcagccctgcccgtcggtgggaatcatggccaggacacgtgtgccgtcgccgaccgaactggtgacggtgagctccccgccgagctcggccaggcgcttgcgcattccgtgcagcccgaagccgtgggagtcctccgtcacgaagcccgcaccgtcgtcggtgatctccagctcgatcccgtacggctgcgcggtgagcaccacctccacggtggaggccgccgcgtgcttgcggatgttggcgagggactcctgggtgcaccgcaggagggcgatccgggtctgctggtcgcaggtgacgtccggcagttcggcggtgacgccggtcccggtgtcctcggtgaaccgctgcaaggtccgtcgcagggtgtccgccatcgagccggcggcgacaccgctccgcggggccgagccgacgaggacgcgcgcctcggcgaggttctcgcgcgcggtgttctcgatcgcgagcaggtgcttcccgctcctgcccgggtcggtccccagaccggatctggccgcctccgccagcacgatgatggacgcgaatccctgggcgagcgtgtcgtggatctcccgcgcgagacgttcgcgctcgtccgccgctccctggcggtggtgtgcctcgacgagccggagccgcgcttcctccagttcggcgctcaggcgccgggcccgctcgtcggcgtcctcggtgatgtggcgcaccccaagcccgatgaacacgcctgccgcgtacccgatgagcgtgaagatcacgttgccggtgaagaactctccgtcccacccctgtcgtacgacgttgcctgccacgaccgccgccgcggcgaaaccgctcagggcgatcgcggcacgcgcactcatggtgtagatccagaagtgcggcagtgtcaccacgaagagcgccgcgctgccgtcgagcaggtacgacatggctccgagacccacgacgagtacgtacaggtaggagcgggggcgtagggcggggttgccggggaacagccccaccgcgccgtacgacagggcgagcacggccagcagccccagcaccgggtagcgcgtcgtagcgggtgcgtcggcgaccgcgagggccggcgggaccacgcccagcagcacccagaagacggcgttccaccggtgcggcgacggtacggtcaacggggtttcgggctgcggccgttgattcaccgcgtcagcctacttccgccggcggtccggcggcgggttcctgggcccgcccggtccgcccgggccgcc

SEQ ID NO: 3016 - DNA, 8905 bp, Unknown
  Kingdom: Bacteria, Phylum: Actinobacteria, Class: Actinobacteria, Order: Streptomycetales, Family: Streptomycetaceae, Genus: Streptomyces
tcgcggccgtccacgccgacttcgtccgcgccaaaggcaacgccgacgcccccggccagggcctcgtccgggcggactccgcgggtccgccgcgagcacgcctacctgaccccggagggtgcggggttgccgttcaccccgcgcggaccggtcttccgtgcgctgagcggcagggccacgtacggcagggccgcctcgatcccggggcggcaccgggacgcccggccggctccgccgcaccttcgaggtctcaactccccttacacgccccgtagtggacgttcaggacgtcgccctccgcctcgcgcaccgcggcctcaccgaagcccgcgtccttcagcatccgcagcgccggtccgcctgcctcatacgacccctggacccgcgccgccctcgcccagcaggaccgtcacgcgatccctccctccgacatgtccaccccgtgaggacattcccgtcccacccggaaccttcgggcaactcgattgcgatatccgatcgtccggcgttcacccgagggccctcaatctgttcgtatacaccgacaggttatacagaggtacgaagcgtccggcttgaaggggtaaaccgctgaggcacccggactgcccaggtcgcagcgttgattccagtgggtccgcgggctgttggatgaagatttttttcgtacgatgtgacagcgcgcatcgcggtataccagtagattgccaacaccatcgcgagattgatatcgacctgccaactgcagttcatcgactgatatttggcggtcagtcaccatgtgaagagttcctgacgaacaccgagtccgggcagcccgtcggtccgcgaaatcgagcccggtcggaccgaccgtgctggacggtcgcggtgttcgctgtcgtttccgacctgatccggttgtccggggacaccccccacgcggccggccgagagcatgaggaacgttctgtgaaggttcgtacgaggcggccgagcaccctgatcgccgggggactggcagcgatgttattgacggcttgcagctccccggactccgagaacacgatggtcgtcgggatgtccgacgacatcctcgccacggatccggcctcggggtacgacccggggtcctggctgctgttcaacaacgtcttccagtccctgctgagcttcccgcccggagcgtccactcccgtgcccgaggctgccgaggactgcaagttctccgacggcagcaaaacgtacacctgcaccttgcgtgacgggctgaagttcagcaacggcaacagtctcacttcggcggacgtcaagttctccttcgaccggacgatcaggatcaacgacccggcgggccccgcgccgctgctctccacgatctcgtcgatcagcaccccggacgacaagaccgtcgtcttccgcctcaaggtgcccgacgcaacattccccagcaagatcgcctcgggaggcggttccatcgtggaccgtcaggtgtaccccgaggacagcctgctcgaaggtggcaaggcggtcggttcgggtccctacgagctggactccatcgacaaggggaaagccgtcttctccgtctactcgggctatcagggcaccgccgaggtgaagaactcgggcgtgaccctggagctcttccagggtgaccagcaggctctccagtcggctctggagaagggcgacgtcgacatcgcctaccgcggcctcagcgccaaggcgatagctgaactggatacctcgtccaccgcggagaaggacggcatcgaggtggtccagggcaacagcgccgaagtccagcacatggtcttcaacgtcgacgacccggtcgtcggcaagctcgccgtccggaaggccatcgcctacctcgtcgaccgccactccctggtcagcgaggtctaccagtccacggcggcaccgctctactcgatcatcccgggaggcatcaccggccacggcacctccttcttcgacacctacggggacagcccgaagccgaaacaggcgaaggcggagctgcggaaggcgggtatagcggacaaggtgaaactcaccctctggtccaccccgagccgctacgggccggctaccgacgacgagttggacaccatcgccgatcagctgaaccagagcggactcttcgacgcccgcatgaagtccgtccccttcggcgagtacgagaagggcatcgccgaaggcaagtacggcatctacgtcaagggctgggtgccggactaccccgatccggacaacttcacccagccgttcttcggcgagggcaacgtcctgtcgaacaactacgacaacgaggagatcgtcgaccgcatcatcccgcgaacctcgtccatgacggatcgtgcgaacactcggcagcagtacatgaaactgcaggacatcgtggcgcaacagctgccgattctgccgctctggcagggcaagcagtacgcggtcgcccacgagaacgtccgaggcctgcagaactgcctggacacctcgaccgtcttccggttctgggaactcagcactgcttactgaggcgtaccgcagaagcgggtcaaactctgcggtgatcgacgtgtggggcgcgaagacgcggcgaacgcagaagaagggaacattgaaacccccgtcggccgtcgggccgtgcgggggtttcgaggtggagcgccagcccggatgcgaaccagcgccacccacccggaaggcgggcgcgccgtattttttttgcgccactgacgcgggcgtccggatacgccactgcggtggagcaaccggtcacactgtgctctccgcaggtacagcgagtgacgacggagggctacgcggccagtcgaccgaacaccttccggagccggagaacggcacccgatcgcggggcctcgcgcagcacaccgacggcgaaccgggcggcagcgccgggcgacatggccgccatctccccctcccactccttccggtagcgctcccgctccttcgccggcagaaagcggagggcgacgctcacgcggcgacgggcggtccgggattcccgggaaagccggagctcgtccgctacgcggacctgccggctcgcgtcgatcagcctgcacttgacgagccagtcgaaacccgaggcgccaagcccccgcaggaggtcgtcccgctgcaactcctcaaggatctgcgtcgatgccggcagtcgaccgtgacgcttctccgcgaccaccatggcgtgatccaggcgagcgaagtacagccgtgcgtccaggagttcagagatatccacccgactccgagccgcttgttcgatccgccgcacagcactccggttccgctgcatcgtcacctcggcccccgactgccggtcggcgccgagggcggggcgctcgccgaccccgaagcggtcgaccaaccacctcgggaggatgcgccgccacttctcgtccacgtcgagcacccgaacgagcagcaccgccagcaacacgaaggtggtgacaccggagatcacggtcacgtcagcccactctcgggccggaggttcgcgacacccgcacgccggcgacgatgcgccttggcaagcgccagaggcacttcctgggcccccttctcgctcagccggtagtagcggcgcgcaggccggccctcggcatgcttgtcgacctcctcccaacggctttccagccatccccactgctcgagccgcatcaggatcggatagatggatccaggcgccagccccgcagcatcgctcacttcaagcccgtagtgctcgtccgccggtctcgccataaatgccgcgagaacggcccgagtgggcatcgtcatcctcggttcacccatacctcaactctacatagctatgtagagaaagctcgaccctatgtagagatagacacagacccctatgagtagtaagactaagcaacacggcgggtcgggtgcgtcgccagggtggcgaccgcgcccgccgggatggggtaggtcatgatcagttgggtcctggtggttctcatgtgcaccgtcggtgtgctgctcgcgctcgtcgcctgcgtggtcgccgcggcactccccgatgccactgcgactccccactggtcggaccggtgccgtcggggatgcaaggcattccttgcttcgatgacgctgtacgtagcgctcgtactcatggcgctgggggtgctgaccgccctctgagacgacgaagccccggccggcaggcggtcgacccatccgagtccccttccgggggccgccggcacaggcgctggaagcgacggcacgacagcggtcacgcagagatccgccgcgtcggccctgtccgaccatgcggacccggcccggcccgaacctgggatcggtaggagtcccggcagcgcgagcctcgccgcatggacctgcagaagttgttcgggctctggtggacggtgcccgccgggctggcgttggtgggttatgcgtgttcgctggccgggctgacccggccgcagcgggcggtgtgggtgacggctcgggtcgtggaggtgcatccgccaggacacggtgagtcgggaaaccacgggataccggtgacgatcgcctaccaggacccgggcaccgggcgggagttcagactgcggcacgagaacaagcgtggtgaccgggtgctggtggcctgggtggggcaggagttcccggtccggtttccgcggcggcgaccggagcggttctatctcatgctggacagcgaggggcggacctccgggaccggcgggccgaactgcatggtgttcctgctggtgttgggtctggtcgtccattcgttcttcgcgtggggctggcagtgggggctgatctgcgtcggtacactcctgcttctcgtcgtcgcgctgtgccgggacggcgagtacgtccgcgcccgcgccgctcaactcgccgagggcgtcaccgtccagggccgcgtggtcgctgtcaccagagacgtccactccgacgccgaaggcggcgagagcgtcagccacgcctccgtcgtcgctttcaccacccacgagggcgtcgaggtcaccgcgctgtgcacgcagggcatccgaaatatcgccaggtccctcggccgtgacattcccttgcgttacgcgcccgccgacccgtccctgctcaccgccgagcccgaccacgaacgccgtgagcgcacgtcacagatccggttcgtcgtctccctgctggccacggggatcgccgcgatcggggtgggcacgtactgccttcaccacccctggcccctcacctgacgatgcaggtcagagcggcccagaggaggggcgagtgctcgatctggccgtcggtgcgccaccggtcgaactgctgtcgctgccaggcgccgagatggcggacggggtcgtggtcctcgtgggccgcgtccacggcgaccacggcctccgtgagcggccgtacagactccggcagaccggccagccggtggtaggcgaagctggtggggagcacccagcgggtggcggtgaccagttgggcgccgttgtggatcatcgccgtcgccaggccgaaggactcggcgaagcggagatcgccgccgctctcgcaggcgatcagcgcgacgcgcggcggcgcgggccagatctgggcgcccggcaagccgtccgcgcgcagcgggagtgtgcccaggagaaggtccttggcggacaacggacgatgggtccgcacgggttcggccatccccgtggtctgcgggccgcagcacagatgaagggtgacgtcctcgctctgcccgccctcgacgggagcgccgctgacgtgaccgacgtacatcagacggcgggcacccttgcgcagcgcctcgcccagccggtcgcggtcgaggtcggtacggcggaaggcctcggcgggggaggcgacggacggtacgacggtgcccgcgtcgagcctgcgctgtacgagggacagcagcgccgggtccgagccgggctgccccaggaccgagccgagtggggagtcggcgcggaagccgggcacgcggggatcgagcacgagaaccacggtgtccgattccgggtcttcacgggtcggggtggcgcctgcccgtcgtagcgacgccggggccgtggtggcgatgtcgaccagatcgatcagccgtacgtcgctgtcgccaccgtccactgcgagcagctcccacgggacctgcgcgacccggggcgacggctggatccgcatcagcggacggcccagccgcgccgagacctgacggatctggtcggtcaggcccggcggccacagcacctcggccagcatgcgggaaaggcagcgctcttcctcggacgaggccagcgcaccggactcgaacgcgcgtcgcatgccttccgcgccgccgcccgggagttccgcggccagcgcgcggacggcctcgtccacgtccggccccggcgtgtacccggtgccgaagccctgggcaccacgggcccacgtccaggtcatgtgcaggtcaccggcgtcggcgaggcggacctggaccaccgggcggttcgggtcggtcacatcgtcggcggacagaacggcacctcctcctcgctcacgatccgccggtgatagcggaactcggctgcctgcacgtactcctggagcgcggtacggccgcccgcctccgccgacatcacgatcttcggtggcggtgcgacccgcaggccgacggaggcggcggcctcggccgcgatgccgcccagcgtcaggggagcgccgtcatcgggggcgtacgtcttcatggcggcgtccgggcagaccgccgcggccctgtcgacggcgggcgtacggctcagcgccagggaggcacccgcgcaccggtgttccaccagctcgaagatcagcccctggtcattgctgcggagggccaggcggaaaaccaactgcatcgcttggtcggccagttggagccactggctgcgggcgtgggcagtggcgaagtcgtagcgggccgcttccagcgtcagggctgcgggcagggcgagggagagcgcgttcgcgagcgaggcgcgttcgtggaggccgtggtcggtccggttcaggttgtcctcaagggttcgcgcgagcatcaggtccacctgggcgcaccgctcgtacaccccgcgctcctggtacacgtcccgtgcgccctgggcgagccgcttcatctcgtcgatgtcgccccgctcgtacgcgtgccgagcgcccatcagcatggtgtcggcggcggcgaccgcggcaccgacctgctggaagcgagccaggctggacgccgtcagagcggcggcgccgaccgcgtccccgcggtgtgcggcgatggcggcacgggcctgttcgcagaccgccaggtcttcggcctggccctgccgttcgaagatctcggcggcctgcgcatacaactcctccgcacggcccaggtcgccggcctgtagcgccgcgtacgcccggtgggaaagtacctgttggcgccccgcgtggtggcccagcgtcagataggcctgctccgcgcgggcgaagtggtcctcagcctcctcgaaacgcgcggtcgaggcgcagacgactcccaggcagtccagcaggtacggctcggccaggggcgcgtcggccagcagcgcgagggccagttcctcggccgcgccccatgcgctgcggcccatcagcagatgcacccggctcaggccgatctcggcggtgcgcagcccttctgtgtcgtcgaactccgacaacagggccgtcgcctcgtcaatcgcctcctgcgcctcgtcgaactgcccggtcctgcgcagcagttcacccctggccagcagtgtcttcagcagggtctccagccacagccgtcgtccgttcggccccatcggcacggacgcgatgccccgcaccagatcgagggaccgcccgatggacagggctgcgccgggcagatccgtggccgcgagccgaaccgtcccgatgtcggacaacaggtgcccccgcagaagtcgtacgtcgggagagtcctcgaacgtctcggccacagcgaggagttcgccgtagaccgccaacgccgccggtagatccggggtgagttgatgctgttcggcgagcgcgaagccgctgtcgaagggctcgccgtagctgaaccccaccgtctgctcttcctgttccgccgagccttccgcgtcttccgggcttttcaggtcttccgggtcttccggcatgggctagaagtcctcctccacggcagcggcagccgcgatctcggcgaggaacggctcggggtgtgcggcctcgctgtcgtgcggtgccgtcgcggcgccgagccggtgccgggccagggctcgtactgcctcacgtgccgcacggtcatctgcggccggtcccgggtcgaagcccggcaacaggatgccgacttccatgcccggtgtcgtcgaggccgggatgtccaggtccacccggccggtccatacgtcatcccgcctggccagcggcacgcggttcggcgggccgccgtccacgtggacctccgccgcgaggtgcaccccgcccacgggggccgcgatgccggcgacgacctcgacctccatccgccgatcggcaccgagcgcgtacgcggtccaggacacggcgttctcggccgcgtccacgaagccgggcggatagcggcaccagtcgttggtccccggtccccgggcgatcacgcggccgctcgcggtgcgcagagcgcctgctgcgagggtgaactcctgatgccgtaggaagagttcggcgaggtcgagcggcgtggcggtcggactgcggtcctggtccagggctgaccggaggtgccgtagcgcctccccgtccagcccggcgttgtcggccgcgtcgtcggtcagccgcaggacacggtccagccggcgaggggggtccgccgactgccgccagcggatcagcgggtcgagggcggccaggtgctcctccagcagctccagtccct

SEQ ID NO: 3017 - DNA, 7552 bp, Unknown
  Kingdom: Bacteria, Phylum: Actinobacteria, Class: Actinobacteria, Order: Streptomycetales, Family: Streptomycetaceae, Genus: Streptomyces
accgcgccgtagaaggcctgcgccacagggccacagccaggtcagcgaccatcaggttgatccagcggggtgcgccctgcaccggcacgctccgccgcttgtccgacccagacatccgtcgtatccgctcggcgttcggtgtcccagcatcccgtcggccggccatggaaatgccgcgatcgacggatccgatgccggcatccttgccgcgccggcggctctgatgcgcgctgtgagcgggtgggcgcggcgcctcatcatgcaccaggagctatgaacagctctggcagcgttcacgctgaccccctggtccaggcgcaggtgacccattacggccgtcacgtaggcgtgcattgcccctcaggagaaccaggttcacaaggatgggtcgcgggcgatcgggccccaggggccgggctggccagcgacgatgtcgagggcttcggtgatgacgtggtcggccacccaggcgatcggttcgatgtccttcaccaggggttcgttgtccggtccccgcgccgcttcaacgccgcgtagcagccagggccgggtgcgaggatgcttcacccgcgggagatggcagtagtcgtagagtcgtcgggccacccagatgtccaccggccgccgaccccaccagtcctctacatccagcgcactggccgaaagtcctggcaaccgaacgccggtcaggtcgtcggtactggagacctcccgcaggtcccagtccggcccgagggaccagcgtacgtacaagccctcgccctcggtaaccaggtgggccaacttctgcaggctctcgatctccggcatcgacggcatgcttctcaccgatcggcagaatgagtgggcggtacacaagcaacgagacgccggggttgccggtctcggtgcgtaggaactgccgggtggattgtcagcatcggaagtttccttctcgccctcgtgactcgggatctacgccagctggctaccccgggctcttcctcctatgcgcttggcggctggccgggtgccgcagcgaacgccgcaacaggcgtcatagaggtaggtcggtgaccgccgcacatcagctcgccggccaggtcgtcaggtgctgtcccggtcgttggacaggggggaggcgacgccttcgcccggttcgacgacgtcgcgcctgccttcgttggcgcgccggtcgagggtggccacggcagggtggtggagatcgaacgccggggattcggaccggatcttgggcagagtgacgaagttgtgccggggtggggggcaggaggtggcccactcgagggatcggccgtatccccaggggtcgtcgacggtgatgcgctctccgtatttcgctgtcttccacacgttgtagaggaaagggagtgtggaaagtcccagcacgaaggcaccgatggaggagagggtgttgagcgcggtgaagccgtccgcgtccagatagtcggcgtagcggcgtggcattccttccgcacccaaccagtgctggatcaggaaggtcatgtggaatccgacgaagagcgtccagaaatggatcttcccgaggcgctcgtcgagcatggtgccggtcatcttgggccaccagaagtggaatccggcgaacatggcgaagacgatggtgccgaacaggacgtagtggaaatgagccaccacgaaataactgtcatgtacgtgaaaatcgagcgggggtgacgcgaggatgactccggtgaggccgccgaagaggaaggtgacgaggaatccgaaggcccagagcatgggcgtctcgaacgagagcgagcccttccacatggtgccgatccagttgaagaacttcactccggtcggcacggcgatgaggaagctcatgaaggagaagaagggcaggagcaccgcgccggtggcgaacatgtggtgggcccagaccgtgacggaaaggccggtgatggcgatggtcgcaccgatgagtccgatgtacccgaagaggggcttgcgggagaacacggggaggatctcggtcacgacgccgaagaacggcagcgcaagaatgtagacctcggggtggccgaagaaccagaagaggtgctgccagagaatggccccgccgttctccggattgaacacttgcgctccgaaacggcggtccgcctcgagaaccagaagggctgctgccaggacgggaaaagccagcaggacgagtaccgaagtcagcaggacgttccaggtgaaaatcggcatgcggaacatcgtcatgccgggcgccctcatgcagatgatcgtggtaatgaagttgaccgcgcccagaattgtgccgaatccggacagggccagtcccatggtccacatgtccgccccgacgtagggggtgcgttcgccgctgctcaggggggtgtaggcggtccagccgaagtcggcggtgccattggtcgtcaggaggccgcccacgacgatgaggccgccgaagaggaagagccagtaggagaacatgttgagtcgcgggaacgcgacgtccggcgcgccgatctggagcggcatgatcgcgttggcgaacccggcgaacgtaggtgtggcgaacaggagcagcatcacggtgccgtgcatggtgaatgactggttgtactgctcgttggagatgagctggattcccgggcgcgccagttcggcacgcatgagaagggcgagcagaccgccgaagagaaagaacgaaaacgaagtgatcagatagaggtggccgatcttcttatgatcggtggtcgtcagccagctcaccaccactctccccggccctctgccggcaacgggcacgggagtgacgggctcggtcgacgtggccatggatgaacctcgaatttcgatcgggggacaacgaatcgctgggtgcccccaagaccgcctttcaaacgcgcacttcaccctgatgggcgcgctcgtatggcgagtcgccgagtacggtacagtttcagccgtagaagcgcgctttctggtcggtaagcgactggcgtcttgagaaagtagtagtggccggacggaatgtgcctccctcttctggacatgaccggcaggcccatgggctgctgaaatggaagagcggcgcggcttcctggtttcaagggcacgctgccgggatactcggccagccctgccctctgccttcgaaggaggcgcaggctcgaggcacatgagcagcacagtggatgtgtcgactacgcagtagacgcgcagccaggactgaatcaggccgccctctgagcctgccccggagtggtgtggccgcggcgacctcccgccgctgtggagaggccgcggcgcggagaagccgttgaggacgggaagaccggagcggatagccgcggggctgtggacgcgcaccgtgttcatctctcggagttcgggttcgcctggacgcggttccgcaccgcactacggaacgaagagaaggagtagttggctgtgacagatgtagcgagcaccgggccggccgcggacgacgaccggccggaactcacgaaccggcagggccatgcggtcttcgacaatcagaaccagcgcaccgtcggggcccgtggcccggcgactctggagaactaccagttcctggagaagatcagtcacttcgaccgggagcgcattcccgagcgtgtggtgcatgcgcggggtgtgacgacgtatggctacttcgaggcctacgggaagtggggcgaggagcccgtctcccgctacacccgggccaagctgttccaggaggcaggtaagcggacggaggtcgcggtccgtttctccacggtgatcggtggccgtgactcctccgaggcggcgcgcgacccccggggtttcgccgtcaagttctacaccgaggacggcaactgggatctcgtgggcaacaacctcggtgtgttcttcatccgggacgcgatcaagttccccgacgtcatccacgctctcaagcccgacccggtctcgcacgagcagaaggctgggcgcatcttcgacttcatgtcgcagactccggagagcatgcacatgctcgtgaacctgttcagcccccggggcattccgtccgactaccgccacatgcagggcttcggcgtcaacacgtacaaatgggtcaacgctgaaggcgagtcggtgctggtcaagtaccactggctgccgaagcagggcgtccgcagtatgaccgccgaggacgcggcgaacgtacaggctcatgagctggggcacgccacgaaggacctctacgacgcgatccggcggggggaacaccccgagtgggaactggtcgtgcagatgatgtccgacgacgaccatcccgagctggacttcgacccgctcgacgacacgaagacctggcccgagcaggatttcccaccgcaggcggtgggccggatggtgctcaaccgggtgccggacaattacttcgcggagaacgagcaggtgtccttcggcaccggcgtactggtcgacgggctggacttctccgacgacaagatgctggtcgggcggaccttctcctacagcgacacccagcgctaccgcgtgggcccgaactacctgcaacttcccgtcaaccaggcgaagaacgcccacgtggccaccaaccagcgcgacgggacgatggcgtacgacaacggtcaccacggtgagaaccccgaggtgaactacgagccgtcgatcaccggggggctgcgtgaggcccagtacccgacgcatgacgagcagggcccggagatccgcggccgcctcacccgcaagcgcatcccccggaccaacgactacctgcaggccggccagcgctacctcctcatggaggcttgggagcgggaggacctggtgacgaacctcgtcggcatgctctccgactgcgaccgggccgtgcaggagaggatggtctggcacttcctcctcgttgagaacgatctcggccgccgggtcggcgacgggctgggcatcaccccgcaggacgtcaaggcactgcggtccctcgcgagccaggacctgtcggacgacgaccgaaagcgtcttgcccggctgggcgagaaccccccgcgcgacgtcgaaggactcaccatgacgcactgcgttcccgacgagcggtacgtcgtcgcccgctgaacgagcgcgtgggacgagagcgccggcggaccaggcggcgggggcgtctccggtgacgccggcgggcatgcgctgcggaccgggcctggcgcgagtggcagtgtgaaggggtccgctcgggtgctgacgcgcacgaaacgggccccttcccaggccgtttgaaaggcgctatgtggagcggctgttgcatgacgatgcgctcgtgttcgacgaacggcacggccgacgacgactccgccgtcgtcctggttgaggggcgcgcccaggtggctggacgagccgccctcggcggtgacgacctccgcgacgcgacagtggtgctgacccgtgcgcagctcgtggaccggcggggtcctgcgtaccccgccccgcaggacctgactctggtggcgacgtcgttggacgacgccgtcggcaagctcggcggctgacgtgcccggtcccgtggcggccgaccgacgtccgctacgggtgcggggcgcggagtacgggctaccccaggggcctaccgaaggatgtcgcaggagaggaagcgggatcatgtcatcgacggacacgccggtgcaggtccagttcgtcggcaacgaccctgttgccgcggtacgggcgccaagtcgcgacgctcacgcccgatgacccaggtccacgcgcgctgaccagtccgtcccctggggtcgtgcccggtcccttccgatgcgtagtggacgagcaccgacccgctacctcagccgtctcggcgcgcaggagtcgtaccaccgccagcacagcccggacggaatgctcggccatcgacgggtagagctccagctgctcctgcggccaccgctgcttgggtgaacaccggaacctgcgagcacgaccacccggtcggaagccgtgcagggggcggttggtatgaacgaatcgctcgctgagcgatcatgcgaggcgtccgaatgaatgcccgattgtcctacgaattgccctgttgaggtcgggggcgcagcatgtaaatcacctcggcgggaggggtccggcccggccgctcgtgggcctcgacgacggaggacgtgcatggcatcgtatttcgagaacggtgaggacactctggtgccgggcgcactgcggggtttcgcccgcgcccacgcggatctgctcacgctcgacgccgcgcacgggttcctccgtgcccgcgatacggcacctacacggagggtcggcctcctctcgggtggaggatcagggcacgaacccctgcacgccggatacgtcggacgaggcatgctggacgtcgcctgcccggggcttgtcttcgcctcacctcacaaccggcaggtgtacgagggatccctcgccgccgcccggccccagggcgtcctgcacattgtcaagaactacaccggcgaccggatcaacttcggcatcgccgccgaacggctcgcccaccgcgatgtcccctgtgcccgggtgctggtcgacgacgacctcgccaccgactccgaggacatcgccgcaggccgccggggcacgggaggcaccgtcctgatcgagaagatactcggggcggcggccgacaccggcctcggcctcgaggaactccaggaactcggcacccgcctcgccgcgcgctgtcgcactctggccgtcgcctcggccgctcacacggcgcccacgaccggcaggcccgccttccccctcgattcggacgagctggagtacggcgtcggcatccacggcgagcgcgccccgaagaccatccctcgcgggcccctcggccctctcgtcgagcgcatggccctggcgctcctggaagcactctccccggcccgggattcctccgtcatcgccctggtcaacggcctcggggccgtcaccccactggagctgtacgcagtccacgccgagctcggggacctgctcgacgaccagggcatcgaacttgcccgttccctcgtcggcgagtacatcacttctctggacatgcgcggtttctccatcaccctgctcgtcaccgacccccagatcctgcgcctgtacgacgcgcccgtgcggaccgccgccctgcactggtgaggcggcggcaggcactcggccgtgcccaaagagttcccccgagtacgggaggcacctatgacgaccagcacctcccccgatgcgttctccaccgacgcctggatgcgcaggttcgtgcagtccgtccaagccgcgaaagaccgcctcaccgcgttggaccaggaggtgggcgacggtgacttcggcatcaacctcagcaccggagcccactccaccctccgacatctcgacgcgaaccccgcctcccgcagcgaacccgccgcccccttccacgccgcggccaccgccttcctggacgaggtgggtggcaccagcggtccgctgttcggcctcttgttccagtcactcgccgtcgccatggccggcgccgaggccgccagcacgccggctctcgcagccggagctaccg

SEQ ID NO: 3018 - DNA, 4879 bp, Unknown
  Kingdom: Bacteria, Phylum: Actinobacteria, Class: Actinobacteria, Order: Streptomycetales, Family: Streptomycetaceae, Genus: Streptomyces
gccgacgcgctggcggcgctgctgcgccgccggctcgccgtggaggcctgaggggccctgtggcccgctgaggggcgttccgcacgcctgggcactcctggcccgggctcagacgtggggacgcagccgggcggcctggagcgtctgcgggctgtccggcgccccctcgtggagggcgctgcccttctgccacttctcccaggagaggttccagtcgccgaacccgttgccgaacgggtccatgtcctcgccctcgctgccgacgaccctgacgatgtcgccctcgcgcaccgtgtcgaagaaccattcggcgttgccggtgctcatgccggtgcagccgtggctgacgttggcgttgccctgggagccggttgaccagggggcggcgtggacgtactcaccgctccaggtcacccgggtggcccagtagaccggcaggtcgtacgactccgaggagccggcggcgatgccgatgctctccccgcgcatgcggacgaactgctccttggcgagcaccaccttgaccccgttgcgggtggagaagccgggcttgccggtggtgaccggaatggtattgatcacttctccgttgcggagcaccgtcatggagtggtccgaggcgtcggtgacggcctcgatccggtcgccggtggcgagcttcaggggcttggcctcggctccgtagagcgcgttggtcaccttgatgcccgccaggttggagcggacctcgatggaggcgttcgcgggccagtactccttcgggcggtagtgcagcttcttgtcgtcgacccagtaccaggagccggtgaccgccggggtggagcggaccttcagggcacgctcgacggtggccctggccgccttgtcggtgatcggagcgctgagttccgccgtgatgggctgtccgacgccgtaggtgcccgcctccgggccgaaggcgaccttcagcaacttcttgggcgaagaggtgccgaaggagagcgtacggacgcctggggcgccgtcgctgttctccgtggcgaccctgacggtgtatccggtgccggccgcgagcggggcggtggagcgccagcgcttcccgtcggcggagagctctcccgcgaggtgacgcccgccggtgtccacggcgctgacgtcggtgatgcgcccgtcgtcacccttgacggtgacttccaggggcttgtcggggtcggccttctccttcttggaggggccgttgaaggagacctggtcgcccgcgtcgtaaggcttcgtggagagcgggtggccgtcgggtgagccacaggcggtcgcacccgcggcgagggtcacgaccagcagggtgcagctcactacggtgcggatgcgcggcgtgtggttcatgccgtccacgctaagaagattcatccgttccagcgcgttcagtgactgcaaacgagcgaaaggcccgcgtcgctgtcggcgatgcgggcccttcgtggtgtagcgcgtgtcaccggcggtgcggtgtcacggggtgcggtgtcactgggtgcggttctcgccccggtagtactcgaagacccagccgaagaggccgatcaggagcaggggggcggagaagtagagcagccaccagccgaagacgacgcccatgaaggcgaaggctccgccgaccgccagggagagcggctgccagctgtgcggggagaagaaccccagctcgcccgcctcgtcggcgacgtccgcttccttgttgtcctgggccatggcgtcgacccggttggccgtgaaggccaggtagaagccgatcatgatggacagcccgaaggccaggaagagggccgtggtgccgaccggctccttcgaccacacgccgtacacgacggccatggcgaggatgaagacgctcagccagatgaacatctgtccctggatcttcacttgcctgcctccttgccgccggcgagggccttgtccgactcggagaggtgatcgagctgttcgagcgccgtgatctccgggtggtgcaggtcgaacgccggggattcggaacggatccgcggcagcgtgaggaagttgtgccgcggcggcgggcaggaggtcgcccactccagcgaacggccgtaaccccacgggtcgtcgacctcgatcttcttgccgtacttcgcggtcttccagacgttgtagaagaacgggagcatcgacaggccgagcaggaacgaggagatcgtcgagatcgtgttcagcgcggtgaagccgtcggcgtcgagatagtccgcgtaacgacgcggcatgccctcggcaccgagccagtgctgcaccaggaacgtgccgtggaagcccacgaacagcgtccagaacgtgatcttgccgagccgctcgtccagcatcttgccggtgaacttcggccaccagaagtggaatccggagaacatcgcgaagaccacggtgccgaagatgacgtagtggaagtgcgcgacgacgaagtacgagtccgagacgtggaagtccatcgggggcgaggcgaggatgacgccggtcagaccaccgaaggtgaaggtgatcaggaagccgacggcccagagcatcggtgtctcgaaggacaacgatcccttccacatcgtgccgatccagttgaagaacttcacgcctgtcggcacggcgatgaggaacgtcatgaaggagaagaacggcaacagcacaccgcccgtgacgtacatgtggtgcgcccacaccgtcacggaaagaccggcgatggcgatcgtcgcggagatcagaccgatgtagccgaacatcggcttgcggctgaataccgggatgacctcggaaatgattccgaagaatggcaaagcgatgatgtacacctctggatggccgaagaaccagaagaggtgttgccagagcaatgcgccgccgttggccgcgtcgaagatatgcgcaccgaattttcggtccgcctccagcgcgaagagcgcggcggcgaggaccgggaaggccagcaggaccagaacaccggtcagcaggacgttccaggtgaagatcggcatgcggaacatcgtcatgccgggtgcgcgcatgcagatgatcgtggtgatgaagttgaccgagccgaggatcgtgccgaagccggagaaggccagacccatgatccacatgtcggcgccgacgcccggcgaacggaccgcgtccgacagcggggagtaggcgaaccagccgaagtcggccgcaccctgcggggtgaggaagccggccaccgcgatgagcgagccgaagaggtacagccagtacgcgaacatgttcagccgcgggaacgccacatcgggcgcgccgatctgcagcggcatgatccagttcgcgaatccggcgaacagcggcgtcgcgaacatcagcagcatgatcgtgccgtgcatcgtgaacgcctggttgaactgctcgttcgacatgatctgcgtgcccggacgggccagctcggcgcgcatgaagagcgccatgagtccgccgatgcagaagaacacgaacgaggtgaccaggtagagcgtaccgatcgtcttgtggtcagtggtggtcagccacttcacgacgatgtttcccggctgcttgcgccgcacgggcagctcgtcctcgtacgagtcgtctgccggagcggcaccctgaggttcgttgaggatgctcacagttggttcttctccgcattcctggccgggtccgtctgcgcgatgcctgccggcatgtagcccgtctgacccttctcagccagctccttgaggtgctgctggtaacgctccggggagacgaccttcacgttgaagagcatccgggagtggtcgacgccgcagagttcggcgcacttgcccatgaaggtgccctcgcggttgggggtcacctcgaacacgttggtgtggcccggaatgacgtcctgcttcatgaggaacggcaccacccagaaggagtggatgacgtcacgcgaagtgaggacgaagcggaccttctcccccttcggcagccacagggtcggacccgggttgccgttctgcgggttgcgggtcccggggatgcccacgtcgtagacgccgccggcgccctcggggaagtccttctggaacttgtcggggatggcgtcgagttccttggggatctcggggcccgccgcaggctggccatccaccttctcgatgtagttgaagccccagctccactggaagccgaccacgttgatggtgtgggcgggcttgtcggagagctcgaggagcttcgactcatcacgtgcggtgaagtagaagagcaccgagacgatgatgaggggaaccactgtgtacaacgcctcgatgggcatgttgtacctggtctgcggaggtacctccaccttggtccggctacgccggtggaagaagacgctccagaggatcagcccccagacaaggacacccgtgacgagcgctgccgcccacgagccttgccagagggagaggatccgaggggcctcttccgtaaccggagtgggcattccgaggcgggggaaatcctcccagttgtatgaacaaccggaggccgtcgccaggaccaggcccgcagtcagcacctgcggcagcttccgccgcatcgggcgccgcgacgagcggtcggagccgttgggactcacgtagcgccttcccgagagtctcgcccgcacggtcggcgcgcccgtatgtgtctggtcggtcgccggccctgacgcgggcaggggtttggatgtttatgcggaccaaaccctactggacgctatttggggtcgcgcggggagggtgcccaacgcgccgcccgacacgcccatggggtggaatccgggcctccggaccccgtctgacgcccactcgcccggccgggaggagcggcccccggcgtggtcgggccgggtgcgggctagcgtggcggggtgccc

SEQ ID NO: 3019 - DNA, 1945 bp, Unknown
  Kingdom: Bacteria, Phylum: Actinobacteria, Class: Actinobacteria, Order: Streptomycetales, Family: Streptomycetaceae, Genus: Streptomyces
tccgtccggggccccggacgttccgctcggttccgccggggcccgtcgttcgccgttcgtggtatgccatccgtgacgcgtcggtccgtcgaccgggggccgtgcccgctcacgcctgtcggaacgtgtggcgcatggtgccgagtccatcgatcccgcactcgaccacatcgccgtcgcgcaggtacggccggggctcgggacggccgagggcgacgccggccggggtgccggtgttgatgacgtcgccggggtgaagcaccatgaagtggctcaggtagcggatgatcccggcgaccgggaactccatgtctccggtcgaaccgtgttgcagctcggtgccgttcaccgacagccggagcgtgagtttctgcgggtcggggatctcgtcaggggtgacgagccaggggccgagcgggttgaacgtctcgcagctcttgcccttgtcccactgtccgccgcgctccagttggaacgcgcgctcggagacgtcgtgggagaccgcgtacccggcgacgcacgcgagcgcgtcctcgtcgccgtcgaggtagcgggcggtcctgccgatcaccacggccagctcgacctcgtagtcggtcttgacactgccgcgggggacgaggactccgtcgtacggccccgtgaccgtccaggggtccttcatgaagacgaccggctcggccgggaggtccgctcccgtctcctccgcgtggtcccggtagttgagaccgatgcacacgatcttccccggccgcgccaccggcgccccgatgcggaggccgtccgtcctctcggccaggacgggcagggtcccggctgccgcggcctcggcgatacggtcgagcacgccgtcggcgagagtccggtggtccaggtcgccggcgatgccggacgcgtcgaggagtctgcccgatccgtccaggaccgcgggacgttccgccccggcctcaccgactctcagtacgcgcatggttcccgcctcacgatatacatcggatgtatcgacgcgggcatgcaatcaatcatcgagcatcttgtccaggggcaccgcaatcaactgcggcgagaaggcgcgtacttcactatcgcctgcagttgtcatccgatgtatggtctggcgcaccgaccggccgtgaccacaccaatcccagggggcccgaaccgatgacggacacgaggagagggcctaccgcccttctggtcatggaggaggagcgccgtgccgacgtgtacccggcacacgtcctcgacgagatagggcaactggcgcactggcaggggcccccgctcacccgtgacgccctgcgccgcgatcccggcgcgttggagggggcggaggtcctgctcaccggctggggcgcaccggtcctcgacgcggacctcctcgcgcacgcgccggagctgagagcggtgctcgtggcggccggatcggtacggcacctgacgacgccggagttctgggcccgcggcatcccgatcgtgtccgcggccgcggccaacgcccggccggtcgccgaattcaccctcggccagatcctgctcggcctgaagcaggtgcaccggctcggccgtgaggctgccgccgcccgccggtatccgcgcgatccccgggtggccggggcgtacggctcccgagtggggctgttcggcctgggccagatcggccggctggtcgcggagcacctgcggcgcttcgacgtcgaggtgctggcctgcgacccggtggtggaaccggccgtcgcacgggggtggggcgtccggctgaccggcatcgaggagctgttcgcgtcgtgcgacgtggtgagcgtccacgcccccctgctaccggagaccgaaggcgtcgtggacgggcctctcgtgtcactgctccccgagggcgccacgctggtgaacacggcgcgcggtgccgtgctgaacgagccggcggtgatcggcgtcctccgcg

SEQ ID NO: 3020 - DNA, 3999 bp, Unknown
  Kingdom: Bacteria, Phylum: Actinobacteria, Class: Actinobacteria, Order: Streptomycetales, Family: Streptomycetaceae, Genus: Streptomyces
gcgcggccgccagattgaatctggcggccgcgcacgcggtcggagaaaccccgaacggggccccgccccgggaaccgcacgtcgggccccgaacgtcggacggacttcaggtctcccgtgtgtagaagacgtagaacgagacgcagaagacgccggccccgaccaccagacccagaacggtcgacctcagcacgctggtgtcggtgaggctcaccaggaagccgatggcgcatgcggtcagcgcgccgtacacggctgcccgcagctcgcgcggcagcgagcgctggatccggcccaccccgaagcagaggaccgccagagcgacaccggagacgagcccgagcaggacctgcccgccggtgctgggaccgccgtcgcgacggatgaacgccgcgtagaacccgtagaccacgccgagcaccagaggcagtgcccaggcgagcggggtgtggtggcggtgccgcgcatgcgcgcgggaaccacttcggccgggcatggctgcatgtgtggccatcgcggacagctccttccgtcgcccccgtcgcacgcccccgttcctccagagcacacccgaccgcgccgcccggcaactcgaatggcgtacggcccggagcggcccggctccgtacgggattccctggaggagtgcggacctctccctcggcgatctcggcgacctcggcggccctctcggcggtcctgctcgttctgctcgccgtcctcgtgccgttgagcgcgctctccgcctgggtcgacctggagatcgacgacaccgaccggtacgtcgccgccgtgtcgccgctcgcctccgatccggcggtgcagaccaccgtcgcggacctggtcaccggagaggccatgcgacagatcgatctcggtccgctccaggacacggtccgggagttcttgcacgagaccgtgcggtcgttcaccaccaccacggccttccggaacgcctgggacaccgcgaaccgggccgcccacgaagccgtggccgccgctctggacggcgacagcggggaggccgtgacgatcgatctggccccggtgatcgaccaggtcaaactggacctggtccgcgacggagtgccgttcgcggaccagatcccggtcgagcgaacggagatcaccgtgctcggccccggccaggccgacgacctcaggaactcgttccgcctgctccgctactgcagcatctggccggccgtcgccacgctcgtgttcctcgtgctggtggtgggcatcgcgaccgtacggcgcgggatgcggtccgggctgtgggccaccgcgaccgtgggtgccgggttcgtgctcggtgcgatcgtgctccgggtcctggtcgcggtcggccgcagccgggtgttggacgaggtgccggacagcgaccgggacgcggccgcagcggtggtcgacgccctgaccgcctcgctgcgaaccacggtgtgggtggtgctggcagtcggtgcggccgtgctcgtgggagcggtggtggcgcgggtgctcctgcggagcgggcggcccgcggccgacgtgcgatgaggaggcgaccgggtgagagtgggatccgtgaccgccaccgagcgacccgagagaggcgtcatggccgaccgcgacatcttcgagaacatcgacgacctggtctccgaggagcgcgagctgcgcgaccgctccgtggcgaagatgggcctgtccacggacgacaaggcccggctgcgggcggtggaggtccagctcgaccagtgctgggacctgctgcgtcggcgacgggcgctcagcgagtacggcgaggaccccacaacggcgaaggtccgccccgccgacgaggtggaggggtatcagagctgaccgggccctccgcaacgtgcgcttagcgcgtccggcccggtgtttcacgtgaaacaccgggcggcggcctcagctctccggcgggcgcccctgaagacgttccatctcccggcggtcgcgcttggtcggacgtcccgttccccggtcccgtacgggcacctggatcgcgatctcgcggggcggcggaggcggactgttgtcgacgaagcactccgcggccaccggcggaccgacccgcttcttcacgaccttcgagacgacgaccacccggtcccgccccgcatgccggaggcgcacctcgtcaccggcgcgcacggcctgcgcgggcttgacccgctcgccgccgactttcacatgtcctgcccggcaggcggctgccgcctgggcacgggtcttcgtcagccggaccgaccagatccacacgtcgacccggacgcttccttccgcctgcggcgcctcaccggaaaccatgggtccgactgtaatgcggaccgggcggcgggcgggagcaataaggcctcccgcccaccggacctcacacgccgatgtcgcgcccgtccttgcgccagacggcgacgaccgagggacggacgatcctgccgggaccgtcgggccagacgctccccgggttctccacggaggccccgtcgatctcacccgggtgctggaccgcgaccaggacccggcggtcctggatgaccgggccgcaggtctcggccccggccgggacggtgaggaactgcttcagttcaccgcgccggtcaccctgcgtcgccacgccgaacagcccgtcgtgcgagtcgagcttgttgccgtccgtggagatccacaggttgccgtggtcgtcgaacgccacgttgtccgggcaggagatggggctgacgttctccttggggaaaccggcgaagtacgtcgacgggtcgtccgggtcgcccgcaacgaggaacagccgccaggcgaaaccgtcactcgccgggtcgtcccagttctccgcgagctccaggatctgcccgtgcttgttgttgttgcgcgggttggcctcgtccgcaccggccttgcccgccttgccgcggtccgtgttgttggtgagcgccacgtacacccggccggtgcgcggcgagggctcgacgtcctcgggacggtccatcttggtcgcgccgaccttgtcaccggcgagccgcgtgtagacgtacacctcgtcggcggtcatgccgggcacatgggacgtggtgccggtggccagcgggatccagacgccgctgccgtcgaactccccgtccacggggagctttccggtgccgtcgatctcggtgaccggcgagtcgccggtcagcttggcgacgtacagggtgccctcgtccagcagcgtcaggttgtgctcgcgggcggcccgcgagttgcccttcttcatccgcttgctggagacgaacttgtagaggtagtcgaacttctcgtcgtcgcccatgtagacgaccggacggccgtcggaggtgagccgcggctgtgcggcctcgtgcttgaaccggcccagcgcggtccgcttgcgcggggtggagtccgggtcgtacgggtcgagttcgacgacccagccgaagcggttggcctcgttgggctccttcgccaggtcgaaccgccggtcgaaccgctcccacttgcgctcggtggcgctcgtgccgatcccgtaccgcttgtgcatgtcggtgttgccgttggcgaagtattggttgaagttctcctcgccgtgcagcgtggtgccccacggagtggtgccgcccgcacagttgttgagggtgccgagcaccttgcggccggttccgtcggcggaggtacgcagcagggcgctccccgcggccgggcccgtcatgcggaactcgctggtcgcggtcagacggcggttcagcgggtgccggttgaccggccccagcttgccggtgcggtgctcctcctggacgacgaccacggagagtccgtgcgccgcccaggcgatctccacctgctcacgggtcgggttggccggatcgtagccgcggaacatgaggatctcgtccgagtactcatggttcgcgaccaggacctgccggccgcgctcgccgcgcagcgggagcagagagaggaagtcgttgttgtagccgaactggccggcctgcgccttcg

SEQ ID NO: 3021 - DNA, 2708 bp, Unknown
  Kingdom: Bacteria, Phylum: Actinobacteria, Class: Actinobacteria, Order: Streptomycetales, Family: Streptomycetaceae, Genus: Streptomyces
ccgggcgtaggcgacctgggccccgtcggcgtcgtagacaccgaagttgagcgacccgcgcatggaccgttcgacgaggtcgcggctgcggccgagtgcccagaaggcgtcggtggagagccagtggtgcaccagggtgatgtcgaggcgtccgggatcggtgtcgatctcgtacccgtcgatgccctggttcccgttcccgtcttcgctgcgcgtggtggacgtcatgggctgggatcgtatcgccgcgctgaacgggctacgccgccgcgcacccgccgtacgcggacccccggcgagggcacccgcctgcatcagccggggcgactactgaggtcaggactgactcgcccgccgccccgcggatcctcgtgatccgcgccggcggacagggccgcccggcagaccaggccgtgaggtgcgaagggtgtcaggatgtctgtatggacgtgcgcgagagaaaccgggtgcgggtggcgggccgggagaacggcccggtggtgatgctcgcccacgggttcggctgcgatcagaatctctggcgtctcgtcgcgcccgcgctggaggagcacttccgggtggtcctgttcgatcatgtgggggcggggcgttccgatgcgtcggcctggagctccgagcggtactccaccctggacggctacgcgcaggacgtcatcgagatctgcgaggagctcggtctcgggcccgtgaccttcgtcgggcattcggtcagttccatgatcggtgtgctcgccgccgtacagcagcccgcactcttcgagaaactggtcctgctcaccccctcgccgtcgtacaccgacgacggcgactaccggggcggattcagcgagcaggacatcgacgaactgctcgaatcactggacagcaactatctgggctggtcggcgaccatggctccggtcatcatgggaaacccggagcgtcccgaactgggggaggagctgaccaacagcttctgccgaacggatcccgagatcgcccgggtcttcgcgagagccaccttcctttccgacaaccgggcggatctccccaaggtgaccgttccgacgctcatcgccgagagcgcgcgcgacacgatcgcaccgcgtgaggtgggcgctttcgtccacgcgcagatccccggcagcgagctggtcaccctggactcgacgggccactgcccccagctgagcgcccccgaggagaccgccgaggcgatcatcgccttcgtgcaagggccgtgaccgtgccaccgggtggtgacaggaccgacggatcgcggccggcggaggaccgcgaccagggcgccccggtgtcctccgcgctgctggaggaaaacgcggaggatctgtacgagaacgcgccgtgcggctacctctccacactgatggacggacggatcgccaaggtcaacggaacgctcctgaaatggctcggccaccggcgcgaggacttggtgggccacagatacttctccgacctgctgaccatcggcggcaggctgtaccacgagacgcacttcgcaccgctgctgaagatgcagggcgaggtcaacggtgtcgccctggaactcaaggcggcggacggcacccggctgcccgtcctggtcacctccaccgtcaagcaggacgaagacggcgaaccactgctgatccgcaccaccctcctcgacgcccgggacaggcgtacctacgagcgtgaactcctgcgggcccgacaggaggccgagcgtgaccgcgaacgcctgcaacgcctcgccaccacccttcagcgcaccctgatcccgccggtcatcgaaccggttccgggcatggaaaccgccgcgcactaccacttcgcatccaccgacgaggtgggcggggacttctacgatctgttccccctcgcagccggaacctgggggttcttcatgggggacgtgcgcggcaagggtgccgacgcggccgtggtgacgtcgttggcgcgctacaccctgcgagccgcggcagtctccgatcccgtaccggtcaaggttcttgccaacctcaacaccgccctcaaccaccaggtccaggaggacgagcccttcttctgcaccgtgatcttcggcctgctcactcccgaggagaacgacgtcggattccatgtcgccctggccggcggcggccaccctcccgccgtgctgctccgggccgacggcaacgccgactacctgcacactccgggcggccagttggtcggggtcgtaccggacgcccagttcaccaccgccaccctggacctgcgtcccggtgacaccctgctgctctacaccgacggcctgaccgaggcccgcaccgggaaccagggcgaacgctacggcgacgaagcgctcctggacttcgcgcggaccctcgcccccaccacggcgcccggtgccgtcagggcgctcaccgccttgctggactcgttcggcgagggactcgacgacgacaccgcgctcctggcgatgagcgtgcccccgggtgaacggtgagggtcggagcggacggtccgaggcacgctcctcggctccctctcccgggtcaggcggcggcccgtacgtcctcggtgcggtgctcgtggtattcgcggcagtcgcggcagtggccgggggtgggggagcggaaggcgcggtcgcaggcgtcgcaggtctggaagggcgtgacggtgatgcgggggcggcgggcgagtgcggcgagttcctgggt

SEQ ID NO: 3022 - DNA, 1272 bp, Unknown
  Kingdom: Bacteria, Phylum: Actinobacteria, Class: Actinobacteria, Order: Streptomycetales, Family: Streptomycetaceae, Genus: Streptomyces
cctcggcggccggcgggaccgccggccgccgaggcgcggacgaccgccgccctggagcgcgtcaccggcttcggggccaaccccggcaacctgaacatgtacgtgcaccggcccccggccctgccggcgaacgcacccgtggtcgtcgccctgcacggctgcacccagagcgcgcaggtgtactccgacaactccgggctcgacaccttcgccgaccgccacgggttcctcgtcgtctacgccgagaccaccaccgccaacaacgccaacaagtgcttcaactggttccagccgggcgacacccggcgcggccagggcgaggccgcgtcgatccggcagatggtcgcgcacgccgcgaccgcctacggaaccgacgtcggccaggtccatgtcacggggctctcggcgggtggggcgatgacatcggtgctgctcgccgcctacccggaggtgttcgccgcgggcgcggtcgtcgccggaatcccgtacggctgcggagtcgacgtcgtctcggcgttcggctgcatgagccccggggcagaccgcaccccggcggcgtgggcgcaggcggtccgggacgcgcaccccggtttcacgggcccctggcccagggtggcgatctggcacggggacaacgacccgaccgtcgtgccgaggaacgccgatgagctgcgcgaccagtggaccgcggtgcacggtctcggccagtccccggaccggacctccaccatcggccccaacagcacccgcaggagcgagtacctgtcggccgggggcgggagcgtcgtcgaggtcaaccgggtgccggggatcgctcacggcactccggtcgatccgggagccggcggcgagcagtgcggcgccaccggcacccagcacttcatcgactcgatctgctccagctactggatcacccgcttcttcggcctggacggcggcaccactcccgagccgcccgtggacccgcccaccgaacccgccgcctgctggacggcgagcaactacgagcacgtacgcgccgcacgggccaccaccaccggcggatacgtgtacgcgaagggatccggccagcacctggggctctacaacaccttcgtgacccacaccctcaaggagtctccggcgggccactacgtcctcgccgacggcacctgcccctgacaccgctcacccgacggaggcacagccatgccagtcgccccatcgaccgtccggcgcaccggatcaccccacgacgctccgcggggaccggcccgcggagcgtcgtggggt

SEQ ID NO: 3023 - DNA, 15976 bp, Unknown
  Kingdom: Bacteria, Phylum: Actinobacteria, Class: Actinobacteria, Order: Streptomycetales, Family: Streptomycetaceae, Genus: Streptomyces
ggacgggcggcgcgggaaggagggggccgccggaggccccgccgggtgctcccctcccctgccgtcgctctcgcgtccgggcctacggcgggtcagggaggctcgatcgggtcctccccttcggttcgcgtcgtatcagggggtcacgtcgggtcgaagtccagccaggtgccggcgaggccctgctgacccgctccgggtacggaccagtcgcagactccggtgccgaagatcgactgaagttccgcgaactgaccgtcggacaccggcacttggtagtcggttcgggtcacgggacgcttgcggcacttcacgatgtcgttggcgacatcggctccggcgaccatccgcggcgaggtccacaccgggtagagcgtgttgcactcggtgttgttgatgccctcgacctggggctccgagatcttcttcgcaccgatgccacgggtccagcaggcgtccgtgaggcccggcggccgatgccggacgatcttctcgatgggtgcgtcgccgccggggtcgcccttgatgccggtgagccactggtccatgtcggacagcatcccggcgagggtgaatccgtgcccgctggagcgggtgagcatgacctggttggcgtgcgtcccgttggccttgtccaagcgggcccgggtggagaaggagtggaagcgcatgtgcatgtcgccggcggccgcgtcgtccgtgtagtcgcggtagtcgatgatgggaacgtcggcgaggccgccaccgccgttcagcatgcggcccgtgcggtaggcgagccgcaccgccttgagatcggcgacggtccgctccgcggcgggcttggcatcgtcgtcgaggccgccgatacgccggttcaggtcgatgaaccggtccatgtcgatgatgcccttgttcagggcctcaagtccgtactggataccggtgttgtcgagcggcctgcgtgccttcccggtctccggcacctcgccgtagacgttcacggcgtggctgtagacgtcgcagcgggcgccgtccgggttggtggcggggtggtagcgctgcccctggggcagttgcgccggacagtacaccgtggggtcgatccggccactggccctggccaggctgccgatgctctcccacctgccgaagccggagaccgccctctgctgttccatcgtgaacgcgtccggggcgacgttcttgaagtagtggttcaggagctgggcgtcgctgagcgtctgaatcgtcccgaagccgacgtcggggaagctgcagccggagaggatgccgtccagcagacccggatagttgtcggtgatctggtgggtctggtacgagccaccggagcagccgttgccgatggtgaaggccggttcgccgtacgtctcgacgaagtgttccttgaccatgctcatggtctcggcggccagcaggtcgttgcagttgttgccgaagacgttcagtgaggacgacgcgacgccgtagcccttgcgcagataggtgtcgttcatgatgccgacggtgttccggccctggacgtaccagccgccgttgcagcccccgccgaagccgtacacgaggcgcccgttccagcccggcccacgctgcagcggatcggggggaccggcgttcggttcgtgcagtacggccgtctcgtagatggcgcggttgatggtgccggtctccacgcggacgatgtacggcaccttttggcccgtgctcgtcgtggccgtcgccaggtcggcggggcgggcgttctcgtcgggcagcggaacgtacgcgccggccgtcgtgcggtacatgtagtcgacgcgcgtctcgaccgagcagtccgcgtcgagtggcggtcccaggctgacgccggtgaccgtcttgaactcggcggtgtcgcagatgaacggctgctcgtgcggcccggcgaacaccggtccggtgatggggtggttcttcacggtcagctgtccggagtccgcgccctgggccctggccgtgaacgtgttgtcaccggtggccagctccttcaccacgcccatcagcgcgtggtcaccggacggccggaacaccgaggtcacgtcccggcccgccacctcgacccggaccgtgtcggccgtgatggacgcgggcacctcgacacgtatcagggcgtcgtcccccgacaccgtgccgggccgcgacgacacggtggtcacctgtagctgcccgctttcccggctgctggccggcgtcgccgacgcgcctaccagcacgcccatgaacgctatgccgacaaggactggtctcgcggttcccctgaatgacacgacggaactcgcctcacttcctggagtgggaattcttgctcggtgtgcggacgcgggcccgcgcggccgaccggctcgcatcgggctcgccccggatcggatcggtccagcccggctaccagttggtgaacgccccgtccgacgtgcgcaagtgcggacgctcggcggccgtggcctggtaccggcgcgccgcctcgcggtcgatgtcgacgccgatgcccggcagttcgctccgttccacccgtcccggcacgatcgtcggccgtgcggtgaagagggcggcgatggccggatcggggtcggtctggtgctcctggatcgccacattcgggcaggtcaggttgagttggagcgaggaggcggcggtgacgggaccgagcggattgtgggtggcgagcttgatgtggtgcgcctccgccatcgccgcgatcttcttcgcctcggtcaggcccgcggccactccgacgtccacccgcgcgtagtcgatcaggtcgtcctcgataagggtcctgaactcccatttggagccgtactgttcaccagcggccaggggtacgccggtgcgggcccgcagcatgcggtagctgtcggggttctcacagcgcagcgggtcctcgacgaagtacgggcggcccgcctcgatctcccggcacagggtcagcgcctccggcgggtccaggcgcgtgtggacgtcgaggatcagctccacctcgtcgccgaccgtgtcccgcacctggtggaagagctcgaccgagtcgcgcagacagcggcgggcgtcgagcgtgccgtcggcgtcgtgcggcgaggcgaaccgcagatggctccagccctcggcgacgaggtcgcggcagcggtccaggaaccacgcacggtcgtggtagccgtcgccgacatgcacgtaggcgggtacgtgatcgcgcacccggccgccgagcagctcgtgcaccggtacgccgagcgccttgccgcggatgtcccagagggccacgtccaccgccgcgatggcggctccgagtatgcggtcggcggggaagaacccgcgccggaacatgacctgccagaggtgctcgatccgtcgcgggtcctcgccgacgatcagctccgcgagatgatcgagccctccggcgaccgcccgttggcgcgacctgatgccgacctcgcccaggccgtggatgccctcgtcggtgtcgaccacgaccagcatcatgctgtcgccgtgatcggggagagtcagcacttccaggccggtgatcttcatgccactcctctatgaaaacgttcccgcaacttccatgacgttcttgggaacacatcattcgcagcaggcgggttggagcgcaaggcccgtgcacacagaaggtttccctggaagaaatactcctgacacatgccttgacacgccatgggaacgttcgcaaacatcaaccgcattcgcaggatccagctgcgaggcgaccgggccacccggctcaagacgatgaggaggccgtccgtggcagtcacgatccgggaggtggcgagcgccgcgggcgtatccgtgtcgacggtgtcccgcgccttcaccgcacccgaccaggtgcagccgaagacgcggcagcgcatcctcgacgccgcggcccggctcggctactccgccaacccggcggcccggtcactgcgcggcggcggcaccgggacgctcggcctgatcgtcccggacatcgccaacccgttcttcccgccgatcatcaaggcgatgcaggcccgcgcccggcacctgggctacacggtcctggtcgccgacagcgacgagcgcgaggcggacgagctggccgccatcgcggccgtgtcgaagcgggtcgacggcctgatcctgtgggcctccaccctcaccgaggaccggctccacgagctggcggaccggatgcctctggtggtggtgaaccgccatgtgccgggcatcccggaggtccggatctccctgtcggccggcatcgcgcaggccgccgaacagctcaaggcgtacggtcacaggcgctgcgtcttcatcaacgcgtcccgccccgagctgagccgcggcaagtccatccaggagtccttcgaggcgctcgacctctccctgtcggaactcggcccgtacgagccgcggttcgagacgggcgtgcacgccgccaccctggtcgccgcccatgaggcgacggccgtgatcgcccacaacgacctggtcgcactcggcgtgctgcaccagatggccaacctcggcatgagtgtgccgcgtgacgtcagcgtcatcggcatcgacgacacgctgttggcctccgtctccactcccagtctcaccacgatcaggatcgaccccgaagagatcgccacgcgcgcgggggacctcctgatcgagacgatcgcacgtcagccgggccgcgccggaggaggacccggacccgactctcccttcgtggagatcggctcccgcctcatcccccgcgcctcgacgggtcccgcacccgcccactgatccacggcgcacaccaccaccacgagcacagcgccgcaccgcacccactcctgcccttcttggagccgttatgcccagaaactcccgtcgtgcggccatacttggctgcatggcgctgaccgcgaccctcgcgggctgttcctccctcaccccgagcagcgccgccggggacggcgatctcgtgctgcgggtgcaggggatgccgccggccacggacaagccgggcctcgcgctgttcaagcagcaggtggccgacttcgagaaggccaacccgggcatccggatcaagggttcgacgacggtcttcgacccactgacgttctccgcgaagctgtccggcggcaatgtcgaggacgtcatcaaggtgccgctgaccgagccgcaacggctcatccagcagaagcaggtgcagccgatcaccgggcagctcaaggagtgggagcacttcaaggagttcaacccccaggtcctccagccgctcaccgacggcgccggcgacgtgtacggcgtaccgcagaatccgtacgcccagggcctggtctacaaccgggagctcttcgagaaggccggcctcgacccggaccggccgccggccacctgggcggaggtccgcaccgccgcgaagaggatcagcgacagcaccggcacggcgggcttcgtccacgagtccaaggacaaccagggcggctggcagctgacgatgctgtcgtacgccttcggcggcgaactgcagaaggagcagggaggcacgtacaccgccaccctgaccggggagccgacgaagaaggcgctgcggctgctcaaggacatgcggtggaaggacgactcgctcggcaagaacctcctcaccaatcagaacgacgtgatcaagcagttcgcggccgggcaggtcggcatgttcatgggcagcccggggacgtaccgactggcgaagatgcagttcggcatggagaacaccgacgcgttcggagtggccccgatgccgcagtccggcggcgacgcgaccctcaccggcggtgacatctacatggttccgaagtccgccgacaagaagcacgccgcggcggccgtcgagtggctgaccttcgcctacgccaagccgcagtacagcaccgacatcgccgccgcacaggccaaggcgctctccggcgacccgaagtccgcggtgggcgtgccgacgctgccggtcttcgacaagaagcggcagaccgagatcgacgccgcgatcaagccgtacgtcaatgtgaagctgcggaacttcaagccgtacaccgacggtctcgccaccctgaaactgaagtcggagcctccgtaccaggcgcagaagctgtacgccgcgctcgacccggtggtccaggctgtgctcacgaagcgcgacgccgacatcgacgccctgctggcctcggccgagaaggacgtcaatgccaagctcgccgcggaccagaagtagccggcgatggccctgctcactccgtcccggcgcccggccgccgtgtccaaggagcctctggcgcaccccctgccgcagcggcggcgtggcaccggcgtccgcaggcagttcacggcctggctgttcctcgtccccgcgctgctggtcttcgggctcttcgcctggtggccgatcgtgcgcagcctgctgctcagcttccagaagaccaacctcgtcgaacccgcggtctgggtcggcctggacaacttccgtacgctcttcgccgatcccctgctcggcaccgccgtcgggaacaccgtgttcttcgtggtcctgggcgtgctgatcggcttcccggcaccactgatcctggccgcgatcatgtcgacggtgcggcgcggcgcgggcgtctaccggttcctggtgtacttgccggtggtcatcccgccggtcgtggcgatcctgctctggaagtggttctacgatcccgggagcgggctcttcaacaacgtcctcggcacggtcgggctcggcccgtacgcgtggctggagtcctccgacagcgccatgctctcgctggtcctggaggccacctgggcgggcatgggcggagcggtcctgatctacctcgcggcgatggtcggcattcccggcgaactctatgaggccgccgaggtggacggcgccggaatctggcggcggatctggcatgtgatgctgcctcagctgcgttccgtcatcggcttgctgctgctcgtgcagctgatcaacacggtgcaggtcttcaccgagccgtacgtcttcaccggcggcggacccgagaactccaccctcacggtcctgctgctgatcttccggtacgccttccaggacggcgagtacggccaggcggccgcgctctccttcctgatggtgctcgccctcgccctgctctccgcggtctatctgcgggccacccgcagctggagcacgtcatgaccacgctcaccaccttcgtctccgccaacgaccgtcagcgccccggcgtacgcgccgcggtgcggtccatccaggtgctcaccctgatcctgctgctgctcatcggcatcggaccgctgtactggatggtcaagggcgcggtctcaccgcccacggaactcacgaccgcgcctctggccctctggccggaccggccggccctgggcaacttcgcgacggcgtacaccgatctgagcgtcggccgctatctgatgaacaccttcctggtggtcggcggatcgtggttcgtgcagctcttcgtctcggccacggcgggcttcgccctctcggtgctcaggccgaagttcggcaaggtcgtctacggggcgatcctcgccacgatgttcgtgccgtacaccgtgaacatggtcagtctcttcatgaccgtgatcgatgtcccgttcctccacctcaacctgggcgacacctactgggcgatctggctgccggccggcacgaacgccttcacggtgctgctcgccaagcagttcttcgacgccctgccgaaggagctgttcgacgcggcgcgggtcgacggggccagtacccgccagctgctcaccaagatcgtgcttcccatgagcaagccggtgctcgccgtgatcagtctgctcgcggtgatgcactcctggaaggacttcatctggccgctggtggccatcaccgaccccgagaagcagccgatcagcgtcgcgctcgcccagctcgccacgcaggcgccgcaggaccagctgatcgccgcgatggtgctcgccgtcgccccgccggtgctcgtcttcgtcgtctgccagaagtacatcgtcgccggactcggcttcaccggagtcaagggctgacctccgcccgcgccgacaccggacggccggctcccgcaccacacaatccgctcccgcaccacaccttccgcttcggaacatccggagcatccggaacaccccgaccaagagaagggcacctccatgccagtcgcccgccgcaggttcatccagggcacggccgtcgccaccggcgccgcgctgttgccgaccgttcccgcctacgccgcggatccggtcaccatcgaggccgacggcatcaccctggtcggccgcagcgacggcagcgtcctcgtacaggacggtgcgggcgccgaccgcatcctgctcagccacttcatgttcaaggactccgcgctcggccagcagcgcaccttcggcggcacgcccgcccggatcacgctccccgacgggcggccggcgatccaggtcacctacacgatggcgagcggcacgtccggagtcacggtgcgcggcaccttcgacgtcaccgctcgcaaggcgcacatgaagtgggaggtcggcggctccagcacgctcacaccggccggcttcatgttctcccgcacggtctacggggcgagcgcgccggagtcgtacgaagcgctgaccgtctgggaacgggacgcccggggcggcattccgtacgaggtcaacgcgggcggcacgtacgtggagacctgggcgggatcgaagggcttcttctgcctctcgtccaccaaccccgcgaacaccaacgccacatggatccactcccctggcgtctcgaccggcgcgggcaccgcggtcaccgaggccgatctggtcctgggcgacctgcggccccgcggggcgggagcgctcgccgccaggaggccgctgggcgtggaggtgtggaccgaccagccgttcaacctctacaagacggccgggcagacgatgacgctcaaggcgcaggtcgtcaacggctccgccaccgccaggaaggtcaccctgacgtggtgggcgcgcgacttcggcggcaggaagatcgccggcggcacgctcggcaagagcctcgcggcgggcgccgcctgggacgcctcctttcccgtgacctcgccgtcgcagaacatcgtgttcaccggggtggaggtgacaagcggcagtgacagcgcgctggcccgcacgaatctgagcgtgctcccggagttcacgtacaaggcgggcaaggagtcgatgttcggcctcgccaactacccgtggctgctcaagcccggcaaggacgccgtgctcgacctggtcaggacgctcggcatcaagtggatccgcatcgcctacgcgggcgcaccgggcatcgacatcgcgacgctggacgcgaacggcatcggccacaacgtggagctgtccggcattcccgtgggcggcagtgcggagcagatcgcggcctgggccgacacgaacgtcgccaaggccctggccgccgaggccgcgtacttcgaggtgagcaacgaggtcaaccagccctggatgtcgggccgcggcgccgacgcctacgtccgggacgggctgcgccaggtcaccacgcgcctggacgcggcgggttcgcggatgaaggtcatgaacgccggtctgggcggcatggactacgtctggacgaagaacttccatgacgcgggcggctgggacctcatcgacgccttcgccttccaccccggccgcggcaacttcacgcccgacttcgccccgccgcccgaggagtggacgcagggttcggccggctcgtactggaacttcctcggctcgctgcgcaaggcgaaggaggttcttcaggagtacggcggcgacaaggagctgtggctcaccgaggcgtacgcgccgacccggcccaacgcgtggtggagcgacacctaccggcacgccgccgagaacacgctgctcagcctcgcactcgccaaggccgagggcgttcgcgccgtcaactggtaccagctgcacgactcgacgatccaccacccgcaggaagccgatcccgccaacgccgagtaccactacggcctgatgaaccgcgacaccagcgccaagccgtcgctcctcgcgttcgcgaccgccgcccgggtcctggacgaggccgagttcgtccggcatctcgccttcgcggacaaggacgtcaagggtctcctcttcaccactcccggcgggccggtgtcgatcctctggagccgcaaggacggctacatcctcaactccgagcacggcgaggacccctggtacgcgtcgccggagccctgggtcgacacctggacgaccaggaccccggtcgtggcccactccgggacggtcgacggaacggtgcgggagctgaactgcatcggccaggaacgctgcttgaaggcctccggcggcaggatcaccctcactctcgacggcgctccgcgcgtctattacggactcgccgtcaatcccgactggaagtagtgacgtacgacatgaggaacgaaaccgcacggcacgacatcaccgtcgtcggcggcggcctggccggggtctgcgcggcgatcgccgcggcccggctcggccggagcgtcgcgctgatcaacaacaggccggtactcggaggcaacgcgagcagcgaggtccgggtctgggtgtgcggcgcgaccgggcacggcaagaaccaccatgcccgtgagggcggcatcatgggcgagctgctcgtggagaaccagttccgcaacccggacgggaacccctactactgggacgccgtggtcctggacgccgtacgcgccgagcccggcatcacgctctacctcaacaccgacgtgcgtgaggtcgacgccgaaggaccggacgaggcgcggcggatcacttcggtgaccggctggatgatggggtcggagcggcggatacgtttcgagagctcgctcttcctcgactgcacgggcgacggtctcatcggccacctggcgggcgcccaccaccgcatcggccgggagtcgcgcgccgagtacgacgagccgtgggctccggagacggccgacgacatcaccctgggctccaccctcctcttctacacgaaggacgccggccacccggtcaagttcgtgccgccgaacttcgccaaggacatcacccagacctccatcccgcagcgccgcatcatcaaggcgggcgacaacggctgtgcgtactggtggatcgagttcggcggcgagctcgacaccgtccacgacaacgaacgcatccgcgacgagctgtggtcggtgatccacggcatctgggaccacatcaagaactccggcgagttcgacgcggcgaacatgacgctggagtgggtgggctcgatccccggcaagcgggagtaccggcgcttcctcggcgactacgtcctgcaccagggcgacatcctcggccagaccgagttcgccgaccgggtcgccttcggcggctggtccatcgacctgcatccgccgcagggcgtgtacgccaccgaggcaggcgccaaacagctctacgcggacggcatttaccacattccgtaccgcagcctctactcggtgaacaccgagaacctgctgttcgccgggcgcaacatctccgccagccatgtggctttcggctcgacccgtgtcatggcgacctgcgccacgatcggccaggcggccggcacggcggcggccctctgcgccgccggggacgtcaccccgcgcgaacttcccgtacccacgctgcaccgggcgctgctgcacgaggacgcctcactcatcgggctcgcctcgacggacccggaggacctggcgctgcgggcggcggtcacggcgtcgtccaccttgcgcagcctggcggtcgagcactccgacgagccctggccgctcgcggccgacgccggactggtccttcccgcggacccggacctctcgggggtggaactgctcgtcgacgccgaccgcgacaccgagctcgtgatcgatctgtacgacccggagctcggccagaactacgtcccgcgccggctcgtcgccacgaccaccctgcctgtccccgccggcgcccggcaatggctcaagaccggcctggactggtctcccgagaccccgcgcaacgccttcctggtcgtccgcgccaacgacgccgtcgccctgcaccgctccgaccgcccgacccccggcgtcctgtgcttcacccgcgtcccgctgcgcccgacggacgaatcgccccagcctctgcgcgagtggacggacagcgggctgctgcgccgcaccttctgcttccgtacgggagagaccgcggcctactcccccgccagggccaccgacggctacgcccgcccgtacgcgggaccgcacatgtgggtctccgcaccactggcggacgacccggccccctggttggagctgtcctggcccgaaccggtcaccctgggccggatcgaggtcatcgccgacgacgacgtcaacgaggacctgatcaatctgcaccaccaccgcacccccttcgacaccctccccaccctccttcgcgactaccgcgtcgaggcgcgggatcccgacggcacctggcgcgtcgtcgcccgtgcggagcggaaccggcggaggcgcgagacgcacacaccggccgagccggtcaccacagcggcgatccgggtcgtcgtcgaagccaccaacggggcagcggcggcgcatatcgtcgccgtgcgcgcccaccagtagaagcaccgactcaggagagtgaccgaatggtcgcaagagcgatggtcaccggggccgccgggcggatcgggcgagcggtcctcgcgctgctcgccgagcgcgggatcgaggcgaacgccctggtcctcgacgatcccggtgatctcgcggcacgcctcgtcgtgaccggtgacgcgacggacgcgacgaccgtgcgggcggctctggagggggccgacgcggtcatccacctggcggcgatcccgacccccgagcgcaacaccgcgtacgaggtcttcgcgggcaacagcctcgccaccttcaccgtcctggaggaggccggccgggccgggatccggcatgccgcggtggcgagctcctggggcgtcacgggcctgccctggacggacgccgaggatccgcatccgccgtacgcaccggtcgacgaggccatgacctcgcaggtcgccgacccgtacggcctctccaagcaggtcgacgagctgaccgcggggatgatggcgcggcggcacgggatgagcgtggtgtgcctgcgctatccgtacgtgggcggcttcgaggaacggctgcgcgcgcacgccgcccggctcacggccgacccggcggcgggggcgagggacctgtggacgtatctggaggtccgtgacgcggcgagggccgcgctgctggccctggacgtacccggccgcgcggcgcacgcggtccacctctgcgcccccgagatcatcgtgccgtacccgaccgaggagctgctgcgccgctaccaccccaccaccgagctgcggagcccgctgccgggccgagcggcgccggtcgacacctcggccgcgcgccggctgctgggtttcacggcggagaacctcctcgatcacggggcggttttgccgaactgagacacgaagaagccggtcccggcgacacagtgtcgccgggaccggctctattcggtcgatcgaccgctggctggtgtccgaggggggacttgaacccccacgcccgataaagggcactagcacctcaagctagcgcgtctgccattccgccacccggacaaggtgtctgtcgttcgcggtgtgttccccgtggcgacatggaaaacaataccaggggttcggcgcgcccttcacccgtatatccggtggtcagtgcggtgcggcgtgccgggtgggacctcggcctccccggtcctcggagatcccggggctgccgtcgcgtccatgagtgatcgcggctcccgccggccccgtccgccgtcccctctgcgcgagcatctgcgcgacacgtactggtccgccccgcgccggctgcggtacgcgggtctccgtctcggtgggtagccgggcccgccggagggactccggcgggcccggctccacccgtcagtctccgcagcggccctcgcgcagggagtgcaggtgctcgctcgacttgcgggcgaacgcgagcgactcgaccgggttgtcgtgctccgcctgccagtggtggtaggtccggccgtggtgggttcgctgggtgaccttggacaggaacgtcttgtagtcgatgtccccgtcgcccacgtccgacatgcggtagccgtcgcgggtcgtctcgtcgcggaccccgtccttgacgtggaagagcgggtagcggttcgggtgcttcaggacgtacttcagcgggtcgagcggggccgggctgccgtccacgcgcttgctgaagcggaactgggcgcagaacgcccagtagatgtccatctccaggtagacgaggtccgggtcggtctcttcgagcagcacgtcgtagaggcgcacgtgcggctggtcggtcgcgaaggagaattcctcggcgtggttgtgctggtagaacttcatgccgcgcttgcgggcggccgcgccgtagatgttgaactcctccgcggcccgcttccagccgtcgaccgtggagccgtagcggaagggtccagaggccgtgccgatgtgcttgaggccgagcgcctgggcgtcgtccaggaccttctccaggttctgggcgaaggtgtacgcgccggggttgttgtcgtcgtagtagccgacgtggctgccgatcgggttgaggccgtggtcccgggccagccgcttgagccgggccagggtgatgggaccggccgagccctgggtgtagcccgcgagttcgatctcgtcgtagccgtacttctccagttcggcgaagaccggcgcgaagcccagcgtggagatctggtcgcggaggctgtagagctggataccgaggcggccggggggcaggacgggcttgcccttgccgtggccgtggtcatgtccgtggccgttgccgtgtccctgaccgcggctgtcggcctgggcgctcgccgtgccgatgatggtggcggcggtggctccggcggcgacaccgaggatgttgcggcggctcagtctgcgggcgagttcggtgtccttgggggtgcggctcatgttcgggtgtctcccttggtgacctgacggggtgagtggtgcggtgccgggtgcgtgacggggaatgtcagtgcagtccggcaagctggaggagcagggacttcacttcggtggccctgacccggtcggggaacgcgtggggggtggagcagaggatgagcggaccttcgtcgtcgctctcggggaggcggccgtggctgccgcggatgggtgaggggtccagggggacgaccgccatgcggtagcgcaggccgagcttcttgcgggcgaccgccgagacggccttgacccggacgtaggggtcctgggggtccatgaagagctcgacggggtcgtagccgggcttgcggtggatctcgacgagctgggcgaagtcgggggcgcgggcgtcgtcgagccagtagtagtacgtgaaccaggcgtccttctccgcgacggcgaccagctcgccggagcgggggtggtccaggtggtgcgccttcttgccctcgtcgtcgaggagctgctcgatgcccggcaggtccgcgagggccgcccgggtcgcttccaggtcctcgggacggcgtacgtagatgtgggcgagctggtggtcggcgacggcgaaggcccgggaggtcatcgggtccaggtattccatgccgtcctgggtgtggacctccaggaggcccgcccggcgcagggcacggttgatgtcgacggggcggtcgacgcgggtgatgccgtattcggagagcgcgacgacggtacgtccctcggcgccggcgtcggccagcagcggggccatggcccggtcgaggtcggcggcggcccggtggg

SEQ ID NO: 3024 - DNA, 18773 bp, Unknown
  Kingdom: Bacteria, Phylum: Actinobacteria, Class: Actinobacteria, Order: Streptomycetales, Family: Streptomycetaceae, Genus: Streptomyces
gtcgaggacggtcaccgtgtggtctctccttctcggttgcctgccatcggttttccgcgcctccccgcgcggtgcgccggtggtcaggtcgcctcccgcccgtcgagcgtctcgcgcaggatatccgcgtgcccggcgtgctgggcggtctcggtgaggacatgggtcagcacccgccgtacgctccactcgccgccgggttcgctccagggcgcctcggggagcgggtgcgtcgccgagaggtcggggaccgcgaggatgatcttctcgctgcgggcggcgacctgctcgtaggcgcggaggaccccggccgtcgtctcgccgggcagcatccggaactccttctcccgctcgatcgcccacgtcggcaactcgcgtgcggtgccggccgccaggtcgtcccaggtgactccttcgggcagcgcgaaggacatcgccgacgggccctcggtcacgaagttcagccagctctcctccatggccgtgacgtgcttgacgaggccgcccgggcacagtgcgctgaccgtcgggcgctcaccggcccgctcgtcgccgaggccctcgaccgagcggatcagggcggctcgcgcggtggccagggcggcgatcaggtctgtgcgctcggcgtcgggggaggtggaggccgtggtcatggtgatcgggttccttccggtgttcctgtcgtgcggtacgggtcgaccctcgcaaggaaagaggccaggatgtggcctcttctccactcatactggcgtcatgccgaagacttcagcgcgcctgctggcgctgctctccctgctccaggcgcgccgggactggccggggcggttgcttgccgagcggttggaggtcagcccgcgcacggtgcggcgtgacgtcgatcgcctgcgggagctgggctatcccatcgcggcgttcaaggggcccgacggcggataccggctggacgcgggcgcgcagttgccgccgttgctgttcgacgacgaccaggccgtcgcgctcgccgtcgcgctgcggaccgccgccgcgaccggcgccgggatcggggaggccgcggcccgcgcgctcaccaccgtccggcaggtcatgcccgcccggctgcgccatcgcgtcgacgccctgcgggtcaccgccgtcgaacgtacgggaggcccaccgcggccgcaggccgatccgcgtgtgctcatgacgctgagcgcggcggtgcacgcccgcgaggtgctgcgcttcgaccactcccccgcgtacgctccggccaccgccgaagatccgcccgcggtgcggcgggtggaaccgcaccgcctggtcacctggggcggacgctggtatctcgtcgcctgggacctggagcgcgaggactggcggaccttccgcgcggaccggatcaccccgcgcactcccacgggtccccgtttcacgccgcgcgaggtgcccggaggcgatgtggccgccttcgtcgccgcgcggttccagggctccgacgtccccggcgatcggccctgccgcggcgaggtgatcctcgacgcgccggcctccgcggtggccggccacgtccgcgacgggagcgtcgaggagtacggaccggaccgctgccgcgtggtcctgagcgcctggtcgtggcccggcctcgccgccgaactcggcaagttcgacgtggacatcgaggtcgtcggtcccgacgggctcagggaagccttcgcccatctggcccgccgctgtgccgccgcggcggggacggggcccggcggccctcaggaacccacgcgacgtgtgtcgtaggtgtcgtcgatgtcgtcggtcgtcgacgcggtcacggacgaggtgacgtggcccgccaggcccagcaccaggaacagcaccacgagccatttcgcggcgctgctcaggaccagcggtcgggtggcggagcgcgaccgctccggggccacggcgacgtcgtcgccgaacaggcccttggggtaggcgggggtgagcatcatgacgtacgcggagaaccgcatccggtagcgcagggtggccgccgtcgcctcgaacagcggccggggcatccggccgagacacagcgtgatcagccaccagacgaaggccagcgcccaccacccgtacacggcgaggctctgcacgatcgccgccgggatcatcaggaagacacggaacagcaccgcgagccggttgagcggggtgggccgcacctcgatctgcaccggatagtcggccggcggggtcagggcgaagggcgggtagcggtcgatgagcagcatgtcgctcgccgagacgcgcatgtcgtagccgaggacgccggtcaggaagcggaagacggggtcgggcagccgtcccagcaccagggccgcgaaccagcccacgatgacggtgaagaacgcggcgatgtgcaggacgaacagcacgatgaagtgcgggacgagcagcaggagtcgcaggagcacggtcagccgccgctggcgtgccggttcgacgatgtccaggacgggccggaactcgtccgcgtccgtctccttgcggcccgggctccactggccttcggccatgtcgctcctcctcggcaggggatccgtacggcatccgcgcgcaggacgtgtccccaccgtccgtcggctccgggccgcccgcaaacggcccggcccgaacgggtgccccctcagcgcccgcggaggcggtcgagcagggagcggacggcgccggacccggtggcgcgccgaccgccgctcgccgggccgtcggtcctcccggtgcgggagccgcgcttcctcgccgaggggacgggagagtccgcgccgtcggcgtaggtgtagtagcggtggctgatccggcggcccagcacgaagtaccccaggagcgcgcccgccgtgttgaggatgacgtcgtcgatgtcgaaggcgcgcccctcgaccagggccccctggaccagttcgacgacggccatggcgacggcggtcagcagcgtcgtccggatcatgcgcaggcgacgtggcacgaagaacggcagcaggagtccgaacggcacgccgagcagcaggttcccgcccgcctgcttgcacgcggcgaggaaggtgtagtcctcggcgtactggcgcagcgagcggccggggcggagattcgcggtgacgaggtcctcggaggccggtgagggcgtgagcgtcaccttggccagcaggacggagaacgctacgagtcccagcagcaccaccgtcaggaccgccccgcgcaccagcacacgtacccatgtcccctggcctgtacggggattcgcctctgctgtcatggccgacgggttcccccgcccggctggaacacacgcctggacggtcccgcggagcgaaatctcatacagccgtccgctcccgcctgcgacgatgtgcgcatgagcgcacacaagagggacctgctggacgaggccgaccggttgcggacggagggccggcccgaggaggcacgcgaacggctcctcgccctgacctccgagtaccccgacgacgcggaggtggcctaccggacggcgtggatccatgacgtgctgggcctggagtcggaggcggtgccctactacgagcgcgctctggcgcatccggaactggcttcggaggaccggcgcggggcccttctggggctgggcagtacgtatcggatcctcggacggtacgggcaggcggtggagacgctgcgccggggcgtcgaggagttcccggacgacggctcgctccgggcgttcctggcgatggccctgtacaacaccgacgagcaccacgaggcgatgcgcctgttgctggagttgacggccgcgaccagccaggacccgtgcgtccagcggtaccggcgggcgatcgagcactatgcgaaggacctcgacgagaccgtgtgacttgtgcgggtgaacggtgtcgcgctgaaggtggctctcatcagcgcgcccgccgccaccccgcagaagtacgcccccggagcgacggtcgcgatgggtgttcagggacgcgtccgggtgacgccgacgaactatttcaccgggaggccgacctcgcgggtcgtgtggcatggcgggagccgcgcggcggggacagctgggcgccggggcggccggccgcggtggtggccgggtcgaccgaccagggtcgggcaaggggaagccccggccggatcgggggaatccagccggggcggtctgagtgcgggcgtgaagggcggtcgcctctcggcggagggctccacggggttcggcggtgcggtcttccccatgggctacaggtgaggcccggggacactgtccccctcactcccacgtatagatgaacgataaaccatccagggtcgttcccgggaatccgcccccgcggatgtgatccacggcacggaatcccgggcttcccccctggtcagggctcgttcggtcagctcccggacgtctcgccggtgccgtatcggcgccggaactgttcgacgcggcccgccgtgtcgagcacctggctgccgccggtgtagaacgggtgactcgccgacgaggtgtccacgtcgatgacggggtagctgttgccgtcctcccacgtcacgcgctcgccggagtcggcggtcgagcgggtcaggaaggccacgtcggccgcacggtcgcggaagaccacgggacgggacacggggtggatacgggacttcatcgatgcgttccttcctcaccgcggacagcggtgacgtacagggggacaggcctcttccgggcggtcagcggacctcgcggaacaggacgtgccgaccggcggcggagtcgtacttgcggagctccagccggtcggggtcgttgcggcggttcttgcgtgtcacatagctccggcccgttccgacggtggaccggagggtgacgaccggcctggtctcgctgcgtgccatggcgcctcccgatgcctctgccgaccccgttcctgtatcgggaatgggattcgttttcgttctggtgaggtaacgcgggccaccccctcgacattcccgccccgccgggcaccccgaacggcgtggtcaactcgccccaaacgcaagcctgttcggatcatcaccactctggagagccgctgacatatgccagacgcaagaacgcatcgagtgttgccaaagcccttacggcccgccgcggcctgtgcgacagtcggtagcggtccacccttcagaaccggctaggccgcgcctgtatcggagtacgagatgccgtcccccctcttcgcggaccgccccgcaccacagcttcccgcgcatgacgccgtcgacgccctgatccaccggacgcgccgactgcgtggggatgtggacgccgtgcggcgggacgccgtcgtgttcgacgaggacgacccccagctgcgctggcagcgcgccctgtgcgagcttgccgtgcagcacctggacaacctcgaccagcacctgggccagctccgggcgggtctgccggaccggtgcgccgacgacaccccgcctgctgtcgggaccccggacgaccccagggccggttccctgctgaaccgggtgggcagcgccgagtggaacctcctcaccgacgagtccacctggtcggaggagctgtacgagatcttcggcaggccgcccgggtccacgcccctctccctcgacgacctgccgtccgtactgctgcccgaggaccagccggtgctgaccgccatggtgacgggctgcctcgtcgacggccggccgatggacggcgagttccgcatcgtgcgtcccgacggccgcacgcgcaccctgcacatgacgggcgagccggtcctcgacgccgagggctgcaccgcctccatgtgggcggtcctgcgggacgtcagcgagctgcggcgcagcgagcaggccgtgagcagaaaccacgcgtcggtacggcgcgaggagcacatcgagcgcaccgaacaccgtatggccgtggagctccaggaagccgtccttcctccgtggcgcggatcgctgcggctcccgccacagggccccggcgccctggacatcgccgcgcactacctcccttccgcgtcgagcggcctcatcggcggcgactggtacgacgcgatggaactgtcggacgggcgcaccctgctcaccgtcggcgacctcaccgggcacggcattcccgccacctcggcgatggcgatgatgctgggcgcactgcgcggcatggccgtcgccggcatcgagccgggcgcactgatgggacacctcaaccaggtgctcgaaacgtcgatacagcccgcgctgggcagcgccctgtgctgccgcttcgaccccgacacctccattctgtcctgggcgcaggccggacaccccgcaccactgctcttccgccacggttcgggacggctcctgcctcctccggacgggatgctgctcggcgccgcgtccaacgtggtcttcgagcaggacgaggtacggctgtaccccggtgacgtgctcgttctgcacaccgacggcctgacgcgacgcggcgaccggggtgcgggcccggagtcgctgctcgccctcgccccccggttcgcagaggcccgtacggcacaggagtgcgtacggagcgtcgtcgaggagttcggcgggaccgagcgcctggacgacgcgtgcgtgctggtcgcccgcatcggggcgtgaggaagcgcggacgggtcaaggcgtgagtgagcgcgatgtgacgctgctgggtcagatctgcgtgcccttggccttcttctggctcggcggcatcgagagctcgatctcctcgcgcagatcctggatccccgcgtatccggcgaactggccggtgagccggtacatttcgcggagccggtcccaggtgcggtgcgaggaggtctcccccatcgacaccagcgcgagccgggcgtaccggtcggcctgttcggggtcgttggcgatgaagcaggccgaggccagcgagatgtagtcgaagatcttcgatcgctggcgttccttgcctctgagttccagcgcctgcttggcatggcgctgggcgatgatcgcggccccgtggtcgtgctcggccagggtccggaaggccagtgcctgcattccgtgcatatcggcctcgtcgaacatctgcatccaactgggcggcggcacatcgctcttgtccgagacgaagagctcctcggcctcgccgagggtacgccgcatggcctgcccccggcccatcgacgcctgtgcccaggcctcgatggtgcgcagcatcgcctgcgttcgcggcagggtctcgtcgccggagccggacttggcgagcttcatcaggtcgagtgcgtcgtcgggacggcccaggtgcaccatctggcgtgccgcccgggagagcgcctctccggcgcgcggccggtcgccgccctcgcgggccgcgtgggcggcgatgacgaagtacttctgggcggtgggttcgaggccgacgtcgtgggacatccagcccgccagtacggcgaggttggcggcgacgccccacaggcgccgctggagatggtcggggtggcggtaggcgagcatgccgcccacctcgttgagctggcccacgaccgccttgcgctggagtccgccgccacgggacgcgtcccaggcgcggaacacctcgaccgagtgctccagggcctcgatctcctcggagccgaccggagcggcctcgtaccggtcgagaccggcgggatcggcgtgcaggggatcgttggtacgtggagcgtcggccgccggagcggggtcgctgtgcagccagtcgtacatggggccggcgatggttgagccggcggcgagcgcggcgcccgcacccaccaagccgcgtcggttgagcatgaggtccattcccgtgaattcggtgaggaccgctgccgtccgttcgggcgcccacggcaattgatcgggattgtcttccgtcccggagtcacgccgcttccccacacgcccgcgtcggccgaacccgaggtcctcgatggtcacgacacggccgagccgctcggtgaacagagccgccagcacttcgggcacgggatcacggggggattcccccatgtcgatccagcgcctgacacgcgaggtgtcggtggccagctgcgggtggcccatggccgccgcctgccggttcaccattctcgcgagttcgcccttggaccagccggccaggccgaacaggtcagaaaggcgggtgttgggttctccggtcacttcaagcccccaggttctcggctgacttgacactaaccccctgtcagatgcgctgtgactattcgccagggttcgccagggtccgccagatggtctgccacccgcgctccggtgtcaggtaggaaagcgccaccccgcccggcagccctaggtactccccagggtgccgaacggccgtcggccgggttggcgcacgtaccttgtcggcgcacgaagggatctgtctcgcccatgtacacagcatcgtcctccgtgtccgccccgccccgtccgctccgcccgatgggcgcgggcggcgggccctatctcgctcctcacaccggcgcaccggtgcagggtccgggccgggcccgacgggccgcgggaccgggcgccggaccgctcagcggaaggatcgacctgtccgggccccagggcgcgcaggtgcggatggcgatcgcctccgtgcagcgcatctgccccgagttcaacccggtccaggtactgcgtcgtagcggccgttcggtcctgatcgtcggaacgaccgggcgggccaccgccgtcgcgaagtgcttactggaccactcgccggcgtggaccgagcggttccggcacgaaatagcggcgtaccgcgcgttcgtccggcaccgcccccctgttcgggcgccccggctgatcgcggcggatccggagaactgcacgctggtgatcgagcggatgccgggccgggtcgccgctctcacccggcacccggtggaggcgccgccgcgggccgacatccgggccgcgctcggagccatcgcccgggtgaacgcctggcggccgccgcccggactgttcgaggcgccgctcgactacgcgtcacggatcgcccgctaccacgagctcggactgttcaccgaccgtgacctcggtgacctgcagaagcttctgcacggtctggcccacgcgggcggcaagcagggcatggggcagttctgccacggggacgccctgctctccaacatcctgctgtcgccgaccggaccggtgctcgtcgactgggagcacgccggctggtatctcccggggtacgacctggcgacgctgtgggcggtgctgggcgacgccccggtggcgcgacgccagatcagccagctggcccaggcgagagggccggccgcacgggacgcgttcctggtgaacctgatgctggtgttgacccgcgagatccgcaactacgagacggcggtccagcgcaccatgcgcgaggcccccgcggcgggggcggggtcggaccggcccggcgcgctctcctcgggcgaggagcagcggctgctgctgcggaggctgcacgacgactgcgccatggcgcggcgggcggtgcgggccgcggtcggcacccgctgagaccgaacgaccgggcggggatacggcccgcctgccgagaaccacagtgaccagaccactgtgaagaagcgcgctgcgggaccggtgccgacacaccggtcccgcggcgcgctgttgtgcgttccggggcctgtccgccgtttccggcgtgccgacaccgacggcccgagccggagccgccgaatactccgtacggctgtcgcgagagacccttcggagtcgtatctccccgtgaccgggcgttgaccctgtgccgccccggggtcccccgcgggtgaggcccgccacgagacccacgtcacctacggcctccggtagtaggcacgagacctcccgtacggcgtaacgaaccgcccatatggctcataaattggcatctcacgatgaagagtagtaaaggcggtcattgcttcctatgtcggcgagcgctaaccatggatcccggcaagcaccgagttcgagcccgcgtcgatcgccctccggcgaccgcgacccggacatcccggttcctgccgacgcggcgcgaaggccgcgaagcccgtcccccataggaagagctcacgcatgccccgcatctccaccctgcgcatcacccgctcgcacaagatcgccaccgccgtgctcgtcgcggccggttccgtcagcgccatagccgccaccggcggcccgagcgaagcgcagaccacggcgacccggtcctccatctccgtggagccggtcgccgccgcaggcatccccacggcgaaggacgcggcggccaagaaggccgctcaggagaccgccgccaaggaagccgccgcgaagaaggccgtggccgcccgcaaggccgccgcggagaaggacgccgcagaggcgcgctccgagaagcaggccgccaaccgctccaccgagcgcaaggccgtcacgcccaagaagttcgcgaacaacctcgacggctggatccgcgagtcgctcgacatcatgaagaagaagaacatccccggttcctacgagggactgcaccgcaacatcatgcgcgagtccagcggcaacccgaacgccgtcaacgactgggacatcaacgcgcagaacggcattccctccaagggtctcctccaggtgatccagcccaccttcgacgcctaccacgtcaagggcaccccgaagaagctcaccgacccggtcgccaacatcaccgccgccgccaactacgccgcggaccggtacggctcgatcgacaacgtcgactccgcctactgagcgaccgacttccgaacgaccgccttccgagcacgcatcaaccccgcgattatgtgactaatcgccgtcgtgcgtgctccgtatggccgaagggtagtgctgcgcggacaccaccggtccgcgcgtttccccgcgcggaggcttctggaaaggcctgacgcacatggcacagcccttctcactgccggacttctatgttccgtatccggcgcggctcaaccctcatgtggaggcggcacgcacgcacacccgggcgtgggcccgctccatggggatgctggagggatccggcatctgggaggagaaggacctggaggcgcacgactacgcccttctgtgcgcctacacccaccccgactgctcggccgaggcactctctctggtcaccgactggtacgtgtgggtcttcttcttcgacgaccacttcctggaactgttcaagcgcacgcccgaccgggagggcggcaagcggtatctggaccgcctgccggccttcatgccgatggagcgcggcgccccgacgccggagccgtcgaaccccgtcgaggcggggctcgccgatctgtgggcgcgcacggtcccctcgatgtcggacgcctggcgggcccggttcgcggaggcgacggagaacctcctcaacgagtccctgtgggagctcgccaacatccacgagggccgcatcgcgaaccccgtcgagtacatcgagatgcgccgcaaagtgggcggcgcgccctggtccgcgggtctggtggagtacgcggcgaacgccgaggtgcccgcttcggtcgccgacgcccgcccgctgcgggtgctgcgggacgcgttctccgacggggtgcatctgcgcaacgacctcttctcctaccagcgtgaggtggaggacgagggagagaacagcaacggcgtgctggtgctggagaagttcctcggctgctccacgcaggaggccgccgaggcggtcaacgacctgctgacctcacggctccagcagttcgagaacaccgcgctgaccgaactcggcccgctctgcgccgggaagggcctggacccggcgcagaccgccgccgtgctggcgtacgtcaaggggctccaggactggcagtccggcggccacgaatggcacatgcgctccagtcgctacatgaacggcggcggcgcgggcgaggccgtggccggcttcggcatgtccgccgcctccatcaggttcacgctccgctcggagacctcgcgggcccgcagccagagtcatgtgccgtaccagcacgtgggcccctcgctgctgccgagcttcgacctgccgttcgggacgacgctgagcccgcatctggagggggcgcgggtccggatcgtcgactgggcgcggcggatgggcatcctggaggcccagccgggcgtaccggggtcgcacatctgggacgaggaacggctggtcgcgatcgacctgccgctgtgcgcggcgggcctggacccggacgcgaccccggacgaactggacctgtcctcggggtggctggcctgggggacgtacggggacgactggttcccggtcgtgcacgggcggacccgggatctggcgggtgcccggctggccaacgagcggctctcgctgttcatgccgctcgacggcgaggcgacgccggagccggtgaacgccctggagcggagcctgggcgacctctggcgcaggacagccgctccgatggacgcgggcggccggcgtaccttccggaccgcgatcgagtccatgaccgagagctggctgtgggagctggcgaaccaggcgcagaaccgtatccccgacccggtggactacgtggagatgcggcgggcgacgttcggctcggacctgacgatgagcctgtgccggctcgggcacggcaggaaggtcccggaggaggtctaccgcagcggtccgatgcgctccctggagaacgcggcggctgactacgcgtgcctgatgaacgacctgttctcgtaccagaaggagatcgagtacgagggcgaggtccacaacggcgtcctggtcgtgcagaacttcttcggcgtcgactatccgacgggcgtggcgatcgtgcacgacctgatgaactcgcggctgcgacagttcctgcatgtcgccgaggtcgaactcccggtgctgtacgacgacttcgccctggacgccgaggcgcgggagatcctggcgggctacgtgcaggagctcaagcactggatcgcgggaattctgatctggcaccggggctgccggcgctaccgcgaggaggacctgcggcgcggccacggcacgccctggcatatcagcggtcccacggggctcggcacgtcggcggcacaggtgacccggctgatggcccaactggcgggcagcccggtgtagttcgcgaggtcgcgacccgtcgtccggaggaacgcacggcgggccgcgaccggtgccggatccggccaggcagggctcagagcaggacgtgccggagcacctcctcgaactccgccgccgtcggcggggtgtcggtcagcagcccctggagcagcaggccgtcgatgacgcccttgagcacccgcacccggaccgggtcgtcggtgtagcggcggccgtacgccgagatggcctccagccagtgccgggtaggaccgcgcagttccgggcggcgggccgcgagcagatacagctcgtactccgcgagcagccgtccggggcctttgacgaccttctccatcagctccgccagcgcggtgacaccctgggggccgccgtcggcctcctcggccagccggagcatgcgctgcgcgtcctgctccatgcagcgggtgagcgcggcggtgagcaggtcgtcgatgctcgtgaagtggtaggcggcggcggtggcgggcaggcccgcctcgcgggcgaccgcccggtggctgacgccggcgactccgtcccgggcgaccacctggagcgtggcctcgatgagttcctccttccgtcgctcgcctttgagcagacgtccgtcggtctgcggtgcgtgcacggtgcctccgggcgtcgtggtggatgggacggctggtccgcttcggcgccggtccgtcagtgtgcgggccttccgggggcctcggccgcttcctcggcgtcgcggtccgcacgctcctggagacttcgctccagcggacgccgggcgcacaacgccgtcagcagagcggccgcgcccgcggctacggcgacgacgaagccgccgccggggccgaagcggtcgacgatcgctcccgacaccgcggcgccggacgcgacgcccacgctgaggccggtgatggcccaggtcatgccctcggtgagtacggcgggtggcaccgtcctctccaccagccccatcaccacgatcatggtaggcgcgaagaagagtcccgggaggaagacggcggcggacagcgtgacgaggtccccgacgaacagcagggggagggtcgtgagcgccgtgccggcggtgccgaggacgagcagccggggcagcggcgtcgtgagcctgagcgtcccgaagaccagtccggcgacggcggatccggccgcgtagaccgagaggacgattcccgcaccggcgggtgagccctgctgctcggcgaacgagacgctcacgacgtcgacggtgccgacgatggcgccgccggccacgagcgtgagggccagcaggcggagcgctccgctgcggatcgccgagccgtcgcgcgggtgaccgtcggccggccgggccaccggaggttcggtgcgcttctgcgggacgaacatgaggatgccgagcaccagcagcaccccggcggccaatggcccggcctcggggaacagtgcggtgcacagggccaccgagagtgcggggcccacgacgaaggtgagttcgtcgacgaccgattcgagcgaataggcggtgtgcagccggtcggagcccttgagggcgtgggtccagcgggcccgcaccatcgccgccatgttcggcatcgcaccggccaccgccgcgcagccgaacagggtccagacgggggcgtcgtaccgggcgcagagcagcagcgcgccgagcgccatcacgctcagcccggcgacgggcggcagaacccggctctggccccggcggtcgaccgcccgggagatccgcggaccgcagagggccatggacagggtgaaggtgacggagacggctccggcgaggccgtagtcaccgcgcatctgggacaccatcgcgatgatgccgatgcccgccatggacaggggcatgcgggcgacgaacccggcggcggtgaaggccctcgatccgggcgtcctgaacaggaggccataagggttggccatgcgcggacctccggagaacagacgtacgggcgaccctccacagggaacggtcgctcaactggaacgatcgcttcaatttgaacggtcgtttcgttttctactctatcccctccccggacaacggaaaaggccgcccggacggatccggacggcctcgcgcagggacgtttcagccctgctggaacagctctgcgggcaggggcttgagcagggtgtacaggtcgtcggtgatcggccggtcccagctggcgatggtcacgaggacaccgtcactgcgatcgaactggacgcaggcgatgcggctctcggagagcttgacgcggcggacgatcagcagattgtcgccctgcatgacggggacgtcctcggagctgacgacctcgatcggctcgtcgttctccagggcgaggaggagttgggccacctcgaaggggacctggccctcctcggtctcgcgggcgggcgagccttccgggagattgccgatgatcatcgccgggccccggccgccgtacaggtcgtaacggaggaagacgccctgacagctgccgtcgggggcggggagcagaccggcgccgaggttgccgggccagtccccggggtccatggccaggacgtcgaagtccgggcccgcgggtgttgcggcgctacggcggcggaggaaggacatgctgccatgttacgtgtcccggctcacgttgcggagccgggcccgggggccgcgggaccgggccggccgcattccctcagccgggcggcggctccgctccgacgagccacatggcgaagaactgcgctcctccgccgtaggcgtgacccagcgccctggtggctccgtcgatctggtgctccccggccctcccccgcacttgcagggccgcctcggcgaagcggatcatgccggacgcgccgatggggttggtggacagcacgccgcccgagggattgaccgggaggtcgccgtcgagttccgtgacgcctgcctcggtgagcttccagccctcgccctcgtcggcgaagccgaggttctccagccacatcggctcgtaccaggagaacggcacgtacatctcgacggcgtcgatctcccggcgcgggtcggtgatccgggcctgccggtagacgtcggccgcgcagtccttgccggcctgcggggagacgaagtccttgcccgcgaacagggtcggctcactcctcatggccccgccgtgcacccaggcgggcgggtggggcgagcgggccgcgccgtaccggtcggtgagaatcatggcgcaggccccgtcggaggagggacaggtctcggagtagcggatcgggtcccagagcatgggggcggcctggaccttctccagggtgatggcgtggtcgtggaggtgcgcgtaggggttcttcagcgcgttgcggcggtccttgtacgcgacgagcgatccgaccgcttcgggcgctccggtgcgcctcatgtacgcacgcacgtgcggggcgaagaagccgcccgctccggccagcagcggctgctggaaggggacgggcagcgagagcccccacatggcgttggactcggactgcttctcgaaggcgagtgtgaggacggtccggtgcactcgggcggcgacgaggttcgcggcgaccagcgcggtcgaaccgccgaccgagcccgccgtgtggacgcggagcatcggcttgccgacggcgccgagggcgtcggcgagggcttctctggactcctcgacggtacggcgggcccggcgtccggcggcgtgcagtgaggacgcgttgccggtggcggagagctgggcggtcatcgccccgatcgcttcgggaagcatcggggtggtcgcggcgtggtcgaggtaagccatggtgaggccgattctacgagcccggggcggggcgcatgccgggcgcgtcacggcccggcccccgcgcacgcccgcgtgaggcgcggctggccggctcggaggccggtccggagcccgatccggaacagggagagcggctcgcggagccgtgtggggaccgtcagccgccgaagtcccaggcgaccgcgccgttgccggtgacgaggacgccgagcacgacgagatcggcgacgcccagggcgaggcccagccgggcacgtccccggcggcgggtgcggcgggccagggccagcagggccatcacgatcgcggtgggcccgagcaggaggttgaagaccagcagcccgacgaggccgagaacgaatgaggcgacggccaggccgtccgcctcccggcccacggtcccggagaccgcggcatccgcgcccgcggcgggagcgggggcctgggcggtgcctccgggagcgggaccggcagccccggaacccataacggtgcgggcgccggagtcggtcacgcggcgggcgaagtcggtgagggtcatggtgcgagctccttcggatcgatccgggacacggcaggctcggcgggtgcgggtgcgagttccgggagcgggtgcggcgggggaagggtcagcgggtgcggcgcgacgtgcgctcgcgtacggcgaagaccagcagccagcagccgatcacggccgcggcggtcagggtcagcggcagcgggatgtgggcgaccgtcccgaggacgatccccagtagaagcagcgcggcgacgaggacgagcacggcggaacctctctgtgcgacgacggacaccgttcggcggccgcggggcagccttcggagtacgagtgttcactgacttgcgagtctaaacctcggaccccttcctcgactcggagaacggttgtttactgaatggcatgagtcacacccccgccggagtccgccacacccagaagctcaggacgcgccaggccctcctggacgcggcgctcgtcctgctggagcaccagagcctgagcagcctgggccttcgggaggtcacccgggccgccggggtcaccccgacggccttctaccggcacttcgaggacaccgccgcgctcggcgtcgccctggtcgaggagaccctgggcagcctgcacgggctgatcggcgcggtgctcgcggagacgggcgacagcgaggagcggctggaccgcagcgtggaggtgatagcgcgtcatgtcggcgcgcagcccgcccacttccggttcatcgcccgcgagcagcacggcggtgtgcgcccggtgcgcgtggccatcgccgcccaactgctgcggttcgccgaagaggtggcgctcgtgttgcgcgaggagccggggtcggccgggtggagcacggaggacctgctgatgctgggcggcctctatgtggaccacatggtgatcaccgcgtcggccctgctggaggcgggtccggcgggtgagcgggaggtcgtccgggtggcccggcgccggctgcgactggtctcgatcggccgcgagcactggctggacggggagactgccgcttgaccctccggtaacgggaggccctacggtcccggggtatgaagatcgtcgtccatgacaccgcctccgcccagctggccctcctgcgcctccctccggcccaacgacccgacgccctgcgggagatgctctccccgttgcaggaggtgatgtcccgggtgggggtcggggacctggtcgagaggcaccgagctggcagcggcttcccgctcgaccgggaggacccgcgccttccggaggccctggagcggatgcggaaggcccgggt

SEQ ID NO: 3025 - DNA, 9270 bp, Unknown
  Kingdom: Bacteria, Phylum: Actinobacteria, Class: Actinobacteria, Order: Streptomycetales, Family: Streptomycetaceae, Genus: Streptomyces
cgcctgaccgcctgaccgccagcgcccagggacctccctgggcgctccaggcgtccagggtcgagggtgctcgcccggcgtaccatgccatgatcgccatctttcgacaggatcgtgccatgggaagcgtgcaacgggccgtcgttctcgccctggacggggtgcatccgttcgagctcggtatccccccccgggcgccggtggccgcacgcgaaaggacagtggatatcgcctttcgcgcagttggcgattttgggaattccggtgattctcgcggattggcagacgcatttaccggatgtccgcgccgctgccatcgggattcccgggcggggtccgggaatcggccggggtggtgtggggggtctcacccgggccggagaagaaaacctattagtctgtacctaatcttgccagtatgtgcatcgcaggaacggctcgccactacatgacccctggggggagttatgcccgaagcagcagtcttgatcgatccggtgccgaccatggacgcggaggccgaggtggtgcatcccgtggagatcgacatggtgcaccggaccaggccgcaggacgcctttccacggaactgggtacgcctgagtcacgaccggttcttggtgagtgcggttcttccgcacgaccatccgttcttcgctcccgtgggtgacgaccggcacgacccgctgctggtcgcggaggcgatgcggcaggcggccatgctcgccttccacgccggttacgggatcccgctcggctaccagttcctgatgacgggactggactacgtctgccatcaggagcacctgagcgtggggggcgcccccacggagatcgacgtggaggtcttctgctccgacctgaagtggcggggcgggctcccggcgcagggtcgtgtcggctgggcggtgcaccgggacggccggctcgccgcgacgggaatgggggagacccggttcagcacccccaaggcgtaccggcggatgcgcggcgaggccccggccgaggggatatccataccggagaccgcgccggtatcggccgtcctggcaggccgttcccgcgctgaggacgtggtgctctcggagaccggtcgggacggagtctgggaactgcgtgtggacacccggcatcccaccctgttccagcgtcccaacgaccatgtcccgggcatgttgctgctggaggcggcgcgccaggcggcgtggctggcggcggggcccgccggagtcgtgccggcggaggcgcgcacccggttccaccggtactccgagttcggcagtccgtgctggatagaggcggtggtcctgccggagacggccgaggatacggtgacggtccaggtgacaggccatcaggacggggaagcggtgttctccaccctcctgtccggcccccgagccgatggctgagaggtttctcgagtgattctcgtgacgggtgcgaccggagcggtgggccgtgaggtcgccggacagctggcggcggccggccccgtgcggattctcgcgcgccgtcccgagcggctcacggtgcggggaggaggggtcgaggtcgtcgagggggagtacggggaccgcgccgctctcgaccgggcgctacgaggcgtcgcctcggtgttgctggtgacgaacagccccacggaacccgacgacgagcgggtcgccgcggcggcggccgcggcaggcgtacgccacctggtcaagctgtccatgatggcggtggaggagccgggcgccgacgatttcatcacccggcgtcagcgggagaacgaacaggcggtcagggagtcgggggtcccgtggacgttcgtccgccccaggaccttcatgtccaacacactgtcctgggcgcccggcatccggtcgacgggagtggtgcgcgccctctacggcgacgccccggtcgcgtgcgtcgacccacgtgacgtcgccgcggtggccgtcgccgttctcaccggtacgggacacgagggcagggcgtacgccgtgtcgggcccggaggcgatcaccgcgcgggagcagacggctcagctctcccgggtgctggagcggccgttgcgcttcgaggaactgggcgtggacgccgcgcgcacggccctgctggcgaagtatccgcggcccgtcgcggaggccttcctacagagcgcggagcggcagcggacaggagcgaaggcggccgtggtgcccacgatccaggacctgacgggccgtccggccaggccgtaccgcatctggtcggccgagcacgcggaggcgttcgctccggaagccggtcgtctggcgggcgagtaggacgcatcggctccctgcggaccgcggatacgtacggcatcgcgcatattccttttccggtccgctttcatggctatcaggagaggcgcggccggaaggcccgggagcctcagccgcattcctccgtttctccgaaagggaaaccggcgagtcggccggacaactcccgatctcccgggtacgcgggtccggttccgcatgctgctccagcggcgggaccctgtaccttccgccacatggctgacgagaatttcgggcatccccggcttgctgccctctacgacccgctcgatcccgaccggggagacctgcaaccgtacgtccgcctcgccgaggagttcggcgcgcggcgggtgctggacatcggctgcggtacgggcgtgttcgctctgctgctggcggaccgcgggatcgaggtcgtcggggtcgaccccgctcgggcctcgctcgacgtggcgcgcgccaagccgggcggcggccgggtccgttggatccacggtgacgccgcgacccttccgccgttgcgggtcgacctggttaccctgaccgccaacgccgcgcaggagatcgtcgacccgggcgactgggagacgacgctgcgcggcgcctacgaggcgctgcggcccggcgggcatctggtcttcgagacccgggatcctgcccggcgcgcctgggaggcgtggaatcgggagagttcccaccgcgtcacccagatccccggcgtcggccccgtcgagacctgggtcgaggtgaccgggatcgtcgggccgctcgtgtcgttccgctggacctacgtgttccggtgcgacgggcaggtcctcacctccgattccacgctgcgcttccgtgaacgtcaggaggccgaggcggacctggcggcacaggggttcgtcgtacgcgacgtgcgcggcgcacccgaccggccgggccgggagctcgtcctcatcgctcgtcggccgggccccgtcccgcgtcgccgatgacgtccgtcaggaccgcgtcggcaccccaactcgccagcaggcgcaaggcctgggccgactcggagcccggctccgcgtggtaggtcaccagatgctgctcctcgtcgtccgggaggttcagcgtctcgtacgacagggtcagctccccgacgagcggatgccgcagcagcttgacgccgtggcccttctccttgacgttgtgcgtggcccacagtcgccggaactcatcgctcttgacggagagttcgcccaccagtgccgacagctccggatcgtccgggtggcagcccgcgtacagccgcagatagctgaccatgtccgaggccttggagtcccagttcacgaacaggtcccggtaggcgggggagaggaacaccagccgcgcccagttgcgctcgtccggcgccagcgcgccccagtcgccgaacaccgccgccgccatcggattccaagcgagcacgtcggagcgcgccccggtcacgtacgcggggatgccgtccatgctgtcgagcagatacagcacacccttccgcacgcgctgcacccgggccgggcggcgcttcttcttgtgccgcgcgggcttggccaagtgggtcagatgcgcgctctcggcgtccgtgagccgcagggcccgcgcgatcgcgtcgaggacctcggccgacacgttgcgcccgttgccctgctccaggcgcgtgtagtacgccacggacaccccggccagctgtgccagctcctcccggcgcagaccgggcacccggcggtgccggccgaactccggaagtcccacgtcgcccggccggagcttggccctccgggtgcgcaggaactcgctgagctcggcgcgccggtccagcggctcgggggcgggctctggctgatcgtccatggcttccattattcctgtgattcctggtcgtacgcgccggagcctgtccccgccagtagtaggaccgctggacgtaggcaaagcggtgacctgggtaaacatccgtcgcggcgtgatgctgggagatgttcctaccgcatcacccagaggagaacctccggcatgaccaccgttgccgcctatgccgctccccgtgccaaggccccgctggagcgcaccacgatcgaacgccgcccggtgggcgagttcgacgtcctgatcgccatcaagttcgccgggatctgccactccgacatccaccaggcccgcgacggctggggtgagggcatcttcccgatggtgcccggccacgagatcgccgggatcgtcgccgagaccggctccggggtcacccggttcaaggtcggcgaccgcgtcggcgtcggctgcatggtcgactcctgcggaaagtgcgacgcgtgcctgatgggccgcgagcagcactgtgccgaggggaacacccagacgtacaacgctctcgaccgcggcggcgagcccacctacggcggctactcgacgcacatcgtcgtggccgagacgttcgccctctccattcccgagggcatcgccctggacgaggccgcgccgctcctgtgcgcgggcatcaccacgtactcgccgctcaagcgctggggcgcgggccccggcaagaaggtcgccgtcgtcggcctcggcggtctgggccacatggccgtcaagatcgcgcacgcgctcggcgccgaggtcactgtcctctcccagtcgctgcggaagaaggacgacgggctcaagctgggcgccgaccactactacgcgaccagcgatccccggacgttcgaggaactggccggaaccttcgacgtcatcctctccacggtctcggccccgctggacttcagcgcctacctcggtctgctgcggaccgacggcacgctggtcaacgtgggcgcccccgaggagccgatctcgctgaacctcttctccctgatcctcggcaacaagtcgatcgcgggttcggcgatcggcgggatcaaggagacccaggagatgctggacttctgcgccgtgcacgggctcggcgccgagatcgaggtgatcgacgcgggccaggtcaacgaggcgtacgagcggattctcgccagcgacgtccgctaccgcttcgtgatcgacacggcgacgatctgaggagtcggccgcccggccgcccccaccacgcaagcgtccgccccgagcgcctcaggtgctcggggcggacgcgtcacctgccgcacctcgccgaggcggcctacgcgcgataccgcgccgaatccccggccgaccgggacggcgaccgtgccgaccggcacgcggagcggccccgacccgcgccgacggccgtcccggacaccggccgggcgaccggcccggaccgcgaagcgacgacgccgctcccggtggaggtgtcccccggccgcgctggggtgccagccccagtgatctcgaacggcccttctcctaacgtttgttgacgtgagttacgaagaggacaccgagaagatcacccgaagcccggcggctgcccgagccgccgaggccgccccgacgaccgccaggaccgccgccgcgggcctggccctggccctcgcggcgggcctcaccgcgtcaccggccctggccaccgcacggcccggcccggcgctccgtaccgtcgcaccggtgatgactgccggagcactcgaccgctactaccaccaacccctcgactggggcacctgtatgaggtccccgcaggacggggcgggcagggatctggacaaggcgggcgtgcaatgtgcggacgtcacggttccgctggactactccgcccccaggggccggacggtcacggtcgcgatatcccggctgaaggccaccgacacccgccaccgcatcggcgcgatcctcctcaacaacggcggccccggcggccaggccgtggactccccgccggtcgtccgcacggcgatgaaggaggtcggcccccgttacgacatcgtcggcttcgacccgcgtttcgtcggcaggagcaccccgctcgactgcggctggccggtcggcttcacctggttctcggccggtgcgagccgggcgggcttcgaccgccaggtggccctcagcaagagccttgcggccaagtgccgcgccacgaacgcctcggtgctcccgcacatcaccacccggaacacggcccgcgacatggacgtgatccggggcgcactgggcgagcggaagatctcctacctgggctattcgtacggtacctacctgggcacggtctacacgcagatgttccccggccgctacgaccggatggtcctggacggagcggtgggtccggacgactacaacccacgcctgctgaagaacacggcgagtgagaacgagcaggcgctctccgcctgggccgcctgggcggccgcccgccacacgacgtacggcctgggccgctcccgtacggcggtgctcgccaccatcgaccacatcatggcgaaggcggccagcggcccgctgacactcggcaccgcccctgacgccttccgggtcgacgacacccacataccgacgctgctcttcatcggcctggccgacgacggcgacgggtcccgggcgttcctggcccagcaggttgcggcgctgtcccaggcgtcgaagggtcgcgaggaggcgttggccccggaattcgcggggacgctgcgtctcctcctgaccggcgcggagtcgtccttcggcagctcccagacggcgatcatctgcggtgacgtgccggccccgcgcgaccccgagctctactggcgcgacatccggcggagccgtggcgcgcaccccctgttcggccccctcaccgagaacatcggcccctgcgccttctggggcgcgccccgagaggctcccacccgcatcagccacgacgcgccggtcctcctggtcgcggccacgggcgacccccgcaccacctaccggagcaccacgaccctgcacagcaggcttcccggctccaggctcctcaccctccagaacgccaatcgtcacgccctttacggggagtacgggaacgcctgcgtggacaccgaggtcaaccgctacctggcgacgggccgactcccgaagggggacgagacctgcgtgaagtgacgcgggagcggggccggcacgggccgggcgggtacgaggcggctccacaccgcctcgtaccttccgacgacggcctcccgaccgagggggctcggggccgcgcgttaggacgggaccggtgaagcgacggccccgtcctccggggcctccgcctccggggagtcctccacgagctgctcgcggagatagttccagaccaccccgagcagcgccgccaccgggacggcgagcaggctccccaccacaccggccaggctgccgcccaaggtcaccgcgagcaggatcgtcgccgcgtgcagacccagcccacggctctggatcatgggctggaacacattgccctccagctgctgcaccacgacgatgatcgccagcacgatcagggcgtccatcggtccgttcgagaccaacgcgatgaccaccgccacgaatccggcgaacagcgcccccacgatcggcacgaacgcgcagacgaaggtcagcaccgccagcggcagaaccagcggcacccccaggatccacaggccgatcccgatgaagaccgcgtccagcagaccgacgaacgcctgggaccgtacgaacgcgcccagggtgtcccagcaccgggaggccacctcgggaacgtcggtggcgagcctgccgggaagctgacgggtgagccacggcaggaagcgcgggccgtccttgaggaagaagaacatcaggaagatcgccagaaccgcggtgaccagcccgttgaccacggtgctcaccccggtgacagcggtggtgaccacactgccgacactgtcctggagttgagcggtcgcggtgtcgagggcaccggtgatctggtcgtcgccgatgttcagcggcggaccggccgcccactcgcggaccttgtcgatgcccgcgatcaccccgtcggccagttccccggactcacccgccaccggcaccgcgatcagcgccacgatgcccgcccccacgagcagggagaacaccgtcaccaccgacgcggcgagcgagggccaccacccgagccggcgcaggaaacgggcgagcggccaggtcagcgtggtgaggaacaggccgactatcagcggccacacgaccgaccacatccggcccagcacccacagcgcgaccgccgccgccacgaggaccagcaacacttctgcggagacccgcgccgacgtgcggagagcagccgcggtctttgtcgaactcaatggcgaagacatggcgttaccctatggcttcgccaagcgtgttccggccacgcccgcggcccgccgatcaccacgagggcgggccgcccggcttcgtcagcgcaacgccgggggcagttcctcccggtggacgatgcccaggcgctgggtggcgcgggtgagcgccacgtacagatcgctcctgccgaaccgggcgggctccacgaccagcacatggtcgaactcgagccccttggcctggcgcggatccagcagcaccaccgggcgtgtgaggtcgggggcctcacctgccgtgatgccgtccagcggggcggcgatctcctcgtgcagcgcgcgcggcgcgatcaccgcgaggcgtccctcccggggcgtcagctccacgaccgcccgtgacacctcgcccgccaggtccttcccggcatcccgcgtccacggcttctcgccggtcgaccgcaccgagacgggggcggtgaacgaagggtccttctcccgcaggaccccggcggccagctccatgatctctgcgggcgtacggtagttgacctccagcgtgacgtgctcgaagcggtcgccgacgtacggctggaggatctgctcccaggacccgacgccggcctcctccgaggtctgggccgggtcgccgaccagcgtcagcgagcggctcggcgcccggcgcatcagcagtcgccacgccatcggcgagagctcctgcgcctcgtcgacgatga

SEQ ID NO: 3026 - DNA, 6089 bp, Unknown
  Kingdom: Bacteria, Phylum: Actinobacteria, Class: Actinobacteria, Order: Streptomycetales, Family: Streptomycetaceae, Genus: Streptomyces
gcgcaccagggcgatcagcgcctcggtcagctcccggccgacacccgccgcgaccgcgctgtcgaaggcctccatgccgccggtggcccgctacctccgcgacgaacccgccgtacaggtgcggctgaccggcgcggtggtccggctgcgccgctcgggtccgcgcggcgccgggatcgtccggctgcgggtgctggccggggccgaggtcgcgcacgtccgggtggagctggacgaggaggcgtaccgcatcgcgggccacgcccacctggtcgggctgccgctgcgggtggaggggcggctggagaaccggggcggcttccggcggctcaccggggcctcgcaggtcgcgcccgtccaggtcgacgaggccgaacgggaccggctgatgaaggccctccaggagaacgtggacttcttcgaggaggcgtgcgcgggggaggagccgtagcgcgcaggaagccgttcgcatcgggggcgtacggctcggtacgattcgtcgtgcccgcccactacagggtgagcgtcccctcagtcaggagagaccggtgtcagacgtccgtgtgatcatccaacgcgattccgagcgggaagagcacgtggtgacgacgggcacgacggccggcgagctcttccccggtcagcgcaccgtcgtcgccgcgcgcatcggcggcgagctgaaggacctctcctacgagcttcgggacggcgagagcgtcgagccggtggagatctcctccgaggacggcctgaacatcctgcgccactccaccgcgcacgtcatggcccaggccgtgcaggagctcttccccgacgccaagctcggcatcggcccgccggtcaaggacggcttctactacgacttcgacgtcgagaagccgttcacgcccgaggacctcaaggccatcgagaagaagatgcaggagatccagaagcggggccagaagttctcccgccgcgtggtctcggacgaggccgcccgcgaggagctggcgaacgagccgtacaagctggagctcatcggcatcaagggttccgcgtcctccgacgacggcgcggacgtcgaggtgggcggcggtgagctgaccatctacgacaacctcgaccccaagaccggtgacctgtgctggaaggacctctgccggggtccgcacctgcccaccacccggttcatcccggcgttcaagctgatgcgcaacgccgccgcgtactggcgcggcagcgagaagaacccgatgctccagcgcatctacggcaccgcctggccgaccaaggacgagctgaaggcgcacctggagttcctggaggaggccgccaagcgcgaccaccgcaagctcggcaacgagctggacctcttctccttccccgacgagatcggtcccggcctcgcggtcttccaccccaagggcggcgtcatccgccgggccatggaggactactcgcgccgccgtcacgaggaggagggttacgagttcgtctacagcccgcacgccaccaagggcaagctcttcgagaagtccggccacctggactggtacgccgacggcatgtacccgcccatgcagctcgacgacggggtggactactacctcaagccgatgaactgcccgatgcacaacctgatcttcgacgcgcgcggccgctcctaccgcgaactgccgctgcgcctcttcgagttcggcacggtgtaccggtacgagaagtcgggcgtcgtgcacggtctgacccgctcgcgcggcttcacgcaggacgacgcgcacatctactgcaccaaggagcagatggcggaggagctcgaccgcacgctcaccttcgtgctgaacctgctccgtgactacgggctcaccgacttctacctggagctctccaccaaggacccggagaagtacgtcggctcggacgacacctgggaagaggccaccgagacgctgcgtcaggtagccgagaagcagggtctgcccctggtcccggacccgggcggcgccgcgttctacggcccgaagatctccgtgcagtgcaaggacgccatcggccgcacctggcagatgtcgaccgtacagctcgacttcaacctgccggagcgcttcgacctggagtacaccgggcccgacggttccaagcagcgcccggtcatgatccaccgtgccctgttcggttccatcgagcgcttcttcgccgtgctcctggagcactacgcgggcgcgttcccggtctggctcgccccggtccaggccgtcggcatcccgatcggcgacgcccacatcccctacctccaggagttcgccgccaaggcgcgcaagcaggggctgcgggtggacgtggacgcgtcctccgaccggatgcagaagaagatccgcaaccagcagaaggccaaggtgcctttcatgatcatcgccggcgatgaggacatggccaacggcgccgtctccttccgttaccgggacggttcgcaggagaacggcatcccggtcgacgaggccctcgccaagatcgcgaaggccgtcgaggaccgcgttcaggtctgatccgtacggtcggaacggcccccggagcgctacccgcgctccgggggccgcttctcgtcctcccgggtgaacacctggatcagccaggacgagaacgaccccgtgaccgcgccgagcagcgccaggccgccggccatcagcgccgtcgcgaccgtccggccccagaacgtgaccggcgcggcgtctccgtaaccgaccgtcgtgagcgtcgcgcacgcccaccacaccgcgtcgccgaaggtgcggatggaggcgtcgggggccgtgtgctccaggtggtagaccgcgagcgaggcggcgaaaccgagcagggcggcggtcaggctcgcgtaggacatcacccgcgcgtacaggctgagccgcgggcggtcacggcgttgctgcaccgccgtgtacaccttgaccatgcgcagcgggcgcaacaggggcagcagcaggaccagggtgtcgagccagtgcacccgcacaaagcgcgcacccagtccgctgagccgcagtcgtgtcccgtagtccacgaggaacagcagccaggtcgaccagacgaggaccagggcgatgtcgttccagggcttgtcgtcgtgcggggtcagcacccggaacgcgtacccggtcaggaagagcagccccgcggcgaagagcggaacctccgtgcgctgctcccagcgggccagccgggcgggtggatcggaggcggttcggtcgctcatcgcctcagcatcgcgggcggccgagcggtgcggccccggcgacacgccccgccggggtgacgcaatatgctgatcggcatgacgagtgagccggagcagcagatcggcgtggggacgcccgacgcattccagcgcctgtggactccccaccggatggcgtacatccagggtgagaacaagccgagcggcccgggcgccgaggacggctgtccgttctgttcgatccccgcgaaatccgacgaggacgggctgctcgtggcacgcggcgaacacgtctacgcggtgctgaacctgtatccgtacaacggcggccacctcatggtcgtcccctaccgtcatgtggccgactacaccgagctggacggcccggagacggcggagctggcggacttcaccaagcgcgcgatggtcgcgctgcggggggcctccggggcgcacggcttcaacatcggcatgaaccagggctctgtggccggcgccgggatcgccgcgcatctgcaccagcatctggtgccccgctggggtggcgacaccaacttcatgccggtcatcggccacaccaaggtgctgccccagctgctgggcgacacccgggcgatgctggccgacgcctggccggcgggcgagctgccggcccgctgagcgcggtgcgggaaggaggggggaggtccggccgggcctcccccctcccgcaggtctacgcgtcgtagacgtcggccttgcgcggggccgggtcctggacgaggccgctcagtatcatcgagcggttgtcgaagcgctccgtgtcgacgccgttctccgcgaggacgcgcatcgccgccgtgtggacggcccgcagtaccggggtggcggcgcgcatcgcgtcgtccgccatgaagcggtggttccacggcttggccgcccacgcgtgccgcagcccgaacggctcgggcagcacgatcttcccgcccaggtagtccagcagcggcggataccaggtgaggggcgcccgcagggcgagccggacgacctccttggcgtccaccagcgccagctggatgtcccgggtctcccagaagcggacggtcttgttgaccgtcttcgtcttcgccgccggcttggagaggaacaggctgtgcaccggccccagcgcatggcccgtgacctcgatgcgcagggtctcgtggagcacggtgacggtgatcatcatggtgatcaccagctggccgtcccacagggtgaactggacgcccaggtagtgccggtcgccgctgccgaactgctggtggttgcagatccgctgtatctcgtggggcttcacctggaaggtggcgacgtcctccccctcggggcgcgtgacggagtcggcgttctccccgatgggcgagacgatccagtgcttcacggccggcttcgggaaaccgccggtgttcagcggtccgcgctccagcatcttcagctggtcatggatgatccggatcaggtcccagctgcggaactggtgaatctccctcgtcgggtccttggggtgcagctcctcggccagctgccaactgccccaacgggtgcccatcccgaggacgcccttggggccggcgtagaagacggcgttcgactgctgctcggccgacagcttctccagaccctggcgcagggcctcgcgagccgtctcgttggggttcttcggcaccgcctcggggatcttcgcgatcaccccggtgccggagagaaggccttcccagcgggcccgcatgtccttggccgaggtctccgcgatcctcttggcgatcagccagccgatcaccggggcgacgagcgcgccccggacgtagagcgcgagcagtccgtccagggggagcttgaccatcaggaccagcgcgccgatcccgaaggccgcgaggagcaccgtgccgaccgcgcggaacgccgtgtccttggacttgttgagcgcgtcccggacccggaaggcgatcacccaggccagcatgccgggcaggaacaggaccccgaacaccacggtcaccagggtgagccgggtgtcacgggccttgcgcaggttgttcgccgacaggcagtgctccaccaccgtctgcgggtccgtgccgaaggactggatgagcgccttgcgggcgccgccgagcatgcgctcctggacggcacgggcgaacgcctcgccgagattcggcttgaagtagtcggacttgaagagtttcgatgagcccggcttcaccaccgatttgtgccactcgctgttggcgtcgaggatcgtctccaccggactgtcccgatacgccgccgaggccagggcattggtcgccacggtctggccgcccgagccctggatcgggatctgggccccgggtgagaagtcgaatccgtcgttggccacctgtcgcccccactcgccgcacgtctgctcctgcggtgtgcccaactaccgtacgcggcataccttctgagctgcgaccacagcgtatcgtccggatcacaccaccacccgtcacccgcgtgcatcgagcggtgtgtgcgacagtgcgccggtcacgcgccgggggacccgtccgcccgctccgcgcggacccggtcggccacctgcggcggcatcgcctcgtgccgggcgtacgcacggtcgaagcggccggtgccgtgcgacagggagcgcaggtccaccgcgtaccggccgacctcgatctccggcacctcggcccgtacgagggtgcgcccgcccggactctgctcggtgcccacgacgcggccccgccgccccgagagatcgctcatcaccgggcccacgtagtcgtcggggaccaggacgctcacctcgcacaccggttccaggagctggatgcgggcgtcggacgcggcctcgcgcagcgcg

SEQ ID NO: 3027 - DNA, 17341 bp, Unknown
  Kingdom: Bacteria, Phylum: Actinobacteria, Class: Actinobacteria, Order: Streptomycetales, Family: Streptomycetaceae, Genus: Streptomyces
atcccctgtagctcaattggcagagcagccggctgttaaccggcaggttactggttcgagtccagtcgggggagcgcgatcccctgtagctcaattggcagagcattcggctgttaaccggagggttactggttcgagtccagtcgggggagcggaacggaagagggcccttcggggtcctctttcgcgtgtggtccgcgtgcgggcgacgtcgtgggcagccgcgtgtggccgctcgcggctccggacgcccgcggagaggctctgtgatcaccctttcgggtctccttggccccgcccggaaccgggcggcacgcagcgaagtcctcaagatcaggcgaagccggccatccgaagcgagagatcgtatgaccggctatgctgcggcagacggtgcgcacacttgtacgcgccacgccgaaacggggcggtagctcagccggttagagcagcggactcataatccgtcggccgtgggttcgagtcccacccgccccaccgagcgtccccaggcagaatcgttctgacctggggaaacgtggatttcgcggcggctttccgtgcggtactagccgcgcatcgtgcggtactgacccgctgtcgcactgttgcagtgcacttcaggtgcgtctgacctggtcctttacggtaggtgcatgaggggcgtcgtggcgcgatcccacggctgctggtcagtttgagtccgctcatcgcggcgcgttctccggcagtcgctggagtccgaatagtgctggatgcttgtggtcagcgtgtggctgagggcgtcaggcactgggatgagttgggacggaccggaccggcggtcgcttcgtccggcaaggcggcggggtgccggcgggcccagcgtccgggcgcgtagtccggcgccggggagtgcgccgcaccttcatcgaggtggatgcgctggcgcggggtcctccgggcgcgggtttcaggcagtgacgcgtggtgtcctcgcctcagggttgccgtcgtcgcctacccgccggacggtgacggggccttgcccgacgggcaacagacgctgtcctcatgccggtgccggtgctcgtgggcggtgaccggcccacgagcaccgtcgatgcgctcgaagccgctggcgtgacggcgtactgctgggaagtggcagtgcccagcagcagggatgctcgtcttcgtggcgaagacaggaaggctcacgcgagccggccgccaggtcccgggccccgaggcggcgcaggcgtctcccggtcggtcagaacgcctgcaagtacacccgggttgtgccggcatccagttcgaggatgtggatctcgatccactgaacctcgggccggcggctgtcccccacgcaaggcgggcagactccggcccaacggacgcccttcttgctctgaggctcggcgaggccgagatgtccgaagagctccgtgggggacgggaggttctcgttcctgacgcgcaggggctcctcgagacgcaggtcctccgccactcgtactgcggtcttctcgtcggtgacgaaggagagcaggtagatgtcctcccgagggttgatctgcacggcgcccttcacctccgacgcgctcttgggcacctccagctgcatgaacgccgacgcctccggggcgcccagggcctttccccagcgcgaggcgcgcccgtccgtcgtccggtgatcacccccgtcggcattagagcaggaggtgagcagcagggcggccccgaggaccgcgagcagccgtggcctcagggcagatcggtcgttcaccggttctcctcgtcgccgcgcgagacgtccccgcgggatccttcgcgcccggggtccgccggtgccaccccgggggctgagccactgttcagatcctgggtgtaggtgctgctgctaccgcgcatgtcgaattcctgggcgaagcccaccttgtgcagtcgccccatgtcgtcgtcgggaatggtgacaccaccggggaacgtcgtcgcttttccggagtcccagttgtaccggtcccacacgttgacctggtagtcgagcgagacctgtggcttgccgccgtcgcccggactgacggtgaccatgcccgacacgttctgctggtgcgacccgaccgcgtggaaccattcgtcctcaccgaaggtccgcccgatcgcctggctctccacgggaacgacgaccgtcctgtcgccgccggccttctcgaactcatcaagggccttctgacgccatgcttcctggttctcggcgatgtgaagcgtgcccacgtcggtccggaatctggaatcgtcgtgcaggatgcggttgacatcgaggtcgagcggctcgccggtgccactgagatagtgctgcatgttgcgggatgccgcgacctctcctgtgacatcgccgcccgtggcgatggcttgagcttgcgtcaggacccagaggtcgtgagcggtgggagcctccgtatcgaatggtcccgagcccgcgtcggccggcctccactcgtacagcggggccatgatccctgcttctcgaaggtcgtcgccgcgctcccgcagcaggatgccgcgcgtcaccggatcgagatcacgccaccactccgccacggcggccctccccttcggcatgttggcggccttgccagcctcctccagggagggataagggctccttgcagggcttctgttgaagccgttcatggtcccgtccatgatgtctgagtcgaccacggcggccgcgagggcgagcctgatgccgtcgtcggcgtcagtgaccgcctggaccgcccggtggaggagatcggcccaccgggtcacctgagcgcgcacgctttcgtggtagccggggtcatgcacgtacgcagtgcgtgcactctggctgagctgttctgtatcgaacgaaacgacgccctggtcggagatacgcatgccgtccttgatggcgtcactgcacacggtgttcaccctgccacggagggcggctagctgagtgtgtgaatcccgcaggatggacgcaatcgccttggcctccttttgagccccttgcagctccttgagcgtcacgctgaacctgtagttcgcggcatcggcgctctggccgacccacgactgtccgagcgagatgcgatagacatcgcgttcgtactgcttctcgatcgacttgaacttgcccgccatctctacccacttgtcggcggcgtcggcgagtttggacaggtcgctgctcatcacttcgtgataggtcggcacgcatcccccgggcggtcggtcggctggtcagtagttgtcgatcggggacggcggagccagttgtgagccgacgccgatgtcgtcgttctggaggtcgatgcccgttttgctcagggcgtgcttctcccacgacagtcgacccagcagcgccttgacctgctgttcccacgtcctgtgcgctttcctcaacgcacccgaagtgtcccagccgtgtccgtccctggcaccgaactccttgaccacggctgtcacgctctcggtggcgtgcttgccgtccctctcgacgtcgggttccagatcctcgttgatggccttcgctgccgcctgcttcttttgcgggcttgaggcgagatccggggtgctgccgcctcctgctgccgggacgagttggttcagtcgcatggagtccgtgcgctgggcggccacatcgttcttgatctgcttccactcgtcccaggccatggcccccccatcagcgtgatcgttaccgatgaacatacggaatgctatggctcaggcgacagctggtgcctggccaaaagctcgctgccgagtgtctgacgtgtggctgtcctgcacggcccgatcgggagggctgcgcaggcggttgatggccagcaggtgaccaatggttgccgcgctggaggtgaggtcacctctagatgcggcagatggtgacacaagacgtccctataccaaggcgctcggcgacggacgagcgagcaggtggggcggacagagacgacggcacaaggcccgggacgaccctccaaggagcgcggaactacgcgagggcctggtatcccgctcccgggcccggcacctcggtcgactccgctcgtggcagagcgtgactgtggcggccgaggcttaccgccgtgctatcccactctccggcggcgtcatgctgttgcacgactgctgcttcggcggggtcgggcatgggggaaggcggagctctgaacctcaagaggcgtcgggaaggtggtgcagcgaacgctgcaccaccttccgatcgagcgggatcgagtaggacgcaactggagcgaagcggggtataaatcggtcgctttggtaaagctgcaggtgggagccgtcacccttatgggttcgagtcccacccgccccaccagattcacccctgcggaaacgttctgacctgcggagacatgttttcgcggctgctttccgtgcggtactggccgcgcgccgtgcggtactgaaccgttgttgtagcaggtcgcacacaccccagaagcgtccgacctggccttttgtgtccacggaggcgcgtcccgagtacagaagaactgttcaggcgtggacgagtggggtgtcgaccagatgttcggccaggaaccaagcctgtagttccccggtcctgatcacctgggagaccagcagatcgttggtgccgtcgtcacccaactcgccggtccgggcggcggcgtcgtgggcctcgacgaggatggtctcgtgggcttccaggagccgtgacagcatcaccggcacttcctccactccgttcggaggccgccggatcgatgtgatctccgcaacgtgcctggggtcgcccaccgcgacgccgcccaaggactggacgcgttcggcgatggtatcgacgatttccagttgctctgccgcgtgcttgtcgaggacgagatgcagttggtagaaggtcgcaccgcgcatcagccaatgatgcttcttgtagaggccgtaaaggatctgcgtgtccgccaggaccttgttgaggcgctggcaggagtacatccgcgcctcgtaggacaggccgatcgggaactgcttgacggtgccgaactcctggatgacctcgcccctctggtgcagccacggctggctgccgctcacgggcctggaatcggtggtcatggttcgcctcctgtggtgccgcgttgtgcgtgcccgagcgacgctaagtgcctcggcacagggtgcattgaccgggagcgcacgcggtggtgtccatcggcgcacagcgcgcggtgcctcgtaccaggagttcgcttccgggcaaggacccgtgcgctggcaggcacgggccttcggccgggccgatctagcctcggcaggccggcccacgtccgtggagcctgaggaatagaggagaagcaggcatgggcacgaacgagcaggcggatgtggtggtggtcgggctggggccgggtggtgagtacgtcgcgggcacgctggccgaagccgggctggacgtggtgggggtcgaggcgggactcgtcgggggtgagtgcccgtactggggatgcgtgcccagcaagatgatgatccgggccgggaatctgctcgccgaggcgggtcgggtgccggctctcgccggcgaagcggtcgtgactccggactggagcagggtcgccgggcgtattcgcggcgaggcgactgacgactggaacgacgcggtcgccgccgaccgcctcgcggccaagggcggccggctcgtccgggggacgggccgtctctccggcccacgccgggtgacggtcggcgaccgcgcattcgaagcccggcgcggcgtcgtgctggccaccggctcgcggccccggatccccccggtgccgggcctcgaaggaacgccgtactggaccaacagggatgccatggcggccgaggagctgccggagtcgatggtcgtgctcggcgggggcgccatcggtaccgaactcgcccaggtcttcgcccgcttcacgtgcgcggtcacggtgatcgagggacaggaccggctgctgtcgcaggaggaaccggaagccggggagctggccgccgaggtactgcgggcggacggagtcaccgtactcacgggggtccgggcacggcaggtcagccatgacggcaccgagttcaccatccggcttgagggggacggggagccgctgcgagccgaacggctgctggtcgccaccgggcgccacaccgacctggccgcgctggcggtcgacaccgtggggctggatccaacggccggagccgtgaacacggacgggcagatgcgggccggggaggggctgtgggcggtcggcgacatcaccggccgcggcgccttcacccatgtgtcgatgtaccaggcgcagatcgccgtccgggacatcctcgggcagtccggtcccgacgccgactaccgggcgctgccccgcgtcacgttcaccgatccggagatcggagccgtcgggttgacggaacggcaggcgcgggagcgagggctgcgggtacgcaccagtgtgctgcccatcgccctctccacgcgaggctggatccacggaccgggcaacgcgggactcatcaagctcgtcgaggacgcggaccggggtgtgctgatcggcgcgacgtcggcgggaccggccggaggcgaggtgctctacggactgaacgtggccgttcacgccgagatacccatcgaccggctccagcacatgatttacacgtaccccaccttccaccggacggtcgaggccgcgctcggagccctccgctgagccgctcccggatcgcccacgcggccccggcgcccaggcgatggcgcaccatgccgggccgcgaccccggtgagccgcacagggccgccacctcgctggagctcctcttcgacctgtgcttcgtcatcgcggtcgcgcaggcgtccagcagtctgcacgaggcgctgaccgacggggagtacgccaccggagtcctgcgcttcgcgctggtcttcttcaccatctggtgggcgtggatgaacttcacctggttcgcgtccgcctacgacccggacgacgtcctttaccggttgacggtgttggtccagatcaccgggtcgctcgtgctcgccgcaggcgttccccgcgcgttcgaggagggtgacctgcgggtcatcaccatcggatacgtcgtgctgcgcacggcactggcggctctgtggctgcgcgccgcgtggtccgaccccgctcggcggccgaccaccctgcgcttcgccgccggggtgacggcatgtcagctcgggtgggtcgggttgctcggcctcccggcatcggcgcgcctgccgggcatcgtggtgctgatcatcgccgaggtatccgtcccggtgtgggcgcagtccgccgggatgaccccatggcatccgcggcacatcgccgagcgctacgaactcttcaccctcatcgtcctcggagagtccgtcgcggcggccaccgtcgccgtccggggcgccttcgaccggcatcacggcaccggctcgctgtacgcggtggcggccggtggcctgttcatggcctacgccatgtggtggctgtacttctccagatccgcgcacactctgcttgccacgacgcaccgagcccaccgcaggagattcacctgggcctacggccactacctgatcttcgcttcggcgaccgccgagggagccggcctggccgcttacgccgatcacgtcacgcgtggctcggacacctcgccgttggctgcgggcgcggcggtcaccgtccccgcggccgtcttcctgatcaccgtctgggccgtacacctccggccgcaccaaagaaccgtggccgacgggattccgtatcccgtcgcggcggtcggcatcctgctggccgccttcttcccggcacctcccctcgtcgctggagcgctcttggcggtcctggctgtggtggtcacggtggagcgccggtgacgaagccgccgacgagatctcaccctgtgccgggaccgaaggccgcgcggcggtactaaccgtgccgtaagggggcgtcaaccgtggtgatggtcgcggtcgccaaccggctcccggcctccgacggctcttggaccaagccacaggtgcgaacgcgacgccaccccgcgggagggggcggtgccctcgtcagtgagccgcagggccacaggtgccgcactccggccgacgagccacccgcgaccgtctcgccgccctcaacggcggcacccgtacggcactcgggtacaggattgaggcaggggcgtccgtcagggcgcggctgggggctcggaggactccgccgatgcgcaggtcctcgaaggttccggccgggacgacgaggagtctgccggggtggaatgcgcgcgaagcggcgtctgtggccggccgcgtgccctgctgatgctcccgctgttctcccgtccggtgttgggtgctgccgcacacaacgcccgtaccgccgcatcggacacatgcggcggtacgggcgcggggtcagttcatcggccggggttgatccgtgcggccaggatgttggggtcggtgttggtgaagtaggcgccactggcgatgtaggccttgttgccgcgcacggcgagcgaggtcggattctccagcccgtcggcgccggtcagcacgactgtgtggctgccgtccggcctgaccatggccacctcgttgtccgcgttgatcgcggccaggagggtgtcgccgcggccgatgaaggcgaagtcgtcgatgttgaccaggccggtggcccgggtctcgacggggccggcggtgccgtgccgggtgaccgggatgcgcagcacggtgcccttgtccaggttggacacccagaccgcgccgttgtggattttgatgccgttggctccgaggaatccggctgctgccagttccggggccgtggcccactccgtgggcgtgcccccggcgagggggacccgccagaccgtgccgaggaccgagtcggccatgtacagccagcgttcgtgccggtcgatggccaggccgttgggcaggccgtcggccgggagcgcggcgatacgctgcggggtgccgccggggcgcagacgccacaggccggtcaggtcgctgctgccggtggcgtacaggaagtacagggccccgtcgtgagcacggacgattccgccgaggaagggcgaggagagggctggggtactggcgtcgaccggaggctggggcagggtggcgaggacgtgaacccggccgtcgggggagattcgggctacttgacggctgtaggcgaaggtgacgacggcactaccgccgggctccagggtgatgttctccggtcgctgcccgtcggtgacgtccaggtgcgccacgaatcgcacgtccggtctcggagtggcgttggccgtcgtcatgggggttgctgccgtcgcggcgagggccaccgcgacgaccgaggccagaagaccggtgcgcgttccggtcaggaatccgggcatgtgggttctcttctctcttcatctgcttgcagggtgagcgtccgacgaatgtcgctgacgaggggcgagccacgcgtccggtcagcggtccgagcggacggaacggaccgcccgcaggatcaggccggtgaccggcccgggatcgctcacggcggccgcgtgcggggcgcggacagtgaccgtgcgggcgcgggcgcgctcggccatccagcgctcggcggccggcgggatgttgcggtcctcggtggccacgaggtaccagctggggatccacttccacgcggcagcggtggcgggctcctggagcgccgccagggtgatcggacgctgtcccacggccatgacctgggcggtctgtcgagatactccggccgcgaactgctcgcggaacaggtccttcgtgatgaccagttcctccccctgcccgccgttggacagcgggtagtactggctggtggtggcctgtcccagggtgctgccggggaacttgtcggtgagctggagcgcgctctccccgaggtcggggacgaaggcggctacgtagaccagtgcctcgacctgcgggacgtcggccgcggcctggctgatgaccgctccgccgtaggagtgacccaccagtacgaccggtccggcgacgctgttcagaacgctgcgaatgtaggcggagtcgcttgccagtccccgcagcggcagggccggggccagtacccggtggccctgtcgctgcaggcgttcgacgaccgggctccaactggaggcgtcggcgaacgcgccgtggaccaggacgatggtgggtgcggcacggcgcccgtggcgtacggccgccgccgactgcgcggcctgcgcgacgccgccggcccccagggcggctgcgccggccaggagggacacggcgacggtgcggcgtgagatcggtgagttcatcgttcgctctctgggaagggccggaagcagtcgtggtgcggcggccgtcgtacgggcgtgagctggtgcgcgcgggtcagccggaggtggcctgtacggcttcctcgatcagatcgacgacgcgcccggggtgggcgagcatcaccaggtgggaggagtcgatctcgacggtggtcatgccggctcgctggtagccgtagcgctccacgtcggggttgatggtgtggtcggacgaggcgaccaggccccatgagggcttggtcttccaggctgcggccggggccgcttccgcgaaggcctgagcggccagcgggcgctgggatacggcgagtacggcggcgagctgcgggtcgacgtcggcggcgaagatggccgggaacttgtctgtccggaccgacacatcggtgccgggcgcggccgagccctcgatcgggaagggggtgtagacgagtgcggcggcgaggtcgctgtccgggaagcggccctgcagttcgccgaggctctcgcccttctccaaggcgtaaccggccagatataccagcgccttgacgttgtcctcggtgccggcgacggtgatgaccgcgccaccgtaggagtggcccaccaggacgaccgggccgggtatctgccggacgatggcggcgacgtaggcggcgtcccctatcaggctgcggttggggacggccggtgcgaccacgtccaggccgcggtcgaccagccgggagatgacctgggcgtaactggaggcgtcagcgaaggcgccgtgcacaaggacgacggtcggcttgtcggaactgggcatggggaaactccctcatcggtggggtggtggtggctgtcacatggtctgtgtcggcgctgtcggggccgcggtggtggcctctttgacgtgagatgccgcaggccggcagcgtgtgtgtgcactgaccggtcggccgcgggctccgccgaagggggtccgaacgcctccacgtcgggagccttggcgagcggggaatcaccgacacgtgagcaacttaagggtccgtcgagcggcatatttgtctgtccgcgtcccggtggtggcctgtgcgtgcccacctggtggggtggtgcgggcgggtcgtgttgcccgggtacggaagtgggccggtgcccgcactcggccccggcccacgttctgctgtgatgttctttcgcgttcgggatgcggaggccggttgagccgttccggtccgcgaggaaaacgaggagcttccggccggcgcgtgccagacgaacggcggtacgccatcgggcaaggcggccggcggactcctgggcgtcggatacgtgccccgaccttcgcgtcatccagcgccgtgcgtcagctcgttgcgcgcacggcttcgcagatcaggtccgccaccgccgatggccgggagacggtgaccgcgtgggaagcgcctgccaactcgacggtcgtcgcaccggcccgcctggcaccgaagcgctccacgtcggggttgatcgcctgatccgcttcggctacgagggcccagcacggcttcgtccgccaggctgccgcagaggccgcctccgtgaacgccgccgaggccaaagggcgttgggaagctgccagcaccctggcgagggatggtgagacgtcggcggcgaagactgaggggtatgccgctgggacgatgctgacctcggtggcggtcttccctccctcggtcgggtaggtccactgctccagactgcggaggagcggaggagcgggaaagcggtcctgcaactcgctgaggctctcgccttcttcgaggacgtaggcggcgatgtagacgagtccgacgacgtggtccgcagtgcccgccacggtgatcagcgcacccccgtaggagtggccgaccaggacgaccggaccgtcgatctgggagaccacggaggccaggtaggcggcgtcgcaggtcagacctcgcagcggattggccaccgcgaggaccgcgatgccgtcgcgctggagttcgtcgatgacgccgagccagcccgcagcgtcggcgaaggccccgtgcacgaggacgaccgtgggaggagtaggagacacgtgtgaactctttcttctcacaccgagttcagtgcggtgtgcgggagggtgatggtctgactgatggcggctggtgcgacgtggttctcgcgtgcggcttcacgacatcgtggaggattgcctggaagcggacggcggccgcgcgcgacggcggttctcacgttcccgggagccacgtcatgacggcatggcccccatgggtgacgtacccgcgctccggtgccggccgccgtggcgcactcaagtggccttccggtgaggccggtcacacgtgtcagacgttccgcccctgtccagaagccgcgacctgccattcgctgggcgactcgccataggtctggcggaagaggcggctgaagtgggaggggctggggaagccccagctctgcgcgaccgcagccacggagcgcctgcggttcggcagtcggccgaggtcgaggcggcaggcggcgagcctacgctgccgtatatgcgtactcaccgtcgttccgtcaccctggaacaacttgtgcaggtaacgaacggatatgtggtgggcgcgcgcgatggactccggcgacaggtccgggtccatcaggttctcttcgatgtacgaccgtatgcgggccagcatctcgccgccgcttttggtggactcggaccggtggggagcgaggagttcggctacgagcagagcgatgagatccacggcgttgagggcgagccgtgtgccgttcgcagagttccacagcccgtcctcgccgatcagcgcggccaggaacttcgacaccagtgccgcgacgccgtcggctccgctgacccggaggcccgtcaggtgcagcacctcgtcctgcgtgatccccagataggagcagggaacgcggaagaacacgaattcactgccgcatgccaggtgctcggggcgtagggcgtcgaggaggacgaggtcaccggccgccgacgagggctggtctcgccggctcggaagcgtcttcggtgaggggcgttcgagtcccaggtacaagcacgcgtcatctcccttccgcgaggaccagggaagtgttctgcagtgtccgaaatttccgctctggggagtctgggtagtgtatgtttctgcgttttttggcatgcgtgaaatgaccgacctggtcaccataagctccagtcgtgccgtagttcgtcaaaagaacgtgaagtgcccgcgtatcgtccgggagttacgtgtccgccgcggaggcgtcgcgtccgcctatgcggagaggaaggcctcgaccaccgcgttgaaggcaggcgggttctcgaggaaggggaagtgggaactcgccacgctggacgggaagatgtggagccgcgcgcccgggatccggccggcgatgaactgctgcgaggctgggctcacatggcttccctcgcagccgatcaccagggtcggcacgtccactcggggaaggacgtcgcgccagtcctgcgcgcagtggtcgtagagcaggggcgccccggcgtggggcggggtcgacttgatctgtgcggcgacgaaggcgaggaggtcgcggtcggggtcaccggagaacatgctgcggacgaagtcgtcacgcacctgctcgccgtccggccccgccagcgcggcgccaagctccagcagcccggccacatcgaagatggctccggaatcccgctgttcctcgggggtcagccacgggacggccgccacggccgcaggctggtccacggcgacgaaccggcggatccggctggtgccgtactggtcgatgaagctccaccacaccgaagcgcccatcgaccagccgagcgcgtcgaaacgatcgagattcaggtgatcgacgaggtcgaggacatcacgggacaaccgcgcgatgcgatagccgtgccgcggcttctccgagactccgtgacccctgaggtccagtgtgatgacgcggcggtccggagcgaggccggccatctgatggcggaacatttcctgggtctgtccccagccgtgcagcatgaccaggggaacgccgtcgcccccgctgtcccggtaggtcagccgcacgtggtcgttcgtggtcagctcgctcatggtccctgtctcatcttcctgcccagccttcacagcgcactgtgctccgcgctgtgtcggcaatcctcgtgatggccggccgacgtcgcgtcggctgcagcctgaacccattgtcatgcgatgaggcttctcgccaccaccgcgttccgtagggattggtcgacgagaaccacgtcacttcgtagtgacggagccgaccggcacggcaggccggtggctgtccgtccgctcagacggcggtggtcggcccgtccggttgcagcagatcccggatacgcaggccgaggtgcaggaccaaccgatccgcgccgctgtccaggtccagcgaggtgatctcctggatctggcgcagccggtagtacaacgaggtgcggtggatctgcagcgcttccgccgtcttcgggaccgatccggcgtgctccaggaaggaccgcagggtctcctccaggcgggggccttgccccccggcggccgagaggagtgcgcgcagcggcttgggcaggagggatgcgttcagggcgcggtccggaagctggagaaggaccgcgaactcccgcagctcctcccactcgccgacgcgctcgaagtggggcatccgccgggccgcacgggcggccacgagtgcctgttcgtaggagaccaacgcctcggccacgccggtctgacaccctccgatgccgagcacgggagcggcggcggagtccaggaaggtgtcgagggcttcgatgatccggcgggactgctccttcagttcgtgcggtgtcggcgactgctcgctcagctggagcaggaccgcacggtcggtggtgaacgcgaccgcgccgtgcgccgacctggtgcgacagaacctctccagcgcagcacgcagcgcggtctcgatctgcccgggtggctcgtgggaacgaaccacctgcacgacgctgaccacagcgtgccgtgcgtccggaagcacgccggtgtccaggatctgctgctgggcgacgcggcgcgcggtggggctcgcgtcgagcagggcccagggaagatcaggggcgccgctcccctcggcttggccggccacgttctccgcgtacatcaccgggaggcgaggtaagcggcaggccgccgaccccggccgacctccggtcgatggcggcctcgtcgtgaccgccctccgtgaggaggcgtttgcggaaccggacccacttggccgccgacccgatcagcccgatggaaccgaggtgggccgtccgcggggcggcgtcgcacagagcggcgtcctcggcgtggtcatgggtcgtgatcaggacgtgggtgccgcgcgacaactcgtcgaggacctcctcgggcagcagcgggctggaccagcggcaggaccactgccggcaggtccagcggctggccgcggacgaaagcccatctctccggggggcgtccgccgcgtgcccgcagggggccttcccgtacccggcgccacacgaatcacgcgaacgcgtgatggcagcccggggccgctccacgatgctcggtccgcaagctgactggatgctgcggcaggaggcctaccgtgacctgttctgtgcccacgaactcccggcccgggaggctgaaccatgggtgaacaccggcgtgacatcgatatcgcggtcatcggggcgggcgtgctcggactcgcgaccacggacagtctggtgcgccggggcgccgacgtcgtctgcttcgacgggcgggttcccggcagtgggctgtccggcgggctgacccggacgttccggcaccggcacgacgacgagcggcacgtcgcgctcgccgtggacgggcgcgccgggttcgccgagtgggagcggcgcagcggaaaggtgctgatcggtgacgagggcgccgtctacgccgggatggggcccgccgatgtgaaggggctggccctgcacggcgtggcgcaccacttcgtcgaggcgggcgggcaggactccgtgttccccgggctcgctccggtggacggtccgctgctcgtcgaccccggagcgggagcgatacgggccaagcacaccatcgacgcgctcgtcgggtgggtgcgcgaccggatcgtcaacgcccacatccacagcgtcaccgtgccggcggacggggacggcgtggagatccagaccaccgaggccatctaccgggcccggcacgtcgtgatcgccgcgggcaccgccgtgccgtccctggcccgcggggtcgggatcgacatccccctggagtcgcggctgcacgtgcgcccgcacttccgggtccgggggtacgagcccggccgcacccgggcactgccgtgctgggtggaccgcgccgggatctggggcgagaccgtgtacggatcgccgatcggcgacaccggccggtacgtgatcgggctcatcggcaccgaggtcgacatcccgttcggcccggacggcgccctgcccgagggcagcaccaccctggacgacgcccggcgggtcgtcgactacgtcgagcgggcgctgcccggactcgatcccgaacccgtgggcgtacgggtctgtgtgatgaccaagctgccggcggggagcgacgcgctgcgggcctggcatacccccggggtcacggccgtcgcgggacacaacctcttcaagatggcgcccgttctcggcgaactgctcgccgacacggccctggaggaccggctgcccgaccggctggcggacgccggggccggggctctggtcgcaccgtgacggccgctcccaccggccggatcgcggtgaccggcgcaaccggaaccctcggcaccgccctcgtacgggagctggcggcgcgtggtcaccggcccctcgcgctcgtccggccgggccggggcggggtggtggcagggccggccg

SEQ ID NO: 3028 - DNA, 10651 bp, Unknown
  Kingdom: Bacteria, Phylum: Actinobacteria, Class: Actinobacteria, Order: Streptomycetales, Family: Streptomycetaceae, Genus: Streptomyces
tcggcgccgccaaggagccgtagatagtggggccttcgaccgtgttggtcaggtagatccggagcaggaaactgccgaggacccacatgcccagcgccatcagcgccccggggacgtcctcgatccagggcgaacgcaccggcacggacacgtggtagagcgtcgtgaggaacgcgacgcccagcagtatcacgagcggccagtacaggacggctatgacctcggtgccccatggcaccagctcgaccacccggtccgggccgacgaccagcagcggcagcaccacagcgccgatcagcagggcgacgacgtacagcaggaaggcgagcagccgggtcttgacgatgccgcggtggccgtcgagtccgtacatgacggtgatggtgtcgatgaagacgttcaccgcgcgggagccggaccacagggcgatggcgaagccgatggagatgatgtcggggcgggccccggtcgtgacgtcggcgagcagcggtttggcgaagtcgttgaccccgcgctcggacagcaccgtctgggcggcggagaggatgttgcgttcgatggaggcgacggtggtggtggtcgtccactcgtcgacgtaaccgagcagtccgatcatgccgagcagcagcgggggcagcgagagcagggtgaagaacgccgcctcggccgcgagtcccagaatgcggtactcgatgcacgagttgacggtgtccttgagcaagtgccacgccatccgccgtttggagacgttgcggtagagcactcgcgcccggtggagccggcccggtggccgctcgggtgtttcatttgctgcctgcacgtccttaccgtatcggcatggcagccaccacccacacagtgaccaatcaggttccgccgctggtcggctatgacgtcttcgccgccgaccgggccctgtccgaggccgtcgagcggcataccgcgcccggggtcctgcccgtggcgctggaggaactcggcgagctcggccgggccgcgggctccgcccaggcccaggagtggggtgcgcaggcgaacgcgtatccgcccgtactgcgcacccatgaccgttatgggcatcgcatcgacgaagtggagttccatccgtcctggcaccggctgctgagccatgccgtgtcggccgggctgacggacgcctggggccggccggccggtcatgtccggcgcgcggcggggttcctggtctggacgcaggccgaggcggggcacggctgtccgctgtcgatgacgcatgccgcggtacccgcgctgcggaccgatccggcactggccgccgagtgggagccgctgctgacctcgcacacgtacggggaagggctcggggtcccgcggcggaagaccggggtgctgttcgggatgggcatgaccgagaagcagggcggcaccgacgtgcggtccaacacgacgcgggcggagccgctgtccggcgagggcgagtatctgctcaccggtcacaagtggttctgttcggcgccgatgtcggacgccttcctggtgctggcgcaggcaccgggcggactgacctgcttcctcctgccgcgcgtgctcccggacggcacgcgcaacgtgttcgcgatccagcggctgaaggacaagctgggcaaccggtccaacgcgtccgccgaggtcgagttcgacggggcctgggcccgccgggtcggcgaggaggggcgcggggtgcgcaccatcatcgagatggtggcggccacacggctggactgtgtggtgggttcggcggcgctgatgcggcaggcggtggcgcaggccgtccatcacagcgcgtaccgcagtgcgttcggcgggccgctgatcgacaagcctctgatgcgcaacgtgctggcggatctggcgctggagtcggaggcggcgacggtgctggcgatgcggctcgcctccgcgtacgacacggacacggcacaggagcgggctttcctgcggctcgcggtgcccgccgcgaagtactgggtcaccaagcgctgctccgccgtggtgggcgaggcgctggagtgcctgggcggcaacgggtacgtggaggagtcggggatgccccggctgttgcgcgaggcgccgctcaactcgatctgggagggttcgggcaatgtgcaggcactcgacgtgctgcgggcgttgcggcgggagccgcaggcgctggacgcgttcctgcgcgaggtcggccacgcgcgcggggcggatcaccggctggacgcggcgatcacgggtctgctgacggagctggccgatctggagggcgtcgaggcgcgggcgcggcgtgtggtggagcggatcgcgctggtgctccagggttcgctgctggtgcgctgggctccgccggaggtgtccgacgcgttctgcgcctcgcggctcggcggggactggggctcggcgttcgggacgctgccgcacagtctggacctggcgtcggtggtggcacgggcccggccggccggcgggtagcggggaagcgacggagggtggtgctgcgccgacacggcaccaccctccatgcttctgcatcaccgggcgaccgggacaggcccggcgcacagtgttctgccagtcttgtacggcccgcgggacaccgccagagttgcaaggggttgcaaccattgtgtggactgatcggcggtccggccaggtgaacggcaggatggggccgggagcgggatgcgttcggggggaacggggaccatgacggacacaggtgctgcgggggtggtgcgagtgacgggccagggggcgggtcggcaggcgacccgactgctccaccgggcgagggaggcacggctgacggggacacggtcggaggtcgcgccccgggcgcagatcgacgcctcctgggaccgggtggtgcgcagcggcatcgaccccgaccagtcgccggagagcgagctgctgcaggcggacgagatcgagcaccggcgccacagcacggcgctcggcgagctgatgccgttgctgcgggcggggctggcctcgatagcggatgccgcgcagcagatcatggtggtgaccgacgccgagggccgggtgctgtggcggcagggcaatacgggggtgctgcgccgggcccacgacatctgcctggaggaaggggcggcctgggccgaggcggcgaccgggacgaacgcgatcgggacggcgctggccgtccgggtccccatccaggtccactcggccgagcacttcatccgggcgctgcacggctggacctgtgcggcggccccggtccgggatccgcgcgacgggcggctgatcgggatcgtggacatcagcgggccggcgtccacgttccatccggcgacgctggccctggtcgactcggtggcccggctcgccgagggtgagatccgcacccgtcatctggcggagatcgagcggctgcgcgcggtggccgcgccgatcctgtgccggatcggcgggcgggcgctggccgtggacgtgcacgggcggctggcggcggtgaccgggatggctccggtggaccggctgccgctgccgaagtcgatggggccgggtccggtgtggctgtcctcgctcggcatgtgccgggtcgagccgctgccgggcggctggctggtgcaggtggacgacggcggagcggaggggacgtcgcgacgggtggtgctggacctgagccggccccgggcgctcgccgtgcatctgaccgggccgctggggaaccgcacgcagcggctctcgccgcgccacgcggagctgttgtacgcgctggcggtgcaccggcagggacggtcggcctcggagctggcgcgggacatcttcggggacgcgacccggacggtgacggtccgggccgagatctcccggctgcggcgtcatctggcggaggtgctggcgcaccgtccgtaccgcttcgcggacggggtggaggtggaggtggtccacccggaggagcgcgcggatctgctgccgcactccagcgcgccggtggtggcggaggcccgcagggcggctccgccggcttgagcggggtcgcggggcgcgcgcggccggtccgcggaggggccgccgtgcgcgggcgggcggcggcatggttttctggccgtcatgagcgacaccccgcagcccgcagcccagagcgccgaggcgaccaccgaagtgaccggcgaggtgaccgtctggtcgctggagcagacctcgcccgccgatctccggcccgccgccgtaccggagggcgatctgcgcatcgtccggtccgaggtggtgctgccggagttcagccggttcctctactccgccgtgggcggcgacatccactggaccgaccggctgagcatgtcgtacgcccagtggcaggaggctctggagcgacccggggcggagacgtgggtggcgtacgagaacgggacgccggccgggtacgtcgagctggacccgcaggacgacggcgtggtcgagatcatgtacttcgggctgatcccggcgttccgggggcggcggatcggcggccacctcctcagttacggggtggcgcgcgcctgggacctggcggagcgctggccggaccggccggcgacgaagcgggtgtggctgcacacctgctcgaaggacggcccgcacgcgatggacaactatctgcgtcgcggcttccggctcttcgacacgaagaccgaggtggagccggacgtggcgacgcccggtccgtggcccggggcgtacgcctcctgatcgtccgtgacccctgagggcggtggagcggtcgctccgccgctctcagaggcttcccgtgggcgatttgccgtcaatatccacgtcgcggcccgtgacgggcgccacatcgtcccacacttcgagacccagccgtccacatagcggatagtggtggactgcccagagatgcgcgtgacacgcttccgtcatgtctggaactgggattgccttggtgagtcgacgccacgtcgacctctgccgcatgtccagcgccatctgtccggcgagctgagagtcccagcgccgccgcacccctcttccctctgaaccgccctgcgcaccgccgcgcctcagcgcgagtgtgccgctcagagccgccctcccgcagtcccgaaggacgtattgtcatggccgctaccccggaacagcctgcgaccaccacgccccgccgcaaggccggacgccaccgtggcgagggtcagtgggccgtgggccaccacacccccctgaacgggaacgagcagttcaagaaggacgacgacggtctcaacgtacggacacgtattgagacgatctactccaagcgcggcttcgactccatcgacccgaacgacctgcgcggacgcatgcgctggtgggggctgtacacccagcgcaagcccggcatcgacggcggcaagacggcggtgctggagccggaggagctggacgacgagtacttcatgctgcgcgtccgcatcgacggcgggcggctcaccacgcagcagttgcgggtgatcggggagatctcccaggagttcgcgcgcggcaccgccgacctcaccgaccggcagaacgtgcagtaccactggatccgcatcgaggacgtgccggagatctggcggcggctcgaagaggtgggcctgtccaccaccgaggcctgcggcgacacgccccgcacgatcctcggctcgccggtcgcgggcgtcgcggagaacgagatcatcgacggcacgcccgccatcgacgagatccagcggcggttcatcggcaaccccgacttctccaacctgccgcgcaagttcaagacggcgatctccggctccccgcacctggacgtggcgcacgagatcaacgacatcgccttcgtcggcgtgaaccaccccgagcacggccccggcttcgacctctgggtcggcggcggcctctccaccaaccccaagctcggggtgcggctcggcgcctgggtgccgctggacgaggtgcccgacgtgtacggcggggtcatctcgatcttccgcgactacggctaccggcggctgcgcacccgcgcccgcctgaagttcctggtcgcggactggggcccggagaagttccggcaggtccttcaggacgagtacctgaagcgcgagctgaccgacgggcccgcgcccgaggaacccgcccagacctggcgcgaccacctcggggtgcaccggcagaaggacggccgtttctacgtcggcttcgccgcgcgggtcggccgggtcgacgggtccacgctcaccaagatcgccgagctggccgacgcgcacggctccggccgggtgcggaccaccgccgagcagaagatgatcgtcctcgacgtggccgaggagcaggtggagtccctggtctccggactggaggcgctcgacctcaaggtcaccccgtccccgttccggcgcggcacgatggcctgcaccggcatcgagttctgcaagctggcgatcgtcgagacgaaggcgcgcggcgcggccctcatcgacgaactggagcgccgcatcccggagttcgaccacccgatcaccatcaacatcaacggctgcccgaacgcctgcgcccgcatccaggtcgcggacatcggtctcaagggccagttgatgctggacgagagcggcaaccaggtcgagggctaccaggtgcacctcggcggtgcgctcggcctggaggccgggttcggccgcaaggtccgtggcctgaaggtcacttcggccgaacttcccgactacgtcgagcgggtgctcggccgtttccaggaggagcgcgaggacggcgagcgcttcgcgacgtgggcggcacgcgccagtgcggagtcgctgtcatgagcgagcgagccgccccgttctactgcccgtactgcggcgacgaggacctgcgccccaacgagaccggtcacggcgcctgggaatgtgcttcctgcaaccgtgcgttccagctgaagttcctgggtctgctgacccggggcgtacagcgcaacgacggtgaaggggacgggatatgacgggcactctgccggacggaccgatcggcgacgaggagctccgggagctggccgagcaggccggacgggagctggaggacgcctccgcacccacgatcctgaagtgggccgccgacaccttcgggtcgcgcttctgcgtcacctcctcgatggaggacgccgtggtcgcgcatctggcgtcgcgggtgatgccgggcgtggacgtggtcttcctggacaccggctaccacttcccggagaccatcgggacccgggacgcggtggacacggtgatggacgtcaacgtcatcacgatcactccccggcggaccgtcgccgaacaggacgccgagcacggcgagaagctgcacgaccgcgaccccgacctgtgctgcgcgctgcgcaaggtcaagccgttggaggacggcctgaccgcgtacgccgcgtgggcgacgggcctgcgccgcgacgagtccccgacccgggcgaacaccccggtcgtcggctgggacgccaagcgccgcaaggtgaaggtctcccccatcgcccgctggacccaggacgacgtggatgcctacgtcgccgagcacggggtgctcaccaacccgctgctgatggacggctacgcctccgtcggctgcgcgccctgcacccgccgggtgctggagggcgaggacgcacgggccggccgctgggccggacggggcaagaccgaatgcgggctgcacggctgatgctgatgacgactgatcaggagacttcgatgagcgtgacggagacgggagccacgatctggctgaccggtctgccgagcgcgggcaagaccaccatcgcgtacgagctggccggccggctgcggaccgagggacaccgggtggaggtgctcgacggcgacgagatccgcgagttcctctccgcgggtctcggcttctcccgcgaggaccggcacaccaacgtggcccggatcggcttcgtcgccgaactgctcgccgccaacggcgtgaaggtgctggtccccgtcatcgctccgttcgccgacagccgcgaggccgtccgcaagcggcacgccaccgagtccaccacctatctggaggtgcacgtcgcgacccccgtcgaggtgtgctccgtacgcgatgtgaaggggctgtacgccaagcaggcggccggcgagatcagcggcctcaccggggtcgacgacccctacgaggcccccgaatcgcccgacctgcggatcgagtcgcaccagcagaccgtgcaggagtccgcagcggcgctccacgcgctgctcaccgagaggggcctggcgtgagcactgtcgccaccgtgccggaaggcaccgtcaacccgtacgcgctcagccacctggactccctggagtcggaggcggtccacatcttccgcgaggtggcgggcgagttcgagcggccggtgatcctgttctccggcggcaaggactccatcgtgatgctgcacctggcgctcaaggccttcgcgcccgcgccggtgccgttcacgctgctgcacgtggacaccgggcacaacttccccgaggtcctggagtaccgcgaccgcacggtgaagaagcacggcctgcggctgcacgtcgcctccgtgcaggagtacatcgacgccgggaagctccgcgagcgccccgacggcacccgaaacccgctccagacggtcccgctcaccgaggcgatccagcagcaccgcttcgacgctgtgttcggcggcgggcggcgcgacgaggagaaggcgcgcgccaaggagcgggtcttctccctgcgcgacgagttctcccagtgggacccgcgccgccagcgccccgagctgtggcagctgtacaacggccggcacgccccgggtgagcacgtgcgggtcttcccgatctccaactggaccgagctggacgtctggcagtacatcgagcgcgagtccatcgagctcccggagatctacttcgcccacgagcgcgaggtcttcgaccgcaacggcatgtggctcaccgcaggtcactggggcgggcccaaggaacacgagaccaccgagacccgtctggtgcgctaccgcacggtcggcgacatgtcctgcaccggggccgtcgactccgacgccaccacgctggacgccgtgatcaccgagatcgccgcctcccggctcaccgagcggggcgcgacccgcgccgacgacaagatgtccgaggccgcgatggaagaccgcaagcgcgaggggtacttctaaccatgaccacacccatcctctcggccgagcggttgtcggccaccactctgctgcggttcgccacggccgggtcggtcgacgacggcaagtccaccctcgtggggcgcctgctgcacgactccaagtcgatcctcaccgaccagctggaggccgtcgagcaggcctcgctgaaccggggtcaggaagcgccggacctggcgctgctgaccgacgggctgcgggccgagcgcgagcagggcatcaccatcgacgtcgcctaccgctacttcgccaccacccgtcgccggttcatcctcgcggacaccccgggccatgtgcagtacacccgcaacatggtgaccggcgcctccacggcggagctggccgtggtcctggtggacgcccgcaacggggtcgtcgagcagacccgccggcacgccgccgtcgccgcgctgctgcgcgtcccgcacgtggtgctggcggtcaacaagatggacctggtcgactacgcggagcccgtgttcgccgcgatagccgaggagttcaccgcctacgccgcgtcgctcggcgtcccggagatcaccgcgatcccgatctcggcactggccggtgacaacgtggtggagccgtccgcgcacatggactggtacggcgggccgaccgtcctggaacacctggagaccgtgccggtcagccacgacctcaccgcctgccacgcgcgcttccccgtgcagtacgtgatccgcccgcagagcgccgagcaccccgactaccgcggctacgccggtcagatcgcggccggggtgttccgggtcggcgagaccgtctccgtactcccctcggggcgcaccaccacgatcatcggcatcgacgcgctcggggagagcgtcgacatcgcctgggccccgcagtcggtgacgctccggctggccgacgacatcgacatctcgcgcggtgacctgatcgccccggcagacgactcccccgccgtcacgcaggacgtcgaggcgaccgtctgccacgtcgccgaccagccgctctcggtgggccagcgggtgctgctcaagcacaccacccgtacggtcaaggcgatcgtcaaggacatcccctcccggctcaccctggacgacctctcccagcacccggcacccgggcagctggtcgccaacgacatcggccgggtcgtcgtacgcaccgccgagccgctcgcgctcgacgcctacgccgactcccggcgcaccggttcgttcctcctgatcgacccggcggacgggacgacgctgagcgccggtatggcgggggcgtcgttcgccgcggtcgccgaagccgccgccccggccgccgacgaggacgccgagtgggacttctgatggccaccgacttcttctccaccttcgcgaaggagggcggccgagtgggcagcggtgccctcggcagcggtcagggcggggtcgggcgatgtgcgtgatgacgtacgcgcac

SEQ ID NO: 3029 - DNA, 1999 bp, Unknown
  Kingdom: Bacteria, Phylum: Actinobacteria, Class: Actinobacteria, Order: Streptomycetales, Family: Streptomycetaceae, Genus: Streptomyces
ccgcccaccggtccgtacgggcccggccatcgcggcgtggacctcgcggcggggccgggcgcccgagtgctggcggccgccgacggccgggtgtcgttcgcggggcgggtggcgggacgcggggtggtcgccgtcgaggtggccgacagcggttcgccaccgctgcgcaccacgtacgaaccggtgcgggcgctggtcgaggagggcgcgagcacccgggcagggcagccggtcggagtgctggaggaggggccgttccactgctcggaggactgtctgcactgggggctgcggcgcggggacgcctatctggacccgctctcgctgctgccgccctcactgctgcgcaggggaccctcgcggctgctgccggtgttcggggtgccggagccggacgccgtccgggtcagccgctcacaccgcgcaggaccatcgcgacgacggtgtccgcgatgacgtccggctcctccgcgacgcccagttcgatacggcgcacggcggcgtcgaccgaaccctgcatgagcatggcggccagcctcggctgtacgtggccgaggtctccgagcgcctcgacgatcatggcgatcagcccgccgtgagcggcccggatcttctcccgggcacccgcgtccagctcgctcgcggagatcgcgacgaccgcgcggtgccgacggtccccgacgaggtcgagctgccggcgcacatacgcctcgatcttcgcctcgggggtctcggcgccccgcatggcgttctcgacctcggccgcccagacggggaagtcgacggcgcacagctcctcgacgacggcggcacgggagcggaagtactcgtacacggaggaccgggcgaggcccgtgcgctcggcgagcgcggggaaggtcagcgcctccgtaccgccctcggacagcagggagcgcgcggcgtccaggagggcgccgcgctgcatggtccggtgctcggccacggaggccgctcgaatcctgggcacgcctccactctacggcggcaggcgtgcgggggaagggtacggccgccgatcggatggccggagagtgccgggaaggggacgtcagcgacccgcgtcggccagcttcgcccggagctggagcacggatttggtatggatctgactgacccggctctcggtcaccccgaggacgttgccgatctccgcgagagtgaggccctcgtagtagtagagggtcaccacggtcttctcgcggtcgggcagggtgttgatggcccgcgcgagcagtcttctcagctcacggtcctcggcgacctccaccggattgtcggcggcggtgtcctccagggtgtccatcaggctcagtcggtcgccgccctcacctccgacgtgcagcaactcctccagggcgaccacgttcgccagcgacaactggctgaaaacagcgtgcagttcctccagcgcgatacccatctccgaggcgacctcggcctccgacggcgtacgccggaactgcgcctccaacgtggcgtacgcgcgctccacattccgagccttctgccggacggaccgcgggatccagtccagggcccggagttcgtcgatcatcgcgccgcggatcctggtgatcgcgtacgtctcgaacttgatggcccgttcgatgtcgaacttctcgatggcgtcgatcaggccgaagactccggaggagacgaagtcggcctgctcgacgttggacggcagccccacgctcacccggcccgcgacgtacttcacgagcggcgagtagtgcaggatcagctgctcccgcagccgctcgtcgcccgtggtcttgtaggaacgccacaactcgtcgagggaggagggggcgggggggcgcacagtgccacgcgcaaccggtggtactgccgcgcggtcagacccggaggtgtgctggggcatgtggtgccttgagccgttctgccgtgaagtgctgggggacttttgtctggggcggaatccttgtgagcgtagcgtgactgcgacgtcgcagtc

SEQ ID NO: 3030 - DNA, 11077 bp, Unknown
  Kingdom: Bacteria, Phylum: Actinobacteria, Class: Actinobacteria, Order: Streptomycetales, Family: Streptomycetaceae, Genus: Streptomyces
gtcacggggtgggctccgtgttccagggggcgttggacggtcaggcggcgtcggcaaacagccggtcggcggcgatgccatgcgcggcagccagcaggcggcgggcaggcctggcgccggccacggcggtcaactccgcagccagtgcggtctcgtcagcgtcgggcgtgaggagccggtccgcgagctgctcaacagtgggcaggacagtggtgggcagggtcatcggggtccttccggagacagagcgggggttcacggctgctggggtgtttcggtgcgggcgtcatgcaaggcctcgcggtgctgctccatggcctcttcgcgggtgctggcgttctccgtgctggtctcgatgattcggtggccgagcttccagccttcgaggcgcttgccctgggtgtcgtcgaagacggtggtctcgtaggcgcggaacccaacctggatggtggacacggtgagctcggtgtcgccgttcctgacgggggtgtggcggacgagtcgagaagtgtgcattggggtctcctaggcggcgagtgcgagcttggcggcgacgaggcggtaagcgggcttgcgtgccttgtagttggcggcgatgaccgcgacctgggtgccggtgccgcgtcggcggatgcgtgcggcggcccggttggcgatctggcgggccttcaaggtggcgcggcgggtgcggttgctggcgatcacgagtccccctcgggtggtgcctgtcgttcgccatcgcgcttcactagcgatcatgtgttgcgctggcgatgactcagacattacgcctgaggcatggccaccgcaagtgggttgcgatagattggtgccatgaatccgaccccgccccccgagtcccccaccctggaggacatcgccgcagcaggcacacgccgactccgcgacgccgatcggctcaagaagtccagcgacgaactcaaggaactcgtcctcgccgccctcagggccggaacccacaagcccaccgaggtcgccaagcagtccgggtggaccggagcccacgtcaggaaaatggcgagggaggcaggcatcgagcctgatgaccgctacaaggagcgggccgaccggctccgcaaggctcaggcagaggagccctcatgaatgtcgccgaggtcgaggccctcgcgtccgccgcgcacgccgaccagttcgacaagatcggcgtcccgtacatcgaacacgtccgcgccgtcgcggccggtctcgcaccgttcggtgatcacctggtgatggccgggctgctgcacgacatcatcgaggacaccgactggaccgccgagcggctgcgcgaggagggcatcccggatcatgtggtcgcgctcgtcgtggcggtcacgaacgaacggggtgtcccctacgaggagaaggtggcccgcatcaccgggcagggtcgggacgcggttctgttgaagatcgcggacaacgcgcacaacagccaccccgaccgggcagtcaagctgtccgaggagcagcggacccgactcgccgcgaagtaccggacggcgcgcgacatcctgtggcccgccgtcgagggccgtgacatcgagaccatagtcaggatcgtcaacccgtcgctgctcgacgaactccgcgagcggcagacctctgggagccccgcatgaccgttgccttggtggccttcctccgggcccagttcaccgaggagttggagaaggtccgtttcgcgagcggcacggtcacccaggatcccgagcggttcggtgtcgaacccgagcaggccgcagcgcacgcccggttctccgtcgccaccgccgaagtgcacctcgcgctcctggaggacaccgtgatcccgcacctgggaaccgagggggcggccggccggactgccgagtaccagctgcggctcctcgccgcaccgtatgtcgagcacgcggactacccgcacgagtagctgccggcctgccgggaggtgccgcaccgccacgacgcgaggcccccgcaccgtgctggcgcgggggcctcgttgcgtatcaaccggagccgatcaggtcaccggtaggacccgctcgacatggcgtgtaccgagttcgacgactgccgtggcggggtctggccaacccgcccgtacaccctctcgtgacgggcgtcctcgatcgcctggcgcttcgccaactcggctcgccagatgcgctgttccacccaccggcccgtgggcttcttcgccttcttcttcgccatgctgcccctccccctgagttggggatgagagtagcccgggcgcgagaaggggcgctaggccccgtatgggcgttctccccccgccgcccccgctcccccggcacaatgcctgcatggcgaggtacacggttcatggccgcacgcagcaggagtgccaggacgccctggatgacctgcgtcggctcctcgacgtcaccgtgacgctatcgccgacggatcggctgggcgggtcgtggatcgcccgcgcggaacacaaggcagccccagaccctagggtccggggctttgccgtgcggtgagccgaaggtaaacggctgccagtcacgcgaggtttcgggcgttcacaccattaggtggtcgagacgggatcgggctctcaaacgcttacgggtgtcgttgattcgagtggagcacatccgtgcttcacgttcacgtcaccccccacccgcatctgcttgccggcgataaggggcggggggtgacgcctcacagagggatcagctatggatcaatcccctgcgggccagggactgcatgcccctggccgcgacctggcagcgcctggtcgcagttctcatccggccaccgactcggtgttggtgttggtgggcggcgtgtcgttcaccgagctggtcgccgtggaggggctggacccctggttggcgatcgggccggctgtgacgctggttgcgtgcttgaagttcgcggtgtatgccccggctggtgtggggttgttgcgggacaaggtgcttcggttcatccgttcctgacctcctccctgtgctgcgccccggttcgccacctgcctggtggcgtgctggggcgtttcgcttgtacacgctaagtcaacgtctatagcgaattacagttcttgaatctgtgacggcgtcacccgtttggaggatgtggccctgtgggtctagtcacggccccccacgctttgagtatgcctgcgtcatatgccggacggtttggccacacgacaccgtccgccgccctgccgcatgacgaggccccggaccagaaggtccggggcctcgtcgcgcggaggtctagtagtcgtcgcggccttcgccgagccgcaccttcaactccttgatcttcccgctggtactgagctccgcgtacacgttgcggtccccctgcacgttcccctcccgcgcctgcttcacgaactcttcgagctcgtcgaacgtcatgtccttgccttcgccgctgaacgtcaagctgagtgccatgcggtcatattggcgggtcggcacgggttgcgctgccagttcgggcaaggtcactctgcttgctgggagttgagtgcggcgaccgcgttcttggccgtttcggcgacgacccggccgacggcttcgtcgtgccccttgagtgctgcagccagggcgtcggctcgcgcccggtcgtcggggtcttcgtcgacgggcgggtcgtaggtgtatgccccggcgtcggggggcgcggggtcggtgccgtgcgggtcccgatcggactgccaggcgaccgggaagtcagcgggaagccagtcctccttgagccacaaggcgatggtgaccgttccggcgtcggggtgctcctcgcggaactggtcgacgatcaccggggccgcgtcccactcgatgagtggggtgtcgaacgacgtgaacccggcggcgaggagggttcccaggcggcggtcggtgatgcgccaggcataggtccgtactgccacgtcagtcgtcccaggacatttcggggaccgcgggcagtccggctgcctctcggcgggccatctcggcgcgcaccgagtcggcggcctccaggctgaggccgggggcggtctggccgaggagcgtgtcggcgtgggcgtccggctcgtggtcgtcaccgatgtagggctgggtcatggtggggcctttctggttggtgttggtcgccctacccgcgctcggctcggtggagtccggccgggtgggggcgtgtggtggtgagtcgaatttcgtggctggtgtgacgcctgttaactggccgggttacagcccgaggacgtggtacgggaacggttcgcgttcccaccggacgccgctgttgttgatccagtaccagtggaacgggaactcgtcggcacccaactccatgagggcaaccgcccggtggtgcccgtcggcgacgtacacgtcggtcgggtaccgctcgctgatgccaagctggataggtgtagtcaggccctgcttcggaatggtttccagcaggttgtcgatgatggcccggtccttgtcgcggcggtcgaagcggcgctccgcgtcccgccacttgcggtactcggtgggacggatctgcttgtcgttgagcagctcgaccggcatgcgaccgacgtacttacccatgggtctcctcagtgatggttgcgggtgttggcgatgacgccgcgggtggtgctggtgacggtgcgggtgtcctggtgaacagccccgtggaagtgattggtgaccggtgtcggggcagcctcggccacttctttggcgttcttcatcagccccttgagggccagcacgggcaacgtgagggcgacggggacaccaacgatgccgccgcagatccaggcgatgaccgtctcgttggcgtgacccgacgtccacaggacggcgctgactgcgcccccagcggcaagggtgagaaagctgctggtgaggatggtgacgttgcggtcgacggccttcgcgctcatcgaggcgcggccgggctgctcgacgggcggggtcgggccgacagcggggagcggggtggtgtcgcggtggaaggtggtcagttcggccgtgagtgccgtctcgaccgcgtaggcgagcttgcggacttcggcgcggtcggtggggtcgggctgcccggcgtagacgggctgctcgggcagctgcatgacagtctcctcagtggttgtcgacggcccagcggccgttcacggggcggatggtgaaggccgggccgttgacccggttcgatacggggaggatcacgccgatgcccaggcggtcgatggcgttgagcagctcggcgacttgggcggcgtactcgacggcctgccgttcgcggcggcggagctcggcaggggttccggtgaacacgggtctaccggtcctggttgcggcggcgggtggatcggtaaccgaacggcccaggaagatccatggatgtggtgcgccggccggtggagctgatcgtgtggcgggggccgcggccggatccgagggtgatagaccaggacagccggttgatgttgagccggaccccgggcaggatccggaaggacttgcggaacgtgatcggcatgagggctcctatgcggtggtggtctggtcggcgcggtgctttccggtgcccgcgcagagcgggcagacggtggtggtgtgctggctgtttcgggcggagtagagggcccctttgccgccgcagcagaagcacacgccgcgggtggcggcggccttctggccgagtggggtgttctgggcttcccactcttcgtcggtcattgaggacgtctcgtcggtcttggtgaccggctcgccctgggtgacgggcttgggttcggcggcgggctggtcggctccttgcccgtaccaggcgccgccgacggtcttcccgccgtgcttcttcttctcgtgttcgcggagcgccttggtggcttccttggcgtcccggaacttcggcttctctttcttgccgcaggggcaggtccagccgacgagcccggtgcgcttgtcggggctgaaccgggcggccatggcgaccttgacccgactggccttcgccttggtcggcttggcggggcagggcttggatccgttgaatgccccggtcttcttgtccttggtgaagatctgcccgttgccgtggcaggtggggcacccttcgtgggtcatgcggaggatcgcggcgtctttgcgggtcatgacggtggtcttgtgggcgtccatctgcgaggcggcgaggatggccatgcgcatgccgatccgggcgtggagcggcaccgacttggggaccttgaggcctttgccgatgcgggctcgcgggacgggcttccggcggcgtgcggccggcttccgggtggcagtggtggtcttcgcgggcatgatcggcggatcctctcgtcagacttcgcatatgtggatcaatggggcgtctatgggccgtctagcccccgactatgggccgtctatggcccggctacctgcggtgatgcgtttccgggcagccggggcctagacggggtgaaaacgggggttaggcggcctcaagacgggccttagacgggtcgatcagccccgccgcgacctgttcgacggccgcccgggaccatccgcgaacctgcgggttgtcggcccacttcccgcggcccgctttcaccatcggggcatgcgactggaggatccgggcgagcttggcactgtccatctcgggagccgctacaccttcaagggccgggagcagcacctcgctggtgggcaggaaggcggcctcgtgctcctcgaaggtccgcagcagttgcgcgacgaccacggcgtggtggtggcttatgccgtcgagccggtcggcgagactcacctcaccggcagcaccgccgcggcggatcacgtggagcaggtcggcggcggccaggctgtcgtggtcgaaccaagggcggccggctgcggcccggtccttgacggcctgacggatctgctcgcggtcgaaacggttccaccgccacaggacgggccggaggaagccggggcctgcgatgtagaacttgcccgcgtcgtagatccgctcgtcgtcaacagccggcctgaggcggtccggccggtatccctgggcaactgcgcccttgccgaggacgagggggatgtcctcactacgggcagcaagcatgacccggtaggtgacggcgctggcaatggcgtcaccgagggaatcttgggtggcctcctgggcggcgaagatcaggtagacgccggtttcgcgtccgatgcggagaatctcgatggcgagttccttggcctccggagcgaggaagatgaactcgtcgacgagcccgtagatggcggggtgcttggggctcggctcccacaggtcacccatctccttgcgggacttgacctggttgcgggcggaggcgatgtcgcgaagccagcggagggttgttgtgcagtcctccttgccgcgcacaggcggaatagccatgacgtcggaaaactcgcggatgccgtccttgacggggtccatttcgatggcgatggcgtcacggcacgcggtgatggcttcggcgatgcaccgcagggcccccttggtctttgccgacccggacgaaccgatgatcatcatgaacatgccgcgcagccgcagttcgaacgccgacccgtccatgcaacgcccatacacggcggcgtcacggaccgacatgctgttcggggcatgcaccgtaggccgggccatgtccgcgaacggatccgaggtcacgagccgcagcgtgaagtgcgccgacgcatcggggtcgggctcgatcagcgtcccgccgcggggcacgtcgaagatggagtccaggtcgtcggcgaccgcgttgaccttgcccagcgacgagccgttcaggacgacgtcgacttcccagccccagcctcggtagccgagcacgtcgacgccgcgggtgccgatgcccttgtaggcgagggcccgggacacgcactcggtgacctgctcaccgctggtgcagtgcgaaagcgggaacgggtcgtcgttggtggggtcgtcctgtccggcgatgacctggtcaggctcgatgcccggggcgttgagccggtaccggccgtagagggctgtggcggtggctgcgaggaggccggtggtggtcggggggatggcccacgagtagtcgagggcggtcattccggcctgggcgacgagggcccaccagccggccaggttgagcccggcggtgatcccggtgctgataccgaggagcttccaccgggcacggcgctcgcgcttcacgaagttcaggtcggccttggaggagacgccgccgatgtagtccatgacgtcccgcccgcggatgtaccggtagccgaggtaggcgccagccttgagcccggcccagaaccagccgccggcgacgagggatccgtaggcggtgagaccgacggcccgcccggtgaaggaggcgacgaccatggccgccgacccggcctgccggaggacgggggtgcggtccgggaaggggatgaggaccccgggggcgatgtcgtcgacggtgccgtcgtcgttgtggatgagctgcccggggatgaccttctcggtccactcggcggggatcgtcagcggctcggcttcggtgctcacttctgctcctcggtggaggtccgttcgatgcgcgcctggttgcgcgcgagggggctggggggctgcgtgtcaccggctcgacggcggggtggcacgcccccgtttccgcggcgcccgtcgggggcgttcgggtccttcttctgcttggggggtcgatgggaattgatcagcgaaaactcaccgaaaaccggggtcttcgtagcggcctgcatccgggcctctgcaccgcgtgactgcgcttcgatctcgggggtgattccgacggtcttcgagccggtgacacgaccccacgcctcggtccaaatctgctcggtgacgtactgcgaaccgcgcgccgaccgaatcgcttcggcgacctcccacaccttcgggtggccgctcttccgatcggcgtcccgacgctcctgctcctcccttgcgcgggcctccgtgatctggcggtctgcctctgcggcaagctcggcgtcgcgctgtgcctgctgctccttcttgagggctgcggaggcttcggcctgggctcgtgcgacggcccggcgttcccgccaggaggggatgccgtcggccttctgtgccatgccgtgctcgtaggccatgaggacgagggggccgccgagggatgcgatggcgccgatgaggccggcgttcagcccgatgcgttcgtcggagagaccgccgtgaaggttgacgactgcggcaatgaccgcgccgaccatgattccgatgcggtagggggcaacgtcccgccggttggcgacggcccaggcggcaccgaacgcgaggacgagagcaaaaccttcgaggaggaccggggcagcaacgagaaagggtcgctccctgtcccagaagtgcatgaactgcaccggcccggcgatgatcatgccgacggcgtagatggcgcgggcgccccacttccaccagtgctcggaccgtccctgctccgcctcgcgcttggcttcggcggcttcacggtcggcttccgccttttccgccttctccttctcggcgttcgccttggcggtttcggccgccttcttcgcgacgtaggcgtcgtggtcgacctgcttgcgttcctgcgccagccgggcacgctcgttggtgaggcggagcttctcggcctcttcggcggcgagggtacgggcggcgtcggcctcaccttcggccttgacgcggagggcctcggcttcagctgctgctctggtgcgaacagcgtccgcctcggcaagcgcaaccgggtcgaaccggggctcggaggtgggccgcttgtggccgttcacctggggcgggctggtcgtcacggcggttcggttccttcctggggtgggtggtcaggcggtcttgcggcgggtggggaaccagaggcggcgcttcggctcgggctcggcctgcagctcgggcggcatcacgaaggtgatgggctcgggaagagcgcggcaagcctcggcgtgcttctgggcccaggcgcgggcggcgcggtcacccttgtcctggttctggaactcggtcacgccgggtcggcggtagttcggaaagctgtcagcccaggactggacagtgactgccctgcacccggtgcacttggcgcaggttgctctcttcgtgccgtcctcggtttcgttgcgatgggtgaggtcgacggtggcgccgacgagggtgaggtaccgggcgatgacgtcctcgggccaggcggtctgcgcgatcatggcggtgcccttcaggtcagcggttcgcggtctgggtcttgagccagtcctcgacgtcggcggcgagcccgccgtcgtcttccggctggtccgggtcggggtcgtcgtcttcgtcgtcggggtagtcgccgcagcactggcactccaggtccgaccagatccggcccgactgccacagcccgtgggccagggcgccgaccatgtcgagcgcccaggcggggccggcgacgagtaacgcggcggcaagcaggtggtgcccgccgggggtgccggtggctacgaacagcccggcggtcgcgattactccggcgggcacccaccggtggtgcccccggttcaggagcaccatccgggggtggtggactaggtcgcgggtgaggcagatcaggtcagcaatcgggcggggcaggttcatgtggggctcccagcggtggcgtgttggcgggcacggtgaaactcggcgacgaactcgtcggtgatcccagccccgacgaacccgctgaccgggggccggccgagacgctgggccgcccacaactccaggaagatcaggcgggtggcggtgtagttgacgaccgggcgggcgcagcggaccaggaggaccaccacccccagcacggtcatcacagccagggcaagaactcggagagtccacacccgcaccccagcggcggtacgccggaaccatccgggcttcgcggtgatcaggtacgggtgcacgggactaccggctggtctcggcggcgactgcggcgtcccgcacctcggcgagcgccgcggcaatccggccctcgtccccgccg

SEQ ID NO: 3031 - DNA, 6918 bp, Unknown
  Kingdom: Bacteria, Phylum: Actinobacteria, Class: Actinobacteria, Order: Streptomycetales, Family: Streptomycetaceae, Genus: Streptomyces
  misc_feature (581)..(582): n is a, c, g, or t
gcgttcgctgttgcggatcaccccggtcgccgacagccacctcgccgatccgtgggtcgggcacgcgtggacgtacgagccgttggcggttccgccgggcagccgcgtcctggaacaagtgctcgcggcggtggcagccgcccgtcgagccgccggccgctgaccacaccggccttcctgacctgcgattttgacgagtgctttaccctttcctttacctttccttggtgatgcctgtactgttcggggaacggaggggagtactccttacgcgacgtcccgtcaatacggaccgttatcggtcccggggcgccggcccaggcacgcgcaccgcgtgcggggtggaagagacctccggcagcgacgacgctgatcagtagccgtagcgaactgccggaggcgcagtggacgtttcatggaccgtttgggttctgaccattcttggtctgtcaaccctgatcgccgtcgacttcttcatcgggcgcaagccccatgacgtgtcgaccaaggaagccggaatctggacgatcgtctggatcgcgctggccgtgctcttcggagccgggctcgcggtcgtcggnngtcgacaacctcttcgtcttcgtcctgatcatggccaagttcgcggtcccctcgcagcttcagcagcgggtgctgctcatcggtgtgctgatcgccctggtgctccgggcgatcttcatcgccgccggcgccgccgtgatcgcgaacttctcgtgggtgttctacatcttcggcgcgttcctgatctacaccgcctggaagctcattcaggaggcccgggccgacgaggaggaggacgacttcgaggagaatcgtctcctgaagtcgatcgagcaccgcttcggtgtcgccgacaagtaccacggcacgaagctcttcatccggaacaacggcaagcgcgtgatgaccccgctgatggtggtcatgctcgccatcggcatgaccgacgtgctgttcgcggtggactccatcccggcgatcttcggcctgacccaggacccgtacatcgtcttcacggccaacgcgttcgccctgatgggtctgcgccagctgtacttcctcatcggcggtctgctgaagaagctggtccacctcagctacggcctgtcggtcatcctcggcttcatcggtgtcaagctggtgctgcacgccctgcacgagaacggcgtgcacgtgcccgtcgtgtccatcccgttctcgctcgccgtcatctgcggcgtcctggtgatcaccacgatcaccagcctcgtcgccagcaagaagcaggcggcggccgaggcggagaaggacgcgaaggcggagaccgccgacccgtccgacgaggagagcaagagcgtcaacagctgacccggggccgccccgagcggcacagggacacaccggcagcggccggggcggtaacggcgaaggccgtccgccccggccgctgccgtatgcgtacgcgggagaggtgcgggagggagggctgcgggctaccagccgcgggcacgccactcggggagctggggccgctcgtcgccgagtgtcgtgtcgtgtccgtggcccgggtagacccacgtctcgtcgggcagccggtcgaacagcttcgtctcgacgtcgtgcaggaggctcgcgaacgcctcgggatcctggcgcgtgttcccgaccccgccggggaagaggcagtccccggtgaacaggtgcggagcgccgtgcgggtcgtcgtagaccagggcgatggagcccggggtgtgaccggccagatggcgggcggtcagttcgacccggccgacggtgaccgtgtcgccgtcctcgaccaggacatcggtcgggaccgggatgccctcggcgtcgtagcggcccgcgtacgtccgggcgccggtcgccccgaccacctcggccagcgcctgccagtggtccccgtgccggtgcgtggtgacgacggaagcgattccgtcgtcaccgatcagcgccagcagggtctccggctccgcggcggcgtcgatcagcagctgctcgccggtcgcccggcagcgcagcaggtaggcgttgttgttcatctcgccgacggcgaccttggagatcatcagatccgtcagttcgtgcacgctcgccggtccgccgaccttcaccgctccgctgtacgtcatacggctcagcctatagcggaggcagcgcgggcagggggccgccggccacggtcagggcggagccgtcacggcggccgcagagccagcccagcagctcggcggcgggcccctgcaccgtcaccagcgcgtccggcgggccgccgccggtgccccaggtgcggccgtcaaggtcggtcagcgcggtggcgggcacatcctggttgcccaggaagcgttcggtcaggaacgcgatctcccgcgacacgaactccgcgggcaggtcctccagctcgtagccgacgtcgaggtcgacgtggtgcagctccacctcgacccagcgccggaagggcacccgggcggcggagtcggtcacaccgttgcgcagggtgaccgtacgggaccagtcggcgggttcggcggcgaccgccaggaagccgtccgcggtctgccgcagatcggccagctgctcggccgccgggcggggggcgccggcggcgatgtcggcgtcgcgggtttcgctgctcgcgtacatcgggcgtccccggagaacatttccgatcgcgtcggcgttacgtgacaggtgggccagaacatggccccgactccatccgggcaaccgtgacggcccggcgacagcggcgttgtccagtttgccgactgcgtcgagcagtcgttcggtcgcttcgcgtacagctcccaggtcgtgcgcatgatcaatcatgcggtcgagcctagctccgccactcattcgggtgaaggagtccgagggcggccgtaaatcgaatgtgcgtgctatacgctcggaatcgaaagcttcttacaccgctgtggcgccccccataccctgggagaggggctcagttcccccgcttctctctagaaaggtgcggaccggcgtggccgaccgtctcatcgtccgtggcgcgcgcgagcacaacctgaagaacgtctcgctcgacctgccccgcgactccctcatcgtcttcaccgggctctccgggtcgggcaagtcgtccctcgcgttcgacacgatcttcgccgaggggcagcgccgctacgtggagtcgctctcctcgtacgcccggcagttcctcggccagatggacaagccggacgtcgacttcatcgaaggtctttcgccggccgtctccatcgaccagaagtcgacctcgcgcaacccgcgctcgacggtcggcaccatcaccgaggtctacgactacctccggctgctcttcgccaggatcggcaagccgcactgccccgagtgcggtcgtcccatcgcgcgccagtcgccgcaggccatcgtcgacaaggtcctcggcctgccggaaggcagccgcttccaggtcctctcgccgctggtgcgcgagcgcaagggcgagttcgtcgacctcttcgccgacctccagaccaagggctacagccgcgccagggtcgacggcgtcaccatccagctctccgagccgcccacgctcaagaagcaggagaagcacaccatcgaggtggtcgtcgaccgcctcaccgtcaaggacagcgccaagcgccggctgaccgactcggtcgagaccgcgctcggcctctccggcggcatggtcgtgctcgacttcgtcgacctccccgaggacgaccccgagcgcgagcggatgttctccgagcacctctactgcccgtacgacgacctctccttcgaggagctggagccgcgttccttctccttcaactcgcccttcggcgcctgccccgactgcaccggcatcggcacgcgcatggaggtcgacccggagctgatcgtccccgacgaggagaagtccctcgacgagggtgcgatccacccctggtcccacggccacaccaaggagtacttcggccgcctcatcggagcgctctccgaagcgctcggcttccgtacggacatcccctgggccgggctgccgcagcgggccaagaaggccctgctcttcggccacaagatccagaccgaggtccgctaccgcaaccggtacgggcgcgagcgcgcctacaccacgcccgctttcgaaggcgcggtgcagttcgtcaagaggcgtcacaccgaggccgagagcgactccagccgggagcgcttcgagggctacatgcgcgaggtgccctgccccacctgcgagggcacccggctgaagccgatcgtgctcgcggtgacggtgatggagaagtccatcgccgaggtctccgcgatgtcgatcagcgagtgcgccgagttcctcggccgcctcaagctgaacgcccgcgacaagaagatcgccgagcgggtgctcaaggaggtcaacgagcggctgaagttcctcgtcgacgtcggcctggactatctgtcgctgaaccgcgcggccggcaccctgtccggcggcgaggcccagcgtatccggctggccacccagatcggctccggcctggtcggcgtgctgtacgtcctggacgagccgtccatcggcctgcaccagcgcgacaaccaccggctcatcgagaccctggtccggctccgcgacatgggcaacacgctcatcgtcgtcgagcacgacgaggacaccatcaaggtcgccgactgggtcgtcgacatcggccccggcgcgggtgagcacggcggcaaggtcgtccactccggctcgctcaaggaactcctggccaacaaggagtccatcaccggccagtatctgtccggcaagcggtccatcccgaccccggacgtccgccgcccggtcgacccggcccggggcctcaccgtgcacggcgcccgggagaacaacctccaggacatcgacgtctccttcccgctcggcgtcctcaccgccgtcacgggtgtctccgggtccgggaagtcgacgctggtcaacgacatcctctacacccacctggcccgcgagctgaacggcgccaagtcggtccccggccgtcacacccgggtcgacggcgacgacctcgtcgacaaggtggtgcacgtcgaccagtcgccgatcggccgcaccccccggtccaacccggcgacgtacaccggagtcttcgaccacgtccgccggctcttcgccgagacgatggaggcgaaggtgcgcggctatctgcccggccgcttctccttcaacgtcaagggcggccgctgcgagaactgctccggcgacggcacgatcaagatcgagatgaacttcctgcccgacgtgtacgtcccgtgcgaggtctgccacggagcgcgctacaaccgggagaccctggaggtccactacaagggcaagtccatcgccgaggtgctggacatgccgatcgaggagggcctggagttcttcgaggccgtcccgacgatcgcccgccacctccgcacgctcaacgaggtcggcctcgggtatgtgcggctgggccagtccgcgccgaccctgtccggcggtgaggcgcagcgcgtcaagctggcgagcgagctccagaagcgctccaccggccgcacggtctacgtcctggacgagccgaccaccggtctgcacttcgaggacatcagcaagctgatcaccgtgctctccggcctggtggacaagggcaacacggtcatcgtcatcgagcacaacctcgatgtcatcaagaccgccgactgggtcgtcgacatgggccccgagggcggcaacggcggtggcctcgtggtcgccgaagggacgccggagcaggtcgcctcggtccccgccagccacaccgggaagttcctccagtccatcctggacgcggaccgcgtcagcgaggccgctgtgccctccgggcgggggacgacccgcaaggcggccgcccgcaagaccgctccggcgaagaagacggccgccgcggccaagaaggccgcggtgaccaaggcgaacgccacgggcgccaaggcggggacggccaaggccgccgcgaagaaggccacccgcacccgcaaggcctgagcggggccgagcggctgcccggcccggcagccgctccccccgcgccgacgacggcggcccccgcagcacgaagggggccgccgtcgcccgtcggagcaggcgatccggcccggtcgcagggcttccgatccccgccggtatcgtcggttctgtcaccggcacgcagggccgccgtcgccgccctgtccggcgacgcggatccgccgtgatccaccccggaacgacccgccccaccgtgatccaccccgaacaacgacccgtggagtccgcatgcccggcctgcccgccgcccgccgtaccgtgctgaagggtgccgcgctcgccggcgccgccgggctgggagcggccgcctgctccaccgagtccaagctcggccacgccaagaaccccacccccaccgctcccgtcgacctcggggacgcctccgaggtgcccgtcggcggggccaagctttaccgcgaacagcgcctggtcgtcgtctgcccggcgaagggcgagtacaaggcgttcagcgcccagtgcacccacggcggctgtgtcctggacaaggtcgagggcaccgagggccactgcccctgccacggcagccgcttcgacatgaccaccggcgagccggtgaagggcccggccaccgtgccgctgccggccgtcccggtcaccgccgagggcggaaagctcgtcgcgggtcccgacgcctgaaccccgcgggaaggcctcactcccagtcccagtcgaccccgatcaggccgggccgtacgttctcctccaccaggtgcacggtccggtgccggccggtcagcgtgaggtccgcgcgggcgccgcgcgccgctcccgccgaggcctgggcgaaccggcgg

SEQ ID NO: 3032 - DNA, 3016 bp, Unknown
  Kingdom: Bacteria, Phylum: Actinobacteria, Class: Actinobacteria, Order: Streptomycetales, Family: Streptomycetaceae, Genus: Streptomyces
cggcgcgcgcgccgcggacgagcggcaggcacgggtgctctcggagcccgtgggtgccccgctgctcacgatggagcgcaccacgtacgacgacaccggccgagcggtcgagttcggctcgcacgtctaccgggcggagcggtacgccttcgagttccagctcctggtacgcgcctgagcccatccggggtgaagaggcgagcgccgcgtcggcatgttcggacaaacggttgacgtggacatgtggtgcgactagaactcgctgcaccgaaggacgcgtccccaccggccctgccgggcgggagcgggcggggctcggggatacttgggcagccgggccgggaccgtaaactctccggccccgtcaagcagcacagcgagcagcagtagaagggcacggcgtcgtggcaagggttcggacaggggtacgcgcgatgggcgccgtgctggcagtggtgctgggcgcctccctcgcgggatgcagcagcaccggcggcaagcgcgccgaggagcgcgcggccgccgcggccgagggacgggccgcggtgaacacaccgcgctggaccttcgccatggtcacccactcgggcgacggcgacaccttctgggacatcgtccagaagggcgccgagcaggcggccgtgaaggacaacatcaacttcctctactcgcacaacgacgaggccaaccagcaggcccagctcgtccagaccgcgatcgacaagaaggtcgacgggctgatcgtctcgctggccaagccggacgcgatgaaggccgtggtcgccaaggccgtcaaggcgggcatcccgctcgtcaccgtgaactccggctccgcggagtccaaggagttcggcgcgctcacccacatcggccaggacgagtcgatcgccggtgaggccgtcggcgacgagctgaacagccgggaccgcaagaaggccctgtgcgtcctgcacgagcagggcaacgtgggccacgagcagcgctgcgccggagcgaagaagaccttcgacggcacgatgcagaacctgtacgtcgacggcaccaacatgcccgacgtcacggcgtccatcgaggccaagctccagtccgacaagagcatcgacgcggtcgtcaccctcggagcccccttcgccgacgcggccgtccaggccaagcagacggcaggcagcaaggccgagatcgacaccttcgacctcaacgccaaggtcgccaccggcctccagaccgacaagctcggcttcgccgtcgaccagcagccctacctccaggggtacgaggccgtcgacctgctctggctctaccgctacaaccgcaacggcctcggcggcggcctccccgtcctgaccggtccgcaggtcatcaccaaggacgacgccgacgcactggccgactacaccaagcggggcacgcgatgagcggcaccaccgccgcaccggagaaggtggacgagcggctggtgcgcacctcgccgctgcgcaagctgctcggccgccccgaactcggctcggtcgtcggcgcggcggccgtcttcctgttcttcgcgatcgtcgccgacagcttcctccaggcctccagcttcggcaccgtgctgtacgcggcctccgtcctcggcatcatggccgcaccggtcgcgctgctgatgatcggcggcgagttcgacctgtccgccggcgtcatggtgaccagctccgcgctgatctcctcgatgttcagctaccagatgacggccaatgtctgggtcggcgtcttcgtgtcgctgctggtcacgctcgccatcggcgcgttcaacggcttcatgctgacccgcaccaagctgccgagcttcatcatcacgctcggcaccttcctgatgctgaccggcctgaacctcggcttcaccaagctcatcagcggcaccgtctccaccaaggccatcggcgacatggagggcttcgactcggcccgcgcgctgttcgcctcgacgctgaccctcggcggcgtcgagttcaaggtgacgatcctgtggtgggcggcgctcgtcggcgttgccacctggatcctcctccgtacccgcttcggcaactggatcttcgccgtcggcggcgaggccgacgcggcccgcgcggtcggcgtcccggtcatccgtaccaagatcgggctctacctgggcgtcgccttcgccgcctgggtctccggccagcacctgctgttcagctacgacgtcgtccagtccggcgagggcgtcggcaacgagctgacgtacatcatcgccgccgtcatcggcggctgcctgatcaccggcggctacggctccgcgatcggctcggccgtcggcgccttcatcttcggcatgaccagcaagggcatcgtgtacgccgagtggaacccggactggttcaaattcttcctgggagcgatgctgctcctggccaccctgctcaacgcatgggtgcgcaagcgcgcggaggcgacggcatgacggccacccctggagctcctgcggcgggagcgaccgccggaccgctggtcgagctggacgacgtgtccaagttctacgggaacatcaaggccctggaacacgtctcgctggaggtccacgcgggcgagatcacctgcgtcctcggggacaacggcgccggcaagtccaccctcatcaagatcatcgcggggctgcaccggcacgacgccggacgcttcctgatcgagggggaggagaccgcgctcgccaacccgcgcgacgccctggaccggggcatcgccaccgtctaccaggacctcgccgtcgtccccctgatgccggtctggcggaacttcttcctcggctcggagcccaccgtcggcgtcggccccttcaagcgcctcgacgtccggaagatgcgcgagaccacccgtaccgaactgctgcgcatgggcatcgacctgcgcgatgtcgaccagcccatcggcaccctgtccggcggcgagcgccagtgcgtggccatcgcccgcgccgtctacttcggcgcgaaggtcctggtcctggacgagccgaccgccg

SEQ ID NO: 3033 - DNA, 1250 bp, Unknown
  Kingdom: Bacteria, Phylum: Actinobacteria, Class: Actinobacteria, Order: Streptomycetales, Family: Streptomycetaceae, Genus: Streptomyces
cggcggcggccagcagcggccccaccgtgagggggatacggggcccgatccgccgccccagctcccccgaccaggcggagaacagcagcatgaggatcgtggtcggcagcagcgcggtaccggcccccagcgccgagtacccggcgacgacctggagctggatcgcggagaggaagaagaagccgccgagggccgcgtagacgcagaaggtcaccaggttgaccgaggtgaacaggcgggagcggaagatcgacggcggcagcatgggatccgcccgccgccgctcgaccaggacgaacgccactccgagggccggcccgccgagggccgacccgatcaccaacggcgacgcgccccgccccggggcctcgatcagggcgtacgtcaccccggcgagcgccagcgccccgaggacggcccccagcacgtcgaaccggccgtgcgccgccggatcccgcgactccggtacgtgccggagcgcgacgggcacgcagagcgcggcgagcggcagattgagcaggaacacccaccgccacccgggtccgtcgacgagccacccgcccacgaagggcccgacggccgccccgacgccgccgaacccggaccagagccccacggcccgggcccggtcgtccggatggaaactggcctggatgatcgcgagcgaccccggtgtgagcagcgcgccgccaaccccttgcagggcccgcgcggcgacgaggacccccgcgttcggcgcgatcccgcagagcaacgaggccgccgcgaaccacaccacccccaccacgaacacccgccgccgcccgtaccggtccccgagcgccccgccgaggaggatcagcccggcgagcgtgagcatgtacgcgttgacggtccactggagcgcggccatgtcggtgccgaggtcctcgccgatacgcggcagggccacgttgatgaccgtggagtccagcatcgccatgctggagccgagcacggtggtcagcacgacccaccgcccgacggacgaggcgacccgaatctctccggtcgcgggggcatcagccatgggagcagcatcccggctgctcccgccccctgccaccgggacccgcaccccacggaccggaggcacgaatccagcccctccggcgatcgaggagcgggggcgcgggactacggcccgcaccccacggacccggggcacaaatccagcccctccagcgatcgaggagcgggggcgcgggactacggcccgcaccccacggacc

SEQ ID NO: 3034 - DNA, 5408 bp, Unknown
  Kingdom: Bacteria, Phylum: Actinobacteria, Class: Actinobacteria, Order: Streptomycetales, Family: Streptomycetaceae, Genus: Streptomyces
atgacgcggcaggccctgccggacgcgtcgggcagggcctgccgcgtcatcgggccgtcttcgtcctcgggtacccgaacccctcgcgcgttcaacggccgggacgcccgtcgggccggtcgtgccgctcctggcggcgcgcctcggcctgccggcgtcggccctcgtccctgcggtcctggtcgtcgagcgccttgccgtccgattccgtggccagtccgcgggccttcagcaccttggcccgcagaatcctgcgtacgtcacgcatcgtgtcctcctgtgcggtcagcggtagttcggttgtcgagcggttcttgtctcctcgtcctgggcacgcaccccaggttccgtcatgtgggtgcgcctgctcctggtggctcgcgccgctgtagaggagtgaccccgaacggccctgccaaacatggccgccgctcgccgctccgggcacgggccgtgcgccgggggtccgtcgtaggctgaatccctcgttccggccggcaggggacggacgagtgacgaaccgaccaacaggaggccggggtggccgcagggacgccgaccgacgcgacggtggccgaggtgatggccgagctggccgcgctggaggatccgcgagcgcgcgcggtgaacgagcggcacggtgacgatcacggggtgaacctcggaaagctgcgtgccctcgcgaagcggctgaggacgcagcaggaactcgcgcgccggctgtgggagacggacgacaccgcggcgatgctgctggccgtcctgatctgccggccgaaggcgttcgagcgggacgcgctggacgccatggtgcgtgaggcccgcgcgcccaaggtgcacgactggctcgtgaactacgtggtgaagaagagcccgcacgccgaggacctgcgcctggcctggaccgccgatccggaccctggggtcgcgagcgtcggctgggcgctgaccaccgagaacgtgcggaagaagcccgacgccctcgacctcccggggctgctcgacgtcatcgaggcgcggatgaaggacgctccggaccgcctgcagtgggcgatgaaccactgtctggcacggatcgggatcgaccaccccggcctccgcgcccgagccgtcggcatcggtgagcggctggaggtgctcaaggactatccgacctctccgggctgtacgtccccgttcgcgcccgtctggatcgccgagatggtgcgccggcaggacgccgcgtagccgatgcctccggcggtcctcatttccgggcgggcggggggtcgcagccttcctccgtcgcggccggtgcagaggcgggagtcggggccgggccgcggacgcggcgcggtccgatgagcgtgacggtggtgagcacggcgacgaccgcgagcgccgcggacacgcccagtacggctcgggcgccgtcggtgaccgcctgcgcgccgtggccgccgtggagggtgaagaccgcgccgagcgccgcggtgccgactcccgcgccgagggaggcgagggtggcgacgatcccggcgaccatgccgacccgttcgggagccgtgacctgcacggcgacggccatcacgggtgcgcccgcgatcccgccgcccgctccccaggcgagcagcggcagcagaagcgcccaccacggggtgccgggggtgatcagcaatgccagggcggcgaggccggcccccttcagcgcgtagccggcgccgatgaccaggccgggggcccggtcgccgatcagcttggagccgaccatgcccatgacgatctgggcgaggaagatcggggtcatcagcaggcccgccgcggtcgggcccaggccgaggccgtcggagaagtacagcaccaggtagaccgagccgccgatggtcaggacgcgcgagagcaggacggcgagcatcgcgccggagaacgcgggccggccgaacatccgcagctccagggtcggcgcgggcacccggagctggagggccaggaacgcggccagcgccaggcaggcggtgagcagcacgacggtctcccgcccggaccagggggcgtcgccggggcggagcatcagcagcgtcccggtgccgagtccgagcatgagcagcaggctgccgagccagtccgtccgccccgcctccgaagtatccggggaacgcggcagcacgtgtacggcgagaacccaggcggccacgccgaggggcaggttgaccgcgaagaccgcccgccagccgaaggtctcggccagcaccccgccgaggatcggtgcgagcaggcccgccgccgtcgcgaacgagccccaggcgccgatcgcgaggttgcgctcctcgcccgcgtagcggtcggagagcagcggaatcccgttcaccatgatcgcggcggctcccgctccctggaccacacgggcgacgttgagccacagcagatccggcgccacggtcgcggccagggaggccagggtgaacacggcgataccggcgaggaacagagctcgtcggccccaccggtccgacaggcttccgacgacctgggtgagcgcgcccatcgcgaccatgtacgtcaccaccacggactcggccgaggctccgcccccgacgtcggcgctgatcagcgggagcccgatggccacgatcgtcagatcgacgaccaccaggcccgtggaggccatcacgagcaccagaaccccgctcagcggcggaagacggcgggacttctgagcaggcatgcgggaaccggcttccgggcgtcggggctacacggacccgcacggcgagagcgggcggacgggcccggacggcccgtgcccgaccagcctggccgcacccaccgttaaagtcaacatgtgtgaagttcaagcgggaccgtacgctgtcgccatgcctgccacgcctcgccgccgacccgccacgcgcaagggccgccccgtcctcacccgcgagatcatcgccgccaaggctctggagatggcaggcgcacaagggttcccgtccatcacgatgcgcgccctcgccgccgaactggacgtgaccgtaagggcgttgtacaactacgtcgaagatcgcggggaagtcgtcagcctggccgtcgacctcatgctgacctcctggaacccgcccccgctcgaccccgcggcctgggagacctccgtcgccggctacgcccgctccctgcgcgcgctctaccgccgctggccgcgcgccctgctggtatccctggacgaggagacgcccccggcctcggtgcaccccaaccgcctgctcaacctggaccgcttcctccggctgctgcgggacgtcggcctggacctcccggcggcgctcgcggcgcaccgccatctctccctgctcgtgctgtccttcgccctcgtggtcgacgggcccgccggccgggccggggacgaccggaccacgctcgtccccgaccactggctcaccgctcacgccgacctcgacatccccaccctccgtcaggcggccgcactgcctcttcccaccgcggacgagcagttcgaccagctcgtcgccgccgtcgtcgaccggatccgcggcggactcagcgccggctgacggccggccggtcccggtggagctcccggtgcggttcccggtggatgggctccgcgcctccggtcaggggcaggcccgtgccgccccgccgggccgcgacgatctccgccgcgatggacagggccgtctcctcgggcgtacgggctccgaggtccaaaccgatgggcgagcgcaggcggtccagctcccggtcgctcaggccggcctcgcgcagccgccgcgtccggtcctcgtgggtgcggcgcgatcccatcgcgccgacgaacgcggcgggcctccgcagcgcctccgtgagcagcggcacgtcgaaccgggcctcgtgcgtgagcacgcacagcaccgtgcgcccgtcggtgggggtactccggagatagcggtggggccagtcgacgacgacctcgtccgcctcggggaagcgggcccgggtggcgaagacgggccgggcgtcgcacaccgtcacatggtggcccaggaactttccggcccgtaccagcgcggcggcgaagtccaccgcgccgaagacgatcatgcggggcggctccacgctgctctcgacgagcagggtgagtccgccggggcagtgcgttccgtcctcggagagggtgacggtgccggtgcgcccggcgtccagcagggccgaggcctcggccgccgccgtacggtccagctccggagttccgccgaggccgccctcgtgggtgccgtcggcgcggacgagcagggcccgtccgaggaagccgtccgggccgctcaccacccgggcgagtgccgcccccgcgccggagaccgcggcggacagcgcggcctccagcaccgtgcgttccggcgagtcggcgcggaccggcgtgaccatgatgtcgatgaccccgccgcaggtcagcccgacggcgaaggcgtcctcgtcgctgtagccgaactgttcacgcacggtcacgccgtcgccgatggcctgcgcgcacagttcgtagaccgctccctccacacagccgccggagaccgagccgatcgcggtgcccccgctgtcgacggcaagggccgcgccgggcccgcgcggtgcgctgccgccgacggagacgacggtgccgacggcgaactcccggccctccgccatccatcggtgcagctcaccggcgatgtcaagcatcagccgctcccgcgcccgccccggcggagtcggacacggccgccgcgaggacccggtcgggtcggatcggcaggttccggtggcgggcgccggtggcgtgccagaccgcgttggcgacggccgccgccgcgcccacgatgccgatctccccgacccccttgatgccgaccgggtcgtccgggtcgtggtcctccacccagtccgcctcgatgtccgggacgtcggcgtgggtggccacgtggtagccggcgagatcgggggcgtagtgaccgccgctgttccggtcgcggaccgcctcctcgtgcagggccatggagatgccccaggtcatcccgccgaccagctggttgcgggcggtgagcgggttgacgatccggcccgccgcgaagatgcccagcatccggcgcacccggacctcgccggtggcgatgtcgacggcgacctcggcgaactgggccccgtaggagtgccgttccttctgcgcgagggtcccgagcgcgtcggtggtgtcggaccgcacggtgatcccctccggggggatgctcgtggccaccgcgagccgctcccgcagttcggcggcggcggccgtgaccgcccaggcccaggagcgggtgcccatggaacctccggcgatcatcgcggggccgaagtcgctgtccccgatgcggacccggacgtgtccgggttcggtccccagggcgtcggcggcgatcagggtc

SEQ ID NO: 3035 - DNA, 1003 bp, Unknown
  Kingdom: Bacteria, Phylum: Actinobacteria, Class: Actinobacteria, Order: Streptomycetales, Family: Streptomycetaceae, Genus: Streptomyces
gggctcggcgagtccgatgacggggtcgagctcgatggtcaccaactcgggcacccgcagccccagccgacggccgagctctccacagatgatctccgcgacgagcgtcttgcggccctgccccgccccggtgaacttcatgacgtacgtgcccaggtcgtcggcctcgacgatgcccgggagcgagccgccctcacgcaggggcgtgacatagcgagtcgctacaacttcttgcaacactttcccaggccacccatcttttcagccttacaatcaacggaggtccccagcaggccgcagaggccggaaccgccggtcgacacgccgcgccccttgctgccggcctccggcatgaagtgagcatagtaaccgagagtgatcgtcggcgaggaatgtccgagccaccgcgccaaggtcacgacggactctccggcttccagcacgatcgaggcgtaggcgtgccgaagcacatggaaaccgtcctccggggccgccgcccactgccggtctttcgccccctgggcacgtggcgggatgacaccggcctcggccaaggccggcttccaggtgtaggtgttccctgtgttcaccgcgatggcattgccgccctggcggagtccgcagcccagaccgactacgacggcggtccgctcgttgatggcatcgcggccccgcagtgccgcggccatcggccacgcgtcgcgccgctcccctggctgcttgggccgccgcacagatttgcgtgcacggggttccacgcgaggcgcctgtcgtcgacgaccgcttcccggatggaggaaagctcggacaggatgccgcgctggtagtggaccgacgagcctgggccggcttcctctcaggagtatcgccacatcggatctgcgcgcgttcgtagtcaccttggagtcgacagtgcgcttccccttccgccacttcccggtcaacgccgcctggtgcgaactcagcctcgcggcgatcgacctcctcgccgcgacccgcgtcc

SEQ ID NO: 3036 - DNA, 9129 bp, Unknown
  Kingdom: Bacteria, Phylum: Actinobacteria, Class: Actinobacteria, Order: Streptomycetales, Family: Streptomycetaceae, Genus: Streptomyces
gaacgccatgccgccgccgtgcgcgtccagggaccgtacggcggcggcatggcgttcacgggactcggcctcgtccagcgagccgtacagcgtctcgcgcagcaggtcgtgggcgaaggcgtactgcccggacgggcgggggacgacgacacgggcgacgacggccggctccagcagccggtccacgtggggggccggtgcgccgtgcaccacggccaggacctgccggcggaactcccggccgagcagggcggcgctggtcagcagggagacgaccggctcgggcagtagggcgagccgctgccggaccgcttcccggacgccgggcggaatggtggagaccgggctcccgctgtgccagagccgggcggtctgctcgacgaagaaggggttgccgccggtgcgccggtggacctcgtcgatcagctgcggggcgggctcgcggcccgtcgtcaccgtcatcagcgcccccacctcgtcccggccgagaccggtcagcgtgagggtcgtggcggcgcgcgagaccagcggcaggatcagctgctggagggggtgcccgggggcgtccacctcgacgtcccggtaggtgccgatcagcagcagccgttcgaaccaggcgtgctgggcggcgaattcgagcaggcgcagggaggccgggtcggagctgtgcagatcgtcgaggacgaccaccagcggccggctctgggagaccgtgacgagggccgtggtcacggcgtcgaagagtccgaaggcctcggctccctccggcgaaccgccgcccggcgggctcgtgtccgcttccgtgccgggctcgccgccgcgcaccccgtcggaaccgggggatgcggcggcccccggagccggaagtgtgctgggtcccggtccgtccgtaccgcccatggcgaccctgaccgggtcgcccaggagcacggcgaggcggccgtccgacgcctcctgggccgctgcccattcggccgcggtggcggaccggcgcaggccgcgcaggatctggacccagggccagtagccgggggtgttgtccgagtcccagcaggaacctccgaccaccagtgctccgcgccgccgtgcctcgtgcgcggcgtcggtgacgagcgtgctcttgccgatcccggcctcgccggtgaccagcacgagaccgccgtggctgtccgtggcccgggcgatctccgagcggaggacgcctgcggggtggtcgcgcccgaacagagcaggggtcatgaccacacgataggagcacccactgacaacggccccttcgttttcctgccgtttcctaccgtcgaagcggctcagccgcttttaaccgtcgcaccggctcagtcgcccttaccgccgagcctgctcagtcgcgcacgactgtcaccgggcacggcgcgtgctgggtgacatgaaggctgaccgagccgagcagggtggccttcaggccggtgtggccgcgggctcccacgacgagcaggtcggcgccccgggcgcggtccagcagagcctgggccggattgccgatgaccacgaccttgctgaccgcggcggctccctcggcgccgagggcctcctccagcgcctcggtgagggagacggtggccagggcctgcgggtcgaagtcctccggcatgcccggcatcatcgacgcccagctggtggcggggtactcccagctgttcacggcctccaccgcggcgccggtcagctcggcctggcgcacggcccagtgcagtgccttgatcgaggagtcggagccgtcgacgcccacaacgatcctgcccatttctgcctccagctcgataacgcggtagcccggtacagcgcggtacggagcggtcctgttctgtcccgcttgtacagcgtttgatctcactgtagtcacatcggacaagtgggggcgggtcagggtgaaccgcccccacggtctcgttcagggacgtgccggtacgaacccgcccccacggcctcagtccagccgcaggtccgcgagctgctgctcgaaggggacgaccgcgtcctccccgtcgtccaggcccggagcccgcgaggccccggagaccgtacggcccaggaccgcggaggccagctcgccgcccgcgcgccggatccgggacggcaggccctcggtgtactcgtcgcccgaggagccccagtcctccgaggcggcgtagacggaggtgggcacggtgacggcccgcaggtaggcgaagagcgggcgcagcgcgtgctccaggaccagcgagtgccgggccgtcccgcccgtcgcggcgatcacgacgggcttgccggtcagcgcggtgttgtcgatcaggtcgaagaacgacttgaacagaccgctgtacgaggcggtgaacaccggcgtcacggcgatcagtccgtcggcctccgtcaccgcgtcgatcgcttcccgcagcgtggccgaggggaagccgctgagcaggtggtgggcgatgtccacggcgaggtcgcgcacctcgatgacctggacctcgacgttccggtcctgctcggccgcgaggcgctcgtgggtggcggcggccagccggtcggccagcagccgggtggaggacggctgactgagcccggccgagacggcgacgacgcgcaggggtgtggtggcgaacatcggggtcagacctccttctcggtgctctcggcggtacgggtggttccggcggtacgggcggtgcgggcggctgcgaccgtcgggtggacgggcgcggactccggcactccggccggccgcaggttggcgaactccttgcggagcaccggcacgacctcctcgccgaggatgtcgagctgctccaggaccgtcttcagcgggagccccgcgtggtccatcaggaacaactggcgctggtagtcgccgacggcgtcccggaacgtcagcgtccgctcgatgacctcctgcggggagcccacggtcagcggggtctcgcgggtgaaatcctccagggacgggccgtggccgtagaccggcgcgttgtcgaagtacgggcggaactcccgtaccgcgtcctgcgagttcttgcgcatgaacacctggccgccgagtccgacgatggcctgttcggcggtgccgtgcccgtagtgggcgtagcggcgccggtagaggtcgaccatcttcttcgtgtgctccatgggccagaagatgttgttgtggaagaagccgtcgccgtagtaagcggcctgctcggcgatctcgggggagcggatggagccgtgccagacgaacggcgggacgccgtccagcgggcgcggggtggcggtgaacgactggagcggcgtacggaacttgccctcccagtccacgacgtcctcgcgccacagcttgtgcagcagggcgtagttctcgatcgccatcgggatgccctggcggatgtccttgccgaaccaggggtagaccggtccggtgttgccccggcccatcatcaggtcgacgcggccgtccgcgagatgctggagggtggcgtagtcctcggcgatcttcaccgggtcgttggtggtgatcagcgtggtggacgtggacaggatcaggttctcggtgcgggcggcgatgtagccgagggtggtcgtcggggaggacgggacgaacggcgggttgtggtgctcgccggtcgcgaagacgtccaggccgacctcctcgaccttctgcgcgatggccagggtcgccttgatccgctcgttctcggtgggggtccggccggtggtcgggtcggtcgtgacgtccccgacggtgaagatcccgaactgcatggcgtccgccttcctgagtgccggccggaggtcagggattccggagtacggaagcctcggccgatatttggttgaacgttgaactacaccctacaacggggtccctctccgtcctattccacgcagacgggcgcccttcccgagcgcacgtactctgaaacggtggacgaacggacgagtgacagcgaggagtggaaagcgcgcggagtgttcctgcgcgtcttcgtctatgtcttcgcgacgcacgtgttcgccgggttcatctggctcctcttctacgtgggcgggcacgccccgaagtaacgcggacctcctccccaccggggccggtggccgctacactcggcccatgacctccgtcctgtgccgaaactggtggcgctcctcataggagcggccacagcatttgcacggaaccagggccgttcgacatggacggcccttttcgctgccctcgtacggagcggacacggagacgaagcgcagcggcgctcaccggcggggccgtcctccacgcatcatccacgcgaggagagacccgatcccatgaccagcaccgcacccgcacccgcacccgccgcacccgcaccggccgcacccgcacccgccgcgcccgccggactccagggcgccgaactccacggcggcgagctggagcgtcgcatcgcccaggaccccggcagcttccgggtcctcaccggggaccgtcccaccggccccctccacctcggccattacttcggctccctgctcaaccgggtccgactccagaacctcggcgtggacgtcgtcgtcctgatccccgactaccaggtgatcaccgaccgggacaccgcggaacggctgggggagtacaccgacgggctgctcctggactacctggccctcggtatcgaccccgcccggtccaccgtcttctgccacagcgccgtccccgcgctcaaccagctcatgctgcccttcctcagcctcgtctccgtcgcggagctgaaccgcaatcccacggtcaaggacgagatcgcgcactcccggcagtccacggtcagcgggctgatgctcacctacccggtccaccaggccgccgacatcctgtcctgcaagggaaacctggttccggtcggccgggaccaggcgccccacctggaagtcacccggacgatcgcccgccgcttcaacgagcggtacggcgacgtcttccaggaaccggacatcatgctctccgtcgcacccctgctgctcggcacggacggcacgaagatgagcaagagccgggccaactccgtcccgctcggcgccaccgccgacgagacggcccgcctcatcaagggcgcgaccacggacgccgaccggcacatcacctacgaccccgacgcccgccccaacgtctcctccctggtgctgctggccgccctctgcctggagcgggacccgcacgaggtcgcggcggagatcggcgacggcggagccgccgctctcaagcggacggtgaccgacgcggtcaacgggcacctggcgcccttccgggcccggcgggcggagtacgcgaaggacctgacgtatgtgcggtcggtgctccgcgcgggcaacgagcgggcgaacgctctggcggaggccacgctggacgaggtgcgggaggcgatgggcgcgttcaggtagacgggtgccaggtgcggggtgccgggtgcggggtccgggtcacaccggaccccggccgcctcgacgtcccggccgcgttgacgtcctggccgcctcgacgtcccggcgaccccggccccctcggctgcttcgaagccccctactgccggggaaccaccgaccgctgccgtcgcagcagctccgcgagccctcggcgggtggcggcgatcaccacccggtccgtggcgcgcaggacatagccggggtgcaggtcccagaccagtccggacggcggcggctccgcgtcaccgtccgggttgtacggcgggatcgcggcgaggtccggattccggtcggccggcggggtggcgtcgatggccaggacccgccaggcgcccgcgcggaaggcctgctcgaccgtgtggccctccaactgcgggtgccccgcgacctccagggccgcgaacagcatgaccttgcgttcgaccgggatcgcgccgaggatctggcggcccatcatggcgccggcgaacgccggggcggccaggtgggagacggagcgggagcgggtcagggccccggggtgcgcggtgcgcagggtgcggtagacggcggtggcgaactcgtcgtcgtacagccgcagggccaccctcaggtccggcttcaccgagcgggcgtacagcgccgcttccaggttcgtggtgtcgatgctggtgagggcgagcagggcgcgggcacggcggatcttggccgcttcgaggacgccttcctgggtgacgtcgccgatgacggtcggcacgtgcatggagcgcgccagcgggatgccgcgcgcctcggggtcctcctcgacgacgaccacggggacgtcgagttcgcggagccgtacgaggacgcgggtaccgatcttgccgagccccagcagcaccacgtgacccgagaggccgcgtggcgggcggcgcagcgaggaagcggtgcgcagggtgccgaacgcctccaggacggcggcgagcagcagcgggagcaggagcagcccggcgatgccggagaggagctggatgatctgccgggccggcggcgcgttctccgccgggtcgttcatgcccagcaggtcgagcagggtcaggtaggtggagtggatcgcggtgtcctcggtggtcaggagcgaggcgatcaccagggcgagcgcggaggccgcgacgccgagggccgaccagcgcagcctgcgggagaagacctgggagagcggggctcccctgccgcccatacgcgtggccggacggtccgggtcggcccggctgaccgcttcgaggaccaccgtgccgcggccggtcgcggcggcgacggcgctctcgtcgggcaggagttgcggggcctcgtcgccgctgctgtccgaaccctccgcgcccgcggggtcgttggtggtggaggagagcagggcgagggtgcacagtccggggtcggccgtctcgccggggcggggcggggggcgctcggcggcgcgcaggagcagtccctcggcctgaatgatcttgctgctgccggtgagagcggtggcggcgagggccggggcggcggtgtcggcgtcggacaggacggtggtggaggcgtccagtaacgccgggtcgatgccgggcatggcgacggccgccgcctggtccagcagttcctccaggtgctgtccgagcttgcggttgtagagccggatcaccagccgcaggcgggggttgaggcggcgggcggtcagggcggcgcggatgttgcgttcgtcgtcgtcgtagacgagcgcgagggcggcggcccggtcgacgcccgcctcttccagtacgtcgtcggaggcttcgggcgcctccatgatgcggacggcctcgacgccggcgttggtgtcgccgctgccaccggtggtcccgccgccgttgcccgcgcggttcatcgccgccgacatccggccgaacagggccgccgcccgcccccgttgggtcagcggcgtctcgggactgttcgcgtcccggcccgggggcaggagcagggtgacccgttccccgtagacgtagcggagttccacggccagccggcgcgccagggcgtcgtcaccgcagacgatcatgtggccggccgacggcgggcgtcccggctgctgaggaagtggaggcacgaaacccagcatgccgtgctccttccggctcggtcttcccggtcagtgtggagtgttggtgatcttcgcatggtggtccggaaccgcccggtcgttcggagcccggttcggaaccgtccggtcgttgagcgcgtggttcggaaccgtccggtcgttgagcgcgcccgccgggttcccgggtccgcccaccgggccctggggtccgcccgccggcaggtgccgggggtccgccgctcgccggatcgccgtctcgaccgccgcgatccggtccgcgagcagtccgagcgcggccaccgcccgggtcatggggtcgccgtccgggccgccgagtgcctgcgtacggacgtaggacgcggtgatcgccgcccaccgcccggcctgttcggcggtgagtctgccgcgcagggcggccagcttgaggaggttcgcctcggcccccgtggtgagcgtctgggcctcgcccgcgtagtggtcgtcgacgacggcggacagctcgtcgtcgttcatgacgggcacgatgcgctcggcgatcttgttcatgtcgcggtaggagccctggagccggaacggcggctcggtgcgcgtggcgtccgtctgcgcggccgaggcgatgtacgccgcgttcaccgcgagcacggtgtcccgggccgtgagcagatggcgcagcacggccaggacgcgatccaactcggtggcgctgtacgggtgctccaggtgtccggcacgcgcggtcgggtcgctcccgcccgccagccgcaccagcagcgccaggtcgtcccgggagcgggcggccagcggggcgaggaccgggttggcggtcagggcgttctccacgaagctcagcgcgaagacgtcgtcccggccgctgaggacctcgccgaggttccggacgtcggcccggttggcgagcatgtcggggatccggaactgctcgcctgactcggtgtacgggttgccggccatgcacaccgcgaaccgcttcccgcgcaggtcgtagctccgcggctcgccgtcgcgcactccctcgatccggcgcgtggcgtcgcacaacgggatgaacttctgcagcagttcgggtgaggtgtgttggatgtcgtcgaggtagaggagtgtgttgttgcccgcctccagcgcgaagttgatcttctcgatctcctgccgtgcggtggcgctcggggcacggtccgggtcgagcgaggtcacgtcgtggcccaggttcggcccgctgatcttgacgaacaccattccgaggcggtccgcgacgtactccatcagcgtcgtcttgccgtagccgggcggcgagacgagcagcaacaacccctgcgagtcggtgcgccggtcggcatcggcggtgccgagctgcttggccaggctgtcgccgatcagcggcaggtacacctcgtcgagcagccggttgcggacgaacgccgacatcacgcgcggccggtggtcgtgcagccgcagccgtccgcgctcggcggtcaccagcgaggtgcgcagccgctggtaggcgcggaagccgggcacggtgcgggtgcggaactcggcggtgcgtgcgaggagttcgtcgatccgtacgg

SEQ ID NO: 3037 - DNA, 7583 bp, Unknown
  Kingdom: Bacteria, Phylum: Actinobacteria, Class: Actinobacteria, Order: Streptomycetales, Family: Streptomycetaceae, Genus: Streptomyces
gaggccctggagcgggccgacggctacaacgtcgagttcatccgcgcccaggactgggagctgaacttccgcatccgcgaggccggcgggctgatctggttctcgcccgaactgaaggtccagtaccgtccgcgccccacggtgaaggcgctcgccaagcagtacaaggactacggccgctggcgccacgtcgtcgcccgctaccactccggctcgatcaacctccgctacctggccccgccgaccgccgtcgtcgccatcgcggcgggcctggtcctgggcgcggccgtcaccccgtgggccctggtcgtccccggcggttacgtggccgcgatcgtcgccgggtcgctgcccgcgggcaaggggctctcgttgaaggcccgcgcccggatcccggtcgcgctggcgacgatgcacatgtgctggggcttcggcttcctcaccagcccgcggtccctggccaagcgggtcatcgcgagccgccgcccggcgatgaccggcagcagcgagaccgtctgacccggcagccgtacggagaagggccccaccgctcggcggtggggcccttctgccgcgtacggtccgcctgcggcgtcaccaggtgtagttcgggttcaccttcatgcaggctttctcgtcgtcgccgttgagggcgcccgccgactccggggtcttctccttgcccttggacaccgggtaggtcccgtcctcgcgccagtccgcgcccacggcgagcgagatccccgagacgtcggtggacttcttcacctgcgacaacggaaccccgagcgccttggcaaccgcctgcgcgtcgccctccagatccgcgctcggatacaggatcgccgtccgtgcggccccggtcacgtcgcccgggtcgacggtggtcttcgcgaagcccgcgtccttcagctggtccgccacgtcactggcgcgccccgaggccggaccgagcgcgtccgtggcggtcccgttccgcacggcgaccgcgatctcgccgaccggcgccgacgggtccttcgtggcctccggcttcttgcgcttggaggccttgccgtccagcgggacgtcgtcgcggaccatccggaacagctgctccgcgtcgcccgccttcgggtagacgcggccgttgttcgtgccggtgccgtacacattgggcatggtcgacatcgtgatgcgcttcgtggggaccttcttgaactcctcggccaggtcgtagagcttcttgaccgtgtcgaggcccttgtcgaccgtcagcgcctcggtggccgcctcggcgaggttcatcagcttcgccgggtcggagagcttggtgcccttgcgcagctgacgcaccatcgcgttcatgtactggtgctgggccttggcccgccccaggtcggtgttgtcctcgaagccgtaccgggtacggagccactggagggcctgctcgcccttgacgtaggtggtgcccttctccagcttcagcccggagcccttgccgtcccggccgcgggagttgatgttggcgtcgacgcagaccgggacgccgccgatcgcgtcggccatcgagaccacaccggcgaagtcgatcatcatgaagtggtcgatcctgatgccggtcagctcgtaccaggtggccaccgtgcaccccggaccaccgcggcccaggctctggttggtctgtacgtccgtggtgctggcggggaagacctcgccgtccggggccgtgcacttgggcatcttcagcatggtgtcgcgaggcatgctgatcacggagaggttgctgcggtccgcggagatgtggagcagcatctgcacatcggccagcggcggtgcgccgaaggtctccttcgccccgcccagcttctggttggccttggagtcccgggcgtcggaaccgatgagcaggatgttgagcggggtctgcccggcggcgttggccttgtgatcggccatctgctggtcgccgagggtcagatcctctttcttgatgttgccgttgaggtgctcgtagtagaggtaaccggcgccgccggtgccgagtatcagcacggcgagcacggaggcgctccagcgcagcacgcgccgcttggcgctcttgggcgcacggcgactgctgcgcccccgggcgccggccttgtggccgcgccggtccttcgcggtacgacggccgccccccggcgcctcacggccccccggcccgtcgccgtcgtccgccgacccgtcgccctcgtgcgagctctcgtcccggccgagttgatcggcgccgcggacgcgtgaccgcgtcctctccccgggcgtgctgctccgtcccaccggaccccccatgctgttcagatttccgctgtggcgcggtgacccggtgtcactgggcgcataccgccttgtcggcgcttgccttctcgatgtccttcggcggcttcgccggtccggtgatgagctggcccgcgcccttgaagtccgcccccagcgtgagcaccatcgcctcaagtccctcggcgtcggcggtgccctgcttcatggccgttgcgggcagccccatcatctcggcgagcgcccgggcctgatcggcctggttgggcgcgtactccagcgtcgtcttcttgatcttctcgggtgcgttggccttgttggtggacttcagcaccccctgctcgttctggagccaggtgacggtcgagcccgccgcgccggggatctcaccgccgttgaggacgtccacgcgtacgtcggcggcctcggccttcgggcccttgagcagggccgcctgcttgcccttggcggccttctccttctgcttcacctcggtcagcgaggtgtcggagcgcatcatcgcgaagagctgctcgcccttgaccggggccacgaccacggtgacgggcttcggttcggccgggttgtcgatgaccggcatcgtgaggaagctgatgttcttcgtgtcgaccttgccgatctcctcggccagcgtcatcagcttcttcgcgtcgccgatggccgtgtcgacggtcagcgccttggtggccgcgtcggccagcgagtacagcttcttcgggttggtcagggtgtcgctcgacttcatctcgcggatcatggagccgaggaactgctgctgcaccttgatccggtcgaggtcgctcctgttgccgaagctgtcccgcgtgcgcagcagggccagcgcctgctcgccctgcaccttcgactcgccctggggcagcttcagatgcgacttcgggtcgtcgatcggcttcgccatgcagaccttgacgccgccgaccgccgccgtcagggccttgaccgcgttgaagtcgaccatcatgaagtggtcgggcttgaggccggtgatgttctcgaccgtcttcatcgtgcagccggggttacggccgttctggccgaggctggtgttgaagcgcgcgttcggggagccggggatgaccgtggaggtgccgtcctcgttcttcgtctcgcactcggggacctcggtcatcaggtcgcgcgggatgctcatcgccgtcgcgttggtccggtcctcggagacgtggaacaggatcgtggtgtcggcgtggccctcgctgcccttgtcgccgtacccctcgttgcccttgccggtgcgcttgtcggtgccgatgatcaggatgttcatcggcccgtccgtgacgacgttcttgctgccggcgtcgcccacgtcgatggcgtcgatgttcccgttgagcttctggtacagcgcgtacgccccggccgagccggcgaccacgacgaacgccatgaccccgcccgtccacagcagcgccttcttcttgcgcgacttccgggtcttgcgcttccggcgtccggccgcgggcggttcagcggctccgcggcccccctgggagctgcggcggctgcgctgaccgggcacctggcgcggcccgtccggagcttcctcgcgctcgcgctcgcgcgacccggtaccgcggcgtcccgaaccggtccgggagtcgccgcggcgaccggttccttcggccgtggccgtacgcgaagggctgctcgactccccagcggagtggtccagtcgcaattcgtaattgccggtgtgcgggttgagtacccactggtcggcggggtcgatatcgtccgcccgtccacgactgtgcgcgtccacggttgcctgcgtcctccgtcggtgccacgcgaggcgccctcccccggcaaggcgctcgttccttcgctccagcagtgcacgacctgacggccggaagcaccggatcgcgtcacactatccggccgattccgcgtcgagcgacgtgcgtgacacattccacgccccttacaaccgggcattcttcccattaggcgtcgattgtgttctgtgtcttggcaattgctttactgcttgcacaggtcgtccgccgcactcgaacccgaataagtgggtgtgggcgtcgggctttcggaccctgtgtcgtccggtttcccgtcctgcttcctttcctggtcctgctgtgcttccttcagttcgtcggccgggaccacggcgacgggccggtcctcacggagttgcttgaacaggtcccccgcgtccggttcgacgagttcgtcccggttcacgttgttgcggtacggctgccggggcacggtcaggaactgcacctgctcggtcggcacgttgcgcatcccgcgcaccaggtcgtacaggtcgcgcagcgagtcaagacccgggtccgtggtcagcgacttggtcgccgcgtccagcacggggtagagccgcgtcgggttgagcaggacgccgttgctctgcatcttgttcaccagagcgcccaggaactgctgctggcgctccatgcgttcggtgtcgctgccgttgccgagggtcttgcgcgcccgtacgtagccgagggcctcctcgccgttcagcgtctgccggccggccgggagctccaggtgcgcgtccttgtcgtcgatcggctccttgaggcagatctcgaccccgtccacggcgtcgaccatgtccttgaagccgttgaagtcgacgaccatgtggtgatcgatgcggatgccggtcatccgctccacggtgcggatcgtgcaggcggtgccgccgagctcgaacgcggtgttgaactgggtgaactgctcccgcgtctccttgtcgtcctcggtgcggcagctggggatctccaccatcaggtcgcgggggagggacacggccgtcgcgctcttccggtccgccgcgaggtgcagcaggatcgtggtgtcggagcgctggctgccgccgtcgtcccggccgtactcgctgttgtccccggcccggctgtcggacccgatgagcaggatgttctgggcgtccatgacgaccggggtcggccgttccttctcgtacgccttgagctcggcggcggcgctcgtgtcggtggtgatgttcccgtcgagcttcttgtagagccaccagcccgcccccgccgcgacgagcacgaggaacgaggcggcgagcgcggtccagcgcagccagtgcctcttgcgcgcggcgacgccgccgtccttgggccggtccgcccaggtctgcacgcccgcgctctcgtcgctcccggcctttgcgggatcgggatccgggtcggtgccggggtcgggcgtgaccccggccttagcggcggccggggtctccttcccggccgccgggtcgtccgaggccgccgggtcgtccgaggcctgcggggtttccgcatgcttcggaggctcctgggcgtcctcggctgccggggtcccgtcccgctgggcaccacccagcggtgaaccgtcctgcgaggtccggtcctcgggggtcaagccctcgggcccggactcttcctgcgacctgccctgcggcttgtccccggccgggtggtccgggtcggacggcgggccagcactgtcggtcacgtctgcgtccatccttcacgttcggcggcgcgaggggccgccggtcgcaggagtagacggctgaaactcacgcttggttgtgcacggccaggagagtggtctgtaccgcccgatcatctacccgctccggagccgattaccgaggactcggcccgctgtgggccggacgagtgcacctcagagcgcttgtcataccgcggtgttggtgacccgctcgctcgcggtccgcttggccagcccctccgcgtcgagctgcccgaggtggcggcagagcaccacggacccaccggccgccagtggcgcgaagagtccggcgctcagcccttcccaggtgtcgtacgtacgcccggacagcagccgggaccccggtacgagaccgagggcgtcggcgtcctcccgggcccgggcgacgagctgcgcacccgtcagcccgatcccgccgacggtcagcgcgttcgcctcggggtccaccggggcgaagggcgcgaagcggtcgccctggctcggcacctccaccgcgtagtccgcgaacccctcgggcgcctgcgggaacctgccgcccagcggacgcagagcgagggcgacgcgctcaccccggcagacccgcgcccgctccagggtgtccgggccggtcacgacgaggtcggcggcggccgggtcgccctggacgtcggcgacgaccccgacggaggaacaggcgagcagccagaccgcggactgccagtgtgcgggcagcagcagggcgagccggtcgcccggctccgcggcgaggtcgccctggagcagattggcggtcttggccacccaattggcgaaggtggccaccgacagttcgacgcgttctccggtggcgtcgtcgtagaaggtgaccagggggcgggccgggtccgcggcgagtgcggatcgcagcaggtcggcaggggtgcggtcgctggagttcatccgcgcaagcgtacgcgggggcgctgtgcgggtcaggctgaacgggtgtcacgtacaccggttcggccgacggtgtgtcacgccggggtcgatgtccgggtagccggactcctgcctgtatggccaggatcgtgcgtatgcgtgaactattggtcacctcaatcggcgtcacctgcgcggcggccctcaccctgtcgctcgccgcccccgccctgtccgccccggccgcgcactccgccccggcgcggcctccttccctgtcccccgagtcgcccggatccggcccgccgtcggcccggaccgaagccgcccccgacgaagcgaacgaaccgaacgaagcgaacccgggggacgaagccgacgaagggggcgccctcgaagtccccgaagccgctcctccgcgcaccggtgagaaccgtgcggccgcgctcgcgggctcgacgcagtccctgcccctggaacccctcgccgcaccgtccgaccgggctgtgggcccggcggagtccggccagggactggaccggcggacggcccggccgttctccctcgtgggcgtcgtctgggacgacgccgaagccgaactccacggcacggtccaggtccgcacccgggcgaccggcggtacgacctggtcggactggcaggacgtcgagacccacaacgccgaacacgccgccgacctgggcagcgccgagcgtgcgtccggcgccgtgcgcggagcgaccgccccgctctgggtcggcgactcggacggcgtggaagtgcgc

SEQ ID NO: 3038 - DNA, 2344 bp, Unknown
  Kingdom: Bacteria, Phylum: Actinobacteria, Class: Actinobacteria, Order: Streptomycetales, Family: Streptomycetaceae, Genus: Streptomyces
gggtggcgcggcggatggccgacggcagtgtcgtcttcgggggcgcgccggtctccggtacctcgcggccggtcgtccagcgggaatccgacgtcgccgaggtcgtcgaggaaccgccgccgcccgagcccgatcccgtaacggaaccggaggacggcgcggagcccggacccgggacggagacggggagcggagccggggctgccacccaggacggcaaaggggctcccgccgtcacggacgagctggtccgggccctgtacgccccgctgagccggctcctcaagaacgatctccggctggaacgcgaacgcgccggtcatctcatcaacacccgccactgaactccgagacgaagcccgaacgaagcccgagcgaagcccggacgaccggctgctgctcgaccgaactgagaggcacgtgtcatggccaccgcccaggacagcgaccccgccgtcagcgtctgcttcgtcgtgacgatcgacgacatcgagctcgggtcgttcaacacgtgcgagggcctcggctgcgaagtggtcctcgaagcgcgggaggagggcggcaacaacgggcatgtgtggcagctgccgacccggctgaagtactccaacgtgaagctgtcacgaccgctcacccgggagacggagaaggtggcgcgctggttcgccacgatgaccaccgggttcagccggaagaccgcgcacatcgaggcgcgcaccggggacggccagagggtcgcccagtgggggttgctggaggtcgtgcccgtgcggtggaccgggccttcgttcacgcccgagtcgcccaaggtcgcgatggagaccatcgagatcgcccaccacggttacgtgatggagggctgaggacgatgagcggtgcgggtcccatcgcgttcagcgcggccggtacgtcgggggtggcctcggcggcgaagggcggctcggcgcggcccaaactggagcacgcctacctggagctgcgcaccccgccgaccgggggagggctgacgcccggcgggccgtgcgggcggatcgacttccagttcaaccccaaggagctgagcctgaccaaggcggcttcctggaagcggagtccggcgaagggcgcgaagagctcgggcccgccggagtaccagggatcccagcccagcaagctcaccgtcgagatgttcttcgacgccagcgacacccaggacacccgggtggtcacctcggtggagcagctcttcgcctgctgtgtgccgacggacgagacccggcagcagcagcggtcgtccccgccgtgggtcgtcttccactggggcggactgacgggctttcccggttacgtgagccaagtcgccgccaaatacacgctgttcacgacctcgggcgtgccgatccgggcggtctgccaggtcaccatggaggagatcagcggtgagacccccggccagaacccgacctcgggcgcgctggccgcccggcgcgtccaccgcgtcggctcgggcgactcgctgccctcgctcgcccaccgggagtacggggaccccggggcctggcgggtgatcgccgaggcgaacgggatcgacgacccgatgcggctcgcccccggcacccagctcctgctgcccgccctggacgagctggcccggctcagggacaagagcaggggcagggactcctcggaccgggactccgccaaggccggccggggcagggggcggggctgatggcgcagcagggggtttccacggcgctgacggtggagttcggcggtacgccgctgcccgcgaagttcgtgaacacgctggtcgaaggctatgtcgacgacagccgtacgctccccgacctgttcctgctgcggttccgggaccccgaccgggtgctgctggagcaggccgggctgaagatcggcaccgaggcccggctgctggcccgcgcgggtggcgacaccgcaccgaagccgctgctggagggggtcgtcaccgcactggaggtggagctcgacgagtccggcacgttcaccgtcgtccggggactcgacgagtcgcaccggctgttccggggccgccgggtggccagctaccagaacatgaccctcgccgacatctgcggccaggtcgcccagcgtgccgggctgaagccgggcccggtcgacatcgccggtcccgtactggagcacatcgcccaacccaacatcaccgactgggagttcgtgcgcggcctcgcggaggaggcgggtgcgcaggcatacgtgcgggacggccagctccacatcacgaagccggcggaggcgggcggcgcacccgacgcctcggcgcgcgccgaccgcgacccgctcgtactggagctgggcagcaatc

SEQ ID NO: 3039 - DNA, 4571 bp, Unknown
  Kingdom: Bacteria, Phylum: Actinobacteria, Class: Actinobacteria, Order: Streptomycetales, Family: Streptomycetaceae, Genus: Streptomyces
gggctggaaggtggccgcggcggtggtgtgcgtggcactgctggccggcgcgggctgggtggcctcccggggcagcggcgagaagggcggggacggcgaccgcgcgggctcggtgcagggccagggcggcagcgagggcgcagccggcagcggctccaaggagcggtggaaggacacgcaccccaccctggagatcggcgtcaaggacgaccagcccggactgagcaagttcgacaagaagacgcgtacgtaccaggggtacgacatcgacctggcgtacgccatcgccgagagcatgggctacggcaagggcgaggtcgccttcaccacggtcgccacggactaccggagcaccgcactgaagaccaagcaggtggacctggtcatcgcgtcgtacagcatcaccgacgaccgcaagaccgcctcgcccggcggctacagcgtcgacttcgccggcccgtactacgaagcgagccggggtttcctggtccgtgagaagtcgagcaagtacacgatcaacgactccagcgacctgcgggatctcggcgtcgaggtctgcacggcacgggagtcgacgtacgagaaggcgctgccgaagcagggcttcaccatggcgaagtcgcagcccaacacctatcaggactgtctggacaagctgctggaccccaagtccgacgtgtacgccgtggcctccgacgacatcattctcgccggatacgtcgaggccaacccgggcaaggtgcgccggctggagaacatccagggcgcggagggatacggcgtggcgatgcggccgaagtccccggtcctgaagggcgaggtgtgctcggcgctccggacgatcctggccggccggatctgggaggacatgtacaaggagaacctgtccggcctggtgggcgacaagaaccctccgggccgacccgaactgacggagtgtcaggggttctgagggtcgcgtcgacggcggtgcgccgggactccggcgcaccctggctcagcgcccggggaaccgctccccgcaccggctgcagaagaccggcgcggggtcctgcgacagccgcccgcactccgggcagacccggtccagcatgcagggcccctcgcccccctcgtacgccccggccggcggcttgatcgcgaggccgggacggcggcggtggacggtgagatacacgagcccgtcgggccccgcggcgagcgcgcggcgggacgtacggggcagccagagggtggtgccgggccccagctccaggacccgaccggcctccgccgccctgacgctccctgcgccctccagcacgaccaggagcacatcgagcacgtcctcctgatgctcaccgacctcggcgcccggcggcaaccgcaccagatttgcgtccaactcccgcccggactcggccagatgccacagcgcgccgcgcgcgccgggttcagcggaggcgaggagttcgtcgaggacggcaaggatccggggagcagcgttcacggcgtccaggctacgcggcggcgggggtggtcggagcggccgccgccacgcagaactcgttcccctccgggtcggccatcaccacatggtgctcgtcgacctccgccaggacggacccgccggccgccaccagccgtgcggcctccgcccggatgcgggcccaccgctcggcgggggtgccgtggcccgcgatccgcacgtcgatgtgcagccggttcttcgcggtcctcggctcggggaccttgaggatggagagccggggtccgacgccttcggggtcgcagagccacgcgccgtcgtccgccgtgtcgccctccggcaggtcgaaccgggcgagccactcctcccgggtcgcgaacggcggcggcgggggctggtccacgtagcccagggccgacttccagaaggcggcgaggagttgggcgtcggtgcagtccagggtcagatcgatgcgtacggcggtcatgggcaggaccgtacgggacgcctccgacgatcgcacccacgtaacgtgtcccaccgtccacccacccgccgcaccgaggggaaccacgccgtgcaccgcgaaccgaacgacctgtacccgccgatcgaaccgtacggcagcggcctgctggacgtcggcgacggcaaccacgtgtactgggaggtgtgcggcaacccggacggcaagcccgccctcgtggtgcacggcggtcccggctccggctgcacaccgcgcgcccgccagtacttcgacccggaccgctaccgggtggtcctcttcgaccagcgcggctgcggccggtccacaccgcacgcgagcgacccggcgacggacatgtcgcacaacacgacggcacacctcatcgccgacatggaacgcctccgggaacacctgggcatcgccaagtggctgctgtacggcggctcctggggatcgaccctgatcctggcgtacgccgaggagcacccggagcgggtcacggaagccgtgatccccgcggtgacgacgacccgccgcagcgagatcgactggctctaccggggtgtcggccagctcttccccgaggcctgggacgccttccgcgcgggcgtgcccgagacgagcgacccgaggggcctggtcgcggcgtacgcccgccgcatggagagcgaggacgccgccgtacggcagaaggccacgtccgactggtgcgcctgggaggacgcggtcgtctcgatggaggcgaaccagggcccgcccccgtacagcggccgcccggaccgcgagcagcaggcgctcgtgcggatctgctcccactacttcgctcacggagcctggctggaggaaggccggctcctcgcccgggcccaccgcctgaccggcatccccggagtcctgatccacggccgtttcgacctggccggcccgctggtcacggcctgggaactgagccgcgcctggccggacgccgagctgacgatcatcgacaacgcgggtcacatgggcggcacggagacccggcgggcggtgctggcggcgctggaccggttccgggagtgaacgtgtgccccctcctcggccgccgcccccggccgaggagggggtggcggccgccgggcgcgggcgcgcggataccgtcgcggtctaccaggcgaaggcctccggagacggccccgggcccgggaagatctcgtccaggcccgtgagcacggcctccgggagctccagttccagggcgcgcagggcgctgtccagctggtcggcggtgcgcgggccgacgatcgggcccgtgatgccggggcgggtcagcagccaggccagagccgcttcgccgggttccaggccgtgcttgtcgagcaggtcctcgtacgcctggagctgggaccgggtggcggggtcggccagagcgtcggccgctcggcccgaggtgcggcggcctgcctcggccgtcttcctgatgacgccgcccagcaggccgccgtgcagcggcgaccacgggatgacgccgaggccgtagtcctgggcggccgggatgacctccatctcggcgcggcgctcggcgaggttgtagatgcactgctcgctgaccaggccgagcgaaccgcgtcgggcggcctgctcgttggcctgggcgatcttgtagccggggaagttcgaggaaccggcgtacaggatcttgccctgctggaccaggacgtcgatcgcctgccagatctcgtcgaagggcgtgttccggtcgacgtggtggaactggtacaggtcgatgtggtcggtctggaggcgcttgagcgaggcgtcgaccgcacgccggatgttcacggcggagagcttgtcgtggttcggccaggcatcgccttcggcggccatgttcccgtacatcttggtggccaggaccaccttgtcgcgccggccgccgccctgcgcgaaccaggtgccgatgatttcctcggtgcggcccttgttctcgccccagccgtagacgttggccgtgtcgaagaagttcaggcccgcgccgagcgcggagtccatgatcgcgtggctgtccgactcgttggtctgcgggccgaagttcatcgtcccgaggacgagccggctgaccttgagtcccgtgcgtccgagctgtgtgtacttcatgacgccccagccaactccttcgagtccactccaggcaagcatgtgcctcggacgcgccggacggaccggacggaccgggcttccgggcggcgcggcacgccgcccgggcggtccgccggtctcagccgcccagggcggcccccacggcgacgacgacgaacatcagcacgagcacggccgccatgatgcggtttctggtcttcgggtccacccttcgagcgtaacggcaccgctcaccggcccagcgcccaggcccgcaccgcctcgtggcgcggccgctcccccggcaccccggacaccggcagactgctccgtacgagactcagctcaccggcctcccagcgctccccctcgaagtccgccagcgccgcggtgaagggccgcaggtccgcctcaccccggctccgggccagcgtgaggtgcggggcgtagcggtggtgctcctccatcggcagcccggcccgccgggctgccgatggagga

SEQ ID NO: 3040 - DNA, 13064 bp, Unknown
  Kingdom: Bacteria, Phylum: Actinobacteria, Class: Actinobacteria, Order: Streptomycetales, Family: Streptomycetaceae, Genus: Streptomyces
ggaccgtagcgggccgggatggcgccgccggacaccgggaggcaggggtcgggagcgtcgaagggcgtggcggccgtacgcaccaggcgctcgcccgccaccaggtcgaccaggacgtggtcggcgaacccggcgagcgcgaagtccagcagggaggtcgccgcctccatcgggtcctcgcactcggaggccgtacgggcggcccggtgcagctggctcgtccggaaccgcagccggtcggcctcctgttccgcgaacctgtcggcggtgacgtcccggaacagccaccccaccccgagcgggaccggttcctccgccagcggcgaggccagccgcaggaacccgctgcgccagcaccggcggcgttcgccctccgccgtccgcagggtcacccacagctcggcgggggcggccggtgcgccttcggcgagcacatggtgcagggccgcctccagctcctcgacgccctggaccaccagttcgccgagcggacggccgaggagggtggtgcggcccccgccgagcgcgcgggccgcatacgcgttgacgaccgtcgggcgcaggtcgacgtcgacgaggaccaccccccaggacgcgtcctccagcagcgcctcgctcagcgcgatggcccgctccagatcgatctgggcgtgcacctcgctgaacgcgcagtagaccccggccggctgcccgtccgcaccgcgcaccccggcggactgggtccgcaccagaacccggccgccgtccttgcgcagcagcgcgaactcgtgcacctgccgccccggcgcgtccatggccgacatcagccgcgcccgcacctcgtccgcgtcggcccggcgcaccgcccagcccgcgaagccggtacggcccacggcctcgcgcgccgtccagccgaggagccgttcggcctcgcggttccagtgggtgaccgtgccggccgcgtcgaacgcgcagagcgcggcgtccatgccgtcgagcagcgccgccagcagttcggacccgggaggctcaccgggaaccccgccgccgtcggccgggggtccgggatccgcggaacaccccggggacccgccgccggaatcctcgtccggcccgagctcgtcggtggtcccgctactcctggaagcacccactccgcaccccccgcagaacgtgtccgccgttttcccacgcgtcgccgcgtgtattgctgcacgtcagaccattcaactcgaacgtgacccagcacacatcaacttcaccgaaatcagttctcccaccgccggattcccgatcgctcccatcgttttcgcgccacgccgcggacgcgccggcgccgcgtccggctctccggcgtggggagttcaccggcggcacggcggtgcgtggtgacgacgaggagggcggcaacgccaacgcggacgaccgcgcgatctggcgcgatcccgccgccccggaccagataaatcggttgaaccgcgatccgggacgctcctaggctgtgggcacacaggaaaggaggtgttcaagaagtgatttcttctcggactcgtgaggtgactgcgggctgacgcccgtcgtcgcactctttctgcagtgcaggccggacgccggccaatcccaagcagtcaccgacccgcaggctcgccggtaagtccggccggctcctctgtgcacggaggaaccagagcctgcgggtttctgcgttttccggcccccgcaggcctctcacggcgtcccgcgcgccctcacggcgtcccgcatgccgctcaacggcgtgcggatcacgggcagagccgctccacccgccactttccggcgcccggctcgccgccctccctcacgtaccgcagccggtcgtgcagccggttttcgtgcccctgccagaactcgatcgtctcgggcaccacccggaagccgccccagtgcggcggggccgggaccttctcgccctcggggtagcgggcggccagctcctcgtaccggcggatcagctcctcgcgggagccgacgacggtggactggtcgctggcccacgcgccgagctgggagccgtgcgggcgggtgcggaagtagcccacggtctcctcgcgggaggtgcggacggcggtgccggtgacgatgacctggcgagccagcgggtgccaggggaaaagcagcgagacgtacgggttggcggccagctcgcggcccttgcgggactcgtagttcgtgaagaagacgaagccccggtcgtcgtactgcttgaggagcacggtgcgcgaggacgggcggccgtccgggccggcggtggagacgaccatcgcgttgggctcgtgcagcaccccgccggcggcgacctggcggaaccagcgggcgaactggtccatcggatcggagcagaggtcacgctcggtgaagtcctccgagcggtactgctcgcgcatcgccgccggatcggtggtggaatcgatacgggagggcttacgggagagcccggcggaaggagcctgatgggcggcgtgatccggtgcgggcacagcatgatccggattcggcacggagtgatctggtgtgggcacgggcccatcctgccgcagcgatccagtgtgcccggcggggagggcccgtaaccacgcgtcgtcgaaatggagccctgtgccggatgtcacgcttccccgccccgtgggaacccgccaatatcttggggcaggcccctgtgtccttcgaacagcagcggcctttgtacacagcggtcttgatgcacctgctccgcgtacgccacggtcgcagaacacagcccgccgcccgccgaactgagggagccgcctgatgtccgacttcgtacccggtcttgagggagtcgtcgcgttcgaaacggagatcgccgaaccggacaaggaaggcggttcgctccgttaccgcggggtcgacatcgaggatctcgtcggccacgtctcgttcggaaacgtgtggggcctgctggtggacggggcgttcaaccccggactgccgcccgccgagccgttcccgatcccggtgcactccggtgacatccgggtcgacgtgcagtcggcgctcgcgatgctggcgcccgtctggggcctgaagccgctgctggacatcgacgaggcgacggcccgcgacgacctggcgcgggccgccgtgatggcgctgtcgtacgtcgcccagtcggcgcgcggccagggacggccgatggtgccgcagagcgagatcgacaaggcgcagtcggtggtggagcggttcatgatccgctggcgcggcgagccggacccgaagcatgtgaaggcggtcgacgcgtactggacgtcggcggccgagcacggcatgaacgcctcgacgttcacggcccgggtcatcgcctcgacgggcgcggatgtcgcggccgcgctgtccggcgcggtgggcgcgatgtcgggcccgctgcacggcggtgccccgtcccgggtcctcggcatgatcgaggagatcgagcgtacgggcgacgcgagcacgtacgtgaagcaggccctggaccggggcgaacgcctgatgggcttcggccaccgcgtctaccgcgccgaggacccgcgcgcccgcgtcctgcgccgcacggcccgcgagctggccgccccgcgcttcgaggtggcggaggcgctggagaaggcggccctggaggaactgcacgcacggcgtccggaccgcgtcctggcgacgaacgtggagttctgggcggcgatcgtgctggacttcgcggaggtcccggcgcacatgttcacgtcgatgttcacctgcgcccgtacggcgggctggtcggcgcacatcctggagcagaagcgcacgggccgcctggtccgcccgtcggcgacgtacatcggcccggggacgcgggacccgcgcgagatcgacgggtacgacgacatcgtcgcgggctgagacggacgacggagccgggccccgggcgggcctgcgcggcgggccggggcgatgccccggcccggctcagggctcttccgtctcagagcttccgtatcagggcttccgtctcggagcttccgtctcggagcttccgtctcagagcttcccggacatgaaggccgtacggtgaccctccagccgacggtcgagctccgcgaggaaggccggggtgaggtcgggccacccccagaaggtgaagccgaggttgccgaaggagaagcagccgcccattcccgtccagtcggcgagcggggacgaggcgtcgcagtgcgcgcaccgcacgaggccctcgcctccctcctcccagtcggcgatcgcctcggagaagggggcccaggcaccgggtatctcttcccaggtctcgtcgtgaaactccgtgtcccgctcgcaacgcggacacgtggccgaggccggatcggcccactgcccggcgtcgaacatggtgcgggtgacttcgacgtcgagcggcccgccctgccacggctcgccccagccgctgctgtcgacgacctcccggatacgcggtcccggcggatatccgagccccttgccgaggacgggttcggtgcgctcgggcccgatgacgccctcggccacgagccaggcgacgacgcgcgcggccagcggggcggcgtccgcctcggtgacctcgcggtccacgacgatctggaagtaatcccccacggctctccccatcgaccttcgattctgatggcctccactctgccatcccccgccgacacaccggattcaggcgcggtcgccccggccgacggcgggccggccgacgtgacgaacggcgatgacgttgtcggtcacggtcgcggtctcgccgccgggtccggtggcgctccgccggggtgcgtggcacagctcggtccgccatccgtcgcccagccgcagggacgcgagtacgtcgtcgggggtggggaagcgtacgtcctcgtggccgtcccgccaggaccagggggcgagcgaggcgtgctcgaccagcacgagcaggccgccgggggcgacggcctcggcggcccgccggagcacccgctcgcggggaatctccacaggggtgtggaaatagctggcggtcaccagaccgaaggtcccgtcggggaaggaccgggccaggtcgtgccggctcgggtggacgcggtcgttcagaccggccgcggcggctccggcggcgacccggcccagggcggtcgccgacacatcgacggcggtgacgtcccagccgagcgaggcgagccagagcgcgtcgcctccgtgcccgcagcccaggtccagcgcccgtccgccgccgcccggtgcgggggccagcgcggtgacgacctcggcgaggacggcgttgggacgggtgccccactgcgcgtcgacgccggcgtagtgcttctcccagaaggcggcggagtccgtgacgccggtgacgccggtggtgtcgctgctcatggctgttccctttcctgcccgtggaggccgctccggatgagcaccccgctgaacaggaaggtgcgctgcggcctgccgcacttgcaagctcccatgccgtttcggcaacctggcaggcatggcagacacggcaggcgaagaagacgcggcaggacagccgcccaaggacaccaggagcaccgggaacaccaggaacagcaaggacggcgtgctggccgcggtgggtcctcgccttcgcgaactgcggcgcagacacgggatgacactcgccgagctggccgagcggaccgggatcaacgagagcacgctgtcccgcctggagggcggcacgcgcaagccgacgctggagatgctgctgccgctggcggaggtccacgcggtaccgctggacgaactggtgggcgcaccccgcacgggcgacccgcgcatccacctccgcccggtcacccgcgagggcctcacctacgtaccgctcagccgccccggcggcgtccaggcccacaagctgctgatcccgccgggcccggacaccgagccgatcctgcggacccacgagggcttcgagtggctgtacgtgctggccgggcggctccggctgatcctgggcgaacggacgctcgtcctgaagccgggcgaggcggccgagttcgacacccacgtgccgcactggctcggccccgacgacgaccggacggtggaactgctcgtcctcttcggccaccagggcgagcgggcccacctgagagcccgccagggtgccgtgcgcggaccgggcgacggggccgcatgaggcgacagccgtacgcctcgacgaagcaatgttcgccctgttgccacgccccgtacagaccctggtccgggccggacgccgggggcagggagcctccgacggctgcgctggggttccgcccgtagccagccatatcgatggcctcaaggccgcccccgggcaggggacttgtgaccaccacgaagccggcgaatgcccgggtccccgtcgctgcgccgccgggtaccggattatccggcttcgcgcatgtccaactgttgctgctggagcgcgtcccctgaccaccccggctccaccagggcccctccggccctcggccctcgcccctcgtccctcgctctgccggtcagccgactggccgatcccccaccaacgtggcgaaacgaccgaaggtctcgtccccggcgcgacggtcgccgagttccgcgcacagcacggggaacccggcccatgcctcgccctcgacggtccaccgcgcgaagctgctccgcccgtcgtggatacgcgcctcgtcgacccactggtcaaggccgtcgcccatggagtggacgaagaagtgcgcgtcctccaaggccggtgccagaaggtcgatgagctggtagaggtcgcgcatgtcgatgtagcagacgtccgacagctgctccaggcagaggtagtcggcctccggtggacccaaaccgaattcccatctcccgccatgggcctcctggttgagcagatggaccggccaggttctctgccctggcagctcggtggccaccgccgagagcgcctcctcggccaggggccgccaccccggacgtacgcgaacgaacgtcgtgtacaggtcgggccacggcgacacttgaggaaaccgcagccggaaccgcccgtaccaacggttgtcgcgccaccgatcatcgctcttggtgagaaacgtcccggtcagctcgaccggatgaggctccctcatgggctgagcatacggacaccgccgccggcctcctggcctcttggcggtcctgggaactgtcctcgccgatgcgggctcgctaccggcggcttgggcgcacgtgtcggtcgtggtccgagagcgccgccgcggtggcgcgggcgaagccttccgggttgtccagcatgatgttgtgcccgcagtccgggaccgggaccacggacaccccggcctcgatgagcgcgtcggtgcccgggagcgggccgtcggcctcgggcagcaggtaggtgcgggggatcttcaggtccagcagatgctcacgcatggtgggggcggtgcctcgggtgaggtggaccgcgctgcggtgcagagcttcccggcctgccaggcgcatcgtggaccaccagtgggacccggcccggtcccggatctcctgccagccgcccgccaggaactcctcctcggagtacgcggcgatgccgctgctgcccgctgagccgggtgaaggcgggatcgggtcgaggttggcgtcgaccaggaccaggcgggagaccagtcgggggtgtcggacggccaggacgacagccaccgagccccccatgctgtgcgcgatcagctcggcgcccgtgacacccgcaccggtcagggctgcggcgagggcgtcggcgtgggattccagggtgtagtcgaagtccgtcggccggtcactgatgccatgtccgagcatgtcgatcagcagcgatcgacgtccggcgagcagcggatggacagcagcctccgcgaagtaggccggtgacgtggcgcccagaccgtggacgtagacacgcgacggctcccgtcccggcagttcgacccagcggatccggctgccctcgggtgtcacggcggcgtttcgcacagtctgcttcccttcaccccggtccgacggagagacgagagtagccaccgagcctcggtgcacctccaccgcccccggcgggacgttgcgccgcacgacgaaggctccgacatgcctgccgtgcgcctgcctgcgccagggcgacgctgcttgcgaagctcgggtccgagacccgggagccgagcttcgaggcccaggatccgagacccgggattcgatagagcccactcactcattcgggccccgatgccctccccgacggactctgccgcccctgccgcaccgcccaccacccggggtcggccgactccccggccagtacagccgaagtacccgccgacgcccgcgacatcggggcgtacatcgccggcctccgcgagctgctcagggctccttagcgctgggcgcgggcctgtacggtctcgatcgcgttccggatcaggcatcccgccagcgtcttgccctggccgagggggtccggcgtccgtcctcgctggaggccggccatggctccgtcgtacacgagcagtacgttgcccgccagggcggcggggtcctcggtggtgacggtttccgccagctggttcagccgtgtgacgaggagcgtggactccgcctcgatcacggcgcggacggggtggtcgaggtcgggcagttccgtgctggtcgcgaggaaggcgcacccgcggcccggggtgtaccggtcccggtaggcggagaccgcgtcgaacagagccaggagcttctcagcaggtgtggccgcggcgtccaccgcttcctgccatacctgatcccagcggtccaggcgccggtgcagtgcggctgcgatcaggccgtcctttcccccgaagtgcgcgtagagcgtgccgggagcgacgtgggcgtggtgcagcacctgatcgacgctggtgcgggcgatgccgtcccgggagaaaagctcgtcggccgcgtccagcaatcggtccctggcggacggtctggccatggcttcggtggtgtcctggtccatgcactccagcataacgagcgttacagtgaaacgatcgtttcagtgaggtcgggagggtcggacgccttccgcctccgaccggaggtgcgcacatggacgacctgaccggtgcgggacccgcccgcacccgagccttcctcggtgcgggcctggtcctcgtcagttgcctgagcgtgcaagcctcggcagcactcgcctcgacactcttcgaccggctcggcgctcccgccgtcgccgggctgcggcaactctgcgccgccctcgtcctgacggtgctggtgcgtccgagggtccgtggccacacgcggcaggaatgggccggcatggccgtctacggcgcggcgatggcggtgatgaacgtggcctattacggtgcggtgggtcacctcccgctcggcgtggcggcgacgctgctgttcctcgggccgttcgtcgtggcggtcgcctcggcgcgcacttggcgcgaagcgcttctgccggccgtcggcctggcgggcgtggtcctggtcacggagcccggcgggacagtcgcgtgggcaggaatcgccttcggtctgctctccgcgctggcccttgcctgctacaccgtcttcgcgcagcgcgtgggcagggcgtcctccaggttggagggactgtccctgtcggtcggcatctcggcgatgctgctcctccccttctcccttcccgccactccgagcgtcaacggatccgactggggcctggtcgccgtctccggcgtcgtcggggtggcgctcgccttcaccctggacttccgggccgtgaagatggccggcgccaaagtggtcgcgacgttgttctccctcgaccccctggtgggcgcgctgatcggtgccctcgccctcgccgaaagcctctccgcaccggtgctcgtcggcatgggactgaccgtgtcagccggtgccctggcgacctggcgcgctgaaagcctcccagtttcaccgatgccgagcagtacggaccgcccgtgacacgacaacgggaacgatcatcggtcgcaccccaccggcagccgttccttccgcacggcggaacaaccgaacagccgtgcaggacacggtctaagccttgatcggtgcggccgccctcgcggcccgctcgatcttcgcgcagtaggccgcacgggcttcctcgtcgatctgcttctcgtgttcggcgcgcaacccggtccggccgtcgaggccctcgcgcaggatgtcggcgtgcccggcatgccggacggtctcgccgacgacatggaccatgacggcgaacaggttcgtgtcggcataaggctccggccaccacggcacgtggccgggggcgtcgagcggaagctcgtccatcgtcgcgtccgagtgttcccacgtacgccggtagaagccgacgatctgatcgcgggtctcgtcctcggccacccattgatcgctgccgtcgtgatcctgccaccggggcagcgcttccggggaagggcggtcgaagacctcgccgaagtaccttgcctcgacgccggccacgtgcttgaccaggccgagaaggttggttccggtcgctgtcagaggccggcgggcgtcgtattcggacaggccgtcgagcttccagagcagcgcctcacggtcccgccgcaaccgcccatgcaggttgcctttcgcaaattcatcaatcatgcggcatgagcctgccatgagctgctgatggtttcaagatcccgtacatggccggtcacttacgcgggagaacatcggttcgcgcccgagcggggtcgtgcggccgtcgcggagcaggcacccttgctatcgcaaatcgcgcgatctgggcggacccccgctacggctcgcggccaccgcacagtcctcgggagtcagcacaacccccgagggtcacgcggtggccgcagaacacggaaggctccgacccgtgcggcgccgccctgcggcggcggtgcgtcagctctgtgcggcgtcggcgcccgcctgtgcggtgtcgtcgcccgcctgaccggcgccctcggccccgccggtcttctcgcgcatcttgcgcaccagctcagccttctggtcggccgcgctccggcggtccagattgcggtgcgggccgttgttctgccgttcggcgcgggacagcttcttgcgctggccgccaccctggcccacggggttgttgatgttcttgctcacggtcacgggttctcccggtagtgatgtgaagtgatctacggattcaccggtgggggacgggcggcgacgtcgcagggcgtcagcggcggcccgtcactcgctcactcgtagatcggcgtctggaatgagaaagacgttacccggttccgtcaaccctcgcacaccacccctttcccgccgccccggcgtcggccgggccttcggcgagcacccggggtgagctgctgcctggccgcttcgtgtgagtagccgtatcgacgggaagcggtgcgtgtctgcgctcagggaactggaatcgcctggaggacgaccaccggacccacctagtatgtaatgcatgaagatgagcaatgacccttacgagctgtccgtcgaactgcctgccgtcgagacctacctgcggctgcgacccgcggcgggactgagtgcgatgtcccccgaggccgcggcgctcggcctgccgaacacctggcacgcggttcaggtccgccacggcggtgagccggtcggtatggggcgggtgatcggcgacggcggttgcttcttccaggtcgtcgacatctgtgtcctccccgatcatcaggggcggggcctcgggaagcgcatcatggccgagctggtcggcgaactggagcgccgggccccggcgggcgcctacgtctccctcatcgccgacggcgacgcccggcatctctacaagaagttcggcttccgcgagaccgcaccggcctcggtgggcatgcaccgcaccgtgtgagacgacaagctcacagcagggcgagcgttgccccggcgcccgatgagttccgctcccgcgctcggtcaccatcgatgaaggcaaccacacggacaggagcgggacatgggtcagctggtcgtggtcaacttcctctcgttggacggcgtcatgcagtcggtcctctcggccgacgaggaccgggacggcgggttcgaccgaggcggctgggtgctgccgtacgtcgacgaggtggtggagcggttcatgagcgaggccacggccggcgccggtgccctcctcctggggcgcaggacctacgagatcttcgccgccacatggccgtacgccgacctggacgaccccgcggtggcctcgatgaacgcgatgcccaagtacgtcgcgtcccgcacgctcaaggatctgagctgggcgaactccactctcctcggcgccgatccggtggaggagatccgtgggatcaaggccgcgtccgggagcgagacggtggtcctgggcagcggagggctgctcgggagcctgatcgagtacgacctcgtcgacgagtaccggctgctggtcttccctctccttctgggccgtgggaagcggctcttcgccgatggcaggaccccccgtcgcctgacgctcaccgcgacgcggccgacaccgtccggcgtcctgatcaatacgtaccgccgctccgccgaagggtgagggcctgatcggcggcaaggaaccgaagcgctccgggaccatgtggagcgggcacagctcggtggcgttcggcgtggagatcgggaaggccggcgcgcatggtttcgacagtgcagaacggggcgaccgactgtgcggatgctcatgggccggcacgggtctggagcggtgtgacaggtcgtccgccgcacccggaggacaggccgggcgaccgggagacccaggtgctgccggcggaggggccggcgttccgcggagtgcgtccgaccgggccgccatgaattcctgacgcccacgcagtccgggacgtactccgagcacccccgggccgcgcggctccgaacgagtggacttcgcagggcgcggccgggatgcgggcggagcccggaggccggggtggtgtcgttgccgtcgctcccctcccctc

SEQ ID NO: 3041 - DNA, 4181 bp, Unknown
  Kingdom: Bacteria, Phylum: Actinobacteria, Class: Actinobacteria, Order: Streptomycetales, Family: Streptomycetaceae, Genus: Streptomyces
gccgaccgcaggactcggggtcgacgatccgtccgcgccggaccggccgctcgtcgcccccgtgggggccggagccggggaacgggtcgagaaccagtccccgtccgggcacccaggcccgggtgcgggagctgcccaggtccagggccagtccccgggcggccgggggaactcccggtgcgccctgggcctccggtgcgccccggtgctggtggtgtgcccggaggtccgcgtgggaacgccgcgccccgaacgccccggcaccgctcccgtcacgaagcggtccggggcccttcccccatgggcccgcccccgggcggagcggccctcgccactcgccgggcgcggaagtgagcgggccgcgaacggccgggaccgaagtggtcgggagagcagtgaccgggagagcagtggtcagggcaggaatggtcggggtgggttccgctccgccatgtctgccggggacgccgggtccgccgggtccgccggggacgggaaaccttcggcccgtgccggccttcccggacgacggggggacggcgcgacccggtcgctgtccgtcgtgcacagaacgcatcgtccctcacccccggccggccgtctcagccgtccacgcacccgtcggcccactgatagcgaggcacgaccaagccctcactatgcaatacggggtggtggaacgccacttcctcgctgattcacaggcacaccctcgcggcgcgcaccgttaggcagtcggctcagctctcctcccccatcggcaggaaggcgccgaccagctccgcgaactcctccggcaccgcgatccggacccccaggtcctccgccttggtgcgcttggatccggccttctccccggcgaccagcagactcgtgcgcttggagacgctggaggacgacttgccgcccgcccgctcgatcagctcgttcatctggttgcgcgacagcttctccagcgctccggacatcgcgcccgtgaccaccacggtcattcccgccaggggcagcgtggagccggttccggcgtcgccaccggcctccgcgtccgggccggccgcctcctccgtcccgggctccggaggcggggtcgcacccggctccgtcatcgtcaccccggccgcgacgagcttgtcgatcagcggcgccagctccaccagctcggcgaccaccgcggccgccttctccttgccgatgccgtcgacccgctggagcgtctccacgtcggcggcgacgatccggtccatcgtggcgaaataccgtgcgatgcggcgcgacatggagcgtcccgtgccccggacgccgagggcgcagaagacccgggacagcggccgggtccgggcggtgtcgatggccgccaggaggttgtccgtggaggtctcgcccatccggtcgagggcgagcaactgctcccgctccagagtgaacaggtccgcgaagtccgcgacgagacccgcgtcgaccagctggacgacccgtgtggagccgagtccctcgatgtcgagctgatcgcgccccgccgcataggagacggaggcgaccagacggcagtcacggccccgggtgcagcgccagcgctgctcgctcgtgtcgatgtcggaaccgcactgcgggcagctctcggggaaggcgatgggcgtctcgtcgccggtgcgcaggtgcaccacgggggcctcgatgcgcgggatgatgtcaccggccttgtagaccatgacctggtcccccagccgcaggtcgcggcgggtgatgtcggccgggttgtgcaaggtggcgtagccgacggtggagccgtcgatctccacgggttcgaggacggcgcgcggcgcgatgatgcccgtgcgcccgacgttccactcgacggccagcaggcgggtgatcttctccacggcgggaagcttgtaggcgatggcccagcggggggcgcgggtgccggagccggcctcgcgctggtcggccgcgaggtcggccttgatcacgatcccgtcgatgccgaacggcagcgaggcgcgcagggaacctatcccgtccacccgcgcctggacctcctcgaccgtaatcgcccggagcggcgcgacgtcggtgtccgcggccgtgtgcacgccgaggccggcgacgtacgccaggacctcgctgtggggcagttcggcgagggtccccgcgagctccccggaatcgggcagcggcagcgcgccgtaggcgaagaaggtcgtctccacccggtacgcgcggtccttggcgcgcagggtgcccgccgccccgttgcgcgggttggcgaagggggcgccgccgtgttccgtacggatcgcgttgccccggtcgaactgctcgttcgtcatgaggatctcgccgcgcacctcgatggtgaccggggcggccagccgctccggcaggccgacgacggcgcccgccgcgtgcgacacgtcctcgcccgccgtgccgtcaccccgggtgatgaggcgctcgaacaggccgttccgatagcgcgcggcgaccgccaggccgtcgagcttcggctccacgctccacgcggtcaccggtctgccgatccgtcgctccagcgacgccgtccaggtcacgaactgctccgccgagaacacgttgtccaacgagagcatgggcaccgtgtgcggcacgtcgccgacggcggccccgcccgcgaccttgcccgtcggcgaggcggcgagcacctcctccgggtggtccgcctcgtacgcggctattccgcgggccagccggtcgtacgcgtcgtcgtccagcgcgctctcgcccgtggcgtagtacgcggcggcggcgagggaggcctcttccaccgcgacggcataggcggcggcatcggcgagcacagcagctgagttcgtcatggccaccattcttccgcccaccactgacaacgcctccggttcccctcccgccccgataccaggagagcgctctctcttaacggcatgttcaacttaccttcgatcaggctcgtttgttgagaccgcgcactcccttgacatgcacaggaggcgcttctacgttccctgaagagagcgctctctctcgtgaaggaatccccccacttctccggacaggagtgccgtgctcttccgtcatcgacgtaaccccgaccaccgtcgccaacgatccctgccgtcctggcggtacagaatcgccggactcgccgcggccgccctggccctctcgttcctccaggccaatgtgggcaacgcggcggccgagcgggctgccgccgaagccgtgccgaaggccgccgcggacgtggtgcgggtggccgagttcctcgcggaatgcccgtacacccaccgggcccccgacgacccgatcgtcttccccgggctgccgggcgcctcccacatgcacagcttcttcggcaacgacaccacccacgccggctccgacctggcctccctggaacggggccgtacgtcgtgcgcccccgagaccgacctgtcgtcgtactgggtgcccaccctctacgacggcgacaaggaggtggagcccaccgggaccaccttctactacctgggcgaaggcgtgagcgacgatgtcatccgccggatccggcccttcccccggggcctgcgcatcgtggcgggaaacgcgaaggcgaccggcccgcaggacaacacgatcgcccgctggtcgtgcctgcacgccggtgaggtgaacccctcgcagaacttcgtgcactgtccgcccggcacgatgatggagtcctacctggacttcccgcagtgctggaacggcacggacctcgactcggccgaccacaagagccacatggcctacccggtggccgggaactgcccgtccacccacccggtgccggtacccaaactccggcaggtgctgcgctatccggtgaacggcgaccccgcccgcttccgcctggcgtccgggcccggctacacgatgcacggcgacttcttcaacgtatggccggaggaggagatggcgcagcgcgtccgcgactgcatcaacgcgatcgtcaagtgcggttacggcggcagaccctgaccgcccgtcacccctgcccatcgccacgtccgccccggcccccgactccggggcggacgctccttccccgtacgaggacacctcatgagccccttgaacctcccgccgctccaccgggccgccgtcctcggtctgctggccgcactgggtctcggcggcgc

SEQ ID NO: 3042 - DNA, 10584 bp, Unknown
  Kingdom: Bacteria, Phylum: Actinobacteria, Class: Actinobacteria, Order: Streptomycetales, Family: Streptomycetaceae, Genus: Streptomyces
tggcggcgacgtcggcggcggcgaccggctggagccgggtgcgcgggaggcggacggtgtcgtcgtcggaggtccaggagaggacggcgtccatgaactccatgaactgcgtggcgcgcacgatggagtacggcacggggccggcccgcaggatctcctcctggagcgtcttggcccggtagtagtccagttcgggcacctggtcgaccccgacgatcgacaggacgacgaagtgtccgacgtccgccttccgtgcggcggcgacgaggttgtccatcgaggtgcggaagaacgccggcgaggcgtcgtcgaacgtcggcgagttggtcaggttgacgaccacgtccgcaccggcgagggcggcttccagcccttcgccggtgatcacgtccaccccggtggacagggagtgggggactgcgcggtgaccggccgcgtcgagatcccgcaccacctgggatccgatcagcccggttccgccgatgacagcaatgtgcatggccctgcccttcctcgatcacgtgtcctgtccggctccgggggcgtcgcagcacctcacgccaaacgcggacaccttctatccgagatattactcggacatctcctatccgggtacccgacgccgtggaatagagtgaagaagtgaaaatgtctggtggcgtcgagtgggcactgcactgctgcgtcgtgctgacctcgacggaagaccccgcgccggccgcgcggctggcggagctgcacgacgtctcgcccagctatctcgccaagcagttgcaggctctgtcacgggccggactagtccagtcggtccagggcaaggcgggcggctacgtcctcacccgctcaccggcgctcatcaccgtgctcgacgtcgtcgaggcggtcgacggccccgggcccgccttcgtctgcaccgagatccggcagcgcggcccgatggccactcccccggaggcctgcaccaccccctgcgccatcaaccgcgccatgggccgggccgaggccgcctggcgggaggccctccgctcgatcaccgtcgccgacctcgccgccgatgtcacctccgactacgggcccggcgcgctgggcaggatcagctcctggttgaacccggccgacacctaggccgcgtttggatcttgccgaagtggggcggcacgcgccagatggcggtcttcggtgcccagccttgcttcgaggtgtcggtggaagccgaggtgcccgccgtggccgaagcggggcggccgcgtgacgctctgcccgaagcgtggttcccgtgcgagaacgtggacgcgcccgccgttccgccgcccggcatcgcagacctgacctgtctggctggctggctggctggctggctggcccagcaggcggacccaccgaaccggtcgccgtgcggtcatggccttgctcgccgaacggcacgggacagagaacctcggtctggtggtccggttcgacaaccagggacgactcggggccgttgccttgcggtcggcacactcagcgcacgaagtgcgtcactgtgccgtggttgtcgggagaggtcagaccccagaggaccagccccacgatgattgccagcaggatcagccccggcaggttgtcgggcccccaaccggcgggctgccgaaccggtgggccgggtgtggcgtcgtcgcgtgcagcgtcggagtcggcacgctgccaggccgcgaccgcggcctcaccccgggcgatccgcgcggccacgtggcgtacatcggccgcgtggtaggtcggctcgcgggtcaggtccggggagggcgcagccgaggtacgtacgctgttggcccgtgccacggccctgatgctgctcggcctgatctgcggccacacctcccggacttcagccttcgtcagccagccttccccgtccgcaaggtcctgctcgtgcgccgcccccatgcgaagtccgccccctcgttcgccgatccccttgacttgatacccagaccgacgaaagatcacccggccgggcagtcaccatcgatctcacgctcactgtgatcggcaggaaaacggcttctcggcggagcagggcctgagccatagccggatggctgctgtggtgacggtgtgccgtggaaggcgccggccactcgcgattcgccggatcctcccggcccttgaccgacccgacgagcaaccgttggaaggccggctgctcgccggacggagcctggctaggccgtgcgcccgagcgcgcacccgcgccgacaccgacgggatcgggcgcgccgcacaccacccacacccgacgcgccctcatatgcttcaccttctgccagttcgcccgcttcaggaggtcctgtgccggcccgcgccatgtactgccacacgtgcgattccgatgagcagcaccgttccctcaccgccgacgagaagacctggctccgcggcaggacgggacgccggagcgtcgacgagttcttcatgtgcaaggcgcccgactgccgcaatgtgcgcagcggtttcaacaagcacccgttcgaccccgtgatccgcgtccctctgccggactgacgtcggctcaggacatttcgacggcttccttgacctcctcgatgggccggtcgacgccgaccgccgtttcgaacgaactgtgtgcccatgactctctccggcccgtcgggacgcaccgggccggagcggccgcccgcgcgccggtcgcgggagatggcgcggaacccgctgtccgccattggtttcggccgaggttcccgggagtcccgcgggggtcggcggcgcgacccttgtcagtatccagaatcctgtttactgtttgatccgtgaacgacctcgacgaccgcttcctcacgcgcaacggcctcgccgcccggcagctggccgtcctgctcctgcaccacgagccggacacccgcctgccccgtgtgcgcgacttcgccgaggagctgggctgcgggaacgggaccgtccaggccgccctccagctactggaggacgccggggcgatctccacgaccgcgcgcggccacctggggaccttcctggtccgttcggaccgcaccgtcctgtggcggctgtccgggctggggaccctgctcgcagccatgccgctcccctactcacgcaggtacgaggggctggcgaccggcctgcgcagcgccttcgaggaggcgggcgcaccgttcgcgatcacgttcatgcggggtgccggagcccgcaccgccgccctgctggagggcaaggtcgacctggtggtgctgtcgcgcttcgccgccgaccagctgatcgccgagcatccggtggaactggtggccgacctcggccccgccacctacgtcggtgcgcacggcatgctcgtacggcacggggtcgacccggcttcgccgggactccgggtggcgatcgaccacgcctcggaggatctgcgcatgctcgtggagcgggtgttcgccggccgggaggacatcgagtggcgggaggcctcctacatgcagctgcatgacctgttcgcacggaacgaggtggacgcgaccgtctggaacctcgacgaggcacaggaccggctcgggctcggcgtcgatgtactgccgctcggcgacgaggtcacccgggaactggcgctgcgcaactccaccgccgccgtgatcggccggaccgagggggcgaaggcactggccgccgtccgcgagtcgctcgacctgtcgacggtgacacgactgcagagtgaggtgctgcggggggaacgcgtcccctcgtactgacccccgccggcccggctgccgcgacgcggatatcccggagcgccgcacaagctgaaaatacagaatcctggttattgttgattgaggaggaccgtcatggacgaccagctcgcactgcggatccagctgttccgcgaaggcggtcaggtcaaacccgaggtggtcgacttcgtcgccgccgaactcaccgccctggaagccgaggggcacctcgtcaccgaggcgactgccggcatgctgaccagtcatctcatgatggcgatcggccgcctgctgaacggcgagccgatcgagcagttcctcaccgacgaccaggtcgccgccgaactggcagaccatccggaggcggtcgcccgtgcccgcgcggtcgccgcacgggccgagcgggagctgggggccgcgctccccgcgtcggagatcaacttcctcggcatgcacttggccgtactggcccggcagtctccgcccgcccccacgtcctgaccggtcgcgtgccttctccccgcacgccctttctccccgtacgccccgcaggaacacgtagaaagcagaacagccatgacgaagatcctcaccggtggagtcggcaaggtcgaggtcacccaggccatcggcaggctcggcatcgactccctcgacgtcgtcccctccagcgacatggacgccgcgatgaagctgcgcgtcggccaggccgactactacctgggcacgtgccacacgggcgcgggtgcgtcgctgggtgtgctcgtgggtctcctgggcagcgcctcctgccacaccttcggccggagcgtccccagcgaggaggccgtcaccgcgctgctcgccgagggcaagaaggccttcggcttctcgatggaccagatcgacgtcatcgccccgctgatggcccgtgccatcgcggcccgcggctgatcgcagcctccttctcatcgtcccgggcaccaaggagtgactcgtgagcaccacactcgccgccggcgcggaactcgacttctcgctggcgcagcaactgaccgtgatagccctctgcgcgctcacggcgttcatcgcgcacatggcgctggccgtcttcaatgacggcgtgcgtcccttcctgctggacttcatccaggggcgcaccacccgcagcgcgacgacggccgtctccttcgggctctccgccgggttcatcttcgggctcggcgcgccgatggccctgtccaccggtgtgctgaacccgtggctgctcttcctgcccacggacatcctcgggatcctgtcacccaagaagtggctcgccccgatcctcggcggcgcgtggggcgcggtggtcgtcttcggcctgaacggcgccaacaacatcgcccacgacctcccggtcgacttcctgaccgcgatgcagcagatgtcgacgccgatcctgttcctgttcacgctcttccccgtgctcgccatcaccaagcagttcggccgcaagtggggcggcgtcgcgggtgtcctcgaactggccctggtcgtcatgacgatgaagctgtggcccaacatgttcgccggagcgctggccatggcggtcggcgtgctgatgctcatcggtctcgccgtcgccaaggacgtgaagcagcgtcgggccgaccgggccgcgggcgtcgtggaggaggtgggcggggacgacccgatggcgtccctcttcagcgccagcgcgacccggctgcggaagtacctgcccctgttcatgctgctcggcgcgggcgtgtgcgtgctcgcccagatgcacgtgttcggcggcggcgaagccaccagcttcctgatcgcgaaggggcagtacgcggaagcggcgcaggtcgacttctaccgggtgttcggcttcatcccgctgatcgccacgaccgcgctggcctccggcgcgtacggcatcgccggcttcaccctggtgtacccgatcgggtacctcatgccgaaccccttcctggccgccgtcgtcggtgcgctcgtgttcgccgtcgaggtgctggcgctctcctggatcggcaaggtgctcggcaagctgccgagcgtgcgggactcctcggagcacctgcgcagcgccatcggggacaccctccagctcgcgatcctgttcggttccctgatggccgccaacgccatgggcggcgggctcggcatcctcgtcgtcggcgggctctacctgctgaacgaggcgatgggccggcccgtcgtcaggatggccgcggcgcccgcggccgtgatcgtcggcggcgtcgtcctcaacatcctgtactggctcgacctgttcaccccggtcaagggctgagacccgatcgcgtccggccgggccgtacacggagagagaacccccacgatgaaccaccccgcaccgcacaccctgcgtaccgtcgccggagaactccgggccgcatcggtacgcggccccgccctcgcccacgagcatctcgtcctggatctggaccacgtgggcgacggcgcggccgtcctcgacgcgggacgccacgcggcggccgtgatcgcggaactcaccgaactgcgcgagaagttcgggctgtccctcgtcgtcgagctgacctgtcggggcatgggccgcgacgtccgggccctggcccgggcagcccgggaggccggtgtcgccgtcgtcgccgcgaccggctggtactacgaacccttccacacccccgaggtcgatgcctgcgacgtggaacagctcaccgaggtcctcgtcagggagatcgaggacggcatcgacgggagcggcatccggcccggtgtcctcggcgagctcggcagccacggcgacgtccccaccgcgcccgaggcgaaggtactgcggaccggcgcgcgcgcggcgctggccaccggtctctcgctcgccacccatgcccagctcggccggggcggtctcgcccagctggacctgctcaccgccgagggactgcccgcccaccgcgtgagcatcggccaccaggatctcctcgacgacccgggggtccaccgggagctggcggcgagcggggcgtacgtcgcgttcgacaccgtgggcaagtccgcctaccagagcgacgacacccggctgaggctgctgctcgcactggtcgaggcgggccacgcggaccgggccctgctcagttgcgacgtctcccgccacggctacctgcgaagtgagggcggccagggatacgggcacctgttcacgggcttcctgccccggctgcgggcggccggggccgacgacgacctgatcgacctgctgacccgccgcaatccgctgcgcttcctgaccggcgcgaacgtggaggagaactgacatgcgcatcgcacccccgcccccgcttcccccgaccttcccgctgccgacggtgaccctggaggacgccgtggcgcggcagttccggctgctggaggccaccgccgcgcacttcgagggggaacagctgttctccgccgacgcgggagtcgtccccggcctaggccggccccggaccaccgcccgcgtcgaggccgtgctcgccgatttcttcggcgccgaggacgccgccctcgtacagggagcgggcaccggggcgatccgggccgcgctcaacgccgtcgtacgggccggcgacgatctgctcatccaccgggccccggtctaccgcaccaccgaggtcacgctcagaggcatcggcgtacgcaccacggaggcggacttcaacgaccgtgcggcgctcgacgccgcgctggcgtccgggcggttccggtgggcctacgtccagcacacccggcagcggctcgccgactcctacgatccgaccgaggtcatcgccgcctgccgggcggccggggtccgcacgatcgtggacgacaactacgccgtcatgcgcacccccgccgcaggggtcgaactgggcgccgacgcctcctgtttctcgctcttcaagctccatgggcccgagggcgtcggactggtcgtcggcgcacgcgacctggtcgagggcgtccgtcgcgacaactactccggcggcgggcaggtccagggccaccaggcactggacgccctgcgcgccctcacccacgtaccggtcctgtgggccgtgcagtcccgggtgggggccgagatcgccgaccggctcgcggccggtgaggtggacggggtggccggggtgcgcatcgccaacgcgcaggaccgctgtctgctggtcggcctggaccggccggtcgccgcggaacttccgtccgtcgccgcacggttcggcgcggcgccgtaccccgtcggctccaactcgcgctacgagatcgcgccgctcttctaccggatgtccagctccgccctggacgacgccccggagctggccgactggaccgtgcgcatcaaccccatgcgggcgggcgcggacctcgtcatcgacatcctgcgccgttcactggccgccctggacgacccgaaggaccactgaccgtgtttctcgacaccgtgctcacccgcaaccccgagctcgtcgacgccgcagccgccctgcacgggtccggcgagatcccgcccgacacctatgtcatcgacctcgatgccgtggaggccaatgccgcgttgctggcggccgaggccgaacgcctcggcatcggcctgtggttcgtcgtcaagcagctcggccgcaacccggaactgatccgcgccatcgcccggcacatcccccgctccgccgccatcgacgtggccgaggcccgggcgctgcacgcggccggcgcacggccgggcaacctcgggcacctcgtccagatcccccggcgggcgctgcccggcatgctggcgtggcggccggagaacgtcacggtcttcgacctggccaacgcccgtgccgtctcggacgcggcccgggaactgggcttcgtccaggacgtcctgatccggctcgaaggagccgaaggcgccgtctacccgggccaggagggcggggttccgctggagcggctggacggcttcgccgaggcggccgaggctctcgcgggcatccggatcgcgggcgtcaccgccttcccgtgcgtgctgtgcgaccccgagacgggtctgcccgccgcgacggccaccttcgacctggcgctcaaggcccgcgaactcctcgccacgcgcggccaccgggacctgctgctgagcgcgcccagcgccacctcgatggcatccctcccgctgctcgccgagcgcggtgcgacgcacggggagccgggccacgcgctcaccggcaccactcccctgcacgccctggacccggcccagcccgagaagcccgcgtacgtgtacgtcagcgaggtcgcccacaccctcgacgacagccgtccggcgctgtacggcggcgggttctacgcccgttcccacatccgcggcgccctgctgccgcgcaccggcacccgtctgggcgtgcaggacgcgcccgccgagaacatcgactactaccggctgctcgacgcacccccgtccggcgcggacatccggctcggggacaccgcactgctcgccttccgcacccagatcttcgtcacccgctcgaccgtcgccgtcgtctccggactcgcctccggtcgtccccggctgaacgggctctacgacgcccggggccgagccctgtaaggagcacctcatggccaggaccgtcatcgtcgtcatcgacggattcggcgtcggcgccatgcccgacgcgggcgtgctgcgccccggcgacctcaccgcggacacctgcgggcacgtactcgaccacgcccgcgccgcgttcggccggccgctgcggctgccggtactcggggcgctgggcctcggcctggtccacccgcaccaggacctggcgcggagcacccggctgcccgtgtcggcgggccgggccgccctcggctatccgggcgcggacaccttcgcgggccaccagaccatgatgggcgccgacttcagccgggtgaccgtggcccggctggccgaccacctcgaccaggtgaccgaagcgctcacggcggccggtcaccggaccgaacggctcgacggggagccgcttctgctggtcgacggggcggtgctggtccacgacaacctggaggccgaccccgggatcaactggaacgcctccggtcgcctggaggacctgccgttcgacggaccggacggaatcctcgccgtcgcccgtacggtacggtccgtcgccccggtcgcgcgggtcatcgcggtgggcgggcacgcggacggtccgctcggctccttcgtacggcgcggggacggggacaccgtcgggctggacaccccggccaccggtttctaccgcaacggcggcctggaggttcagcatctgggcgccccgctcgaccacacccgtcagctccccggtctcgcggcgcgggcaggcatcccggtcaccctggtggggaaggccgccgacatcctggtgtgcgaacaggcggaccgccggccggccgtggccaccgccgacgtcctgacccacatcctggacgcggtacgcgccggcggcgacgccctagtggtcgcgaacgtccaggagtcggatctggcgggacaccagcaggacgccgggagatacgggcaggtgctggagcaggtggacgcggggctcgccggactgctggcgctgctcacggactccggcgaccggctgatcgtcaccggcgaccacggcaacgatccctcgatcgggcacgcgcaccacacccgggagtacgtgccggtgctgatccaccgccccgacggagccggggtggagctgctgccggacgcgcggagtctcgccgacgtgggggcgaccgccgcccggtcgctggcgctctccccgcaggacctggcggccggtactcccctcgtcgccgacgaggg

SEQ ID NO: 3043 - DNA, 12211 bp, Unknown
  Kingdom: Bacteria, Phylum: Actinobacteria, Class: Actinobacteria, Order: Streptomycetales, Family: Streptomycetaceae, Genus: Streptomyces
gcgggcctgcgccccgtcgggtttgccgacggggcgcaggcccgcgatacgcgccggaccggcgacccccgggtacagccgggtccgtttcaggccttgcgctgcatcgacgagcgcgccgggttgccctgctcgcccgccttcgggtccttctcgcccgccttcgcgcgcacgccctcctcgacgcgcttgccgagcgtgctgtcgacgttcgaccagtactggaacgcccgcttcagcaccggttcggtcacgccgttgagcaggtggccgacgatgttgtccaccagccggtcccgcgccgcgtcgtccaggacctcgcggaccatggtgcccggctggccccagtcgtcgtcctcggcgtggtcgacgtaggccgcccgcgtgatgtcgccgtccgcgtaccagctcggcggggtgccgtagcgctccgtgtcggccgccgggccccccttggagttcggggcgtagacggggtcggtggtcttccggtacgccatcgctccgtccttggagtacgtgttcaccgggacgaccggggcgttgacgggaagctgctggtagttgccgccgatgcggtggcggtgcgcgtcggcgtagctgaacagccgggccagcagcatgcggtccgggctcgggccgatgccggggacgaagttgttcggctggaaggccgcctgctcgatctcggcgtggttgtccgtggggttgcggtccagcgtcatccggccgacctcgatcagcgggtagtcgccgtgcggccacaccttggtcaggtcgaacgggttgaagcggtagtccttcgcgtcctcgtacggcatgatctggaccttcagcgtccagctcgggaagtcgccgtcgcggatgtgctcgaagagatcacgcgtgtggtagtccgtgtccgcggcggccatctggtcggcttcgtgctgcgtgaacgtctcgatgccctggtcggtcttgaagtggtacttcacccagaaccgcttgccctcggcgttgatccacatgtacgtgtgcgaggtgtagccgttcatgtgacgccaggtccgcgggatgccccggtcacccatcagccaggtgacctggtgggccgactcgggcgagagggtccagaagtcccactgcatgtcgtggtcgcggaggttgttgtccgcgcggcgtttctgggaccggatgaagtgctggaacttcatcgggtccttcacgaagaacacgggggtgttgttgcccaccatgtcgtagttgccttcgctggtgtagaacttcaccgcgaagccgcgcgggtcccgccaggtgtccgggctgccccgctccccggcgacggtggagaacctgatgaccaggtcggtcgtggtgccgggctggaagagcgcggccttcgtgtacggggagacgtccgcggtcacctcgaacttgccgaaggcgccgcttcccttggcgtgcggctggcgttcggggatgcgttcgcggttgaactgggccatctgctcgatcaggtaggagtcctggagcaggatcggcccgcccgggccgacggtgagcgaatgctcgtcgctctccaccggggcgccggagtcggaggtggtcggcttgcgcgaggtgtcggtcatgtcgtcgtttcctctttttgtcttccgcagacgtgtcggcgatggctcctactacggctgccctactgaccctctgccaatgtaggcaaacgcggacgaattgactcgtcgaggaaccgctcccgaccgagctccccgccgcgtcggcgggccgccgccccggcgggccgccgccccggcaccctcgtggcgcccggagccctccgcgtatccccgatgcggaagctcacacatcggcggcagggccggtcgccgccaggggcccgaagctggccgggggctctgtcattcgcctgcccgcgttacgccggacgggagcggagcaggaggagggggacgggagcggaggagggcgtgcgcgtgcatgcgcgccggcagaaccgactgagtatcttccccctcccctctgagtacggcaccgcctccgcctgccggtcccaaccgtgcgagccttcaccccacggagccgaggggttccggtcaccggtcttgggtgatggggcgggatggggacaaagccgtggatctgttcgatgtggagctgggcgggcgggacgagccctcggggggacccgggggcagttgctcctgggtcaccgccgtgatcctcgggattctggtgctgctggcggtgctggtgcacacgttcttcgggtgggcgcgggatctcctcggctccctgatctcgtaacggcaccccgtcagccgcgccgccgcgcctccaccgcgtcacgggtgtcctccgcgatcagggcgccgttgatcgccgatgccgccatgaggccggccgctgcggcgccgatgacctgttcggtgaggcgggtgacattgcccgccgcccagactccggggacctccgtcgcgccggtcgggtcggtggggatgtacgtgccgatcacctcaccgcccatctcctgcgcgaccggggtcagccccagcgattccagtacggccgaacgcgcgacgaagcgcgcctggatcaccagcgcctcgcgcgggatcacccggccgccggccagccgtacgccggtgaaccggtcgtccgcgacctccaggcccgtcacctcgccgtccaccaccgccacgccccgggccgccagctcctcgtactcctcgtccgtcggctccgggcccgtgtggcggaagagggtgacgtcctcgctccactgccgccacatcagcgcctggtgcacggcgagggcgccggtggcgagcacgccgatcgggcggtccgccacctcgtgaccgtggcagtacgggcagtgcagcacctcgcgcccccagcgctccgccaggccgggcacggggggcagctcgtcgacgagccccgtcgtcaccagcagcctgcgcgcctcgacgctccggccttcctccgtcaccacccggaagccccgctcccccggcagccgctcggccgaggccacccggccctcgacgatctccgccccgtacccggcggcctcaccccggccgatcgccagcagctcgccgggcggggtcgactcgcggcccagatagttgtgcacatgggacgcgggcgcgttacggggctcgcccgcatcgatcaccaggaccgaacgccgggcccgcgccagggtcagcgctccgctcaggccggccgccccgccgcccacgatcaccacgtcgtaccgctgctgcttcatgtcgtcactcctgctctccatgcggatcacctccggttgatgaagagagtgcgcccatgaggccgaaacgacaaacatccttgccggaatggcaagtcaggagaggtcgaactcgcaccacacgatcttgccggggttccgctcccccaccccccatttgtccgccagcgcctcgaccagcagcagcccgcgtccaccctcgtcgtcggcccccggcaggtcgcccgccgggcgcacctcgccgtccccgctgtcgtgcagctcgacgcggagcgcgttctcgatccgctccaggtagatgtggaccttgaagccacgccccggcgggacgccgtgacggagagcattggtcgccagttcggttacgcagagcagcacatcgtccgtgcgcttctcgcactcccactcgatcagcgccttgcgggtgaacttgcgtacgaccgggatcgacctgcgctcacggcagtagaaggcggcgcggtagtaagggagttgagttgtctcgttcatgcttccacgctcacacggtgtaactacgcttcagcagagcccagagacgtacaaaagcttttgtacgggttctgacgggttgacagcgggaccggaacggggagagccaggtcatgcaaaccggaaagcagagcggcatcaggcgagttacctcatggcagttggtcggggcgcaggtgcgccacctccgcaagctcgccggactgacgcaggccgcgctcgccgagcaggccggggtgggcgaggacacgatcgcctcgatcgaacagggtcgacgcgcgcttcagttggacatggccatccagctcgatgaactgctcgacagcaggggcgtgctgcgggtcgcggtggaacggattccgcggaaggagcgttaccaggctctggtcaaggacttcgtacagtacgagcaggatgcggtgagcctgttctcgtaccagtcgcagctcatcccgggactcctgcagaccgaggcgtacgcgcgcttcatcttcggctgcaactacccgccgctggaagaggaggagatcgagaagcgggtggcggaccggctcggccgccagaagatttttgagcgcaggccccggccgatccttcacttcatcctggaggagagcatcctgcacgcccagatgggcgaccccgacatcatgcgggagcagctccttcacctgcgacgctgcgtggatctgccgttcgtcaccatccagatcatgcctcggaacacccctcggcacgccgggctcgcggggccgctcgttctgctggagacgcccgaccacgacgggctcgtgtacgtcgacggccaactgcgcggcgagctgtacgacgagcccgccgacgtcagcgcacttatgcagaggtatgggatgctgcgttcccaggcgctcaccgtcgcggagagcacccggctactggacgcactgcttgacgcactgcttggagagacatgtcccgcgcagcacaccccgcccccggctccacagccctccactggttcaagtccagctacagcaacggcgacggcggagactgcgtcgaagtcgccacccaccccgccgccgtccacatccgcgactccaaggtgaccgacggtcccgtcctcaccgtcgagcccgccgcttggcgcgccttcgtccacggcagcgcggccgtctgagtcacccccttacacgaaaaggccccaccccgcccccggccaccaactcggccggaagcggggcggttcccgtctgtgcgcggcgggatcagtagcgcacccacagctcgtagacgctcggcttggccgcgaacgggttgcagatgaagacgcggctccagagagcgttgtcagcgccggcgttccctacggcctgacactccgccaggctgctatggtggctgcggagaaagaagccgggacccgtcgcggaggcggtcgacgcggtgccgagcagcatcgcaccggcggtcgccacggtcaccgcgagagcggcaatacgtctatgcatgtcggtaactcccttttcaatcaatgcacatgaccgtgcatcagtgactggtcagagccgaaccgatcagcgcgcgccgccgagagaaagctagcgagccgggcgcgcccgcacaataggtctggaccaataaggcatcgcatatgccccatggccgtaaacctgtgtcctgccgcatatttcacgcggctcgctcaccccccggcgatccgctccaccgggatccacagctccgcctccgcccgcttcccctcctccgtcagccgcacccgcaggatctcgggtcccggcctggaggcgtacgggttcgacgggaaccactgcgtgaacacgtcccgccagaggtactgcagggcctgcgggaacgcgccttcgttcgtgaagaccgcccacgtccccgccggtacgtccagggcatccaggccctccggaggctccgccccgctcaccaccccgtggtagtaatcgagttcggtgccctccgcgcggctcgggtcgagctggtcgctcaccccgacgatccccgccgggtcctggtccgagagggccgcgatgcggtccagctcctcccggccgatcccccggatgaactccgcgatggccggattcggcccctcgtggatgagcgggacgcgggccttcctgcccaccacccggaatgcatccttctcgaccagcttgtactgcatggccgtactcccttcgacgacgagtcggaaggtcagccgttgctgggaccgcagaaccgcgccgccgcgccgggcctcgccggggccgatgccgtgcacggcccggaaggcgcgggcgaagccctcccccgtgtcgtagccgtaccgcaccgccacgtccagcagcgtccggtcgggagcgccgagcacctcggcccccgcgaccgtcatgcggcggcgacggatgtactccgacagcgggaggcccgcgagcgcggagaacatccgacggaagtggtactccgacgtcatcgcgatacgcgccagctccgctgcctcgatgcgctcaccgagatgtgcctcgatgtgctccatcgcgtcgttcagccgttccagcaaccgctgactccttcccttgctcgttcaccgtagggaggggccatcctgccggacccgaccgtccgtgcccggatcggtcgggccggcgaagcactacttcccggggttcgccagcagctccaccagggacgagaagctgtccgcgccgtgacccgcctccacgccccggcggaacaggtcgacgacggctgccgggagggcggtgccgactcccgcgtcccgggtggcaaggaggccgtcggcgtcgccgcgatccggtacagcgcccagcagttcgcggcgctcctgggggaagccctggacagggagcccgacccggcggaggcggtgctctcctgcacccgccagttggccgccgggcgaccaccgtcatcagcgccctggagggcgccgaggacacggcccaggtcaaccggagcaaggaacccctcctggcggcgggccggcagttggcccgactctggcctggcccgtctaccgggccgccgccggagcgggctcctgcccgcagatcgacttcctggcctgaccgggccgaccgggaaggggggccggaaacgcgggcaggggcggcctttcggccgcccctgccctggtcccagccgcttcagctgagcttggcgccttccacggtgctggtgaccgtgccggcggtggaggtggtggcccccgccgcgccgtcgaccagtcggccgagttcgccgacgttgtccagcgcccccagcgagacgggcggttcggccgcgtgagcggtgtccccgccgcccgggggcggggagatggcggcgatgaccgctccggtagcgagggtgacgacggcaaggaggcttcgcttcttcatgcccggttcaacggcccggggccgggaaagggcacgccccagatttttcatgtgccggccgtggcgcgtcacgacaccacgcggcggcggtccgcccggcgcggctcccctgccgccggcaccatgtacgcggcgccgccgagaagcacgtccgccccacctcgacggtcaccgcccgcaccccgcgccctagtctgtgcccatgctcgtctacgccccggcggcgctcctcttcctcgtcttctgtgtgagcgtgctgcacgagcgccgcaagttcagcaacgccgtcgtcctcggcctcgccgtgctctgcgcgctgggggccctgctgtaccggctggtcggctccggatcgccctcggtgccctacgtcgtcggggcgctggtggcactgggggcggtggccctgctcgtcttggtgtgcttcctgttcctcaacggcgtacgcatgctgcgcaaggagggcagaagcccctcccacctgctgtcgttcctggccgcgttcgccgtcctcggcgtggtcgccctgctggtcgcggccgccgtgctgcggactccggtgctgatcggggtggcatgggcggccggtgggctggcgctctacttctcgttcctgttcctgtgcttcgtctgctacgcgttcctgtacgggcggctgcgggtgcgccgcaaggcggacttcgtggtggtgctgggttcggggctgatcggcggttccacggtgcccccgctgctggcgagccggctgaagcggggacgcgaggtccacgagcggctctcccggcggggcgggtcccccgtgctgatcacctcgggcgggcagggacccgacgagaagctgccggagtcccacgcgatggccgaccacctggtggccgaggggttcccggccggcctcatcgaacgggaggaccgctcgcggaacaccgaggagaacctgctcttcagcaaaaagatcatggaggaggccaggcccgactaccggtgcgtggtcgtcacgaacaactaccacgcctttcgggccgccctcatcgcccgacgggtccgcatccgggggcaggtggtgggctcccccacggccgcgtacttctggcccaacgcgatgctccgcgagttcgccgcgatcctcgtggactaccggcagagcaacgcggcgatgtgcgtgatcatcgtcctcggcggggtggccgcctggtgggcgagctgaaggcaggagtcgcctgcgtcaccagttgcgcatgtttcgaacacaagtcccccacacatgaataaggttgatcgcgttcgcagcacggacgcccgtcggtggacgcgcgttatcggtcaacgaaacaaggggggtcaggtgtcccgacacctgtacacgagcagccgcaaccgccgtaccggacggaccgcgggagcggcggcgatcgcggtggtgctggccggagggctcgccacggcactgccggtcacggcgcatgcggccgggacggccgaagcggccgcggccgccgacgtcctgatacccgcgcccgacgccttcggcgagggacccgagaagatcctggcgaccggcaggtacggggtactgcaccgcgagggcgacgactacctctggaccaactcgtacaacagcaggaccagggtcgtcaccgagctcgcctcggtgccggaggacctgctcgtgggcggccacgacgagcacaaccgggccatctacacccagcagcgcgcggacggcgggacggacgtcgtacggatcggcatcgaggaccccgccttcaacagcacgatgaccgtgcccgccggctatctcaaccttcgcttcgccggtgcttgggtggtggtgaccgtcgacaagggcgacgggacgtacgagatgcgggtggcccggggcggagcgccgacggcggaccccgtcgtgcggctgcccgccggagccaccacggacgcccggcccgtggtgctcggcgcacagggcagcgaggtcctcatcggctaccgcctcgcggacggctccccgggctacggcctcctgaccgcgtacgacggccgggtgaagccgctgcccgtgaccggcgacgcgagcagcttccgcctcacccagatgaccgtcagctggttctcgcgcaacggcagcggcggccagggagtccgggtcatgccgcggagcggcaccggcacaccccaggtcgtcccgctcgccacccagtccccggacagcgaggtcacctcgttcgtggtggaggacaacatcgtctggcacgagggcatcggcggcccgctgcggctcacgcccatcaccggcgcggacaccgagcgcacgctcctgcccacggtcgagttcgcccagctccgggccgagggctacggagacgtgctggcgctgggcaaggacgccgacggcaagcgggccatccatgtgttcacccaggacggcagcgggaccgtcttcgacctggtgatgcgggacgttccgaaggtcaagacagcggacggcgagatcggggcgctgagcctcgaccgggggcggctgcggtacgtcaactcgctggtcgggaaggacaccttgcacggcaaggccgtcgggaccggcctcgacccggcggagggcgcacggctcgccgacttccccggtctcgcggcaggccgtttcgccgacggcgcggacgagggtctggcccggctggtcaccgatcccggcaccggcgccgacgtgctcgtgaccggcgacgaccccgaccagcaggccccgggcctgccgctgcccggcacgggcggacgcctcctcggcgcctcgccggagttcgtgctgtaccaggccggcggccggcagtacgtcgtcgacaccgcccgcgacctcgtcgtccgcgaccagccggcgcagggcgcggtgctggacggcgaccggctgatcaagtcggccccgagcaagcccggcacggtgaacgtggtcaacccgcgcaccggcacggtgaccgggacccacgacatcggctccgactgcgtccccggtgaactccagcgcagcggaaccctgttgtactggagctgcgcctccgaggacgcggcgggcgtgtacgacacggcgagccatcgcgactaccccgccccggtgtcgggggtgctgctgggcgaccgtttcctggccgcgcgcgacgcgtccggggatctgcgcctcaccgcgctcgggtccgacggttccaccgcggacctgggcaccgtcacgggtgtgaagcccgccgcgaccggcgacggccgcggctcgacctggaccctggacgcggacgcgggcaagctcgcctgggtcgggaccgatgacaccgtccacgtcaccgccccgcagcaggccgtctcccccttgagcgtcacccacagcaccgtgcccgccacctcggcgggcgagtggaacgccgcctggtggctgtccaagccggccgcgtcctggaagctgacgctggtgcgccgcgcgaccggggagaccgtccgcacctggacgggcgaggacacgcgcggcacggtaaaggtcagctgggacggcacgtccggctccggcggccccgtgccgaccggcggctacacctggcggctgaccgccgccccctcggacggcacgggcgcggacgccacggcctcgggcaccttgcgggtcaccggctgagcacgacccgcacggcgggaggcaccccctacggggtgtttcccgccgcctgcgcggtggctgccctcgcctggctccggcggtcgaacgcgacctgtgccgccgcccgcagctgcacgtagaaaggatggttctggtccgtctcccacaggtggagatagaccagcatctggttgatcacggtgtcgtactcgaccagcgtgccggacgccgggcccgccgccttgtcccaggcggtcagctgcgcctgctgctcgggggtgatcttgcccgccgccgcgaaggagtccgcgtacttcttcagcttgccgcccgcgccgccgtacaccagcttctcctccagcatcctctgctggaagtcgctgaacccggcgccccctccgagagtccgccgcaggccgacgagggcgtccctgcgctcctcggccagcgctgtgacctgggcgtcggtcgcgccggcccgcaccagctccatcaccgggctgctcccgaacgcctgatgggccgcgacatgggtcagctcgtgggcgacgtgcccgagcatgaaggaggtgccgcctctggcctgggtgtcgacgttgaacgtgaacgcggggtcctgatcggcggcgctggtgagcttcatgccgggcatgccgccccgcgggtactgcttcacggtcaccaggcccaccacggccatcagttcatcgatgaccgcacgggtctccccgggcaacctctcgtccccccggagtgcgccgaggtcgcggatcaagccgtccaccaggctggtgaacgcggtccccgacatcttctgcgacgccttctggccctcgcccgcgaggccccggacatccatgtccgggtcctcgttcgcggtcaccatccggtcgacctcggtcagcagcccccggaagaccgcctcggcgtcgagctccgcctgcgccccctccgcctcgcccctgagccgctccactccggcgacgcgcttccctccctcgggcttgtgggagacataggcctcgcatgccttgacgatgtccttgagggcgtaccaccgcgctacctcaccggcgtccggcagggcgtagaaggcacgcagcgcctcgtccaccttgctgatctccgacgcgttccgcttccccccgatgcgcttggagctctgcttgaactcgtcctcggtcatcatccgggacaccgtgatcatgcgcgtcacggcggtgttgcccagggtgccctggagactcccgggggtacgaggggcccggccgtcgtgccggtccgccgtccgggccacgggtgcgggccgctggcggtcgtggtcctcggccggggtctcgtgggtatgcatggagtcacgctaggcgggcgcgcgggacgggatctccgcgccggtgc

SEQ ID NO: 3044 - DNA, 6509 bp, Unknown
  Kingdom: Bacteria, Phylum: Actinobacteria, Class: Actinobacteria, Order: Streptomycetales, Family: Streptomycetaceae, Genus: Streptomyces
caccagtacgtgacgtcccgccgcgtcgaccgggcccgccggctgctgctcgacgggatgccgccgggcgaggcggcggccgccgtgggcttccacgaccagtcccacctcacccggcacttcaagcggatcgccggcaccaccccgggccgctatgcccgtcatgcccgcccacacggccttcaggggcccttctgaggcccgacagcccgccgccccggctccgagaccggaaccggggcggcgggccgctcacgcgggaactgcgcggtgcgcagtgctgtgtgcggcagcactgtgcgcccttcacggcgcacgtggacggtcagacgagcgaaccgcccggcagttcgaccttcgcgccgagcttctccagcttctccatgaagttctcgtaaccgcggttgatcaggtcgatgccgtgcacccgggaggtgccctgcgccgccagtgccgcgatcagatacgagaagccgccccggaggtccgggatgaccaggtcggcgccctggagcttggtcggtccggagacgaccgccgagtgcaggaagttgcgctggccgaagcggcagtccgagccgccgaggcactcgcggtacagctggatgtgcgcgcccatctggttgagcgcggaggtgaagccgagccgcgattcgtacaccgtctcgtggacgatcgacaggcccgcggcctgcgtcagcgcgaccaccagcggctgctgccagtccgtctggaagccggggtgcacgtccgtctccagcgcgatggcgttcagcgcgccgcccgggtgccagaagcggatgccctcgtcgtcgatctcgaaggcgccgccgacccggcggaaggtgttcaggaaggtcatcatcgaacgctgctgggcgccgcgcacatagatgttgccctcggtcgccagcgccgccgacgcccaggaagccgcttccagacggtccgggatcgcccggtgggtgtatccgtcgagcttgtcgacaccggtgatccggatggtccggtcggtgtccatggagatgatcgcgcccatcttctgcagtacgcagatgaggtcctcgatctccggctcgacggccgcgttggacagctcggtgacgccctcggcgaggacggcggtgagcagcacctgctcggtggagcccaccgacgggtacggcagccggatcttggtgccgcgcagccgctgcggggcctccagatactggccgtctgcccgcttctcgatggtcgcgccgaactggcgcagcacctcgaagtggaagtcgatcggccggccgccgatgtcgcagccgcccaggcccgggatgaaggcgtggccgaggcggtgcagcagcgggccgcagaacaggatcgggatgcgcgacgaccccgcgtgggcatcgatgtcggcgacgttcgccgattcgacgtgcgaggggtcgaggatcagttcgcccggctcgtcgccgggacggacggtgacgccgtggagctggaggagcccccggaccacccgtacgtcacggatgtcgggaacattgcggaggcggctgggcccgctgccgagcagcgcggcgaccatggccttcggcaccaggttcttggcgcctcggacgcggatctcgccctccagcggggttccgccgtggacaagcaggacatcgtctgtgccggtcatgtatctcgcgttccggagtggtcgggcagggggccaacgaaaagggtaatggcctcctaccccccttccgtaaggcgaaggggggtgtacgaacgtcatgaatccgccacaacaccctccgcgcatccgatcttgcggagggttaccgtccggatggcccaccgcgcgtccgtccggcggtgcgctccccgtgcctccgtgcgccctgagctgcgctcgctctcctgagggcggcatcacggtcactcaccccccgtggagggtgaagatgcgggatcattcctgccatgacggaggtgtcctcgctcacagggcggctgctcgtggccgcacccgccctcacggacccgaatttcgaccgggcggtggtgctgctcctcgaccacgacgaggagggctccctcggcgtggtcctcaaccgcccgaccccggtcggcgtcggcgacatcctcgcgtcctgggccggcctgaccggcgagccggacgtcgtcttccagggcggcccggtctcgctcgactccgcgctcggcgtggcggtgatccccggcgacgaaggtccgctcggctggcggcgggtgcacggggcgatcggcctggtcgacctggagaccccgcccgagctgctcggcccggccctcggttcgctgcggatcttcgccggatacgcgggctggggcccgggtcaactggagggtgagctgaacgagggcgcgtggtacgtggtcgagtcggagcccggcgacgtctcgtccccgagccccgaacggctctggcgcgcggtgctccgccgccagcgcagcgagctggcgatgatcgccacgtatccggacgacccttcgctcaactgagggacgaacctccgctcggccgggggtgacccttccctcaaccggaggccgcctctttcagtacccttggcggttatgagcactcttgagcccgatcgcggggcaggtacggggaccctcgtcgagccgacgccgcaggtgtcgaggggcgacggcgaccacgagcgctacgcccattacgtccagaaggacaagatcatggcgagtgccctggagggcactcccgtggtcgcgctgtgcgggaaggtctgggtgccggggcgcgaccccaagaagtacccggtctgtcccatgtgcaaggagatctacgagtccatgggcgccggtggcgacaaggacaagggcaagggcggcggcaaggacaagaagtaggtccggacctcacttgctgtcaggcccccggggcgtgcgacaccgcgcgccccgggggccttccgcttgtccggtcactcccggtgaccgttcggtcgcgttgcacgggctgcattcgctggtcacagagtggtcgagaccacttgtcgtcgccggagcgcggatctactctcctgccagttgtgcagaacgaaacgcacgttgcacatgatgcaacgcatgaccggtaggggttccggatgaagctttctgcccgaattgccgccccggctgcggcgcttgtgctggccggcctcaccgccaccgcctgcgcgccgcagacctccgacaccagtgcgaagggtgacgagaagagcggcacgctccgtgtctggctcttccaggaggtcggcaacaagcccaaggaggaggtcgtcgacacggccgtcgccgcgttcgagaaggcccacaagggtgcgaaggtcgaggtcgagtacataccggtcgacacccgcgcgcagcggatcaaggccgcgttcaacgaccccaagagcgccccggacctcatcgagtacggcaactccgacaccgccgggtacgtcaaggacggcggactcgcggacatcaccgaggagttcggcgcctgggacgaggccaaggacaccgacccgatcgccaagcagtccgtcaccgtcggcgacaaggtctacggcgcacccttcttcgtcggcgtccgggccctctactaccgcaccgacgtcttcgaggacctcggcatcgaggcccccaagtcccaggccgagctgatctccaccgccaagaagatccgcaaggcgaagcccgacctctacggcctcgcggtcggcggcgcgtacacctacggcgcgatgcccttcatctgggccaacggcggcgaactcgcgggcgagaccgacggggcgtacaagtccggcatcaacagcgagaagtcccgcaagggcatcgaggcctacacctccctcttcggcgacgacaactgcccggccgccaagtgcgcctccatgggcggcaacgccaccgtgaccgccttcgcctccggcaaggccgccatggccatcggcggcgacttcagccacgcggccgtcgaggcgggcgcggtcaagggcaagtacgccgtcgtcccgctgcccggcgtcgccaaggactccatcgcccccgccttcgcgggcggcaacaacctcggcgtcctcaagagcagttcgcaccggaccctcgccgtcgacctgatgaagtcgctcagcggcaagaagacccaggccgcgatgttcgacgcgatgggcttcctgcccacctacaccgacgtcctcgacaacgccgcgaagaaggagcccttcgtcgccccgttcgtccggaccctgggcgcgggcgccaagttcgtccccgcctcgcccgcctggggccagatcgacgcctcgctgatcctgccgacgatgttccaggagatcgtctccggccgtaaggacgtggcccaggcctcggacgacgcggcgaagaagatggacgcggccttcaccgacgcgggctgacgatgaccacgcacaccacctcgctcaaggcgccgcccgcggccgggaaggacggcgccgccccggccgcccggccgccccggcgcggccggtccgtctcgcccgcgaaccgctccggctggaccccgtggctctacctcctgccggcactcgtcctgctcgccgggctgctcgtctacccgatctaccagctcggcctgatctcgttcctggagtacacccaggcccaggtcagcggcggcgaacccaccaccttccagggcttcggcaactacgccaccctcttcaacgacagccagttctggcaggtcctcctcgccaccgtggtcttcgccgcggcctgcgtggtgtccaccctgttcgtcggctgcgccctcgccgtcctgctcacccgcatccgcgccctgccccggctcgcgctgatgatggccgcgctcggcgcctgggccacccccgcgatcaccggctccaccgtctgggtcttcctcttcgaccccgacttcggaccggtcaacaaggttctgggactcggcgacttctcctggacgtacggccgctacagcgccttcgccctggtgctcctcgaagtcctgtggtgctcgttcccgttcgtgatggtcaccgtgtacgcgggcatccgggccatcccggccgaagtgctggaggccgcctcgctggacggcgcgtcccagtggcggatctggcgcaccatcatggcgccgatgctcaagcccatcctgatcgtcgtcaccatccagtcgatcatctgggacttcaaggtcttcacccagatctacgtcatgaccaacggcggcggcatcgccggccagaacctggtgctcaacgtgtacgcgtaccagaaggcgttcgcgtcctcgcagtacagcctcggatccgcgatcggcgtcgtgatgctggtgatcctgctggccgtcacgctggtctatctgcgcctggtgaggcgccagggggaggaactgtgagcgcgacgaccggcagtcccgtacgcgaccgtcccgtacgcggcgccacgcgcggcgacggcatcgcccagctcctgcgcgtcaagcggcccggcagactggccgcggaggccgccgccctgctgatcgccgtcgcggtcgccttccccctctactggatggtgctctccgccttcaaaccggccggggagatccagtccaccgacgcccgcccctggacgctcgcgccctcgctcgactcgttccgccgggtcttcgaacagcaggacttcgggcgctacttcctcaacagcctgctggtggcgggcacggtcgtcatcctctccgcgctgatcgccttcctcgccgccaccgccgtgacccgcttccgcttcaagttccgcaccacgctgctgatcatgttcctggtcgcgcagatggtgccggtggaggcgctgaccatcccgctgttcttcctgatgcgggacttcggccagctgaacacgctcggctcgctgatcctgccgcacctcgccttctcgctgccgttcgccatctggatgatgcgcggcttcgtcaaggccgtccccgaagccctggaggaggccgcctacatcgacggggccagccgcacccgcttcctgtggcagatcctcttcccgctggtcttcccgggcctcgtggcgaccagcgtcttctccttcatcaccacctggaacgacttcctgttcgcgaagtcgttcatcatcagcgacacctcccagtcgacgctgccgatggcgctgctggtcttcttcaaaccggacgagaacgactggggagggatcatggcagcctcgacggtgatgaccatccccgtactggtcttcttcgtactcgtacagcgacgcctcgtctccgggctgggcggagcggtaaaggactgatgtcatgacacccgcgaactccgtccccccgggcgccgtggattccgcggccctcggtctgatcccggccccgcgcaccctgacggccgctgccgccgggccctacccgctcggctacacgaccccgctgaccgccgcaccgggcaccgagggcatcgcccgctggctgcgcgccacgctccgcccggccc

SEQ ID NO: 3045 - DNA, 721 bp, Unknown
  Kingdom: Bacteria, Phylum: Actinobacteria, Class: Actinobacteria, Order: Streptomycetales, Family: Streptomycetaceae, Genus: Streptomyces
ggcacaccggcagccggcgcaccggcggtcctcgcctcggacggccccggtgcgtcggctgccggtgtgcctgcggcatcggaggccgcgggcggttccggtggccggggtgtgccggctcccttcggtctctccggcggcctggacgcctcggacggctgatcggacatgggacccctcccccaccgggtccacgcgcggccctgggccgtacgcctgtcccggcgtctcattcggcgcacgccctcaagatcaactagggacggcgtggccgaaagggtaataccgaactcgcgttcgcaggcccgtggagtgatcctgtggcaggaccgtgacagacgaccgcagtcccgtttcggggccgtcggcgaggaggcaggacggaacggggcgaggtcagcgcaggagcggggtcagccacgccggcggttcctccgtctgtgccagccagtcggccggcggcgctccggtcactccggacgcgacgacaccgccgacgatggcgcaggtcgtgtcgacgtcaccgcccgcctgggcggtgacccagaatgcctgctcgtagtccccgagactccgggcggccgaccagagcgcgaacggcacggtgtcgtgggcgctggtccggcggccgtttccgaggaccgcggcgaccgtcccggcgtcccggtagtccagcatgtcgcgggcccggcgcaaccccgcgccgacggcgctgcggggc

SEQ ID NO: 3046 - DNA, 695 bp, Unknown
  Kingdom: Bacteria, Phylum: Actinobacteria, Class: Actinobacteria, Order: Streptomycetales, Family: Streptomycetaceae, Genus: Streptomyces
ccggaacctcccgctccacccgcgaccccggccgcgctgacgctgagcgcgccgcagcgcacggcggcgtacaagcggtggtgcgagaaggtgaccgtggagttccgcaacaccggcggcacccctgcgcgctcggggaccgtcaccttcgccacgcacatcatcggcgccctcggcgtcgactgggcgaccatcacctcgtcccagcccctgcccaccccgatcggcgcgggctcggcgcgctcggagacgtacaccgtctgcgtggagtcctggcgggtcccgctggggatgcgcgtcgagacgcaggacgtctccgccgtgtggaagtgacctgacccgacggcgggagcccgtcacgcacgaaggccgcccgggggtggagcggcggccggctgtgcggctccgcttcccgtcccccgggcggccggatcgtacggtcgtgctgtggtgtggtgccgtcgcgggccgacccccgtgcaggcgcggggtcgttcccccgtgcgagcgtgagtcggtcccgtgcgggtgcgggtcagcccagggcgagccaggccaccgcaccgaggacgacgacgaccgcgatcaccgccgcgatcaccccggccttcggcccggaagaggtcgccgcgggctgctgccggcgctgcggctcgccctcgtcgacgaaggcgcggaacatctgcgtgctgccc

SEQ ID NO: 3047 - DNA, 15343 bp, Unknown
  Kingdom: Bacteria, Phylum: Actinobacteria, Class: Actinobacteria, Order: Streptomycetales, Family: Streptomycetaceae, Genus: Streptomyces
gggccgtgggtgaggaggaacggcatcgggtggcgcctttcggtgcggctcaactcagccacgggagcatcgggtcgacccacccggaggcgagcaggccggtgagcaggaggacggcggaggcggcgagggcctcgggccagcggcggggcagcatgcccgtccggggccggctccgcgaacggtggacggcgggcggctcggcggctccggcgggtgctcggcttccgggccgcagttcggtccacaggtcgcggatcaggggcacgttgatctggagctggaccaggaggtagaggcagagtccccatgtgggctcccagccgttgcgggccacggccagcgcgaggcccccggcggcggcaccgttggacacgatcagccagaccagtgagacgcccacgacccggcgggccatcgagcccgaactttccttgctccgtacccccgtgggcacccaggcggcgctgcggccccgcagggtgtgccagaacgcggtggcggctgccacactggtgagcacgttggcgcggatcacctccacccgccaccgggtccggctgatccggggcagcagcacatgccacagccacaacggggcgagcagcggcaggacatgccaggggcggatgtcgtccgggtaccagaacatcatcaccagcggcggcagcggggcggcgaaggtgttcacggccgtggtcaggtagccgacgaccccctcgtagaagcagagccgcatccgccagggcgcgcccatccgcttgagcaccggggtgccgaggaggtgcaggttgcccatcgcccaccggtactgctggttgacgaacgacgtgacggtgtcgggcgaggtgcccttggcgaccaggacggggacgtactgggtgcggaacccccgctcgtgcagggcgagtccggtgtacaggtcctcgctgtggtcgagccgggcgaagccgcccgccaggtcgatcgcggcgcgccggtagacggcgttgctgccgcagcagatcgccgcgtcgctggcgtcccgcgagggctggatccagcggaagaaccactcctgcgcggccccggcggcgcgctggatccagtccatgcccgcgtcagtgtcgaagcactgcgggctctgcacgatgccgacggcggggtccgcgagatacgggaccagatggcgcaggaagtccggccggggtgcgaagtcggcgtccaggatcgcgatgaactccgcatcggacagcgtgagcgcgtggttgaggtttcccgccttcttcagacggccccggtcgggacgtacgacgtaccggtagccgtggccggccgccagtgccgccacctcggcccggtcggcgtcgtccagcacccagacggtgagcgcgtccggccagtcgagggcggcgaccgcgcggtaggcgttggcgaggacggggaggggctcgccgcaggtcggcaggtagaggtccacacccggcagtccggcgggccgccaggcgcggacgagcacctcgtgcgaggcccgggtcagccggcgctggcgcaggctgttcacggaggacagcagcagggccacgacgttcagtccgaggatcgcgaggaaggcccacagcgccggggtccgcagcgcgaaggtgaacatcgtcgccgccgtgaacacgaaggccagcgaactgctcaccagcacccaccggcgttgcggcccgaagtaccagtagagctcgtcgtcggacggaggttgcggaaggtgatgcacggtcataaagccccccacggctgtgtatgtgcccgtttcaggtggcccaccctaatgtcaaaggtatagaccactcgcccgagagggtcccgacggagagaatcggacaccggtttggctcgactcaattggtccagacctctgggtggtcccattcgagcccggtgcccgcccgacggaggaaggagcaggtcacgcgggggtgaacagtcccggaagacttgccggccctgacatgcgggccggacgcccggccgaccgccgagccgcacacccggccggaagcggaccctccgccggacggaacgcccggcacacccgtccgtcgggcaagacaccgggcacaccccgcacaccggacggcacaatgggtccatgccgatacccagccgcgccgccctcgtcgaccacctcgtccgtacgcgtatcgcgggggacgtcgccacgccacgcgacaacaacctctcccactaccgcaagctcgccaacggtgaccgccactactggctggggctggagctgggcgaccgctggaccgacgagcaggacgtgctcgccgtgatggccgagcgctgcggcgtcaacgacgacccggcgcaccggcagggccaggacaccatcgacccggagctgacggtcgacgccctggagcggatggcggcccggctgcgcaaggccgcggacggccgcgagcgggtcctgttcgccaccggccaccccggcggcatgctggacgtgcaccggcagacggcggacgcgctgcgccgggcgggctgcgagatcgtccgcatcccgtccgggctgatggcggacgaaggcatggtcttccagttcgccgacgtcgcgatgctggaacgcggggcgaccctctggcacacccactccccggctccgatggccgccatcctggacgccatggcccacctcggccgcccgctgcccgacctggtcgtcgccgaccacggctgggcgggctgcgcgggacagcgcgggctggacgcgatcggttacgcggactgcaacgacccggccctgttcctcggcgaggcggagggcaccctccaggtcacggtcccgctggacgaccacgtcaccgacccgcgcttctacgacccgatgacggactacctgctgcacgcggcggggctgctggaggaggagcgggtcgaggaggcacgagtggaggagcccgccgcgtaggagccggtccggcgatgagtgtcgggcccggcgggtgggcactgcctcatcccgttcggcgccgacaagcgcgaggagaccggcatcggcggcggggacgccatcgaggtggagctgaccctcgacaccgcgtcccgcgcggtggagccgcccgaggacctggcggtggcgctggccgcgtcccccggagcggctgaggcgttcgccgcgccgcgcccggccggcagaaggcgcacgtcacgtcgatcgagggcgcgaaggcccaggagacacgggagcggcgcatcgcggagacggtggcggagctgacgccgtaagcctcaggtgtcgttgtggcgcagccgctgcgcccgccccggcgtcgggtccagatagacccgccgcaccgacgggaaccgctcgcgcaactgggcctccgcctcctcgcaggcccactcgacctccgcggcggtggccatgtcccggaagtcgatcttggccgcgatcaggatctcggacggcccctggatcagcgtggtcagctcctggacctccacgatgtgcggcaccgacagcagctcctcgcgcaccccggcccgcatcgccgggggcagcggccgcccgatgagcagttgcgcgttggcgcggccgagcacccaggccacgtacacgagcagcaggccgatcagacaggacgcgatcccgtcccagacacccgagtccgagagctgcccgccgagcagtccgcccgccgccagcagcagcccgatcagggcggccgagtcctccatcacgacggccttcaccgccgtgtccggggtgtggcgcaggtagtacgcgtccggcacccgcagccgtgacgcctcgcgccgcacctgcttgaccccggtgcgcagcgagtagccctccaggaggaaggcgacgccgaggacgaggtaggagacgagcgggtcgcccagctcctcgccctcgaccagggtgtgcaccccgtcgtagatcgagaagacggccccgccgacgaaggtggcgatggaggccagcatcgcccagatgtagcgctcggggccgtaaccgaggggatggtcctcgtcggcgggcttctcgctccgcttgagcgcggtgaggagcatgagctcggtgacggtgtcggcgaccgagtgggccgcctcggagagcatcgcgctggagccgctgatcagcccggcgacggccttcgccacggcgatgccgaggttggcgacggccgccacgatcaccgtgaaggtggactccccgccatcgttctcactgcccgctttcgcgtcgctcatggtggggagtatgtccgaaatggcgcttcaggtggtgctcatccccgtgggatgcggacgacgccttcctggatgacggtgatggcgaggcgcccgtcggcggtgtagatacgggcctggcccagtccgcgaccgccggaggcggagggcgactcctggtcgtacagcagccattcgtccgcccggaacggccggtggaaccacatcgcgtggtccaggctcgcgccgaccacgtccccgaccgcccagccgccccgcccgtgggcgaggagcaccgagtcgagcagggtcatgtcggagacgtacgtggccatgcagacgtgcagcagcgggtcgtccgcgagcttgccgttcgtcctgaaccacacctgggagcgcggttcgcgcgcctcgcccaccgtgccgaacggcggcgcgtccacgtaccgcaggtccaccgcagcccgcgcctcgatcagccggtccacgacccccggatcgctgaagcggtccgcgtaccggggcagcatctcggcggccgtcggcaaggtctccgggtccggggcggcgggcatgggcgcctggtgctccatgccctcctcgtgactctggaaggacgcggagaggtggaagatcggctgcccgtgctggacggcgacgacgcggcgggtggtgaaggacctcccgtcgcggatccggtcgacgctgtagacgatcggcgcgccggggtcgcccgcccgcaggaagtacgcgtgcagggagtgggctccccggttgttcgggacggtgcggcccgcggcgacgagcgcctgggccgcgacctggccgccgaacacccggggtacgagcgcgctgcggctcacaccccggaagatgtcccgctcgatctgctccaggtcgagcaggtggagcagatcgagcaggggatcgggactctcgttcatggagggaacgtaatcccttacaggcccatggacttggcgatgatcgacttcatgacctcgctggtgccgccgtagatgcggttgacccggttgtccgcgtacaggcgggcgatcgggtactcgttcatgaagccgtagccgccgtgcagctggaggcagcggtcgatgacgcggtgggcgacctcggtgcagaacagcttcgcggaggcggcctcggccgccgtcagctcaccggcgtccagggcctccagcgcgcggtcggcgacggcctgggccgcgtcgacctcggcctggcaggcggccagttcgaacttggtgttctggaacgaggcgaccgtcttgccgaagaccgtgcgctcgcgcacgtagtccgaggcgaaacggacggcggccgcggcctgggcgtacgcgccgaaggcgatgccccagcgctcggaggccaggttggtgccgaggtagccgaagcccttgttctcctcgccgaggaggtcctcggccgggaccttgacgtcgacgaacgccagctcggcggtgtcggaggtcttcaggccgagcttgtcgagcttgcggccgaccgagtagcccgcggacttggtgtcgacggcgaagagggagatgccgaagcggcggtcgtcctcgcggggggcggcggtgcgggcgcagacgatcacgcggtcggcgtgcacgccgccggtgatgaaggtcttcgcgccgttgaggacgtagtgcgtgccgtcctcggagagcttggcggtggtcttcatgcccgcgacgtcggagccggtgcccggctcggtcatcgcgagggcccacatctcctcgccggtggcgaacttcggcagccagcgcttcttctgctcgtcggtggcgagcatcttcacgtacggcaggccgagcagcgtgtgcacgccggagccgccgaaggagacgcccgcgcgggcggtctcctcatagatgacggcctcgtacttgtgcgagtcgatgcccgcgccgccgtactcctcgtcgacctcgatgccgaagatgcccagctcaccgagtttgaggtagaagtcgcgcggcacctggcccgcggcgaaccactcgtcgtagaccggcacgacctcggccgcgatgaaggcgcggatggtctcccggaacgcctcgtggtcctcgttgaataccgtacggcgcacgggatgcctcctaggtcggcagtcgattcgatgtcggctaagcgcttgctcagactctcttcgaagttacccgccggttgcggtcgctgtccagggtgatgctcggcacgcggagagccggtggacaccggtccggaaccggtgtccgggccgattgtcagtggtgtgggggaggatcggaacgacggcgacggaacgtacggacgtattcgggagaccaccgtgaccatcacgcgcgagcagctggcggagcacacgttcctggccctgctgtacgaggacgactacttccccgaccacgtgctggacaagggcacggctgtcctgcgcgccctgtgcgagcggatcgaggccgagaagcccgaggacctcaccgccctgtacgccctgaccgccgcgccgacccgggccttcaacgacctggaggcggagttcgaagcggcgggcagcgagatcgagacggtcgcccgcgaggagataggcgaggccttctggatcatcgcgacggcgtacggcttcccggacgcggacccggagaagctgatcgccgagcgcgagtggtgaccgggttccgccgccgcgggacgggccgggcgccggcgggcgtgggagggtgaaggagtgaggctggaggacctggcccggttgcgccgggcccgcgaccgcatggaccgcgagtacgccgaaccgctcgacgtcccctccctggcgcgggacgccctgatgtcggcgggccacttctcccgcagcttccggaccgccttcggcgagaccccgtacagctatctcatgacccgccgcatcgagcgggccaaggcgctgctgcgccggggcgacctgtcggtcacggacgtctgcttcgccgtcggctgtacgtcgctcggctcgttcagctcccgcttcaccgagctggtcggcgagagcccgagcgcctaccgggcccgaccccacgacgcgggcgagaccattccggcgtgcgtcgccaagatgctcacccgaccggtcaggaatggagaagcggatcgcaagtcccgcccgtagcgtgaaacgcatggacatcaagctctcgcagtgcttcatcgccgtcgacgaccacgacaaggcgctcgccttctaccgcgacgccctgggaatggaggtgcgcaacgacgtcggattcgaaggcatgcgctgggtgaccgtcgggtcccccgcccagccggacgtggagatcgtcctcgaacccccgctcgcggacccgaacgccccggaagccgaccgccggaccatggccgagctgctcgccaagggcatgctgcgcggcgtgatcctctcctcggaggatgtggacgcggccttcgagaaggtccgcgcggcaggcggagaggtgctccaggagccgatcgaccagccgtacggcgtccgcgactgcgccttccgggacccctccggcaacatgctgcgcatcacccaggccaagaagtagtaccagcccccaggggccgggacccgatacgggccccggccctcacgcacgaccagtaggctccgcgcaccagtaatggagagacgacgagcatggccccgagaacgaagaccccgcagccgtccgtgccgcacactgccgacagccacgacctgatccgtgtgcacggtgcgcgggagaacaacctgaaggacgtcagcatcgagctcccgaagcgccggctgacggtgttcaccggggtctccggctcgggcaagagctcgctggtgttcagcaccatcgccgcggagtcccagcggctgatcaacgagacctacagcgccttcgtccagggcttcatgcccacgcaggcgcggcccgacgtcgacgtcctcgacggactgacgaccgcgatcatcgtcgaccagcagcggatgggcagcgatccccgctccacggtcggcaccgccaccgacgccaacgccatgctgcgcatcctcttcagccggctgggcaagccgcacatcggcccacccggcgcgttcgccttcaacgtcccctcggtgacggccagtggcgcgatcaccgtcgagcgcggcaacaagaaggccgtcaaggcgaccttcagccgcaccggcggcatgtgcaaccgctgcgagggccgcgggtcggtctccgacatcgacctcacccagctctacgacgactccaagtcgatcgccgagggcgcgttcaccattcccggctggaagtcggacagttggtggaccgtgcggacgtacgcggagtccggcttcctggacccgaacaagccgatcgccaagttcaccaagaaggagatgcaggacttcctctaccgggagccgaccaaggtgaaggtcgagggcgcgaacctcaccttcgaagggctgatccccaagatccagaagtcgttcctgtccaaggaccgcgagtcgatgcagccccacatccgggagttcgtcgaccgggcggtcaccttcaccacctgccccgagtgcgagggaacccggctcaccgagggcgcgcgctcctcgaagatcaagaagatctccatcgccgacgcctgcgccatggagatcagggacctcgcggagtgggtccgcggcctggacgaaccctccgtcgccccgctcctcgaagccctccagcagaccctcgactccttcgtggagatcggcctcggctacctcgccctggaccgcccctccggcaccctgtccggcggtgaggcgcagcgcgtcaagatgatccgccacctcggctcctcgctgaccgacgtcacgtacgtcttcgacgagcccaccatcggtctgcacccgcacgacatccagcgcatgaacgacctcctgctacgcctgcgcgacaagggcaacacagtcctggtcgtggagcacaagcccgaggccatcgccatcgccgaccacgtcgtcgacctcggccccggggccggtacggcgggcggcaccgtctgcttcgaaggcaccctggaaggactccgcgcctccgacaccgtcaccggccgccacctcgacgaccgggccgtcctcaaggacgaggtgcgcaagtccaccggcgtgctggagatccgcggcgcgacctcgcacaacctccgcgacgtcgacgtcgacatcccgctcggcgtgctcaccgtcatcaccggcgtcgccggctccggaaagagctcgctcgtgcacggttcgatcccggcgggtgagaacgtcatctcggtcgaccagagcccgatccgcggttcgcgccgcagcaacccggcgacgtacacgggcctcctggagccgatccgcaaggccttcgccaaggccaacggcgtgaagcccgccctgttcagcgccaactccgagggcgcctgccccacctgcaacggcgcgggagtcatcttcaccgacctcggcatgatggcgagcgtctccagcccctgcgaggactgcgagggcaagcggttccaggcctcggtgctcgactaccacctgggcggtcgcgacatcagcgaggtcctcgccatgtcggtctccgaggccgaggagttcttcggctccggcgacgcggccatcccggccgcgcacaagatcctcgaccgtctcgtggacgtcggcctcggctacctgagcctcggccagccgctcaccaccctgtccggcggcgaacgccaacgcctcaagctggccacgcacatgggcgacaagggcggcgtctacgtactcgacgaaccgaccaccggcctgcacctcgcggacgtcgagcagctgctcggcctgctggaccgcctcgtcgactccggaaagtcggtgatcgtcatcgagcaccaccaggcggtgatggcccacgccgactggatcatcgacctcggccccggcgccggccacgacggcgggcagatcgtcttcgagggcaccccggccgacctggtcgccgcccgctccacactgacgggcgagcacctggcggagtacgtgggggagtgaggtgccgggccctttccgcctgtcctgcggtcaggcggaaagggccccgctcttgaccgcgtccacgaaggaggtccatccggcggcggggatgagcagggcgggcccgccggggaccttggagtcgcggacggggacggcggtggggtggtggtcctggacttcgaggcagctgtccttgtcagggccgctgtacgaggacttccgccagtcggcgagcggggcggtgcgttcagtcacggtgtccgtactccttcgccgctgccctgagcgcgttcagcgactcggagaggggcagcgcgtcgctcatggccagagcgtaggtggcctcgatccgctcgaccaagtgcggtgcatcgtgcaccttcgccacctgcgtgccttcggagtacgccaccggtggctgatcctcgaaatgcatcagcgtcaccatgctctggtgcagattggagatggggccgcccaaaggcagcacatgggcgcggattcggccacgctcgaccagacgcaccacgtgcatgatctgttccgccatgatgtccgcgctccccgccacgcgccggaggacggcttcgtccagcaccgcccagactacgggcgacgtggggccctccaggatcttggcccgctccagtcgtgagacaacggccttgtcacgttcctcatcgctgtacggcggaaaagctgtgcccagcactgcatccgcgtaccggcgcgtctggaggattccaggctggggattcccgatgccttcgagcccggtcacccgtcgggcccggggctggtccggctgcggccgtgaggtttcgcgggtgatgatggggccatgaatcgcgctctgtcgacaccgcccgccatggccacgggctgcatcgccgacgcaccgcaacctgtactcgcggcaaccggcggcctgctgctgcgtccctgggagcgggaggacgcggcggcgtacctctccgcctaccaggacggggagacccgccgctggcacacgcaccggccgtcgaccgaggcccaggtccaggagtggttcgccgggtaccgccaggactgggagcgcgagaagggctgccactgggccgttgcccgcgacggtggccaggtgctcggccggatggcgttgcgcggtctggacttcgacgacggcgtcgcgaacgtcgcgtactgggtgctcccggccgctcgtggggcgggggtggcctcgcgcgcactcgcggtgctcagtgcgtgggctctggacgtcgtcggcttccaccgcctggagctggaccactcgacgcgcaaccacgtctcgtgccgggtcgccgtgaaggccggctaccgcctggagggcaccaagcgcaacgcggccgtccacgacgacggtcggcacgacatgcacctgcacgcccgggtcagatgcgactgatcctgtcgtcgactcctgtgcgcggggagtcgggcgacggggaacggcgggccgcccacctttcggggaggcccgccgcagggacgcgcgggacggttcagcagctgttgacccacttgtgggagcgcagcttgtaggtgcccgcgaggttgcccttgttgccgctggtcgtgcagcccttgcgcgtctcgtagttggcgccgctgtagtagacgacggacttgccgctggtgccgttgttgaacacggacctgacgttcttgtccgcggcccaggagcactggatggcgccattgcgccagtcgctgtcgaagccgttccagttgcaccggtcgccggtgccgttgtcgcccgtgtagaagcagctgtccccctcgggacagctgtaggcgagggccttcgcctgggccgggacggtggcggccccgaggccgacgccggcgagaagcgtcacccccgcgacgagaccggccttgctccgcagcgcgcgtacaggcttcatggatcgtcctcctggtcgatggtgctggaggggtccggtgtgcgttcccccgatgtgcgcgtcgccgtcccctgcggcggcgcaggcaccatgctggagcgcgacggccgcgagcggcacctcgaacattccagggtcggacgcctgagggacgccgcctgcccgtggggacccgaagttctcctcgcggtcggccggagccccgggagccggcttccggggctcggtccagcacggacaagatgcgcctcgccgactgctcctcgggcagcgcctcgtacaccggtgtcccgtcgtcgtcctggacgtacgcgtactccccgccgatgaccggcgacgccgggagtaaccagcgccgcggtgtcccgggtgggcgtgtggtgccctgtcagggcgtgatgcggtcgcgcagccaggagttgacgccgtcgagcgcggtggcggcaagggccgtgggatggccggtgaagccgtggggcgacgcgggatagacgcggaggtccacgtcgttgccggccgccgacaaccggcccgccagcgtcaggttgtcctccagcagcacgtcctcgcttcccacgaccagcagtgccgggggaagcccggacaggtcggcgtagagaggggagatgtcgggaagggtacggtcggccacttggccgacgtaggcctggatgaagtactcgtccgcgatgcgacggccgccgggcgtctgtgcgctcacgtcgtacgcgccgaagcggagcgcggccccggcgaaccggtcgacgacaccccggtcccgcagccggagcaaggtcgtcagggcgagggtggccccggccgagcttccgccgatcgcgagcctggaggtcccgaaacgggcctcggcctcctcgacgagccagagcgccgcggcttcgcagtcgtcgggcgcggccggccagggatgctcgggcgcgagccggtagtcgacgctgacgaccgcgatgcgcagggcgtccgcgagctcgcggtggcgttcgtcgccctgcgccgcggagcccatgtagaagccgccgccgtggatgcccaggtagacggcccggggtgggccctcggcggggaggaagatccggaccgggacgcgtactccggcggcttcgaccgtctcttcgacggcaggcggaacggtggcacgaggagcggccttcttcgcgcgggcctccttcagctcctcgaacgaggcgggtccgcggcccgccaccctcgaacggtagaaggcgcgagcctcggcgacctgctcggccggcacgtcggccagcagtgcttccagcgcgaatcgcacgcgtcgctcctcatccgtcgtcctgcctggtcctgcccggtactgactgcccggctgacaatgtagcggcggacggtgctgctcggttcgtagaggctgtcgtgatcgctgctgtcacgacgggccctggatccgcaggtcatgcctccaaccgctcctccagtcggacggtcacgctgtccccttcctccttgccgatcgccctgcgcacgtccgccttcaccggcagcttgtgcgtgccgtcgcccagagccatgaacgaactgcggaacggatggccgtcgatggtgccccggaccttcaccaggccacgggtgccgaagaactcggcagacccgggccacacgacgtaggtccagccacccttctccgggctcttccgcagggtcgcggtgaactgcttgttcatcgtggataccgcctgtccaggagctttcgatgcgcatgggctgttgccgatgccgtccaccagtaggaccggggcggccggggaaactcatcgcggtcacaacgaccggcggacccttcatgtcgtgcgccgtcggatccgctgctccgggccgcccctacgaagggtcggcgagcgcgtgtgcggcgtacaccctgctcatcgagatcggcacgggcatgcgcgagacgggtggtcgggcaaggtctacaagcgggcgaaggaactggagcagagcggttgggacgcggaagcggtgaacgccgcggtgatgcggaccggggcggcggcctccgcgggcacggccgtcgcgatcaccagctcagggctgtccggcggatcatgtgattactaggatcacggggcggggagcccgacccatgccggccagtgctgacggagcgggcggatgcggcaccgacgaggggtgtgggtccggtactgtccgcggcggaccgggaacggggggcctgtggggagtcgacggctgcgtgggggtctcggaacggcagtggcgttagcgctcacggtgcctaccgccatgcttctgggcaggtcgtggaacgcctgtgacgtgggtgtgaacaacgcggccaacagcggcttcctgctcttcctcttcatcccgggcctctggacggtcctgctgctggtctgggtcgcggtgggcgccgttctggggaaccggcccttcttccatgcctttgccctcgcggtgacgctcctcggcgtcgtctggtgcgtcaccgcgatcttctgggtggaggcctccacaccctcgtgtcccggcggcgtccccccgtggtggccgagcttgatccccgcaccgggattctgagaggtcgggcccggtaggcggagggcatggcctgttcggccgggtccggggtagtggtcctggctcaggcgggacggcgggccatccacgtctggcgggtcgaccgtacgaccaggtcgtcccggtggcgtacgtcctcgggcccgccgtcgacgagccggtcgagtgcggccagatcctccggcgagatgcgcccggccaggttgccgcggatgcgctcgaagacgagataggcgtaccggcccgccccctcgggcagcggtgcgcgcagctcccacggttcggcgcgttcctgctcgacggagaagccggcggccatcagcagggagccccagtcggcaccccggtgcggcaactgctcggcgtgcatgccgtcgagggcctcccggcagcggctctccagtgcacccggctccccgcccacgggcaggaaggtcggcatcccgtccacctccgcgacggccagcagccctccggggcgcagcgcggtgcggatgccggccagggcggtggcggggtcgtccaggtggtgcagggacgccgacgcccagacgaggtcggcgtc

SEQ ID NO: 3048 - DNA, 11415 bp, Unknown
  Kingdom: Bacteria, Phylum: Actinobacteria, Class: Actinobacteria, Order: Streptomycetales, Family: Streptomycetaceae, Genus: Streptomyces
gacgtgtgtgggggagacagggggaagcggagccagccatccatcttcgaactgctgggggaatgccccgagttcagccgctaccttgatctgacggggatgctcacggcgagcggaggacggagtgcagcggatcgggcccagggtcggaatgcggctggtccacctgacgcacaccgagcaccgtggatcgaccacctaccactactaccggatccagaccgcctgggtcgaccggccgcccgagggtgtccggaccgggtatctgcggtgcgccacctgcggtgacatggtcggcttccggctgcacagtcgggcacgtgccaagacgcgccggcggctgtggcttgccgccgcgctcgtcgcggcgaccgcgctcgcggcgctcatcgcgctcacggcggtgatgatcagcagcggcgcggggaccgaatcccggactctcgtacccactgctctcgcggtggtggcgctgattctgtcggtcgtcttcctccccggcgaggacggcgtgacgcttgcacgacttcggaacagcggtccacacgccttcaagccactgaaaccgcgcgtcgcgtggtccaagccacccgcggccgactggcctgttcgcgcggagatcgtcttctccgacgacgcggacccccctcgactccgctggtgcggaggggggtccgctcgccccctgaactcccaccacgtcgtcggaccggcggaccagcgcgcagaccgccgacgcgacagcccccggcagagcgccgggggctgtcgacagcaggcgttacggcagaaggcgttacggcaggttgcgcgccatcacgatccgctggacctggttcgttccctcgtagatctgcgtgatcttggcatcgcgcatcatgcgctcgaccgggtagtcccgcgtgtagccgtagccgccgagcagctgaacggcgtccgtggtgacctccatggcgacgtcggaggcgaagcacttggccgcggcgccgaagaacgtgaggtcgccgtcgacgcgctgggacttggcggcggccgcgtaggtgagctggcgggccgcctccagcttcatcgccatgtcggcgagcatgaactggatgccctggaagtccgcgatcggcttgccgaactgcttgcgctcctggacgtaccccttggcgtagtccagagcgccctgggcgatgccgagggcctgggccgcgatggtgatgcgggtgtggtccagggtcttcatcgcggtggcgaagccggtaccctcctcgccgatcatccggtcggcggggatgcggacgttgtcgaggtagacctcgcgggtcggggagcccttgatgccgagcttcttctccggggcgccgaaggagacgccttcgtcggacttctcgacgacgaacgccgagatgcccttggagcgcttggtcgggtcggtgacggccatgaccgtgtagtactcggagacgcccgcgttggtgatccagcgcttcactccgttgaggacccagaagtcgccgtcgcgcacggccttcgtcttcatccccgccgcgtcggagccggcgtccggctcggagagggcgtacgagaacatcgcgtcacccttggcgagcgggcccaggtacttgcgcttcagctcctcggagccggagaggatcaccgggagcgagccgagcttgttgacggccgggatcagggaggaggaggcgcaggcgcgggccacctcctcgatcacgatgaccgtggcgagcgcgtcggcgccggcgccgccgtactcctccgggacgtggacggcgtgcaggtccgaggcgaccagggcgtccagcgcctcctgcgggaagcggctctcctcgtcgaccgcggcggcgaagggggcgatcttcgtctcggcgagcgcgcggatggtctcgcggagcatctcgtgctcctcggccggacggtacaggtcgaaatcggtcgaacccgccaagacgctcactccccagatgctaactaccgttaagtaactcaattttagtgcgccgaccgcccgacggcatacgtgtcgcgcacgtgagcttcccgacaggggtgggacatatccggcgcagcggacagatagtgcggtgaattccgggcttccgctccccgactatgctcggtccgcacgtccgtccgtatctcccaggagcactccatggccctcaggatcactgtgatcggcaccggctatctcggcgccacccatgccgcggccatggccgagctgggcttcgaggtcctggggctcgatgtcgtcccggagaagatcgagctgctctccaccggccgcgtgccgatgtacgaaccgggcctggaggagatgctccagcggcacgtcgccgggatcgagggttccaccggccggctgcgcttcaccacatcctgggaggaggtcggcgagttcggcgacgtccacttcgtctgtgtgaacaccccgcagaagcacggcgagtacgcctgcgacatgagctacgtcgacagcgccttcgattcgctggccccgcacctgacccggcccgtcctggtcgtcggcaagtcgaccgtcccggtgggctccgccgcccgtctcgcggcccgcctcgccgagctggctccggccggcgccggcgccgagctggcctggaacccggagttcctccgcgagggcttcgccgtgaaggacaccctgcaccccgaccggatcgtcgtcggggtcgcgagcgagggcgcggagaagctgctgcgcgaggtgtacgccgggccggtcgcggagggctcgccgttcgtggtgaccgacttcccgaccgccgagctggtgaagacctccgccaactccttcctggccacgaagatctccttcatcaacgcgatggccgaggtgtgcgaggccgccgacggggacgtcgtgaagctcgcggaggccatcgggcacgacgaacgcatcggaaagaagttcctgcgggccgggatcggcttcggcggcggctgcctgcccaaggacatccgcgccttcatggcccgcgccggggagctgggcgcggaccaggcgctcaccttcctgcgcgaggtcgactccatcaacatgcgccgccgcggccacatggtggagctggcccgggaggcggtgggcggcgactcgttcctcggcaagcgggtggcggtgctgggcgccgcgttcaagcccgactccgacgacgtacgtgactcccccgcgctcaacgtcgccgggcagatccacctccagggcggccaggtgaccgtgttcgacccgaaggggatggacaacgcccggcggctgttcccgacgctcggctacgcggcctccgcgctggaggcggtgcgcggcgcggacgtggtgctgcacctgacggagtggcgcgagttccgtgagctggaccccgcggagctgggtgaggtggccgcccgccggatcatcctggacggccggaacgccctggacagcacggtctggcgcgaggccggctggacctaccgggcgatgggccgcccgaaggcctaggaccttcgctgtgagggcgagcgcttggggcgctcaccctcacgcgctgggcgcggagagggccccggcgtcagccgagcgggccgtccagctccgtgatcgtcgcgtgggacgggccgcgtccgctctgctcgtcgcgggcgacggcttccgcgtcgcgcagcacacgtacggagttctgccaggtcagcttggcgaggtcaccctcggaccagccgcgccgcagcagttcggcgatgaggttcgggtagccggagacgtcctccaggccgcgcggggtgaacgccgtgccgtcgtagtcgccgccgatgccgatgtggtcgacgcccgcgaccgcgcgcatgtggtcgaggtggtccgcgatggtcgaggcggtggcctcggggcgcgggttggccgcctcgaagtcctcgtggatgcgcatcgcgaccggggtggtgtcgaggtggtgcaggccgtgctcgcgcatgttgcggtcggcggccagggtccaggcgacggcctcgggcagcacgaacttcgggacgaaggtcgccatcgcgacaccgccgttggccgggagggccgcgagcacgtcgtcggggatgttgcgcgggtggtcgcagacggcgcgggccgaggagtgcgagaagatcaccggcgcggtgctggtggcgagcgcgtcgcgcatgacgccgtccgcgacgtggctgaggtcgaccagcatgccgacgcggttcatctcgcggacgacctcgtggccgaaggcggagaggccgccgaggcgcggcaggtccgtcgcgctgtcggcccagtcgatgttgtcgttgtgggtgagcgtcatgtagcggacgcccaggtcgtacagggcgcgcagggtgcccagcgagttgttgatggagtggccgccctcggcgcccatcagggaggcgatacggccctcggcgcgggccttctccaggtcgtcggcggtgagcgcccgccgcaggtgcgtcggatagcgggcgatcagctcgccgacgacgtcgatctgttccagggtggcgctgacggccgcgtcgccggtcaggtcggtgcggacgtacaccgaccagaactggccgccgaccccgccggcgcgcagccggttcaggtcggtgtggagcaggccgcgctggtcggcggcgatgtcccgggcgtcgaggtcgtagccgacctgttcgcgcagggcccaggggaggtcgttgtggccgtcgacgacggggtgggcggcgaggagctcgcgggcccgctccaggtggttcatggggagtcccctactttccgaagccgaaggagtcggcgccctggaccttggcgcgcagacgtttgcccttctcggtggcctggtcgttcagctcctgctggaactcccgcatccggtcctggagcgcggggtcgtgcgcggcgaggatccgtgcggccagcaggcccgcgttgcgcgcgccgccgaccgagacggtggcgacgggaaccccggcgggcatctggacgatggagagcaggctgtccatgccgtccaggtacttcagcggcaccggcacgccgatgaccggcagcggggtgaccgaggccagcatgccgggcaggtgagcggccccgcccgcgcccgcgacgatcgccttcagaccgcggtccgcggcccgctcgccgtacgcgatcatctcgtgcggcatgcggtgggcggagacgacgtcgacctcgtaggggatctcgaactcgtcgagcgccttggcggcggcctccatgacgggccagtcggagtccgagcccatgacgatgccgacgagaggagcggcgggggatccggtgccgggggaagtcattcggtgatcgttcctcgcaggtagtcggccgcgtgccgggcgcgctcccgcacgtccgccaggtcatcgccgtaggtgttgacgtgtccgaccttgcggccgggtttcacgtccttgccgtacatgtggatcttgagctgcgggtcgcgggccatgcagtgcaggtacgcctggtacatgtccgggtagtcaccgcccaggacgttgcacatgaccgtccacggggcgcgcgggcgcgggtcgccgaggggaaggtcgaggaccgcccgtacgtggttggcgaactgggaggtgatcgcaccgtccatggtccagtggcccgagttgtgcgggcgcatcgccagctcgttgaccaggatgccgggcttcccgtcgggtccgcgggtctcgaacagctccaccgcgaggtgtccgacgacgcccagctcggcggcgatgcgcagcgcgagctgctgggcctcgccggccagtgcctcgtccagctcgggggcgggggcgatcaccgtgtcgcagacgccgtcgacctggatggactcgacgaccgggtaggcgacggcctggccgtgcggcgagcggacgatgtcggccgccagctcccgtacgaagtcgaccttctcctccgcgaggaccgccaccccggcgcggaacgggtcggcggcgtccgcctcggagcggaccacccacacgcccttgccgtcgtagccgccgcgcacggtcttgaggatgacggggaagcccccgacctcctcggcgaacgcggcggcgtcggccgggtcgctcacgatgcggtggcggggacagggtgcgccgatctccaggagcttggcgcgcatcacccccttgtcctgggcgtgcaccagggcatcggggccggggcgcacggggatgccgtccgcctccagggcccgcagatgctcggtcggcacgtgctcgtgatcgaaggtgatcacgtcgcagccgcgcgcgaaggcgcgcagcgtgtccaggtcgcgatagtcgccgatgacgacctcgctcaccacctgggccgccgagtcctggggggtgtcactgagcagcttgaatttcaggccgagggggatacccgcctcgtgggtcatgcgggcgagctgaccgccgccgaccatgccgactaccgggaacgtcacgtcttcaggatatccgccacgccggtgcttccctgacggccgtacggaggccgggcggccgggcccctgcggactcacgggcgtcacacgggtgggctggttagcatggcggagttgacgtgcttgcgtcgacacgtcttccagacgccttccgacggacgggaccagcgatcaccatgagcgaacggggcgcactgcggacccggcttgagctgctggcccgggaggtcgccaagttcggcgcggtcggcgctttcggcctgctggtcaatatcgcggtcttcaacctgctgcggcacacgacggacctccaggtggtccgggcgagcgtggtggcgacgttcgtcgcgatcctcttcaactacgtgggcttccgctactggacctaccgggaccgcgacaagaccggccggacccgtgagctggccctcttcctgctgttcagcgcggcgggagcggtgatcgagacgggcgtgctgtacctggcgacgtacggcttcggctggaacaccccggtccagagcaatgtcttcaagatcgtcggcatcggcgtcgccaccctgttccgcttctggtcctaccggacctgggtcttcaagaccctgcccgccaaggaggccgtgctgaacgcggaacggtttctggagcagcgcaggccgacggaggagcaggtagcgcccgacgccgtacggaactgacccgcggcatccgtacggaactgacccgccgcgcccgtcgttgttcagcgcaccgggcgctcaggagtcttgcggtctgtcggaacccggctgaggaagagcgcgaagaccgccgggtgctgctggagcagctccagccggccgccgtccgcctccgcgagatcgcgggccacggccaggccgatgccggtggagttgcggccgctgatggtccgctcgaagatccgcgcccccagttcgacggggacgccggggccctcgtcggtgacctcgatgaccgcctggttgccggtgacccgggtgcgcagggcgacggtcccgccgccgtgcatgagggagttctcgatcagcgccgccaggacctgggcgaccgcgcccggggtgccgacggcccgcagcccgtgcttgcctgagcagaccagtgcgcggccggcgctgcggtaggcgggccgccactcctcgatctgctgcttgacgatctcgtcgaggtcgaagacgacggcggagccggtgcgcgggtcgcgggagttcgtcaggagccgctcgacgacgtcggtgaggcgctcgacctgggtgagagcgatgttcgcctcctccttcaccgtgtcggggtcgtcggtgacggagatctcctcgatccgcatggagagggcggtcagcggcgtccgcagctggtgcgaggcgtccgcggcgagccggcgttcggcggtcagcatccgggcgatccgctcggccgaggagtccaggacgtcggcgacccggtccagctcgggcaccccgtaccgcttgtggcgcgggcgggggtccccggagccgaggcgttcggcggtctcggcgaggtcggtgagcggggaggccagccggttcgcctggcgtacggcgagcagcacggccgagacgatcgccagcagcgccaccgcaccgatgatcaggagggtgcgcccgacctcgcgggtgacggccgagcgggactcctcgacggtgacggtctcgccctgctccccggtctcgacggcgcgcaggacgctgccgacgggacgttcgccgacggcgatgggctcgcggccggggatctcgaccagtgcgtaccgcttggggtcgatctgctcggccagcacgccgggattgatccgctccgcacccagcagccggctgtcgaccacgctgatcagccggagcgcctcggactcgacgctctcctgggcgctggcgctgatggtgcgcgtctcgacgatcaccagcgagacgccgaagacggcgatgacgacgagcaccacggcaagcgtggagttgatcagccggcggcgcatacccgcctcgtcaggtcgtcgggacgcacgtggtcacccgcgtcggggtggtcttcagggtgcatgggggtttcgtacgtcagctcttctcgaaccggaagccgacgccccggacggtggcgatgtagcgcggattggccgcgtcgtcgcccagcttcttgcgcagccaggagatgtgcatgtcgagggtcttggtggaggaccaccaggtggtgtcccagacctcgcgcatcagctggtcgcgggtgacgacccggccggcgtcccggaccaggacccgcagcaggtcgaactccttggcggtgagctggagttcctcctcgcccatccaggcccggtgcgactcgacgtcgatcctgaccccgtgggtggcgggctgcgggacgggctcggaggccccgcggcgcagcagggcgcggacccgggcgagcagctcggcgagccggaacggcttggtcacgtagtcgtcggcgcccgcgtccaggccgacgaccgtgtcgacctcgtcggcgcgggccgtcagcaccaggatcgggatggtgtggccgccggcccgcagcctgcgggcgacttcgagaccgtccatcccgggcagccccaggtcgaggacgaccaggtcgatgccgccctggagtccggcgtcgagcgcggtcggaccgtcctggcggacctcgacctcgtaaccctcccgacgcagtgcgcgggccagtggctccgagatggatgcgtcgtcctcggcgagcagtacacgggtcatggactgatggtagtccggacggggggtccgaagtgaggcccacggcgtcgcctgcgggtcagctccacaaagcggacggggacctttgaatatgggagtgtggttccaccaggacctgtgatccatgtctcaagtcctttcatatccctctgtgtcgtgtcgtatggtgtcccgacgcctgttgcactactcaaggacctttgggcagccatgagcgccaagggtcccttctgtgtgcggggccggttcccgccggctccttttgagtgaatgacctgtgagccgggcccggagcgcgagaacgcgcgacgggcgtggatcccgacgcggttcctccccgctccgccgccgcatctccgtcaggagcccggccgcacggagcacgtccccctcaggcgtgggggcggggtacgccgcgccggtgccggctgccccccaccgggcgcgtacagctcacgaggcgtcgcgtcccgaccagcaaggatcgaccatggcgtccagcctgacgaaggactcgcccagttccggcgagaagaccttcttcggccacccccgcggcctggccactctcttcatgaccgagatgtgggagcgtttcagctactacggcatgcgggcactgctcccgctctacctgatcgcgcccggcggcctcgacatgaagcccgccacggcgaccgcgatctactcggtctacctgtcgctggtgtacctgctcgccatgcccggcggctggttcggcgaccgggtctggggtccgcgcaagaccgtcgccatcgccggcgggatcatcatgctcggccacctggtcctggccctgccctccgagggcacgttcttcgccggcctcggcctcgtggccataggctccgggctgctgaagtccaacatctcgacgatggtcggccacctctacgacggcccggacgacccgcgccgcgacggtggcttcacgatcttctacatgggcatcaacatgggcgccttcgcggctcccctggtgatcggcaccatcggcgagaacgtcaactggcacctcggcttcgccctcgccgccctcggcatgggcatcggcgtgctccagttcctgctcggcacccgccacctgaacgagcgcagcctcgtcgtcccgaagccgctctccaaggacgagcgcgcctccacgctgcgcaagtcgatgatctggctcggcgtcgcggccgtcttctacatcggcacggtcgtcaccggcgtctacacgctgaactggctgctggtcccgatcaccctcgcgggtctcgtcatcccggtggcggtcctggtgcgcatcaagcgcgacaaggagctcagcgccaccgagcagtcgaagatgtccggctacatctggttcttcgtggccgccgccatcttctggatgatctacgaccagggcggctcgacgctcgcgatcttcgccgagtcctcggccgagaacagcgtcttcggctgggacttcccggtctcctggtaccagtcggtcaacccggtcctgatcatggcgctcgccccggtcttcgccgccttctggctggcgctgaaccggcgcggcaaggaaccgagcacgatcgtcaagttcagctccggcctcgtgctggtcggcgcctcgttcttcgtcttcctgatgccgctgaccatcgcgggtgacggccacaaggccgccgcgatgtggctggtcgcgatctacttcatccagaccgtcgccgagctgacgctctcgccggtcggcctctccgtcacgacgaagatggctccggcgaagtacgcgagccagatgatgggtgtctggttcctcgccgtcaccgccggcgactgcaccaccggcctgctctcgctggccggtgtggagctcaacggcaccggagtggtcgctctggaggcgacgctcgccgtggcggccggtatcgcgatcttcatgtaccgcggcaaggtcaagcagctcatgggcaacgtccgctgacggacgcaccgtagctcagcacgacgtacgtacggccaggggccgccgcaccggagtccggtgcggcggcccttcggcgtgccgtgctcgtacggcggctccttgtcagcgtgtgccgcgcagcctccgccacggggtgaacgtgaacaccgcgccgcccagcaggatcgccgtgccggcgaccaggccgagcgccctc

SEQ ID NO: 3049 - DNA, 5206 bp, Unknown
  Kingdom: Bacteria, Phylum: Actinobacteria, Class: Actinobacteria, Order: Streptomycetales, Family: Streptomycetaceae, Genus: Streptomyces
gatgttcagacgaacaattcgagccaacccaaagcagattcagtatgaatacatcaagcgaagatcgctatctccgcgcgtagacccgcgtggccccttgggtgcgaccggcccgtacacccccgatcgggtggccccatacactgaactcatggagaagtggacaccgaagcacgaggcgcccgaacccctggaggggcccgtcgtcgccaccgtcgtcggcggcacgatcctctggttcgtcctcttcctcgcccagctccccttctacggctggttcgccgaccgcggccacacctggtgggtgtggaccccgctggccggcgccggactcggcctgatcggcatctggtacgtccgcggacgcgacgccgccctcaagcggcacgcggccaaggtcgaggccaaggacgccgcgggggccgaggcggcggacagcgcgctgggcggcgagccggcgggccgcaccgaccggaccgcctgactccgcccccggaccgcccggatccgtcccgtagggcacctgggcaggacgcctccgcgaagctcccgtacgacctcggggccgacttcgtccacccctggtcggatcttcgaccctccggtgggtgattcgacgcgcacgcccgtaccgtcgaacccatgacgcagcgggcactcgattcctccggggagcagacccccggaccctcccggccgaccatgatcgacgcgggggcggaactcgaccccgtgcatcccatggagccaccgccgccccgccgacgggacggtctgagcaccgccgaggtcgccgaacgggtcgcgcgcggcgaggtcaacgacgttcccgtacgttcttcgcgctcggtcaccgagatcgtccgggccaacgtcttcacccggttcaacctgatcatcggcgtgctctgggtgatcatgctgttcgtcgcgccgatccaggacagcctcttcggcttcgtgatcgtcgccaacaccggcatcggcatcatccaggagtggcgggccaagaagaccctggacagcctcgcggtgatcggcgaggcgaagccgaccgtgcggcgcgacggcgtcgccgccgagatctccacctccgagatcgtcctcggtgacctggtcgagctcggccccggggacaaggtggtcgtggacggcacggtcgccgaggccgacagcctggagatcgacgagtcgctgctcaccggggaggccgacccggtgatcaagcgggccggcgacccggtgatgtcgggcagcttcgtcgtcgcgggcggcggcgcgttcaccgcgaccaaggtgggccgcgaggcgtacgccgcacagctcgccgaggaggcgtcgcgcttcacgctcgtccactcggagctgcgcagcggcatcagcacgatcctgaagtacgtcacctggatgatggtgccgacggcgatcgggctgatcatcagccagctggtcgtgaaggacaacaacttcaaggactccgtcgcccggaccgtcggcggcatcgtcccgatgatccccgagggcctggtcctgctgacctcggtggccttcgccatcggcgtcgtacggctgggccgcaagcagtgcctggtgcaggagctgcccgccatcgagggcctcgcccgggtcgacgtggtctgcctggacaagacggggaccctcaccgagggcggcatggacgtcacggaggtccggccgctcaacgggagcgacgaggcgtacgtgacgcgggtgctgcgggccttcggctcctcggatccccggcccaacgccagcctccaggccatcatcgacgcgtacccggcgggcggcgacgaagcgcttgcggcggccggcggcgacgcgcttcctgcggccggcggcgacgcggagagctggacggtcaccgacgcgatgccgttctcctcggcgcgcaagtacagcggcgcggcgttcaccgaggccgacgggacggactccgtctggttgctcggcgctcccgacgtcctgctgtccgagggcgacgcgaccctcacggagatcgagcagctcaacgagcagggcctgcgggtgctactgctggcccgtgccgagggcgagctggacgcgcccggcgcggcggccggggcctcccccaccgccctggtcgtgctggagcagcggctgcggccggacgcgggccacacgctcgcctacttcgccgaccagaacgtggccaccaaggtcatctccggcgacaacgcggtctcggtcggcgcggtcgccgggaagctgggcctcgcgggtgcggagaacaccttggacgcccgccggctgcccaccgatccggacgagatggccacggccatggaggagaacgcggtcttcggccgggtcaccccgcagcagaagcgggacatggtggccgccctccagtcgcgcggccacacggtcgcgatgaccggcgacggcgtgaacgacgtgctggcgctcaaggacgccgacatcggcgtctcgatgggctcgggttcggaggcgacgcgggcggtggcgcagatcgtgctgctgaacaacagcttcgcgacgctgccctcggtggtcgccgagggccgccgggtgatcggcaacatcacccgggtcgcgacgctcttcctgaccaagacggtctactcggtgctgctggcgatcctggtggtgtgcttccaggtggagtacccgttcctgccgaggcacctgaccctgctgtccacactgacgatcggcgtcccggcgttcttcctggcgctcgcacccaacaaggagcgggcccagccccacttcgtacgccgggtcatgcggtacgcgatcccctcgggcgtcatcgcggcggcggccaccttcgccacgtacctggtggcgcgccaccactacagcggcgagggtgcgctggaggccgagacgagcgcggcgacgctgacgctgttcctggtctcgatgtgggtcctggcgatcatcgcccgcccgtacacgtggtggcgcgtcggcctggtggcggcgatggggctcggcttcctgatcgtgctcgtggtgccgtggctccaggacttcttcgcgctgaagctggtgggcgcgccgatgccgtggacggcggtcggcatcgcggtggcggcggccgccctgctggagttcacctggcgctgggtgggacggcgcttcgggaggtaggcgcggacacggagaagcccccgggaggccgtgcctcccgggggcttacgcctgtcggtcctacttcacgtcgaggtagtcgcccttggccgagacggccggggtgctcggcgtgccggcgaagctgtagcgccaggtgccgtcggccgaggccttgacggtcgtcttcagggtgccggtcgagctggtcttgaccgtcttgacggtcgtgtagctcttggcgcccttcttcttgaactggagcttcacagcctggctgctgtagcccttgtacgtgccggtgtcccagttggcacgggtcagcttgccggtgaccgtgatggtcttgcccttcttcacgggctccggggaggcgttgaccgtcagcttggagaagcgctggacgcggaccttggagaccgcgtcgcgctccagttcctggccgtcgttggcgccggccgccgccccgacgcgccaccaggtcgcgtccgagttcagcatcagacccggggtgagggtgatggtgcccttgcaggtcgtggtggtcgcgttgaccaccttgcacgagatcgacttctcgttcggaccgaagccgaagctgttctcgtcgtcgacggacgagccgatccagatgaacgcggcggcgccggcgatgccggagtcgtcggtggccgtcacggtgtagggaaccgtctgcttcgacttggtgccgaccacgatcggcttgccgccgttgacgaccgccgaggtgatcttggcgtcgccggcctgggtggcggcgaacgagcgcttcgtcttctccccggccgagggctggggtgctgtgacgccgtggtccacggtccacgaacgaccgtcatcggcctgcgcggccggtactgcgagagcggaaagggccagggcgccggaaacggcggccacggtggcacgaatacgcatgtgtccccaagtggagaaggggtcccggggcgcgcttgtgtcgtcagcccggcgggacccatctgatccatgagcctcttggctcacaggaacagacagacgaaccatgctcatggttgtacgacctatgactttttcgtgaagaacgttcgggacgaccgtgcgtccgccgccggccctcgggagccgacggcggacgcacggcagtcgctacttgacgtcgacgaagtcgccggcggcggagacggccggggtggtggacgtaccggcgaagctgtagcgccagtagccgtcggccgaggccttgacagtcgtcttcagggtgccggtggaactggtcctgacggtcttgaccgtcgtgtagctcttggcgcccttcttcttgaactggagcttcacgggctggtcggtgtagcccttgtacgtcttggtgtcccagttggcacgcgtgagcttgccggtcacggtgagggtcttgcccttcttcaccggctccggggaggcgttcacggtcagcttggagaaccgctggacgcgggtcttggcctgggcgtcgctccagatgaagtcctggtcgccgccggtggccgcgagcgctccggcggcgacgttccaggtgccggcgaggctgctggtgcggaggtcttcggatcgcgggtcgaccgtgatcgagacggtgcacgtggaggtggtcgggtcggccgagaccttgcagctgccgaactcctgggtgggaccgaggaagccgtcgacctcgtcgatgtgaccgtgccacaggtaggcgaacgcgtcggcgatgccggacggcgacgaggccgtgatcgcgacggtgaacttctgcttggacttcgtgcccaccacgatgttcttgccgccgttgacgacgaccttcttgatgacgggcgtctcgacggcacgggcggcgcgggcatcggcggcgggcgcgccgggcccggcggcgaagacgtcggcgccggacggcacgctgaagcccgcctccggcttctcgtcggcctggacggccggtacggcaagagcggaaagggccagggcgccggaaacggcggccacggtggcacgaatacgcatgtgtccccaagtggagaaggggtcccggggcgcgctt

SEQ ID NO: 3050 - DNA, 19732 bp, Unknown
  Kingdom: Bacteria, Phylum: Actinobacteria, Class: Actinobacteria, Order: Streptomycetales, Family: Streptomycetaceae, Genus: Streptomyces
cgccgccgcgcccccggcggccgctcccgtgcccgcaccggccacgaccgtgcccgccgccagcaccccggccagcagcagcgccccgctccgtggcagccgcgccctcgctctcgatccgttcatggacgtcccctcccgcgtgatggtcttccgcagggacgatcgcaaggcgcgacgacccccgtgcggacgtggtgtgaacgagggatggcgcaggggtgccacggcgggacgggtccggcgcggcgtcctcgcgggccgtccgtttgcggggtcggcggacacccggttacgtgtacggggagggcggcccgcgaacgggacggcccgcaggctggaggtaccccgatggcgaagaaacgatccgcgcccgccaagggtgtgcgcggcagcaaggccgggctcgtgctgagcctgggcagcagcgcgctcgcggtcgtcagggcgtccaagcaggtccgccgggccaagggcacgcacgacaaattgaacaccgccgacgcggtggcggggctgctgccgttgatcacctcggccgccctcgtactgcgacaactgcgcggccggcgacgggagaacccggaagcggcctgagcgccgaccgcacgccggctccgcccgaaaggccggaaatcgccccgccctcgatcactgaagcggatccgtccggggtacgactgtgccgtgccgaaccctttcgagatcaccgcggcccgtgccgaggacatcgtgacgctgggcgagtgggcccacgaggagaactggaaccccggcctgtacgacggcggggtgttcttcgcgaccgaccccggcggcttcctgttcggccggctggacggcgaaccggtcacctccgtctccgtcgtccgccacggcagcgaccacggtttcctgggcttctatctgacccgcccccacctgcgcggacagggctacgggctgcggacctggcaggccggcacggcccggctcgtcgggcgcaccgtcgggctggacggggtgcccgcgcaacaggacaactaccgccgctccggcttccgtacctgctggagcaacgcacggttcgagggaacgcccccgccgccgcaggacatcgcgccgccgccgggcgccgagctcgtcgacgccaggagcgtgccgttcgacctgctcgccgcctacgaccgccggtacttcccggccgcccgggacaccttcctggcctcctggatcaccgctcccgggcgcaccgcgctggcggcggtcggggacggcggactccagggactcgcggtgctgcgggcctgccgcgccgcgtcccggatcggccccctgtacgccgcgtcccccgccgtggcggcggccctggtcggtgcgctcgcggccaccgctccgggcaccccggtcgccatcgacgtacccgacgtcaacccggcggcggtgcgactggccgaacagctgggcctgaccccgtcgttcgacacggcacggatgtacagcggcccgcaaccggtcatcgaccggaccggcctgtacggcatcacgagcgtcgaactgggctgacccgtaccgcgggctcccggcaggaggcgggtccggcctcgggagccgggccggaccgtcattccggaggggtcggccgcaccaccggcgggccctcgcggatccgggaggccagtacggcgatgtcgtcctccgcgtcctcgccgaaccggtccagcacctggtccagcaggtcctccagatgcccgccccgcgggagggtcagcgaggccagcctgcccaccgacacatcgatgtcctcgccccggcgctccaccaggccgtcggtgtacatgaacagcacggtccccgggccgcagggcacggacgcggtccggtacccgccgaatccggtgccgagcggcggccccaccggcaccggcaccacccgggccccggtggcgcccgggtcgatgaagaccgggggcagatggcccgcgctggccacctcgcacaccccgccgaaccggtcgacgacggcgagcagacaggtcgccgcccggtccaggcccgaccgctccaccatgatgtcgagctgctccaggatctggtgggggtgcaggtcgtccccggccagcagccgcagcagggagcggtactggctcatggcgacggccgcctccaccccgtggcccatcacgtcgcccatcgccttgaggtgccggccgtccgggagcggcacgacgtcgaaccagtcgccgccgaccaggacaccccggtcggcggggaggtagcgggtggcgatctcgacgtgcgggtgcggtccccagggctcggagagcagggagcgctggagttcgcgggcgatgctgtgctcgtggtcgtagcggcgggcgtggtcgaggtcgacgcccgcccggacggcgagttcgcgggcgacggtcacgtcctggtcgctgaaggcgggtgacccctccgcgcggacgagggtgagcgtgccgagcggtcggctgcgggcggtgagcgggaccacgagcgcctcgcgcagaccgagcgcccgggaggcggtgatccggcccgcggtgaggacgctgcgcccgctgctgtggtggtcccagtcgtcgaggaccggctcgttctccgcgaggcagcggggcacagcggagtccgccgcgaagtcgacgtactccccgggatggccgaaccgctgcacttgctcgtcgagttcgccggcgccccgcagcgcggcccgccggagccgtacgacgccgggcaccggacggcgtacggagtggcccacctcggacgggaacacgtcgaccgccgcgacgtcggcgaagtcgggcaccacgaaggcggccagctcccggcaggtggtgtccatgtcgagggtcgtgccgatccggacggcggcggtgctgaggagggcgacgtgaccgcgggcctcctccaactcctcgcgctggcgggcgaggtcggtgatctcgacgacgatcaccatcagaccgcacgccgcaccttccgcgtccagccggctgtacgtggcacgccagaaccgctgctccgcctcggccgccgcccaggtctgaccctggagcgtctcctcacggggtttcccgtcggccaggacgtcgcgcagggcggagccctgaccgcgcagctcgggcagcacctgggagaacgtccgcccgatgtgggagtcggcggggagtccgttgagccgttcgagcgccgggttgacgtaggtgtagcggagatcgtggtcgaggaccgcgacggcggccggattgccgtcgaacagggccgcgacggtcctcgggtcgaagaacgacggcatgccgtcgtcgcacgtgtcggcctgcacgagcatgcctcccgccgtcgtcggctgtcccggtcctccatcgtcggctgcccgttcccgtaccgcatccccaggacggccggtcagcgcggggtgcccgtccggtcctggaacgggccggggccgaggtccaggtcgaggtcgagggtgccctcggtcgcctcggcggtgggcggcagggcgagggcttcgccgacccggcccggcagactgccggaaccgagcagaccggtgaccagcgcggtggtgagacggtgccaggcggcggcccggcggatcatggcgtggtcgccgccccggacggtgaccatgcagctacgggctccggcgcgacgggcccgcgcggtgagggactgggtggcctgggggctggtcatccggtcccggttgctgtggacgaggacgacgtcacggcccgcgagctggatgaccgggtcccccggcggacaccagggtgcgagcccgacgacaccccgcaccagggggtgcccggcggcgcggagggcggcgcgcgcccccatggagtggcccaggagcaccaccggcagctcctcgcccgcttcctcccgcagcgcgtcgagggcggccacggcatcgtggacggggtccgcgcgggtgccgttccagccccggtgggtgtaccgcacctgcgtcacgcggatctcgtcgcccgcctcgcgggcggcgcgggcgacggcccggacgaaggggcgcatccgggctccgggcagattcagcagacccgtcggcgggggttccgtaccggtctcgcggcccccgtgcagaacgagaaccgctgccgacggcggtcgttgggccacgcgtacctccaggtccgggtgcggggcgcactgccccctctccccgtattcggcgccgaggccgctccggatgggcgtacggatcgccggatcgacgggccgacgtctcgacgggggcggaatgccgtccactgtacggtcacggtcgcggaaccatccgtgccctcagcgccatccccgtatacgacagcgaaggagcctcccatggcatcaggacctcaactcggcagcgcagcaccggacttcacccttccgggcggagtcctgtcggccgggaccttcgagcgcgccgactaccggctgtcctcggcccgcgggcggtccgtggtgctggcgttctaccccggggacaacaccagcgtctgcacgaagcagttgtgctcgtactcctcgggcatggaggccttcgagggcctcgacgccgacgtctggggaatcagtccacagggtgtggacagccatgagtcgttcgcccgcgccttcgatctgcgcatgccgctgctggccgacgagggccgggagaccgccaaggcgtacggggtctccgcgccgggcatcggggtgcggcgcgcggtcttcctcatcggcccggacggggtcctgcgctggaagcacgtggcgctgctcggtgcgacgttccagtcactcaccacgctcacggaccgcctgtccggcatcaaagacgcgtaaagattgccggaatccggcagtgaccgaagtaggtgctgtatgggatcatccagccagatcgacggaaaacactcgggggaagtcgacaacaggggagtgatcgcgtgaccgtttttctcggtctcggcatggcggggatcgtgctgctcgcgctctccctgatcttcggcgggatcctcgaaggcctcttcgacggcgttctcgacggcctcttcgacggactgctctcacttccggtgatcgccggcttcatctcgatgctcggcttcggcggagcgatcgtgctcggctccacaggtgccggaacgctcctggccaccgtcgtcggcgtcaccgccggcctcgtggcggcctggctcacctggaaactcagcaaggccctgatgcgcgaccagacgcacaccactccgcgcgactccgacctggtcggcacgtcggggtccgtcgtgacggccatcccggccgagggttacggcgaggtgctgctgcgactgggcggtcagcccgtgaagtacgcggccaagtcggccacacccgtcgcgcgcgggaccgaggtctgggtggaagagacgctgtcgaccacatcggtcgcggtccgcccggtggagcgctgaccacgccccaccacccggcctcacccccgtaacacctcacgcacccaccgcaccgatcaactccaccgcaccgcccggttccacaacaatctgccgtcccccacgggaggcaggggggacacctcacatgagtccagtagtcatcgccgtcatcggcatcgtcgtactcctcgttctgctcggcctcgtcgtcatcacgcgctacaaggtggccgggcccagcgaggcgttcatcatcaccggccgccgcggcaagaagtcgacggatccggtcaccggacagaccagcatcgacaacagcggccagaaggtcgtcgtgggcggcggcgtcttcgtcgtgccgttcgtccagcagaagttcaccctcgacctgtccagccggcacatcccggtcgccgtgcgcggcgcggtgacgctgcgcggcgtcaagtcgaacctcgaaggcgtcgcgatcgtcaaggtcggcggcagcgaggacgcgatccgcgccgcggcccagcgcttcctccagcagcaggacggcatcgtcggcttcacccaggaagtgctctccggcgcgctccgcgcgatcgtcggccgtatgtcggtcgaggacatcatccgggaccgggccgcgttcgccggacaggtcgcggaggaggccgaggccagcctctccggccagggcctgatcctggacgccttccagatccaggacatcaccaccgagggctcctacctggaggacctcggccgcccggaggccgcacgcgccaagcaggaggcggacatcgccgaggccatcgcgaagcgggcctcggagcaggcccggctgaaggcggccgaggagatcgccatcgccgagcggacgtactacttgaagcaggccgagatcaaggccgagacggaagccgcggccgccaaggccaacgccgccggtccgctcgccgaggccgcacgccagcaggaagtcctccaggagcaggagaaggtcgccgagcgccaggccgcgctgaccgaccgcgagctggacacgaaggtccgtaagcccgcggacgccgcccgctaccaggccgagcaggaggcggaggcccgccgcatcgcccaggtcaaggaggccgaggccgacgcggagcgctcgcgcctgaccggtcagggcgagaagctgcaccgttcggcgctggccgacgcggtccgcatcgagggtgaggcggacgccgcggccatcgccgccaagggtgcggccgaggcggaggccatgcggaagaaggccgacgcgttcgcgcagtacggcgacgcggccgtcctccagatgctggtcgaggtcctcccgagcgtggtggcgaaggcctccgagccgctgagcgccatcgacaagatgacggtcatctccacggacggcgcgagccagctggcccgtacggtcaccgacaacgtcgcgcagggcatggaactgctcacctcgacgacgggcgtggacctggcggccctcctccagaacctgaagggccgtacggccacggtgcccgctcccacgtccccggaggctccggcggactcctcggccccgcagaagaacggcgagatcgagatcaagggctgacgcgcgaggcctccacccggggccgagcccgttcccgggcccgctctcgctacccgttaccgatccagaccccgtgcccggcagcgacctgttcgccgccgggcacgggcatgtccgtacccgctcgcgacatctccgcctgctcctgctcctgctcccgctcctgccgggcggcggcagcggcggtggcagcggccagccacccccgccacccgctgagctgttcctgcgcctgccagccgtcggcatcgcccccgaggtcggcgatacggtgctcggcccagcgggcccaggcggcggcctgccggcagtcggggcactcggtctccccggccatggcccggaagacatgctcgggcccgggacccgggcaggtaacgagcggcggaacgtaccgggggacggcaggcgggggagccgtgtccgaggccgccggttccggctccggcatcgacttcggcacgggctccggcatccgttcgacttcccttacggagacggtggcttccggcatcttctccgcgagccggtgacgcaggaaccccacggcggaccgcaccccgccctccggcagatcactgctcaacacccgccgcagctcaccggcggagaccccgcgccgaagccactccacggcctgcccgacgagcaagcgagcttcggcgacaccgaggtggagcccacgactcacatgccggagcgacaacaacacccgctcggctcgcttctcttcagcggtcatcagctgcaagtccgccaccgggggcggagcttcggtgggtgggcgggagtggttcctctcccgttcttcgtctacaggcagttgatgaccgacggtccggggacccggctgaccgacggtcggaaaccgggcactcggagacggtgcgacaccgacaccgacaccggcgtcgcaccacagcggagacacctcggcatcggccaacggcacattggagaagacctgctgggtgacccaacgcccacgctcccccacgatccgccgctcatgcacgaacccgcacaggagcaactgctccttggcccgctgataggcccgccccttgatgtccagcttccgcgcatgctcggacaaggccagatcggtgccgccgtccggcaacccttgaacgtaaagaatcagaaccttcgcgtcactgcacagacgcggatgacgcacgacgtcgtgcgaagccttcgtgtagcgccgagacggcgcgatagcatgccaaagcatcccagtggactcctgtttccactagttgggtgaaggccctcggctcggtgctgtgaacaccaccgggggccgccccatgtgcggatacacacagagcgtgatgacgcgatcacggtaccgcagccgggaaggcgcgagcaccaaaaggcggaacaccccacccgaccaggtgacttactgcttccgtgaacgcatgcacgaggtagaccacagccaacctgtccccgctcttcggcctcccgcgactaccggtgatccacttccccccggcccctttggccccagcggaaaaggtcccgcccatcgcggccttagccggccggggaccgccccacggccggggtggacgacgcgcacgcggaggaggcccgggagtgggcggcctcccgcacggcacggaccttctcgggcggggcccgctctaccagtacgggtcagcaaagcaacgaaacccgcgatgcatgctcgcgctctaagcttgggaatcgcgtgggacgccgagccggaacggccgctgaccagtcgctgcgcacctgttcggatggccaggtgactcttgtgatcgccgccgttgaccgcagttcaccgagctaactggtgcgtatctggcgcgaggcctttgggccgcggatcactaggggcgaggaggagacccctacaaaagcaagccatggcacgagcgggctgtctgcgtatcgggcttacgggctgccattgatcgagcgacgatattgcaccatttgggcattttactagctttgtagcacggcttgatgtaacagttgccccagcggaagcctgcaagtgtgatgcgagtcatagctacatgtcctatggtgactgtaactcggagcatagaggactatgtgtccatatttcctgtggggggaaaatgagttccagtgcaactcgacttacctgcttcgcgcttctctcctccatggaggaagacctgcgtgctgtgattttgggtgcttgcgaggaaggcgaaaatgcgcaggagatcctgaaaggcgaccgctacgaaaaggcccttattcgactcacacgcgacgtcggaaagcaagcagtaggcacaatttctggcttgactccctacttggatttcgcagatgcctatgaagtgctcactgggctcaaaatgcgactcgccgaggattttcaggactctctccgaacctttgcgccaagcatcggcaagctcacgcaggtgcgcaatagggtagcccacacgaggcccatggaaattgacgaccttgctgtggttcacgatgtctctaaaactgtcagtgccatcgccccatcagcatggggcaatttgaagcgaacgattagccaactggaaaacgatcctgcttacgttctcggcctcacaatcaaccttgttgccgatcctgacaatgctccgcagcataacctccctgcgccagaatttgacgagacaggatttttcggccgccggaaagagcttgagagaatcaaaaaggcaattaagggcgcctaccctgtcgtctcgatcctgggggatggcgggatcggcaaaacgtcgattgccctaaaggcagcatatgagctcttggatgacccgaggaatccatttgacgctttcgtgtgggtgacagcgaaggcgacaatcctgacagtaaatgaaattcaacggatcagtggcgcaattgagaactctctagggctctttgcttcagctgccgagcaattgggaggaggggtagcaaaaaattctgtcgatccagtaggggaagttctttcgtatctggaacacttcaaggtcttgctcattctcgacaacatggagaccgttctggaccaaaggcttcgcgatttccttctagacctcccaatgggcagtaaggtcatcattacaagccgaattggtttgggcatcgaaaatcctgtatcgctagcccccctgtcctcggatgactcaacgcggcttctccagaagctctcaagggtgcgaaatgtggatgcccttcagggccttccaccagccgttctttccaaaatggtgcaggcgatgaagggacaccctgcatacattcgatggttcgtggctggcgtgcaggcgggcaagcgccctgaggagttgcttcacgagaatgatctccttctagagttctgcatgtctaacgtttacggccaccttagcgaaaaggcacgggcggtccttcggtcgatgcaagtgctacctgggcgacgcagccaggctgaacttgcttttctgaacgattattctgccgtagatatgcaatctagtctattggagctgatcaccactaacttcattcaaatgcaaggcgcttcaatggatcagtccacggagacggtgtaccaactaacggatttcggaaaacagtatctcgataagcggcacgcagtacggtcgctcgatagagcaatgttcgagggtcgcagtcgtgatcttgcggacctaggaatgcggctccaagcagagagtacggcctcaccctacgaccctcgtacgattgacatcaaagggcctggggatttcagtaccgctcgccttctgcgtgatgctctgaggcaccatgaacgcggcgacgtcgatggtgcactactggtgtgtcacgaggcccaacgactttccccggcttatcacgaatcgtggcgcgtagaggcattcattcaggcaggtcaacgtgatgtagcggctgcccgagccgcctatgaaagagccttcgaactcgcacccgattcatcgaccttgaactatctttatggtacttttcttgtaggagaagccgttgaccccgcgctcggccttgaaatgttgcagaaggctgcaattctcgctgaggttccacccgtagtcgtaaatgaaatcgcttgggcgcatattcagttgcaggattttgaggccgcagtaatcgccgcctctcactcgattacgttgaagccggatcgatacgatggcttggtcgctatgacaactggtgtccgagccggagtctacagtgtcagaaggaaggctgagggcggtgagctggacagcgctgtagagtgtattgaagctgcagtggatttggtggaatcggggcgtgttgaaatgctcctgggtgagccaactgaccgtattgttcaattgatggattcgggcgattctctacttcgtcgtattgacgataatttccttcttgagagcctagattcgcttttgagtcgaatgaaagaccggctacgtgtggtcgatccagacgccctaggtaggcgggttggtgtcgtgacaaatgtgcggcaggataagaagttcgggtttgttcgctcatggggaaatgactatttcttccatttgagcgatcttatggatgaaaatgagtgggcctacctcgactccggagtggctgtggccttttacccggacgaaggaggtatgaagggtccgcgggctgccgctctcaggtggttgggctaggcatggaatctgattgatgaacgcctaggttggcgcagcggtttcggccggtgtcctgcccgtttggggtcgagcatgatcagggggccgtacgctggccggcaactcgggcagactgggatcctgcccggaatgtgaacgaatggccccctggtcttgctcgacgcgggacccgaaccggggaggcggctaaagccgtggagccgaccgcagcgggtttcttccccgccacatggtgctcgctccagccgcgcgaccggcgtagccggggccagagcgggccgaaggcaggagcgtcaggccccggcggtgagccggggagcgcgcggcgagcggagcgagccgccttgatgaggtagggaaagtcctaccgcgctgggagcaggtgcttgccgtcgtggctccggatgtgggggcctgcctggtcgagggcgtccagcaggcggatcgcgtagacctcggacatgcgcacgttgatctgttccggggtgagccactcgactgcggtcgactcgtcggacgtgcgctcagtaccaccggagagctcacaccgagacaccacgtggcgacgacgccacaggtcatgttggcctagacgcccgtaggttacgcatactccgccgggccaggttcaagctccggttgctcttgagctgtgtcagccgagcgacttctcgattgcgtcgaagatgtcagcgtcagtctcctgctgccagaccgggagcccgggccagtccgctacgtagcccggcttcgggtcgtcgaaatgcttgaacatctgggccgtccagcaagtggcgacgaagcgtcctcgctgttcacgcgaaagacgggaagcgtgtccaccgctgatctcgacgaactggcggacctgctcgtacaccgctcccgccgcctcgcgttcccactgaggggtgtcgtcccacggggtgacgtagccggccttcggctcgccggggaagtgctggttcactcccgcgatccaggcttcccggaacagtcgtgcaccctcggtctgcgacacgtcatcccctctcgtcactgcgtgctcaacgtggcgatctccgcccccagctcacccacacggtggtcaccgctcaaggggccgaactcgtcgcacaggccttgcagtctacgggcgacatacccggatccggaggctctggccagggccacagcctccttgccgtacgccaccacctgctcgggatcctggcgcttggcaccgatcgcggccaagttcgtcagcacggcaccccggcgtcggtaggactgaccgtgcgccagggcttcttgcttcaacgcacgcgtcagcgcgtcctcagccaggtccaagcgtccgagctgtaggtagcgtgctccccgttcctcggccaaccgcgcaccgtcgaatcggagccaccccccgttgatgctgtccgggtcgaggtcacgaacagtctcagcccggtccatcgcccgctcgcacgcgtccagatcaccgagagcggcataggcctcggactgcaccgatgcgatccactggcgtgtcgagaggctcttgtccccccggccggccagacgttcggctgcgtcaaggagctgcgtggccggccggtagcgcgattcggacatgtccacgtaggcatgccgaacaagcgcgcacgcccacaggtcgtacgcctgggcgtccttgctgacagacgcagccagggcgtacgaagcggcggcatcggagtaccggttgccgtcgaacgcaacttcccccgcaagctggaagaggtctgccgccacgttcagcagggcccgagcccggggacttccgcggtattcggtgagagcgtcgatcagtattccgagctggtcgcgcacgaccggatacacggaccccttggaccgcgagcgttggtagacctgccagaggtggctattcatccgggagaagtcggcgggaacgccgccccggactccttgggccaaggcttcggcctcatccgcaggcaaggtggccagagcgccactgacggtcagtatgcggaggaactcacggcggatcatctcgtcagggtctcccgcgttcgggggctcgctggtccggctaccgacgggttccccgtcggcgatctgtcgcggacccagaagggcgtccagctcttggaggctcgtctcaagggcagctgccaactttcgccgttgggcgggctgcgggcggatccggcgactctcccaacgcccgaccgtcgtgcggtccacaccgagtagatgcgcgaaagcctcctgactgtagcccagggctcttcgccgttccgccagtcccatggcacccgcttcccgcagctccgacgttcccggcggccgtgcacgcatctgcctcaagagtgccgcagtgatgccgtggatacctccgactcctgccggtttcctggttgttgacccggatgagtgtcgggaagagcaagggagttcggcatgaccagaagagaagagccatcaccgcgcacgccaggaagtggcacacaggccgcgtccatcaccgcagagccccgcgtacttctgagactcagagtctcccgtgacgcgggccggacgtgggggcaggtcaaggaagtccgggaggacgagaacctgccgcctctggagaaccccggcttctttcctccgtgtacgtgtcgccgctgctcgcctggggtgcccagcccctcaacctcgtccccggggtggtcatgatgcggtgcactcactggcaccacctgccgatcggactggcgaagaaggcacgtcgcatggctccggatgcccccctcgaccgagccgtccagtgccacctctccgctcacgagggcgacgagcactacggcctgctcgccgaactcgaccaatacggcgccgccctctggctccgctggcacgggtccgacgtggacgtggccgtgctgccggactgcccggtgaccggaaccggctccggtggggacgcctgctgccttttcgccggtcacgtcgagcggcacagctgggaagacacgccgcctcagtgacatccgctctcgccggccttaccggcccctccggaccccgcaccgccctcgtcacatgccaccagggccgcgacattctcgttcgacgaccgcaccggccccgagttcagcgccgaaggccgcagtgaatacgcgctggaggggatcccgctgaccatggaggggcttgacagcatcgacctcaagcccgaggagatcgcccacgtcctacggggagccatcagtgccgaaagcctcggagtcgagggatcgcgctgagcctttgagtccgtcaacccgccatcagggccagaccgagatgagccggcctcgcagagaggtcaccccgtccccgtagcgggcggcccggccgaacccagggcccggagtcctcaccctccgggaccccgcacgctccccctactccgcctccgcctgcgtcagcgcctccgtgatcatgcgggtcgcgaagtccgggtcctccgtgatgcggttgatgtgctccgccagcaggaacgccgtcgcctccagcggggtcagctccgtctgcttccagtcgccgtactgctggcgccacagggtggggctcaggccgatggcggcggcgatgaccatgccggacatcgtggggatggcctcgggaggaatgctcctgggcatccgcctgagcgtcgtgaccagggtcgggaccacgtactcgatgacgtccttgtcgtgtgcctcgtgggcctcacgcagccacttcatgtacaggaagatcagcgtgcacgcgccgtcgagcacgtcgtccaagcccgccgggcccagcgaggagatgagttgccgcgccagatcctcctgttcgggatcggcgtcggtgctgtccttgtggacactcctgagccgggagtcgatgagcatgagcgccgcgcccacatcgccggcgggagcgtatcggggttcaaagggcgacaagacagaagaccttctgggatggccgccggtcggcagcccgcggggccgggggtggcgttccgttcctctatgtactcgggtggttacgcggacgactctccaccatccccggccgtcccgtccggcgctcggcggattcggcgggctcccgccgtcacttccgccagaacaggtggtgcgtcatgccgctcgggctcggaacaacgtccaggtggtaccggtcgagcagttcgtcgggcgactcccacaggtgcaggcccgttcccagcttcaccggcgcgaccgccacgtgcagggtgtcgaccaggccggcgtcgaggaactcacggatcgtggtgactccgccgccgagtcgcacgtccttgccgtccgccgcttcccgcgcccggtcgaggaccgtcgccgggtcgtcgtcgacgaagtggaacgtggtgtccgacagcgtgatcgacgggcgcttgtggtgggtcatcacgaacaccggtgtgtggaacgggggcttctcgccccaccagccctgccactcgtggttctcccaagggccgcgctgggggccgaacttgttgcgtcccatgatctcggcgccgatgttgcgtgcgaagtccctggtgaagtagtcgtccaggccccggctcccgccggcgtccgtgcgcatgggccagctcgccgtcgccccggcccaggagaagagccgctcggggtcgacgtggccgaacggccgctccagcgtctggttctcaccggcggcgatgccgtcgctcgagacagtgaagttctggactctcagcagctgggtcacgtgttgctcctgcttctctgcggtcaacgacggtggtgagacttcatggagagggaaaactcatcggtcgagggggaaagatcacctcaccacaccacaccgcaggcgcatcggcgatccaggagagtcctcgtgagcgatcagtccggccgacaggcccgtaagccgttcctgtacgtcgtcgtctgcgcggccggggtcgcccgcgacgtcgaccggctgttcacggccgcgcaggacgccgggtgggacgtgggcgtcatcgccaccccgcaggggctcgggttcctcgacgcggcggccgtcgaggcgcggaccgggtatccgatccgctccgcctggcgctcccccggcgatccacgcccgctgccggacccggacgcgatcgtcgtcgcgcccgccacgttcaacaccatcaacaagtgggcgtccgggatctcggacactctggccctcgggatcctctgcgaggcgtacgggctcggcgtccccaccgtcgtcctcccggccgtgaactccgccctcgccgcgcaccccgcatacgtcgcgagtctgcggaggctgcgcggcatgggtgtcctcgtcagcaccggcacaccgcatacgcccaagtccggtgacacggctcccttcccctgggaggacgctttggcgttgctcaagcccgccgtgccttcgtgacgcgggcggccggctcgccgagcgcgggccgcgtaccgctgtactcggcgcactgacctccctcacgcatgcgtcacattttcagcacatccggagcgttcccctccctcgctcgttcacctggtcgttacggtcgtatctccacgaaccatccttgggggacacatgacttgggacaaccagaagcagccgcagtggggtcagcctccggtgccgacttcgacaccgcccggagcacggccggcctgggcgcggaagcgcgtcgtgatcccttccgcgttcggtctgttcttcgtcggcgtcatcatcggcagcgcgggaagcaacggcacggagaccaccagcagcacgaagcccgcgcctgaggtgacggtcacggtcacggtgaccgccgagcccaagccggtcgacgcctccgacggcaagcccgccggtacgaaggagaaggcgaagcccaccgccgaggactcgggcaaggaagctcccgtaccggacttcgtcggtatgggccttcagtcggcgcaggacaccgcccaggcaaagggtttccacggcctcacgtcccacgacagcctggggcgcgaccggatgcaggcttttgaccggaactggaaggtctgctcgcagaacgtcaacgcggggaggaccgtctccacggaaaccgacctggacttcggcgcggtaaagctggaagaggactgccccgccaaggacgaacagcctctggaagcaacgggcggccggatgcccgacctcgacggcaagtccgtgaaggccgcgcgcggggcactcgacccgggtacgtccgtgaccgtgacggacgccgccgagaaccggatggtgctgatggagagcaactggaaggtctgcggccaagcccccggacctggggtgaagctgaagggccagcctgtgaagatcactgcggtgaagttcgaggaagagtgcccgtaacgcctcccgccgcccgtgcgtgagcgagcgggcggcgacttccggacacggcaacccgggcaggtggccgccctgccctggttgccgtacggcccacggcagcggctccacggcggaatttcgccgcccgatagggtaatggccgaataaagacatgaccaagtgcgcgcgcgccgccgcactctcgggaggaagccatgggaacccgccgcacgtcactgcccggagtgggtgctcagtacgacttcaccaccgagacgggccagcacatctcggtcgtcgtccaccacgacggccgccggttcatcgggttctacgatcaggacgatcctgattcgtgccaactctccgtccccctgtcgacgtccgaggccaccgccctcgcgcacctcatcgatccggctcccatcgacgccgtacggaccgagggcatcgacctcgtcaccgagcacatcccgctcgggtcccgctccccgtacggcgggcggctgctgggggagacgcgggcacggacccggaccggggcgtccatcgtggcggtgctgcgcacccacagcgcgcacccgtcgccggaaccggactttcgactggccatcggggacacactcgtcgccgtcggtacgcgtgagggcgtcgacgcgctctccgagatcattgcggagggctgaccgtgcacgacacgactgcgttgctggtggagctgggagccgtcatcctcgggctgggactcgtgggacggttcgccgggcggattgggctctcccccatccccctgtacctgctcgccgggctggcgttcgggcacggagggctgattccgctcaaggccagcgaagagttcaccatggtgggcgccgagatcggcgtcatcctgctgcttctgctgctgggcctcgaatacagcgcgtccgagctggtcaccagtctcaagacgcaatatccgtccggtgccgtggacttcgtgctcaacgccacgcccggcgccgtcgccgccctgatcctcggctggggtcccgtgggcgcggtcgcgctcgccggtgtcacctggatctcctcgtccggggtgatcgccaaggtcatgaccgacctcggccggctcggcaaccgcgagacccccgtcatcctcggcgtcctcgtcatggaggacctggcgatggcggtgtacctgccgctgctcaccgccatgctcgccggggtcagcctggccggcggcagcctcgcgctcctgatcgcgctcggggccgtcggactcgtcctctacctggccctccgtcacggccgcctgatcagccgcgcggtctcctccgacaacccggagatgctgctcctggtcgtcctcggcctcaccgtcctggtcgccggtgtcgcccagcagctccaggtgtccgcggccgtcggcgcgttcctcgtcggcatcgcgctctccggcgaggtcgccgagggcgcccgcaagctgctcaccccgctgcgggacctgttcgccgccgtgttcttcgtcttcttcggactctccacgaacccggccgacatcccgccggtgctgctgcccgcggccctgctggccatcatcaccaccatcaccaagatcgccaccggctactacgcggcccggcgcgccgggccgc

SEQ ID NO: 3051 - DNA, 529 bp, Unknown
  Kingdom: Bacteria, Phylum: Actinobacteria, Class: Actinobacteria, Order: Streptomycetales, Family: Streptomycetaceae, Genus: Streptomyces
ggtcgtccaggccgacggcgatctggtccagttcgcctgccagctccatccgtacgtcgtacccggcgccgttgcaccgggtcgcggtggcggtggcgagcgtcccgtcgtcgagggtgagcagagctgcggccgtgtccacgtccccggcctcccggaacatcgcgggtccggcgtccgagccggtggcgtacacctcgctcacctcgcggcccgtcacccagcgcaggatgtcgaagtcgtggaccaggcagtcgcggtacagcccgccggacagcgggaggtaggcggcgggcggcggagccggatcggaggtgaccgcccgcacggtgtgcagccggccgagcctcccctcccgcacggcggccctggccgcgccgtacccggcgtcgaagcgccgcatgaagccgagctggagaacgctgcccgccgcctcgacctccgcgagcgcggcgagcgtgccgggcaggtccagggcgatcggcttctcgcagaagacaggcagcccggcacgggcggcccgtgcgat

SEQ ID NO: 3052 - DNA, 7096 bp, Unknown
  Kingdom: Bacteria, Phylum: Actinobacteria, Class: Actinobacteria, Order: Streptomycetales, Family: Streptomycetaceae, Genus: Streptomyces
gaccccttcttgaacatgttcaagaaggggtcgtggggagggaggttcagagggtcccgggcgtcaggcgctcatcgagcgggcctggttgagctggcccatgaccgccgggaaggtgtacgggcccatggccgggatcatcgtcgagtggtgccggccaccgctggtgaccgtgacctggatgaagccggtggtccgcttctccttcatcagtaggaacagcagaccgatcaggcagaacagcgcgaagatgatcgccagcacgaccgcgtgcgtcgggatcttctcctccgtgcgcgacatgtccgtggccgtccagaccgcgcccttgagcggcatcgatccggacggggtgacgatcgcgtcgctcatcacggtgatgtcgccgatcgacagcaccgggacgccgccctggccgggcgctccctgcggcaccgggaggtactggcccggcatcgtcggctgccccgcgttggggtacccgtaaccggggccgggctgggccgcggagtccggcagcggctgcggataaccgtacgcgggcggagctcccggcgccgggtagccgtacccctggccgtcggcgacggtgggctggtggcccggctgctggggagggccccacttgtacgcgtcgtccgcgtacggattcggctcgctcacgacgatccccgttctctttcggtcttcagctccgctgaaccgtaccgtccgtgcggccccggcgcagcaacaggccccgcccccggcagcagttgcgctgcggggacggggcctgtggaggtgctgtgcggcccgggagggtcagaagcgacgcgtgatgagcgcgcgcttcacctcctggatcgccttggtgacctcgatgccacgcgggcaggcgtccgtgcagttgaacgtggtgcggcaacgccacacaccgtcacggtcgttgaggatctccaggcgctgctcgccgccctcgtcgcgcgagtcgaagatgaagcggtgcgcgttgacgatcgccgccgggccgaagtactggccgtcgttccagaacaccgggcacgaggacgtgcacgcggcgcacaggatgcacttggtggtgtcgtcgaaccgctcgcggtcctcgggggactgcagacgctcgcgggtcggctcgttccccttggtgatgaggaagggcatgacatcgtggtacgcctggaagaatgggtccatgtcgaccacgaggtccttgaggaccgtgaggcccttgatggcctcgaccgtgatcggcttggccgggttgatgtccttgatcagcgtcttgcaggcgagcctgttcttgccgttgatccgcatcgcgtcggagccgcagatgccgtgggcgcaggaacggcggaacgtcagggttccgtcgagctcccacttgatcttgtgaagggcgtcgaggacacgctccttcgggtcgatctcgatctggaagtcctgccactgggcctcgtcggagacctccgggttgaagcggcggatccggaacgtggcggtgatgaacggggagtcggcgaagccggcctcgggcttcgcggtcccgtcggtcttgtccagggtcggggtagccatcagtacttacgctccatcggctggtagcgggtcgtcacgaccggcttgtagtcgagccggatcgactcggcgccgtcggcggccacctcgcggtacgccatggtgtggcgcatgaagttgacgtcgtcgcggttcgggaagtcctcgcggtagtgaccgccgcgggactccttgcgggcgagcgcggagaccgccatgacctcggccaggtcgagcaggttgcccagctcgatggcctccagcaggtcggtgttgaaccgcttgcccttgtcctggatggacacgttgaggtaccgctcgcgcagctcggcgatcttggcgaccgccgtcttgatggtctgctcggtgcggaacaccatcacgttggcgtccatgcactcctgcagctccgtgcgcaggacggcgacccgctcggtgcccgtcgagttgcgcagccgctcgacctggtcggcgaccagctgggcggggttctcgggcagctcgacgaagtcggtcttcgccgcgtactcggcggcggcgatgcccgagcgcttgccgaagacgttgatgtcgagcagcgagttggtgcccaggcggttggcgccgtgcaccgagacacaggcgacctcgccggcggcgtacaggcccgggacgacggtggtgttgtcggccagcacctcgccctcgacgttggtcgggatgccgcccatggcgtagtgcgcggtcggctggatcgggatcgggtccgtgtagggctcgatgccgaggtacgtccgcgcgaactcggtgatgtccgggagcttggcgtccagctgctccggcggcaggtgcgtcaggtccaggtacacgtggtcgccggccggaccgcagccgcggccctcgcggatctccgtgtagatggagcgcgagacgacgtcacgggacgcgaggtccttcatgacgggcgcgtacttctccatgaagcgctcgccgtccttgttgcggaggatgccgccctcaccacgggcgccctccgtcagcaggatgcccatgcgccagatgcccgtcgggtggaactggaagaactccatgtcctccagcggcagaccgcgccggtagcaggcggcctggccgtcaccggtcagggtgtgcgcgttcgacgtgaccttgaagaacttgccggtgccgccggaggcgtagatgaccgacttcgcctggaagacatggatctcgccggtcgccagctcgtacgcgacgacgccggaggacgtcttgaccccgtcgatctcggtgatcagctggtccaggacgtagaactcgttgaagaactccacgccctccttgacgcagttctggtacagcgtctggaggatcatgtggccggtgcggtcgcccgagtagcaggcgcgacggaccggggcctcaccgtggctacgggtgtgaccaccgaagcgacgctggtcgatcttgccctcgggcgtgcggccgaacggcaggcccatcttctccaggtcgaggacggcgtcgatggcctccttcgcgaggatctcggcggcgtcctggtcgaccaggtagtcgccgcccttgatcgtgtcgaaggtgtgccactcccagttgtcctcctccacgttggcgagcgcggcggccatgccgccctgcgccgcgcccgtgtgggagcgggtggggtagagcttggtcagcacggcggtacggctgcgcttggtcgactcgatggccgcgcgcatgccggcgccgccggcgccgacgatgacggtgtcgtacttgtggatctgcatggtttcctctggtccctctgtcccggcgcctagcggatgttcgggtcgaaggtgaagatcaccagcgtgcccagcaggacggtgaacaccgtggcggtgtacaggagcatcttcagccagaagcgggtgttgtcccgttcggcgtagtcgttgatgaccgtacggaggccgttgccgccgtggagcatggcgagccacagcatgatgaggtcccaggcctgccagaacggcgaggcccagcggcccgccacgaaggcgaagccgatcttggagacgccgccgtcgagcaccagctggatcagcaggtggccgaggacgaggacgaccaggacgatgcccgacaggcgcatgaagagccaggcgtacatctcgaagttgccgcgcgaggccttgggggtcttgcccgtccgcttgcgcgggggctcgatcaccggggccgggtggtcgacgtcgtacaggctcacgccttcgacgtcgccgatcgcggctgcggaagaagtctcactggacatgggcctcagctcccgaagacgtcgcgtacggcgtgaccgaggacggggtacagggccccgaccatcagcacgatccagatgcccagcacggtccagagcatctgcttctggaagcgcgggcccttggcccagaagtccacggcgatgatccggagaccgttcagcgcgtggaagagaatcgcggccacgaggccgtattcgaggagcgcgacgatcggcgtcttgtacgtggccacgacgtcgtcgtaggcctcgggggagacgcggacgagagcggtgtccaggacatgtacgaacaggaagaagaaaatgaggacaccggtgactcgatgagccacccaggaccacatgccttcccggccgcggtacagcgttccagccggcacggaagaaccctccgggagcggggattggggtcggccggcttgactgtcggtctgacccggccgggtacggtccaccggccccggccatcgtagcgacgcattgtcggttcgttcgcgccggggcctctggtgtgatcaaagtggcaatcaaacaggcacgtacgggctagagcgacccttaccgcagggggtccggcgtcaccagctcgacgatccggctccgggcgagtcgtcgcagctcctcggcggtcaccgcccgctcctcgtccgtgtcgtgcgccagccggacccggatcccggccagcacctggtccacgtgctgggagggctgataggcgtccaggcagatcacgaaggcgtggccgaaccggctctcgtacgccgcgtgcgcggcccgcagcgccagatgggcggcgcggggagcgtcgtggtgcaggcagggggccggctccgaggccagggcctccgcgatgtcccggggtgcgaggtcgtagcccgcctcgtcggacgcggccagtagagcgccgagatccgggtaggggcggtgggcggccatccggtgggcccagcggagactgccgcagcactccaggaaggccgcctcggcggcggcgaagggcaggttgttgaaatgggccaggccgacggcatgatcgaccggtggcgcgccggcgggcggtgctcccgggccgccggccggaaccgggtggcgcggctgctcgggcacggccgggtggccggccggaggcgcggatcgcttcggcaggccggcgggggactcgctggacctggacagcgtggactcctcgtatcaacgacagttatgactccgtggcccccgaaaggaaccctctgtccttggaagacaggccggggcgcaccgaggttgcccggcagaagagtgacttccgtgggggccggagtgaagggagggacgaatgtgccgcaacgctagcgagatcggtcggcggccgtccggcggaccgcggaagaatcacccgaacgggagagtttcggaacgtgtgatggacgtctgacctgcgtcgaccgaggttctgtccgagtccccggaactcccgatgggcgaggccacggcaaaaatgccaaccttgcaccctattcactcgtttcatccgctattcactcgtttcacccgtcccagccccctcaacggaggaatctgcccgatgtcgcccacgcgtggtgccctcgtcaccggcgcggctgtcacggccgcggccgccgtcgccctcactgtcgtcgtctggccggacgggtccggcagcggatcgtccggcgacacggcgtcgccctccgggacctccgccgaggccgtcgccccgtcgccctcccgcagctacccggtgtccagtacaccgagcacgatccccgcggtgcgcgagcacaccccggcccggggacccggctggcagccgggcaaggacagcaccgtcgtcatcgccaagggcagccaggtgctcgccgacgaggcggagctgctcgccaaggagctgaagatccgctaccggggtgccgagccggcacggacgggagacgtcgagctggcgctcggcgacaaggacgcgggtcccactgagtcgtacacgctcaccgtgcgcgaccggaaggtgaagatcaccgggcccgacgagtcgggcgtcttctacggcacccgcaccttgaagcagtcgctcaaggcggacagcacggtccccgagggcgtcgtcaacgaccgcccggaccggccgcagcgcgggctcaacctcgacatcgcgcgcaagcactacagcgcggagtggatagaggaccgcatacgcgagatgggcgacctcaagctcaaccagctcggcctgcacttctccgacgaccaggccttccggatcgagtcgaagacccaccccgaggtggtctccgacgaagccctcacccaggacgaggtccgccgcatcgtcgccctcgccaacagccggcacatcgaggtcgtccccgagatcgactcgcccggacacctcggcgcggtgctggccgcccaccccgatctccagctgcgcaacaccgcgggcgtcccgtcgaagggctccatcgacatctccgagccgggcgcggccaagctgatcgacgaactcctcgacgagtacaccgagctgttcccggggaggttctggcacctcggcgccgacgagtaccaggcgctgaccgtccagaacccggccgcctcctatccccagctccagcgcgcggcggaggagaagcacggcgccggagccacgatcgaggacctggccaccggctggctgaacgaccgcgcggccgtcgtcgtccccaagggccggaccgccaaggcctggaacgacgggctcttccgggacacgaaggtcaaggccgacgagaacatcgagatcgagtactggaccggcaaggagatcggcgcccgcccgccgcaggagtacctcgccgcgggcttcaagatgctgaacctcaacgacgagttcctctactacgtgctcggcgagcccaacgagttcgtctacccgaccggcgagcggatctacgagcagtggaccccgctggtcatgcgcggcaccgaacccgtggcggagcgctactcgccgcagatcctcggcggccggttcgccgtctggggcgacctgccgaacgcgcagaccacccagcaggtggcggacggcatccggatgccgctcgtggcgacctcgcagaaactgtgggacccgcggaaacccgcgctgagctgggcgcggttccaggaactggcgaagcggaccggcagcgcggggtgaggccgagggatttccccggcggcgcgtgagcccgtggacagcaccgctgtccacgggctcacgcg

SEQ ID NO: 3053 - DNA, 8686 bp, Unknown
  Kingdom: Bacteria, Phylum: Actinobacteria, Class: Actinobacteria, Order: Streptomycetales, Family: Streptomycetaceae, Genus: Streptomyces
cccccggacaggccccagcaccacggctccccacaaacccgcagccgcgatctctcatggagcctcagccaccggggggggggccgctcacccccaccacaccgacgaacctcactcccgccgacggccagcgctcgcccagccagaacgtcgcacccacccgcacccgcactaccccacgacggcgcgccgtcctgctcggcggcgtcggcctcctcgccacaagcgccaccaccgcaacgctcgtcttccgtggctcgccggacgacagctccgccacccccacgaccccgagcagccggccagaggacagccccgccaccctctgccccctcaccggccacatcgacgacgtctgggcggtggcgttcagtcccgacggccagaccctcgccaccggggacgtggacgatgaggtgcggttgtgggatatggctacccgccgtaccttcgccaccctctccgccgacaccggcgcaaccctcatggtgtggctcagcacatgatcgccaggacaggctccctaggcgtatttcgtgcgttcatcttcgagggagtcggccgcataggtgaaaacaaactccaaatccacggtgccggggttggtgatcccgtgaacggagtgcgaagggatgaagaccatgtcccctgcctcgatgtcgtgatcagtgccagcgaggtgtacgactccggaaccactgaggatgtagtagatctccgaggccgcgtgactgtgcttgtgcaacgagccttgaggacggatgcggcacgtccccgctgtcagctcgttggttggggtcccgtcgccgatcagggtcgtgaactctagcgtcccgcgctcatctgaccatcgctcagtcgttccctccgtgccgcgacgtacgacaggtcgaatggacatgggcggactccttgatcgatcgcggcgtgggtggtgaacgtcgcaacgttacaggacgcacgtgtcgctaccgctggtcaccagggctccaggcgttcggtgggcacccctgggacagcgccgatcaggtcgtgtatcggacgtgaatcgtgtgcccagggtgtcggcatgtccctgagtcacatagcggacgacctcacggtggaaatgtcccccgtcggtgaagtggaagatttgccagaccggcggcaccaggcgcatacgggtctcggcgacggcgacctcttcccggcagtactggcccctggccccggtactgctcggtgccctcgtcgccgcggccgaccttgccgtggatccacaccttgccgtagtaggcgcagagcacgcgtcagcctttgtcatcaggctgacgcgccgccgttgcctaggcccgctcggagtcgctgtcttcgccggcctggtcgcggaagtcgatgctcgctccggggtaggcggcggcgacccgtaggcggacttctctggagagggcgttgtagcgaaggtcgatctgttcgacggagggcagggtgaagaagccgtcgggcagctcggtcagcccgttgaaggacagatcgatcctcttcagtccctggaagccgccgattccggcgatgacgtcggcggtcatcggaccacgtccgcccccgtcctccgctccccagcggtcgatctccagctcctccagcgccggcagggggttcgcgagcacgggccgcagcagctggtgcggcgggaccggtacacccgtgtggtcggtgagtccgctcagcttcagcacccgaagcttgggcagccgggacaggtcgggcagcggggacttcaccagtccgagggcattctcgaggccgagttcctcgaggttggtcaggcgcagcagtgtggcggggacctcgtggaagaagttgcccctgagctcgagcttgcgcaggttcgggaagccggtgagggcttccgggaaccgcttgaggtatctccagcttcttcccgtcatggagacttcttccaggccggccaggccctgcatcgatgccgggaacaccaggttggtctggtccgccaccagtcggcgcaggtgtgtcagatgtccggccgtctccgggagcgcgaaggttgtggtgtcgggcagtgcctcgccggtgtcggagggcatgctggacagttctgagacatcgagttcttccagcgccgtgagccggccgatggtgtccggcagcctgagcggccggtgggtgggttcggtggaggagtcgtaggtgatgttgccggcgatccgcagtacgcgaagcctggacagccggccgatggaggcgggcagttcggccaggccgcagtcccgtaccgacagaagttccaggtcggtcaacgtgccgatctcgtcggggagttgcccgatcgggttgccgtccaggacgagtgtgcgcagccatggcatccgcagcacctcggccgggaactccttgagcttgcgttccgacagatcgaggtggagcacccggtcggcccgggcacgcgcgacgtccgccagcgccgcatcgttcgcggtccgcgccccggggcgcaggaccggcagtccggcccgcagccgttccaggaactccggcacgtcgatgctctcgccttccgggtcgacgacctcggcgacgaacgactccacgatgttctcgctgccgaagtcggcgtcgtcatcgtcgccgtagttgtccaccaggcgagcgccgggggcgtcaacgcggagatcgtggtcgtagttgatgacccaaggagtctcaacggtacgggtctccaggatgccgttgttgtagtcgccgtagatgagatgagtgaaggcgccgtcctggatgtagatttcgcagtcgccgccctccagggtctcggcccgggtggtaccgccgacgtagagtcccggcagcgacccgtagagcgcgatcgggccggacaccgtcagatcgccggtgatcaccaccaggtccacgtggtccagactcccgattccggcgacggcgtcgaggaagccaccctccagtaccagatcgccgtcgaagagcaggacgttgtcgtagttgccctcgaaggaggcggagagagcctgcacgaggcgagtgtcggcctcggtgaaggagaggcgttcgggtgcgggggtgtgggtcatgtgggcgacgataggacacgggtatgacagaccttcaatctccttctgcccatcgggcgcacccgtcgcggagcgcgggtcgtcgtagccgaacgcgcactgtcggctaccagcctcgggctttcgtgaggtttggtgtccggcaggcggccagggaagcggagtgcctcaccgccccgaagcgataggggttactgggggccctgcaagtggtcgtggaagaggcactttccatgcgaaggagagtggcgggtcagactcgcgtgtcccggtcggccggggtcagcacgacaacttcgcaccacggaaagagtggtcaccggaggacgcggtggcatgctggacgatggtggacccgaccgggacctggtggcgaacgagcccggcccccatccggttcggcggtgaaggttcagtcgtcgggcgtttcagcggcgcggagcggtagacctgcgtggacacgccgcttcagctcgctgaagtcacggaaaccgtccacgtaggtgagcgcgttgccgcttttgtcgtggtcgtcgaacacgcgcagcaggtcgcggtcgaagtgctccagtatgcggaggtcggccaggccgatcgcggtcggtggggtcgcgatctcaaggcgcggtcgaccgatcaccgcgttggcgaagagcgcgccaccgatggtgaagtgatgttcttcgccatagaagagctgggcgtggacgtcgccgccgatgtaggcggagcagtcgttgtagtcgccgatgagccgatcggttctcaggtcgccgtggacctcgatccagccgccggtcaccacgtcgcgtgcccgcatgttgccggtcaccagcagaagcgactcgggatcgccgctatcgccgtacgcaccgtcgacgaccagatcgccgagcacgaccaggaggtagacgccctcctgtgtcaggtcgagatcaccgggtatgtgcagatcgccgtcaacgaaccagacatcgccggtgtagttctcgatctcgtcgagcgccgcggtcacacgcttgatcttgtagtcgttgtggaaccggccgattgctgtgatgacctcggcttgggagacctgattcttcttgtagctgagcacgttggcaatcatggccagggcactaccttcgtgtagttggcgtcgagttctgtcgaagtgcatctgtcggacggtgagttgttgaggcggcctcttcgaagccgcaccggcatggtaaaggccctcactgacacgaccgctctggcccgacacgcgtcggtagaaatgccgtagtgcaaccggcacttctaccgaccccactggactggggcatcaacgacctctgagggctgtcccggctcaccatgcctggccggcgatggccgcctgccctgccggtacgctgccggggtggcggagcacatcgagcacatcgcgcaggacgggcggaggccggcgaacgacgggccgaaggccgccgtccgtaaccgggccgctctggtcgccgccgcccgggaggtcttcgcggagcacggtctggaggcgccgctctccgcgatcgcgcgcagggccggggtcgggcagggcgtcctctaccggcacttccccgaccggaccgccgcggtggccgccgttctcgaggagaacgtgcggcagatcgagcaggccgccgcggaccaggccgccaccttcgacgcagtactcggtgtgctgacgtggcatctcgcggagtcggcggccttcatcggtcttctgcacgccgaccgggcgggcggccgctcgggcatccgcgcgcacgccctggccctgtccgagcgggtggagcgtgctctgcgcaggcacctcccccgcggtcatcggctgagtgcgggggacgacctcgtactctccgtcgccatggtctccgccgccgtcatcggccccacccgcgaggagcgcgagcagcgggcgctggccgcctggcggctcctcggcgtcgaggtggggccggtgcgggccttcggcggctgagccggaggcccggcgtcagccgccgttcgactgccggatgccttccgcgagcgcgtcgaaggagtagaggtagccgcctgcgggaccgctgacggtcatgtacgccttggtcccgccgggtgtgatggccacgttcgtcgccgactccaggccttcggcccgcgaggggagctccaccgtcgccagccgctcaccgtgccggtcgtacacggccatggccgcccggccgtgcagcccctggtagaggttgccgtccgcgtccacggcgatcgagtcggtctgggcgagtccgccgtccacgcggatggccgtgtgccgggacgtcaccccgccgtcctcgtcgaggcgcaggtaggagatccggttctcggtgagctcgctgaaccacagccctcggtagtccgcgtcgaaggagaccccgttcggcgcggccagatccccggccagaacggtggccccgccgccctcccggtcgatccgcaccacacgcccgtgggccttgccctcggacaggccgcgtgagtcgctgatgtacaggttgccctcccggtcgaaagcgatgtcgtcggggttcatccgtgctccgtcgacctcgccggagaagaaggtccgcgggtcgccgccgccgggggccaggctcacgacctcgccgtgtgcgaagtcgctgaggtagagccgtccgtcgtacgggctgaactgcgccgaggtataggctcctctgccgtcggtgtggaccgcccgggacgtcttcctcgccacgtcgacgcggatgaccttgggtgtgccctcgggtgcggtgacgtcgacgacgatcaggccgccgtcctcgccgaacacgggcccctccagcaaggtcatcccggtctcgccgtgcacctgggtcagctgcatgaccttctgcgcccggatggtcctgtcccggagaaccgactccgcctctccggggtcgccgctctgcgtgccgcagccggtgaggatcagtgtgccgatggtggcgagcgcggaaaatgaccgggccgaaagtcgctgcatggggggggaccactcttcctgtccagtgggcgggttcctcgggcggggagtacgcggcccgcgggaggggagaggccggtggccgaatgtcgtcgtcactcccgaccctcaaccggacagtcttgtccggtagttgctaccgtagcggacggccgcccgaccggggccgcccccaccgtgcggatcgaggacccccacatgacgactcctcagacaccggccccccacgagctcgccgcactgaggcggcgctaccggctcgaacgcgaacggcgtgtgcgtcccgacggagccgcccagtaccgcgacgcggacgccgagttcggctactacgcggcggacccgtacacggaggggccgatcgggcgtgacccgctccacgaccccgtcgacgtcgccgtgataggtggcggattcggcggcatcctcaccggggcgcacctgcggcagcagggtgtcgagagcgtccggatcatcgagaagggcggtgatttcggaggtacttggtactggaaccggtatccgggagtccactgcgacgtcgaatcccacgtatatctgccgatgctcgacgagaccggctacgtaccggagtggaagtacgcccccggtgacgagatccgccgacacgcggtgcggatcgcacggaagttcgacctgtacgcagatgtgttgttctccaccggggtcaccgcactgacctgggacgacgcttccgagacatggaccgtggccacggatcgcggtgacgccttccgggccacctacgtcgtcaacgccaccggcaccctcaccgacccgaagctccccgggatccccggcatcgaggacttcgcgggccacacgttccacacctcgcggtgggactatgcctacaccggcggcaccccccggggcggcatgaccggcctcgcggacaaacgggtgggcgtcgtcggcaccggggccaccggcatccaggtcatcccgatgctggccgaggacgccgcacacctctacgtcttccagcgcaccccgtccaccgtggacgtacgcgacaaccgccgcaccaccgcccgggacgtgggtgccgaccgcgaggactgggcccggcaacgacgggagaactacctccgcatcgtctccggcgagggcaccgagcaggatctcgtggcggaccggtggaccgcgtccgcgggcctgctggagaagctcctgccgagcttccggcggcagggcgaccggcaggccttcgaagccgcctacgaggccgccgacgccgccaagatgaacgagctccgcgcccgcgtcgaacagacggtcacggacccggagacggcggagaagctcaagccgtggtaccgctacgcgtgcaaacgcccgaccttctccgaccagtactaccccgcgttcaaccgcgacaacgtcaccctcgtcgacaccgcggacacccacggcatcgagcgcatcacggagcacggcgtcacggtcggcaccaccacgtacgaactcgactgcctgatcttcgccaccgggttcaacgtcgggacctccggcatccactcgggcagactccccgttcacggccggggcggcgtccaactgctgcacaggtgggcacgtcagggtccgcgcaccctccacggcttcacgagccacggcttccccaacctcatacagatgggccccctccagaacgccagcagcgtcaacttcacccacatcctggacgaacaggccatccacgccgccgccctcgtcgcagccgcagaagccggcggcgccctcatcgaaccctcacccgagaccgaggacgcctggatcgccgtcctggccgagggcgcgcccgaccacgagtggttccacgccgagtgcacccccggctactacaaccgtgaagggcgtggccggcccaacggccccatcgcctacccgcacggagccgtcgccttccacgagctcctcgaacgctggcgtgaggagtccatgggggacgtcctccgggacaggaccgtcccccgcacctgacacggccggcccgcccgctcccctccccgacccccacaacccgagccctcgcagcgccggaaggaccgagccatgaacacacctgtctccgagccggacaccgccactcgcacccgtcggagcgtgatcgtcaccggggccgcgtccggcatcggccgtgccgccgccctggccttcgccgcagggggcgaccgtgtccttgccgccgacctcgacgcggcaggcgtcgaggagaccgtacggaggatcgccgccgccgggggcatcgcactggcgtccgccggggacctggccgagcaacgggtggtggacgccgtggtggcccgcgcggtggcgaacttcggcggggtcgatgtcctggtcaacaacgcgggcatcatggaccgcatgtcggccgtgcacgagaccgacgacgacgagtggaaccgggtgttgcgcatcgacctcacggctcccttcctcctcacccgcgccgtactcccccacatgctgaccgccggcgccggatctctggtcttcaccggctccgaggccggcctgcgcggcggcgccgccggagccg

SEQ ID NO: 3054 - DNA, 7274 bp, Unknown
  Kingdom: Bacteria, Phylum: Actinobacteria, Class: Actinobacteria, Order: Streptomycetales, Family: Streptomycetaceae, Genus: Streptomyces
ccgacgacctcgccgacgacctgctcaccgcggcccgcgccgggaacccggcccccgcggaccgggagctcaccgccgccgacgtggcgctgatcagctacacctccgggacgagcggcacccccaagggtgcgatgaacgcccacggcaacatcatggtcaacgccgaacgccagcgcgccggccacccgatcgccgagggttccgcctacttcgcgctcgccccgctcttccacatcaccggcatggtctgccagttcgccgcctgcgtggccaacgcgggcaccctcgtcctggcctaccgcttcgaggcgggcgtcgtcctggaggccttcgccgcccaccgccccgcctacaccgtcggtccgtccaccgccttcatggcgctggccgcgcatccggacgtcaccccggaccacttctcctcgttccgggtgatctcctccggcggcgcacccctgccgcccgcgctcgtggaggagttccgcgcgggcctcggcccgtacatccgcaacggctacggactcaccgagtgcaccgccccctgcgcctcggtcccgccggagcacgaggctccggttgacccggtctcgggcaccctctccgtcggcgtccccggccccgacaccttcgtacggatcctcgacgagacgggccgggaggtccccttcggggagcagggcgagatcgcggtgcgcggcccccaggtggtctccggctactggaacctccccgaggcaacggccgccgccttcccggacggcgagctgcgcaccggtgacatcggcttcatggacgcggcgggctggctgtacgtcgtcgaccgcaagaaggacatgatcaacgcctccgggttcaaggtgtggccgcgtgaggtggaggatgtcctctacacccacccggcggtgcgcgaggcggccgtcgtgggtgtgcccgacgcgtaccggggggagacggtccgggcgtacgtgagtctgcgtccgggggcctcggtggagcccggcgagctgagcgcgtactgcgaggaacggctcgccgcgtacaagtatccgcgcgaggtggagatcctggccgagctgccgaagacggcgagtgggaagatcctcaggcgggaactgcgttccccccgttagaacggcgtcgatacagcgcacgcacggtacgaaaggaaggtggcggctcatggccaaggcgacggatcagaacggcgctccggtccctcagaggctgctggccgccgccacccggctcttcgccgagcgcgggtacgaccgcacctcggtccaggagatcgtcgaggcggcgggcgtcaccaagggtgcgctctaccactacttcggctccaaggaagacctgctccaggaggtctacgcccgggtgctgcggctccagcaggagcgcctggacgcctacgcggacgccgaggcgcccatcgagcagcgactgcgcgacgcggcggccgacgtggtcgtcacgaccatcgacaacctggacgacgcgtcgatcttcttccgctccatgcaccacctgagccccgagaagaacaagcaggtgcgcgtcgagcgccgccggtaccacgagcgcttccgggccctgatcgaggagggccagcgcagcggcgtgttctcctcggccacccccgccgacctggtcgtcgactaccacttcggctcggtccaccacctctccacctggtaccgcccggacggcccgctcagccgccaggaggtcgccgaccacctcgcggacctgctgctgcgggccctgcgcccgtaacgcatcggcgccccgctcccgacacacgtctctccggagcggggccggggccatccactggcccgctccgccggtcggggtgagtctggatatatgaggtatgtcctgcctcccggtgaggcgccagggttcgcgggcgaaccactgttcgttaatagaacggctatgtccggtttccgctcttgacggagcactgtcatttccttgagcatcggtcacgcattgcgcacctctgggccgcttgtccgggcccacgctccaggacccggccggatcaccacgcggccggggaccccccgcacgttccgtcagtccccaacggaatccggagcccgtgaatgagaccgaaccgtttcaccctgcgcagatccccggcggccgccctggccgtcgccctcgccgccgtcctcgcggccggagccccggccgcccaggccgccggcgagccggcaccggcggcggtcgccgccgcggcgcccgacatccccctggccaacgtcaaggcgcacctcacgcagctctcgacgatcgctgcgaacaacggcggcaaccgcgcccacggccgtcccggttacaaggcgtccgtcgactatgtgaaggccaagctcgacgcggccggatacaccaccacgctccagcagttcacctcaggcggagccaccggctacaacctgatagccgactggcccggcggcgacccgaacaaggtcctgatggccggggcccacctcgactcggtctcctccggcgccggcatcaacgacaacggatcgggctcggccggagtgctggagaccgctctcgccgtctcccgcgcccagtaccagccggacaagcacctgcggttcgcctggtggggtgccgaggagctgggtctgatcggctcgaagcactacgtcaacaacctgccgtccaccgagcgctccaagctctccggctatctcaacttcgacatgatcggctcgcccaacgccggctacttcgtctatgacgacgacccggtcatcgagaagaccttcaaggactacttcgccggcctgtcgatcccgaccgagatcgagaccgagggcgacggccgctccgaccacgccccgttcaagaacgtcggcgtccctgtcggcggactcttcaccggcgccggctacaccaagtccgccgcccaggcgcagaagtggggcgggaccgcgggacaggccttcgaccgctgctaccactcgtcctgcgacaccacgagcaacatcaacgacaccgccctggaccgcaacagcgacgccgccgcccacgccatctggaccctctccgccgccggtgaaccgcccaccggcgagggcgtgttcagcaacaccgccgacgtcgccatcccggacgggggagcggcggtgacctcgtcggtcgcggtcaccggacggaccggcaacgccccggcctccctccaggtcggcgtcgacatcaagcacacctggcgcggcgacctggtcgtcgacctgctggccccggacggcaccgcgtaccggctgaagaactccagcagcggcgactcggccgacaacgtcgtcacgacgtacacggtcaacgcctccaccgaggtggccaacggcgcctggaagctccgggtccaggacgtcgcccggcaggacaccggctacatcgacagctggaagctcaccttctgattcctgccgtacgtgtacgggcgcggccccctcccgaagagcacctcgggagggggccgctcgcggctcacacgtaccgcttgatctcccgccgggccagcgaccgctgatgcacctcgtccggcccgtccgccagccgcagcgtccgcgccgatgcccacagctccgccagcgggaagtcctggctcaccccgcccgcgccgtacagctgcaccgcggagtccaggatgtccaccaccgcgcgcggggtggcgatcttgatggcctggatctcggtgtgcgcgcccttgttgcccacggtgtccatcagccaggccgtcttcagcaccagcagccgcaactgctccaccgtgacccgggcgtccgcgatccagttctgcacgacgccctgctgggcgagcggcttgccgaacgccgtacgcgccacggcccgccggcacatcagctcgatggcccgctccgccatcccgatcagccgcatgcagtggtggatccgccccggacccagccgggcctgcgcgatggcgaagccgccgccctcctcaccgatcaggttcgccgcgggcacccgcacatcgtggaagagcacctcggcgtgaccgccgtgcgagtggtcctcgtacccgtacacccgcatggcgcgccgcacttcgagacccggggtgtcgcgcggcaccaggatcatcgactgctggcggcggatgtccgcgccgtccgggtccgtcttgcccatcacgatgaagaccgcgcagtccgggttcatcgccccggagatgtaccacttgcgcccgttgacgacgtagtcctcgccgtcccgggtgatccgcgtctcgatgttcgtcgcgtccgaggacgccacgtccggctccgtcatcgcgaacgcggagcggatctccccggcgagcagtggctccagccactgcttcttctgctcgtccgtggcgaactggaagagcacctccatgttcccggtgtccggggccgcgcagttcagcgcggtcggcgcgagatgcggggaacgtccggtgatctccgcgagcggggcgtactggaggttcgtcagcccggccccgtactccgcgtcgggcaggaagaggttccacaacccctgccgccgcgcctcggccttcagttcgcccacgatcgccggggtgtcccacggggaggcgagccgcgcccgctgctcctcggcgacctgctcggccggatacacgtgctcgtccatgaacgcgagcagcctgctccgcagctcctcggtacgggcgtcgaatgcgaagtccatggggttcagccttcctggagggtggtgaggccgtgctcgatgaagacggggaccaggtcgccgatccggtcgaagcccgcgccgacggtctggccgagggtgtagcggtagtggatgccctccaggatcacggcgagcttgaaccacgcgaacgcggtgtaccaggagatggcggaggtgtcccggccggagcgggccgcgtagcgctcgatcagctcggcgggggacggatgcccggccgcgccgctggtggtggagacgggcgacttcggcaggccgaggtcggagctgtacatcacgagcagccccaggtcggtcagcggatccccgagcgtggacatctcccagtcgaggaccgccttgatccggtcgtcggagccgaggagcacgttgtccaggcggtagtcgccgtggacgacggtgggcgcgggggaggagggcagctcccggccgagggaggcgtgcagctcgtcgatgcccgccagatcacggttgcgggaggcgtccaactgcttgccccagcgccgcaactgccggtccaggaagccgtccggccgcccgaagtccccgagccccaccgcacccgggtccacggcgtgcaggtcgaccagggtgtcgacgagcccgaggaccgccgcccgggtgcgctcggggcccagcggggcgagctgctcggcggtgcggtacggggtgccctcgacgtactccatcacgtagaacggagcgccgatcacgctgtcgtcctcgcagagcagcagcggctccggcacgggtacggcggtggggtagaggccgctgatcacgcgatgctcgcgcgccatgtcgtgcgcggtggccagcacatggccgagcggaggcctgcgcaccacccaccggcccgtcccgtcgctgacggtgtacgtcaggttcgagcggccgccctcgatcaagcgcgcttcgaggggtccgctcaccagccccggccgctcgcggtcgaggtggccgcgcagcagctccgggtcgaggcctggtggggggactgagctcatggtgcgcacctccggggcgacggaacgatcgggaaccatgatgccgaccagtcggtatgtcgtccagtgcccgcccgcgatccgacggtgcggagccgtgtgaccgagcgcactgtccggggcggtggacggcgtcggccgacgcccggggctcctgccgccgacgccggcctacggggctgctgtcggaggggtcaggtcgcggggttctccagcagggtgacccggttgccgtccgggtcttccagagcggcgaaccgggtgcgcgtaccgccggtctgcaccggccccgcggtcagaccgcgttccctgagctgcgccagggcctcgtccagatcgggaacctccagattgaggagcgtcgaaccggcacgctcggcgtcctcgaagaccgagagtcggccccctgtggagagatgccaatccgccagcgacggcatcggccgggcgtccgccggacgtcccagcaacttttcgtaccagaccaccgcggtctcgacgttcctcacgggcgcgaccatcaatacgcggacgatgtccatgaatgccacctttatttcgcatacttcgacagagatttcggtgtcacctcttcggactgcccgaggcgacagaactcatcgcgcgtcgccgaacccttactcaccgaagccgggagcccggccacgggattcgacgaccaccgtgtcgtcagcaccgccgccgaccggtggaaccaggccggcctcgtacgcggagatggccgcctccacccggttgcgtgcgcccagtttcgcgagtaccgcgctgacgtgtgccttcaccgtgccctcgacgaggtgcagccggctcgcgatctccgcgttggacaggcccgtccccagtccggccagcacctcccgctcccgttccgtgagccgctccagggggcggcgggggtgtgccgcccggtgtgcgcgcatccccgcgatgacccggccggcgacccgcggggacaggtaggccccgccggctcccaccgcccgtaccccgttgaggagttccctcggatcgtccgccttcagcaggaagccgtcggcgccctcctccagggcgcgggtgacgtacgcgtcctgaccgaaggtcgtcagcatgatcacaccgaccgccgctgattcccggtggagccgcgccgctgccgtgagcccgtccaggccgggcatctggatgtccagcaggaccacgcccggccggtgcacgcgggtgagcgcgatggcctcgtgcccgtcgctcgcctcggcgaccacctcgacgtgcgggtcccgggcgaggatggcccgcacccccgcccggatcatcgcttcgtcgtcggcgatcagcacccggaccgggcgactgcccggtgtcgtctcttccacgcggcgagcctacggccgaactccggccgtgcgaacggtgggcgccacggatcagcccggaggcggggtgcgcccctgacgaacggcgggacgccgctgccgttcgaccgatgggcgccggcgccgcggacttctagcg

SEQ ID NO: 3055 - DNA, 8610 bp, Unknown
  Kingdom: Bacteria, Phylum: Actinobacteria, Class: Actinobacteria, Order: Streptomycetales, Family: Streptomycetaceae, Genus: Streptomyces
accggcctcgccgggcctcggtcaccacggtgaaaccggcgggggcgaggcccggcgaggccggtgcgtggtggagcgacggcggtagcctgcggtgacccagggccagcacgaccttcaccagcgcgggcatcgcggcggcgttcagcagatgcccgatgttggtcttcaccgaaccgaccaaccgcggttcgccgtcgggccgttcgggaaaggcgtggttcagcgaacgcagctcgatcgggtcccccacggccgtgccggtcccatgagcctccacataggtcaccgaggcggggtcgacccccgcctcctcgtacgcccgggtgatgacctcgcgctgccgcaacgggttgggcgccatgaggctcatcgaccggccgtcgttgttgacggccgtgccccgcaccaccgcgagcaccggatcgttcgcgagccgggccgcgtcgaggcgtgtcaggacgatggccgcaccgccctcgccgggcacgaagccgtcggcgtcggcgctgaaggcgcggctgcgcccggtgggggacagggctcccactccctccagcagccggtgcggggccgaggtcaggtggaggttcaccccgccgacgacggcgaggtcgcactcgccgtccaggaggctgcgccgggccaggtgcagggccaccaggcccgacgagcaggcggtgtccacggcgagtgcgggaccgtcgaggtcgaggctctgggagacccgggcggcgacgagggcgggcaggttcccggtgagcgcggcgggcagcggcgagccgtcggccgcggcccgctccaggatcccccggtagccgctgtccccgaccgcggcgaacacaccgatcctgcgaccgcgccgcagggggcccgcgtatccggcacgttcgagtgcctcgtgcgcgagttccaggaagatcctggcctgcgggtcgagtgcgcgtgcctcgtcctcgccgatgccgaagtagccggcgtcgaaagcggccggatcctccagcagcgcagcccagcgcttccggggaaccgccggagccgtctcagccgccgtcggcgcccccggaaggtcgtggccgtcgtcccatcgtccgtgcggtacggggatgacggcgtcgtgcccgtcgacgagcaggtcccagaaggcctcgggggtgtcggcgccggggaaccggcacgccatccctatgacggccgcagcggtggcggcgccgacgggggcggtggggccggccccggccgggtccaccgcggtcgttcctccggtgtgtggctcggcgctctccacggcgtccgggtcggacggccgcggaccgggtgccacggtcagaaggtgaccggcgagagcggtcaccgtgccgtggtcgcggatgaccgcgggcggcagcgtcacaccgaaggcctcctccagcgccgccagcacctccatggccttgagcgacgtccctccgaggctcccgaacggcgcgtccgtcccgatcgaatcggcgggccggcccaggacccgcgcccacacctcccgcacggcctcgacggtctccgcccgagcccggggcgccttcgtgagaggttccgccgcagtccgcgcggcttccccccgaccgggtacggcagacgggatcccaccgccgtcacccgccgcgacctcaccggtccccggctcaccggcccgccgctcacccgtatcgaaggcacccccctcgaacgcgccctcctcgaagcgctcccgcagccgccggcgctgcagcttgccactcgtcgtacgggggaacgcccccggaggcagggccagcacccgcacatcgtcatggagcagggcctcgcgcacccgggccgcgacgcgttcgagcacctccgccgcatcgcgcgggggccgtgcccaggggacgaacaccacgacgcgctccgcaccggtgaccgggtcggtcgaaccgaccaccgccggggcgccggaaggcagtccgggtgtcgcggccgcgacctcttccatgtccgtggcgtggaaggtgcggccgttgaggaacagcacgtccttgtgccggcccgtgacgcacagccggccgttccgcaggaacccgagatcaccggtgcggagccagccctcggcgaacacctccgcgccggcatcgggaaggcggtggtagccacgggccagttgggggccgctcaccatgatgtgtccggtccgccggtccccgaggacggtgcccgcgtcgtcgacgatgcgcacggcgcagccggccaccggccgcccgacgtccatcaactcgacggccgcttcgcccggttcggcgtccaccgccactccacggctcaacgccgcccggtccaggaccaggggctcggccacctccccgggcggcgggaaggtcaccgccagcgtcgcctccgccaggccgtagaccggctgggccgccgcagggtccagccccgagggccgggccttgtcggcgaaggcacgccacaccgcgggagcgatcggctccgccccgaccaggatcagccgtacggctgagaggtccagcccggccaggacctcgtcgggaacacggcgtacggtcagcgccagggcgaagttggccgcggacagcactgtggcccggtgccgggccgccacctcgaaccacaggcggggccgcttggcgaacgacagcgggccgatcttgacctgcctggcccgggcggccagcggagcgagatgggtgccgatgagccccatgtcgtggaagtacggcatccagctgaccaccacgtcgtcggggcccagcgccgaggcggcccgtatctgctccagattggccagcaccgcgccatgcgtcacctccacccccttgggcgcaccggtgcttcccgaggagaactgcacgaacgcgacgtcgtcgcgtccggcggcggcgggctcccgcaacgccggtccatcccgcaggagatcgagggtcagggtgcgaacagcgtcggggagttcaccggacagcgaagcggtcgaggcgtccacgacgacgggcggccgccccaggtgctcccagaccgggagcacccgacgggcgtccggcgccagtggaaccggaacgagaccggccgccacggcaccccagaacatcggctggaagtcctcactgcggtcggcgagcaacggcacacaggtcccgggtgccacccctgcctcccggaagcctccggccacccgcagggaatcgtccaggagctcgcgcaggccgaccgtcagctcgctgccgtcgccgcggacatgcacgacgacctgaccgggagcctcacggaccgcgtccagcagtacatccatcagtgtcatgtcgtgttccaccggtccgtcggtccgttcctcggagaatgatcttaaaaacgcgcgggtcgcgggcgaatcagccgccgggaggagagcgcatgccccctgggagtgacctgatggcaagagttcggctcagggccgggcaccgctagcctgtccaccgtgaacgtggggacccgggagacccggctgatcatcctgcgcggcaacagcgcgtcggggaagtcgagcgtggcggccggcctccgcgacagcttcggccgcggactggccctggtcggccaggacaacctccgccgcaccgtgctgtgcgaacgcgaccggcccggggcggcgaacatcggtctgatcgacctgacggcccgctacgccctggacgccggctaccacgtggtggtcgagggcatcctgtatgccgaccactacggcgacatgctcgcccggttgcgcgccgaccaccggggcccgacccacgggtactacctggacgtcccgttcgccgagaccgtggcccggcacgccaccaagccgatcgcggacgcggtcgacgagaaccaactgcgggactggtaccgcccccgtgacgtgctgcccgacgatgtcgagaccgtgatcggtcccgacagcgtcctggccgggaccgtcgaccgcatcatgcgcgacaccggcctgacccggctgccgccggccgaccgctgacgtgcccggcccgggcaggcggcagcggcctgcccggccggtcctgggccggaccgggcaggtcacacatctgtgcccgctccgctacgcgccggtcggggcggcctgctgcacgacctcgaaggaccacaccgtggacccgctggccgccggcttggggcgctcaccgctgccggcgccgccctgatgggccgccttcatcggcccctccatccacgcctggaaggatgcctcgtcacgccagcgggtgtagacgaggtagtcgtccgtgccctcgacgggccggagcagctcgaaccactcgaatccgtcggagccctccacggcatgggcccgggaagcgaagcgcttctccagcgtctcgcgttgttcctgggggacggtcagcacattgatcttgactacgctcatggctccatcctgccgtacgacgtccgggctccgtcggcgggcgggtccgccgcggggagttccaccgtgatgcgcatcccgccgtccgggcgcgggtcgagagtgagcgttccgtcgtgtgcgcgggtgatggtctcgacgatggccaggccgaggccgacgcccgcgtggtgggtgcgcaaccgttcggcaccgcgccggaacggttcggtgagcgtcgcgaccagctgcggggtgacctgcgcaccggtgttctcgaccgtgagcaccacggtctcccggcgtacgccggtggtgacccggacggtgccctgttcgggcaggttgtggacgaccgcgttgtgcacgaggttcgtggtcagctgcagcaggagcgccggcgacccgatcgcgggggcgatctcgccgcgtgtctcgacggtgacaccgtgttcttccgcgagggggaggagggtctcggtggcctcttccgccagcagcgacaggtcgacgcgttcgcgggtgaaggaacgccggtcggcccggctgagcacgagcagagcctcggtgaggtcgatcgcccggccgttgacggcgtacagacggtcgatgatctcgtcggtgtcgcggttcggatcggtgcgggccacctcgagaagcgtcttcgagatcgccagcggggtgcgcagctcatgggaggcgttggccgcgaacctctcctgttcggcgacgtgcgcctcgagccgggcgagcatcgtgtcgaaggcgtcggcgagttcccggaactcgtccttgcggcccggcagccggatcctgtgggagagcgacccgtgcgtggccgcgcgggtggcttcggtgatccgggtcagaggggcgagcatacggccggcgaggacccagcctcccaggagaccgaagacgagaaggaccgccagcacggtggccgccgccggagcgaacgtgtacgcgaggagctggcggttgggattctcgtggagcatccgcttgtcccagtcgtcgggaacgtactccaggaggaacacccacaccgctgtgagcagcaggatgccggcgaccatgaggaatccggcgtagctgagggtgagcttgaggcggacgctcaacccgggccgcctagtcacggccccctccgtcgccgtgaccggtgccggaccctgtgccgatgcggtagccgacgcccggcacggtggcgatgatccacggttcgccgaggcgcttgcgcagagccgagacggtgatgcgtacggcgttggtgaacggatcggcgttctcgtcccacgcgcgttccaggagctcttcggcgctgacgacgccgccgtcggcggcgacgaggacgtcgagtaccgcgaactgcttcctggtcagcgcgacgtagcggccgtcccggtagacctctctgcggaacgtgtccagccgcagacccgcgatctcccgcacggggggtctgctgtgggcgcgtctgcgttcgagcgctctgagcctgagcacgagttcccggagatcgaagggcttcgtgaggtagtcgtcggcgccgagcccgaacccggaggccttgtcgtcgaggcggtcggccgccgtgagcatgaggatcggcatgccactgccggaggcgacgatgtgttcggcgatctcgtcgccggacggcccggggacatcgcggtccaggacggcgatgtcgtaggtgttgacgctcagcagctccagagcggtgtcgccgtcacccgcgatgtccgccgcgatcgcttcgaggcgcaggccgacgcggacggcttccgccagatagggttcgtcctcgacgatcagcacgcgcatggttcgatgctacgagtcggcacctatcgtcggcgtatcgaaaaccgcatacgtgtcggcaacaccgcgctgccttgacttggcggcatgaatcgaccaccgccgtcagtgcgaacgaccccccgccggacgcgcaggccccttgtcgtcggcgcggtagccgtcgtggcagcgatcgcggcagccctcggccacaccctgctgaaccctgcgccggcaccgtcgccctcggcctcaccacgctccccgtccgccgccccctcctcggcaccggaacccttgcctcctcctgttcaccgtgaactccgtgaaccccgtggagccccgggagaggccgacggggtcgtccccgacggcgtgacggtgctcgacgacgggatcccggccgtcgccaacctcgacgccgatctgctcgaagccctccgccgggcggcgcgggagggagcggaggatggcgtcgagttctccgtcaacagcggctggcgctcaccggagtatcagaatcagctgctccgcaaggcggtcgcgcggtacgggtccgaggccgaggccgcccgatgggtggccaccgcgaagacgtctccgcacgtgtcgggggacgcggtcgacatcgggccggccaacgcgacggagtggctgtccgagcacggcgccggatacggactgtgccagatctaccggaacgaaccctggcactacgagctgcgcacggaagccgtcgaccgcggctgtccgcgcatgtacgccgaccccacccaggacccgaggatgcgaccgtgaccggcagcgagcgaggacagacgatggcacaggcggacgcggccgggaccgcacagggagacgtggacacggccgggaccgcaccgggagacgccggcctcccggatgcgggccccgggggcaccggccccctgcacaccggcgcgaggacgggcccgtggaaacgcggccggttgctcacggcggcggcgctgctgctgggactgtccatgctgctgcacgcgagcatcccgaaccgggtcgggaacctcggcagcctggtggagaccttcctcccgtggttcggcctgttcatccccgtgctgctggccggtgcgctgctgcgccgatccgccctcgcggtcgtcgcgttgctgctgccggccgtcgtgtggctgaacctcttcggcgggctgctcaccgacaagtccggcccggacggcgacctcaccgtggtcagccacaacgtcggcgccggcaaccccgacgcggtgggcaccgcccgcgccctggccgcctccggtgcggacgtgctggcactcgaagagctggacccgagggcccgggggacgtacgagaaggagttggcgacgacgtacccccaccacacggtgctgggcacggtcggggtgtggagcaagctgccgctgtcggacacccggacggtcgacgtcaagatggacgcggggccgctgggtgacgcgaagcccgccgacgtcaagctggagtacaaccgggggatgcgcaccacggtggccacggaacacggacccctggcggtgtacgtggcgcacctcgggtccgtacgggtgaacccccgggcgggtctctcgtcgggccaacgggacgccggcgcgcaggagctcggccgggcggtcgccgccgagcggaacgagcgggtggtgctgctcggagatctgaacggcaccgtggacgaccgcgcgtacgcggacgtcacctcgcggatgcgttcggcgcaggaggcggccggcaacgggttcggcttcagctggcccgccacgttcccggtggtgcggatcgaccagatcctggtccggggcgtggagccggagagctcgtgggtactgcccgcgaccggcagcgaccacctcccggtggcggcccgcatcagctggtgaacaccgaggagggcgaacgcacgcgctaggctgcgttccgccacgggggaagtccggtcgaaatccggcgctgacccgcaacggtagacggagcccccgggtcccgtgagcccgatcacccgtggcggagaaggctcctgacgattcgccgtggactgcgaatgggcgctgcgcggggcggccgccgtccggggccgctcctcatcgcgcgacgcacggcccgaggtgaaagcgaccggcctgtggccacgtctctcgaccgcataccctccaaaccgtcgcgccccgcgcagggtggcaccggaccggcgccaccccggcgcgtcccgctgccgttgctcctggccggcctctgtctggccctgcccctctcgctcgtctgcggggcggccctcggggcgtcggggctctcctgggcggaggtgacgcgttatctgtgggcagggctcaccggcggagccatcggccccgacgaggtcccgg

SEQ ID NO: 3056 - DNA, 2336 bp, Unknown
  Kingdom: Bacteria, Phylum: Actinobacteria, Class: Actinobacteria, Order: Streptomycetales, Family: Streptomycetaceae, Genus: Streptomyces
tggcctcggcgggcgcggccttcgtcgcggcgggtgccgccttgggcttgggcttgggctcggcctcgacgacggcggcgatctcgatgatctcctcggccgtctccccgcgccaggtccgtacggtctgctcgccgcgctcggcgaccttctcgtacgtctcccgggccttgatcgcgtactcggcggccacgcccacaccgcggagtgccagatcctgggcgttctcgcccagcttcttcaggtcggcggcgtcgaacgaaccgaacacctcggtgaccttcgcctgcacggtggcctgggcctccttggcctgcgtggtcaccttctcctgcacggccttggggtcggtgttgcgcaccgcgtcgatccgctcgggcgcctcggcccgcagctgctcgatcagcgccggaaccttgcgtgcctgctgcacggccaggtcggccgtaccggcggcgaagtagaggggggtggggtcggtgagggtcttgcgcaggtcatcggtgatggccatgactgtggtcctcccggatcatcagaaccagctgttcagctgtgagggtcttggtcttcggtggcgcccgcaccggcgtcgtcgccttcacggggcccggcgtccttacggggtccggcctcggcctccgtgtccgcgtcgggcccggggacgaatccgttctcgcggcggaaggagtcgtagatctgcagcagaacgttcttctgccgctcgttgatcgacggatcggccagaatgaccgcccgcgtctccagctcctcccgctcccgctcgtcgaggatccccgcacgtacgtacagggtctcggccgagatccgcagcgccttggcgacctgctggagcacgtccgcgctgggcttgcgcagaccgcgctcgatctggctgagatacgggttcgacaccccggtcgcatcggcgagctgccgcagcgagagctgcgccgcacggcgctgctcccgcaggtactcaccgagattcccgacgttgagtgatgccatggctcgatagtgcaacacccttgctaacttttgcaagcacatgcttgcaaaagtgtcgcgcgccactggctcggaccgggggaggtcggccgccaggggaggtcagctccggagtcgatgcgcctcccgttccgcgaacgcgcggaagctgctcgacgccgtactgtgcttcaagctcgacaaccgccacctcgccctggcacttgaggggaaccggtggcgacagtccttacgcggcagagcactacgagcggtggcacggcacactccaggccgcactggagcagatccccggcctcaccgacaccgacttcaccgcgcatgccctgcttgccgccacccgcgccgacctcgtcgaacacctcgccggccggcagcgggtggctcgtgagcaactgcggtccggcctggcggccttcaccgccagagtcctggaatcccgcgcaccactggactgaacagcccggaacgcctcgaacgccgtcagtgaggacaccgcggcgcgctccggcacccgggagggcccagtcccacatgccggccggagtgaccagcatgtggaatctcccgacgccgtgatcatcacgcgggcaccatgcccggcatgacgactgcggagatacggaacgcctacctgctggccgccgaacaggccgtgcggctcctcgcgacggaagaggtggcgcgctgctggcagaaggagtccgtgctgccggggatgacggtgggcggcctggccggtcacctcgcgcgtagcgtccttcaggtcgaatggttcctcgacggtcaggtgaccggcgcggaaccggtgtcgcccgtgcactactacgccaggctcgtgggcacgtccacgcccgactccgcgctcaatgtcggcgtgcgcgctcgcagcgaggaaacggccgcagccggtcccgccgtcgtggccgagcaggcgcggtccgcatggcagcggttggcggagcggctggagagggagccggccgatcagcgcgtggccatcctccaccggcccggagaggagatgctgctcgacggctacctccggacgcgatgtgtcgaactggcggttcacctcgacgacgtggcgctgagcgtgggcactcccagcccgacccccgaagccgcggtcgccatcgcggtcgacgtgctcgtcggggccgcccgcgagcggcacggcgatcgggcggtgctgcacgccctggccaggcgcgaacgcgacaccgcccatgccttgcgcgtgctgtgagcggcccccgtccccgtcgtccgcgaagggcggggaccacctcctgaccgacatgatccgcgaggccggcgcgctc

SEQ ID NO: 3057 - DNA, 3341 bp, Unknown
  Kingdom: Bacteria, Phylum: Actinobacteria, Class: Actinobacteria, Order: Streptomycetales, Family: Streptomycetaceae, Genus: Streptomyces
  misc_feature (3133)..(3150): n is a, c, g, or t
ccgccgcggcggcgccctccacggcggccgccctcggtgtgaacccctcggcgcagcgcgccacggccatcaagtcggcgcaggcggaagcctcttcggcggcgaaggccctgaagctcggcggccgggagaagctgatcgtccgcgacgtcgtcaaggacgccgcgggcaccgtccacacccgctacgagcgcacctacgacggtctgcccgtcctcggcggcgacctcgtcacccacaccgccgccgactccacgctgaagagcgtcgacaaggcgacgaaggcgaagatagccgtggcgtcgacgacgccgaagctgaaggccgcggcgagcgcccgcaaggtgatctacgcggctgacggcaaccccgtcctcgcctgggagaccgtcaagaagggcgtccagaaggacggcacgcccagccgcgtccacaccatcaccgacgccacgaccggcgagaagctgcacggctacgaggcggtcgagaccggcaccggcaacagccagtacagcggcgaggtcgagctgaccaccacgaagaccgacgcgggcttcgagctgaccgacggcgagcgcggcggccacaagacgtacgacctgaaccagggctcctccggcaccggcgaactcgtcacggacgacgacgacgcctggggcgacggcaccggcgcggaccggcagaccgccgccgtcgacgcccactacggcgcggcgaagacctgggacttctacaagaccgcgctcggccgcgacggcatcgcgggcgacggcaaggccgcctactcccgggtccactacggcgagaactacgtcaacgccttctgggacgacagctgcttctgcatgacgtacggcgacggcgagggcaacaagaacgccctcacctccatcgacgtcgcggcccacgagatgacccacggcctcacctccgccaccgccaacctggactacgcgggcgagtccggcggcctcaacgaggcgaccagcgacatcctcggcgcctcggtggagttcttcgccgacaacgcgtcggacgccggggactacctcatcggcgagaagatcgacatcaacggcgacggcaccccgctgcgctacatggacaagcccagcaaggacggcagctcggccgacttctgggacgagaacctcggcgacatcgacgtccactactcctccggcgtcgccaaccacttcttctacctgctcgccgagggcagcggaaagaagacgatcaacggcgtcgactacgactccgcgacctccgacggctcgacgctgacgggcatcggccgggagaaggcgtaccagatctggtacaaggccctctccgtctacatgacctccaccaccgactacgcgggcgcgcgcgtcgcgaccgagaaggcggcgaccgacctgttcggcgcggacagcgaggagctgaaggcggtctcggccacctggaccggggtcaacgtcaagtaacgcggcgcgtcggcgagtacgggagccggtcagccctccaggggtggccggctcctgccgtacagccaggcgtcccacagctccgtcaggtcccgccccgtctcctcctccacgtacgcggtgaagtcctcggtcgaggcgttggcgtgccggtgggtcctcgtccacccctcgaccagggcgaagaacgcccggtcgtcgtccatggcgagccggacgcggtgaacggccatcgccccgcgcccgtagaccggcggctcggacagctcggcggcggacggcgggtccgcgggcgggaacgcccagttcgcgtcggactcgtacgccgcctcgaagctctcccggatgggaacgtcctcgtggtcggcggcccagagccactccgcgtaggtcgcgaagccctcgttcagccacatgtcccgccaggtcgcgggggtgacggagttcccgaaccactggtgggccagctcgtggacgaggagcgcggtgtccggcgggccggggtagacgggccggttctgggtctccagggcgtaggccgagtcacccgtccgctcgacgatcgctccggcggaggagaagggatacgggccgaacttccctgccgaccacttcagcacggccggaatccgcgccagcacgtcctcgctcgccgccgccgactccgggtccacggcggtgaacagccggatgccgtcgggggtcaccgactcctcggtgacgaaccgccccacggcgacggtcgccagatagctcgccatcggttcgacggtccgccagcggtaggccgtgcgcccgttcgtcgtacgccgggacaccagctccccgttggagatccccgcgagcccttcgggaacggtgatcccgatgtcgtacgcggccttgtcgctcgggtggtggttgccggggaaccaggccatggacccggccggttcgccgagggcgaccgcgccgtccgccgtccgcagccagccctccttcgacccgtcctgaccggtgatcgtctccggggagccggagtagcgcacgacggcggtgaacgtacgtccctcgcgcagccggtcctcgacgtcggccgccggacgcagcgtcagttccttgcccgcccggttcacggcggccgggcggccctcgaccgtggcgccgtccacggcgagcccggcgaggtcgaggtggaaggcgctcaggtcctgggtggcgcgggcggtgatcgtggcggtgccgcgcaggtggtccccggccgggtcgacatcgagctccaggccgtagtgggtgacgtcgtagccgccgttgccgaggcccgggaagtacggctcgcgcagtcccgccgcacccggggtccccgcgaccccgcccgtgcagccgccgccgaggagggccagggcgagggccagcagcagaggggtgcgggcggtgcgccgccgggccggtgggacgtggttcacccggccgatcctagatctcggtacgccggaatccgggaccggaaggagccgcccgcctcgggggaagaacgggcggctcccgttcagaggatggcgattccgagcggccggttgcctgccttcaggcggaccggttcgctctcctcctcgtccaggccgacgaccgtgatgccgttccagtacccgtcgcgggtgaagccgccggtgacgtacgccgtnnnnnnnnnnnnnnnnnngcgaggggtcctcgtcgtccgatccgatcgggccggtgcccaccacgaggagggtgccgtcggggccgagggccgcgccgtgctggtgcgtgttcgcggtcatcggctcgatggccacctctccggtgcgcgggtcgaggaccgcgagccgctccccctcgaacggcagcagcagcttgccgtcctcgggg

SEQ ID NO: 3058 - DNA, 651 bp, Unknown
  Kingdom: Bacteria, Phylum: Actinobacteria, Class: Actinobacteria, Order: Streptomycetales, Family: Streptomycetaceae, Genus: Streptomyces
cgtcgccgaacaggccgtcgtactcctgcgcaacgacggcaccctgcccctggcggcggacacggccgccggagccccggcccgtatcgcactcatcgggcccaatgccgacgcgccgacagccgtcctcggctgctacgccttccccgtccacgtcgggggccagcaccccgatacgccgctcggcatcgaactgcccaccttgcgggaggcatgcgtggcggagttccccgacagcgagatcgtcaccgcacggggttcggagatcgacggcccggcgaccgggccggtctcttcgggcgtggcacgagcggggagggctgcgatgcggagaacctggcgctccccggtgtccagcagcaactgctcgacacccttctcgacgcgggaacccccgtcgtcgtcgtcctgctcgccggacggccgtacgctctcggccgtgcggtggaggaggccgctgcggtcgtgcagtcgttcttccccggtgaggaaggaactacggccatcgcctcggtgctgagcggccgtaccgggccgtcgggccggctgcccgtcagcgtgccgcgccacccgggctcccagccctccacctacctggcggcgcggctgggccactccagcgatgtgtccagcgtcgatccgaccccggcg

SEQ ID NO: 3059 - DNA, 16590 bp, Unknown
  Kingdom: Bacteria, Phylum: Actinobacteria, Class: Actinobacteria, Order: Streptomycetales, Family: Streptomycetaceae, Genus: Streptomyces
gggcggggcgcgggctcggcctggcgctggtgcggcaggcggcgtaccgcaacgggggcacggtggagctggacccgggtccggacggcggcgcgcggttcaccgtacggctgccgcttccggcccgtacggcaggttcgcggcccgggtccggggccggacccacgtccccgtcctcgcccgggaccacgtccgcggaggtcacggcatgatccgggtcctggtggtggaggacgatccggtggccgccgacgcccaccagatgtacgtggagcgggtggagggcttcacggtgacggcggtggcgcacacccgcgcggcggcggtgcgggcgctggagcggacgccggtggatctcctgctgctcgacctctatctgcccgacgggcacgggctcgggctgctgcgctcgctgcgggcctccggccacggggcggacgtgatcgcggtgacctcggcgcgggatctcgcggtggtccgggagggggtgtcgctcggcgtcgtgcagtacgtgctgaagccgttcacgtaccccacgctgcgggaccggctggtgcggtacgcggagttccggggcgtcgccggtgaggcgagcgggcaggaggaggtggaccgggcgttgggcgcgctgcgggtcgcgcatccggccgcgctgcccaaggggctcagcggcccgacgctggaggcggtgacccgggtgctgaaggagtctccggagggggtgacggccgctgccgccggggaacggctcggcatctcgcggatcacggcccggcggtacctggagcacctggtgaccgccggcagcgccgcgaggcgtccgcattacgggcaggtcggccgacccgagctgcactatcgctggctggccgcagggcgctgaccggccaccgccgattggccgacaagcgcttgccggtcggtttcacggccgtggcgtgctgctagggatgatcaaaagaaagcgctggtgggacggcattcgcgtaccgtccgcccggttcgcgtctggaggttcctacgaagcgtgatccgtggggaacgtaccgtagccagggcggaaatggacttctacggtgggcccgtgcaccccaccccgccattcaacgcccccgccgcgcgccgtctccgcgaggctctggggatggctcccggccatgtcgcctacgggctcgccgcccagtacggactccggatcagcgcagagaccgtcatcgcctgggagcgtggcctcgcgacccccggggagcgcgagctgaccgccctcgccggcgtcctgtggtgcgcacccggagagctgctggcggccgccgccaccctgcgcgagcaccgtatgacccgggacctgagcgtggacgatctggcccgccagttggggataaccggcgcctcgtacctgcggatggaggagtcgggtcgctggcggggcaacgagaagcagtcggcggcgctgtgccgggcgctgaatctgacggcggcgcagttcctgacggcgacgggccgcgacgaggagctggcggagctgctgagcagcgcggtcaccacgcgctggcaggcctacgtccgcccggtggccaagatcgtcccgctggaccgggcgctggtccaggacgtgctggaacaactgcacgccgactaccaggccctgatggtctccacgctgagctggagcagcacgggccaggaacgcgccgggtcgacgggcgacgcggggcgggcgttcctgtcccgggtggtggaccggttctggcggaccgccggggtgtgaccccgcacgggccgcccgtgcggcccgtgcggtcgcggagggccggccggaaggacggctagaagaccgactcggcttcgtacatccgctcggcgggcactctcttcagctgggtaacggcgtcggcgagcgggaccatggcgatgtcgttgccgcgcagggcggtcatcctgccgaagtcgccgcggtgcacggcctccacggcgttccagccgaagcgggtggcgagcacccggtcgtacgcggtcggcgtgccgccgcgctggacatggccgagaatcaccggccgggcctccttgccgagccgggtctccagctcgatggccagacggttgccgatgccctggaagcgctcgtggccgtactggtcgatctcacccttggcgtacggcatggagccctccgccgggtgagcgccctcggcgacgcagatgacggcgaacttcttgccgcgcgcgaacctctcctcgaccatcttgaccaggtcgtcgacctggaaggggcgctcgggcaggcagatgccgtgggcgccgccggccatcccggactccagcgcgatccagcccgcgtgccggcccatgacctcgacgaccatcacccgctggtgggactcggcggtggtcttgagacggtctatggcctcggtcgcgacgcccaccgccgtgtcgaacccgaaggtccggtcggtggaggagatgtcgttgtcgatggtcttcgggacgccgacgaccggcatgcccgcgtcggagagcatgcgggccgcggtgagcgtgccctcgccgccgatcgggatgagtgcgtcgatgccgtaacggcgggacagctcctcgcagttctcggcggcctcgcgcagccggtcgcgctccaggcgggccgagccgaggatggtgccgccgcgggcgaggatgccgctgaccgcgttgaggtcgagggggcggaagtggccgtcgagcaaccccttgaagccgtcctcgaagccgatgacctcgtcgccgtggccgaccacggcccggtggacgaccgaccggatcactgcgttcaggccggggcagtcgccgcccgcggtgagaattccgatgcgcatcgaggtgtgtctcctgctcgctagtcgcgcttttccgggaggccgaccgtggcggcctccgtgccctgaaccaggacgattgtcccacgcccggcacggaccccgcgctttcggccgggcccagggggtaggaggcgctgtcggaggggggacgcgcgtccccgccggaacggagcctccggcgggcggcatagcggcccccgcaggtatcgtcaagaggcaatgcaggccactgccgcacccggcggatcaccgggcgggcacgggggcatcaccgcacgtccggacgccctacgggtcgcggcaccgaacacaaggacgggagagcacgcgtggcgcgcagcgtgtacgtgaccgggatcgaccggggggacggccggcaggtcgtcgagctgggagtcatggagcttctgacgcgtcaggtggaccgggtcggtgtgttccgcccgctggtccatgacggacccgaccggctctacgagctgctccgggcccgctaccggctctcccagagcccggcctccgtctacggcctggactaccacgaggcctccgccgtgcaggcggagaagggaacggacgagctggtctcccggctcgtcgagcgtttccaccaggtggcccgcgagtacgaggtggtcctggtcctgggcagtgacttcgccgccacccagctccccgacgagctggcgctgaacgcccggctggccaacgagttcggggcgtcggtgatcgcggtggtcggcggcaaggggcagaacgcggagtccgtccgcgccgagacccgtaacgcctaccgcgcctacgcgggcctcggctgcgacgtgctggccatggtggtgaaccgggtcgccgccgaggaccgcgcgacgatcgcggaccggctcgcggcccggctgccggtacccgtctccgtactgccggacgacccggcgctctcggcgcccacggtcgcccagatcaccgcggcgctggacggcacggtgctgctcggcgacgactcgggactcgctcgcgacgcgctggacttcgtgttcggcggggccatgctgccgaacctgctgaacgcgctgacgcccggctgcctggtggtcacccccggggaccgggcggatctggtggtgggctcgctggccgcgcacagcgcgggcaccccgcccatcgcgggtgtgctgctgaccctggacgagcggccgggcgaggagatactcacgctggccgcgcggctcgcaccggggaccccggtcgtgtcggtggccggcggatccttccccaccgcggccgaactcttctccctcgaagggaagttgaacgcggcaacgccccgcaaggcggagaccgccctcggcctgttcgagcgacatgtcgacaccggcgctctcctcgaccggatctcggtggcccgcagcgcgcgggtcacgccgatgatgttcgagcacgagctgctggagcaggcccgctccgaccgcaagcgcgtggtgctgccggagggcggcgaggagcgggtgctgcgcgccgccgacgtactgctgcgccgggacgtctgcgacctcacgctgctcggcgacgtggacgtgatccgcaagaaggccgccgacctcggcatcgacctcgcggacacccagctgatcgatccgcacacctcggagctgcggggggccttcgccgagcggtacgccgaactgcgcgcgcaccgcggggtgacggtggagctggcgcacgacgtggtggcggacgtgaactacttcggcacgctgatggtgcaggagggtctcgccgacgggatggtgtccgggtcggtccactccacggcggccacgatccgcccggcgttcgagatcatcaagacgaagccggacgccaggatcgtgtcgtccgtcttcttcatgtgcctggccgacaaggtcctcgtgtacggcgactgcgccgtcaacccggacccgaacgcggagcagctcgcggacatcgcggtgcagtcggcggtgaccgcggcccggttcggcgtggaacccaggatcgcgatgctgtcgtactccaccgggacctccggctccggcgcggacgtcgacaaggtgcgcgaggccaccgagcgggtgcgcacggagcgtcccgagctgcgggtggaggggccgatccagtacgacgcggcggtcgagccgtccgtcgcggcgacgaagctgcccggctccgaggtggcgggccaggcgaccgtgctgatcttcccggacctgaacaccggcaacaacacctacaaggccgtgcagcgctcggcgggcgcggtggcggtcggcccggtgctccagggtctgcgcaagccggtcaacgacctgtcgcgcggcgcgctcgtccaggacatcgtcaacaccgtggcgatcacggcgatccaggcgcagggcgaggagcgccccgcgtgacgacctccacccccgaccacgaaagcacggcagcccctgtggaaccgcatcgtgtcctcgtcctcaactccggctcctcgtcggtgaagtaccagctcctcgacatgcgcgaccgctcccggctcgcctccggcctggtcgagcggatcggcgaggagacctcgcgcctggtgcacacgccgctgaccggcggcggcgccgggccccgtgagcgtacgggccggatcgcggaccacgacgcggcgctcaaggcggcggccgaggagctggcggcggacggcctcggcctcgactcccccgaactcgccgcgatcggccaccgggtggtgcacggcgggctgaggttcagcgcgccgacggtgatcaccgacgaggtgctgcgggagatcgagcgcctcgtcccggtcgcaccgctgcacaacccggcgaacatcacgggcatcgtcacggcgcgggcgctgcggccggacctgccgcaggtcgcggtcttcgacacggcgttccacacgacgatgccggaggcggccgcgcggtatgcgatcgacgtggagaccgccgacgcgcaccgcatccgccgctacggcttccacggcacctcgcacgcgtacgtctcccgcaagacggccgagctgctgggcagggctcccgaggacgtgaacatcatcgtgctgcacctgggcaacggggcgtccgcctcggcggtggcgggcggacggtgcgtggacacctccatggggctgacgcccttggaaggtctcgtgatgggtacgcgctccggggacatcgatccggcggtcaccttccacctgaagcgggtggccggcatgtcggcggatgacatcgacgtcctgctgaacaagaagagcgggctggtcggcctgtgcggcgacaacgacatgcgggtgatccgccgccggatcgacgagggcgacgaacgggccgcgctggccttcgacatctacatccaccggctgaagaagtacatcggcgcctatacggcggtgctcggccgggtggacgcggtggcgttcacggcgggggtcggggagaacgcggctccggtgcgggaagctgccatcgcgggcctggaggagctgggcatggcggtggacgcctcgctcaacgccgtacgttccgcggagccgcggctgatctcgccggagtacgcccgggtggcggtcgccgtggtgccgacggacgaggagctggagatcgccgaccagacgttcgcgctcgtcgagggggcgtagcccacggttcggacaggtcgacaactgagcacccccgcgcccctttgtatcttccaccagacggaatattccgcagcgaaacaaaccgataggatccgcctcatgcgccgttccaaaatcgtctgcaccctcggtcccgccgtcgactcccatgagcagctcgtcgctctgatcgaggccggcatgagcgtggcccgtttcaacttcagtcacggtacccacgaggaacaccagggccgttacgaccgtgtccgcaaggcggccgccgagaccggccgcgcggtgggcgtgctcgccgacctccagggcccgaagatccggctggcgaagttcgccgagggcccggtcgagctggtccgcggggacgagttcaccatcacctccgaggacgtccccggcgacaagtcgatctgcggcacgacctacaagggtctgcccggcgacgtcaccaagggcgacccgatcctcatcaacgacggcaacgtcgagctgaaggtcgtggcggtcgagggcccccgggtcaggaccatcgtcatcgagggcggtgtcatctccgaccacaagggcatcaacctgcccggcgcggcggtcaacgtcccggccctgtccgggaaggacgtcgaggacctgcgcttcgcgctgcggatgggctgcgacctggtcgccctctccttcgtccgggacgccgaggacgtcaaggacgtccacaaggtgatggacgaggagggccgccgggtccccgtcatcgccaaggtggagaagccgcaggcggtcgagcacatggagggcgtcgtcgcggcgttcgacggtgtgatggtggcccgcggcgacctggcggtcgagtacccgctggagaaggtcccgatggtgcagaagcgcctggtggagctgtgccggcgcaacgccaagccggtgatcgtggcgacccagatgatggagtcgatgatcaccaactcgcgcccgacccgcgccgaggcgtccgacgtcgccaacgcgatcctggacggcgcggacgcggtcatgctgtccgccgagtcctcggtgggcgcgtacccgatcgagacggtcaagacgatggcgaagatcgtcgtcgccgccgaggaggagctgctctccaagggcctccagccgctggtccccggcaagaagccccgtacgcagggcggttcggtggcccgcgcggcctgcgagatcgcggacttcctggacggcaaggcgctggtcgccttcacccagtccggtgacaccgcccgccgcctctcccgctaccggacggcccagccgatcctggccttcaccacggacgaggccacccgcaaccagctcgcgctgagctggggcgtcgagtcgcacgtcgtcccgcacgcggacaacaccgacgcgatggtcgacctggtcgacgcggagctgctcaagctgaaccgctacaacgacggcgacacgatgatcatcaccgccggctcgccccccggcatccccggcaccaccaacatggtccgggtgcaccacctgggcggcggcgagcgggactgacccgcacccgcaccaccgcatgaccgtgggccgtactcctggtgaggagtacggcccacggcgctgtgcggctcccggacgggttcgggggcggctgtcggccggcggacacggcctagctcttgccgccgtcgaggaagttccgcagtcccggaacggtgagcgtgccgccgaactggccggcctggaccaccgtcaccttggtgaagaaggcgaaggggacgttcagcggcggcggggtctgggggctgaaggtgatcgggatgagaccgaagaggttgcccttcagctcctccgtgtacatcgtcacctcgccgttgcggatcgtcgaggtggatccgggccgcgacttcacatgaccggtcgtacccgcggggccgacggtcagctggtgcaggtccttgatgtcgatggaactggcggtgaacttcagcaccttcttgatgctgccgtccgccttcttcacctcgacgatgccgtggtagtccaggccgttgagggtgagcagcgtcgactccagggtccacgggtccgacgggagcaacgggatgccgggctccagttcggccgcggcgagtgcgtccgggtcgggctcgggacacgggaagcggggcttggcgccgtccgggatgtcctcgtccttcttggggtcgagtcccttgacctcctcgtccagctcctcgacgtccttgcccgccttctcggccgcctcgcggatggcctcggccgtcttgtcggacgtctccttcgcccggtccgccgcgctcccggccgggtcctccggctcgtccgacggcttcgggacctcggtcgtggggctcggggacgggctcaccggctcctcggtcccggccttgtcgtccggcccgtcgaagaggtccttgagcgcgtcgccgaccccgagcgggtcgagcgggttcttcgacttcgtgggcgtcggggtcgcggagggcgcctctgcgggcgtctccccggcggactgctccgacttgtccgcgtccgtgccgggcgtggggtcctcggccgggtcggaggcggaaccgctcgccgagggcttcggggtcgcggcgtcgtccgagccggacgcgtcgtccttctcgtccttcgcggtggccgacggggacggggtggccttcggcgactcggactcgctcggctcgtcggaccgggtgacgcacggtccgggcgcgaacgggatgtcggtacggtcgtcggccagggccagcttgggcgtcagccccatgccgacgaagaccgccgtcggcatcgccgcgagcgccagcgccttcttgccgctcggcaggtggagtttggtcagcagcgacttcctgggggccgcgtgacgggggcccttgcgctcgcggaggtcgtcgccggcgtaggcgttcatctgctgtccgtcgtcaccccgcacggtgccccccgccgtcggcgtcgaccgccaggtcgtacccggagccctgccgctgcggcacggccgcggcgtggagctcgtcctcggaccgctcctcgtccgggtgctcggcgagcggggtcccgtcggcgctctccggcttccccggggcccaggaaatggacagggctccgccgacgagggcgagaacgaatccgacgacgaagccgccgatgttggcgacggggatggagatcagcgcgagcaggatggccgcgacaccggcgaagacccgcacgatgctgtggtaccacatcgtcaggccgagcgtgatcagcagaaccccgatgatcagggatccggcgccggccgtggtggacatggccagcgtcatgttgccgagcgtcatgctggcgtacgggaagtaggcgatgggaatcccaccgaccatggtgaacagtccggcccagaacggccggtgaccccgccaggcgcggaagcgtcgccgaaggacgcggatgtagtgctcgttctgccctgtggactcggggctcatggaaaacagctccctggaaccggtactgccgtgagaaggggagggtgggtggccggagagccctgaggggactttccggccacccgagccggaggctagaagcactccttgacgcccgtgtgcagcttcagcttcaggtcgctgagcttgaaggtgccggcggtggtcgcccacgccgtctgcttcaccttggtcagaacggcccggtcggcccgctgcgcgaatccggcctcgttcgccttggtgccgggctggatgcctatcccgttcggcctgtccttcttcttcagcgaaccggccgcgacaccgatgtcgatgttctcgaagtcggcgtcggcgtccagctgtgcgacgtccaggtagaggttggtggcctcgaccggccggtccgggtcggtgccggccgtcaactcaagactgacgctcttgccgatgaaggggaccttcggcgtgaccaccgactggcacatgttggtgatcgtggcactgctgaagcccgacaccgcgaccgggtgcgcggcttccttgccttcgaggtccttaccgaccgcgacgctgccgtactggacgaagtcgtgaccgtccagcttgtcggtgctgaccttgaagctctgcccggacacactgaacgacgcggcgagcgcgccctgtgcgaggccgacgcccaccgccgccgtggcgacgacgctcggcaccatgaccagagcgaaccgcttccatctcgtcccaccgcgaacctgggaactcatacttgctccttcttctcggacgtacatctccggccgggcagcgtgcccgtcctgggatgggagaagtgctacgtcctcgggaaggagagcgcccgtatcggagacgtgtcccgcatccgatccaccggcgttcacccccgagcgacaaccactggccgcgctttccgcacagccggtcggacaggccccacccgtgggcgggaacccccctgtccgcggtcggcgcctctgccgccgaccactcggtggggacccaacagaccctcaggcaccggctggagaccgggctggaggtattggaccgagcgtggccgatcgtggtgcattcacggccgcgacacaagggggatcgttactggctagtaacggcccgataaccacaggacgacagggcggcatcacgcggcgacgcagggtggcacgaaagggacagcggaatggcgggaaacttcatggaaacaggacagaatcaccgacccgccttactgcgagtaacagcttgcatctttgtcaagatttggtaaagcgaggacttctcgcgttcttctttggcgtcagaacggcaaaacggccgcgccgcccgaagggcagcgcggccgacttgtcacatcggaacaatcgggctcgtccggagcggacggcggaccggtgtcagaacaggacgcgcgccagcgaggtgcgcgcggcggtgaccctggggtcctccggaccgatcacctcgaacagctccagcagccgcagccgggcggcgtcgcggtcgtcgcccgccgtgcggcggaccgcttcgacgagccggccgaaggcgtcctcgacatgtccgccgaccagatccagatcggcggcgtcgagctgggcgctcacatcgcccggattgtccgcggcttccttgcggaccgcctgcgggtccatgctctggacgcggccgagcaactccgcctgggccaggccgagcttggcctccgggttgcccgggtcgtccgcgaggacgttcttgtacgcctggaccgcaccgccgaagtcattggcgtcgagagcggacgcggcggcctccagcacggcgtcgtacggaccggcgggaacctccgccgggacggcgtccgccggagcggcgtccgggtcgacggcgatcccggtcagcccgaagcgctcctcgccgacctggatcagctggtccagcgtctcgcggatctgagcctcgggggccgcgccctggaagagcgggagggcctgaccggcgacgacggcgaagacggccggaatgccctggatgccgaactgctgcatcagcatctggttagcgtcgacatcgaccttggccagcaggaagcggccgttgtactcgacggccaggcgctccagcagagggcccagctgcttgcacggctcgcaccactcggcccagaagtcgatgacgacggggacctcggcggagcgctggaggacgtcgcgctcgaaaccggcttcatcgacgtcgatcaccagggcggcgggcgctacggcgtcggcgcccccggtacgggaggcctccgcgcgggcctgctccgccctggccttggcctcaccggccgccttgacagcggcgaggtcgacaacgccgctcatggacatgttcctaggctgcatacgtacatcctcccccctgagcgcaccgttccggaaagcgagtgcgagaaccggaccggcccgggcacccccaccggtgtgcgggggcggacgggccgaggcggtcccggctccccgcgggccccgaaaggcccggtggaaccggtcgggcccctgaaagaccctggctggaactgaccggacccgaaggcccgggtggaccttccggatccccatccggccggtccgtgcggccccgggtccccacccggcgcctgggatctccgtggagaccccggtggctgtcgctcgttcgttccgtggcgctcgggggcgatccggccgccttccttacgctacgacccgtagcgtaactgccgatcaccccgcccggacaggtgatcccggtgatctgtctcacgggtaccggagcacaaccgtttcccctaccggccggtatggtcgccgcatcatgaacgacagcgaccccaaagccacccgaacaggacgtccgcggagcaccgcggccgatgccgcgatccttgaggcgacgcgggcgtccttggtcgatctcggctggtcgaagctgacgatgggtgatgtggcgacccgggccggtgtcgccaagacgaccctctaccggcgctgggcgggcaagaacgaactggtcgtggacgcggtcgccgtcctcttcgacgagttggaactgcccgaccgggggagcctggccgccgatgtgcagggcgtcgtgctccagttcgccgccctgctggagcggccggaggcccgtacggcgctgatggcggtggtcgccgagtccacccgcgacgactcgctgcgcctccggatccgctcggccatcgtggaccggcagaagcgactggtgctcctgggccggcaacgcgcccaggcccgcggcgagttgcggtacgaggacgacgcctcggcggctgcccgcaacgcggacctgatcttcgacgtgatcgccggagccgtggtgcaccgcaccctcgtgagcgcggagccggtggactccgagtgggcgagcggtttcacctcgctgctgctcctggggctggcgggcgcgcaggcgggacagcgctcggacccggtcgcacgcggcgctccgtgacccggcgggaagccaccgggtcacggaaggatgacggactcacggggggatgacgggtcctcagaaccccggcggctccgtgtaggtgccccactcctcgcgcagcaccccgcagatctcgccgagcgtggcctcggcccgtacggcgtccagcatcggcgcgatcatgttcgagccgtcgcgggcggaggcgagcatcgcgtcgagggcggcggtcaccctggcgtcgtcgcgggcggccttgcggtccgcgagctggctgacctggtcgcgctcgacctcgtggctgacccggaggatctccaggtcgccggtgaccgagccgtggtggacgttgacgccgacgacccgcttgtcacccttctccagggcacgctggtactggaacgcggactcggcgatctcgccggtgaaccagccgtcctcgatgccgcgcaggatgccggaggtcatcggcccgatggggtgctgcccgtcggggtgggcccgggtgccgcgttccttgatctggtcgaagatcttctcggcctcggcctcgatccggtcggtgagctgctcgacgtaccaggaaccgcccagcgggtcggccacattggcgacgccggtctcctccatcagcacctgctgggtgcgcagggcgatctcggcggcctgctcggaggggagcgcgagggtctcgtcgagggcgttggtgtgcagcgagttggtgccgccgagcacggcggagagcgcctcgacggcggtgcgcaccacgttgttgtacggctgctgcgcggtgagcgacacgccggcggtctgggtgtggaagcgcagccactgcgccttgtcggtctgcgcgccgtacgtctccttcatccagcgggcccagatgcggcgggcggcgcggaacttggcgatctcctcgaagaagtccaggtgcgcgtcgaagaagaaggagagcccgggggcgaaggtgtcgacgtccaggccgcgcgagaggcccagctccacgtagccgaagccgtccgcgagggtgtacgccagctcctgcgcggccgtggccccggcctcgcggatgtggtagccggagacggagagcggcttgtaggcggggatgtcgcgggcgcagtgctccatcaggtcgccgatgaggcgcaggtggggttcgggctggaagagccactccttctgcgcgatgtactccttgaagatgtcggtctggagcgtgccgttgagcacgcccgggtcgacgccctggcgctcggcggcgaccaggtacatgcagaagacgggaacggccgggccgctgatcgtcatcgaggtggtgacgtcaccgagggggatgtccgcgaagaggatctccatgtcggcggcggagtcgatggcgaccccgcagtggccgacctcgccgagcgcgcgcgggtcgtcggagtcccggcccatcagcgtcggcatgtcgaaggcgacgctgaggccgccgccgcccgccgcgaggatcatcttgtagcgctcgttggtctgctgggcgttgccgaagccggcgaactggcggatcgtccaggtgcggcctcggtagccggtggggtgcagtccgcgggtgaaggggtactcccccggccagccgatccgctcgaatccctcgtacgtgtcaccggggcggggtccgtacgcgggctcgaccggatccccggagagcgtggtgaagtccgcgtcacgcttgcgggccttgtcgtaacgggcctgccagcggaggcggccttcctcgatcgcgtcagcgtccatacctcgaatttactaggacgtcctagtaaatgtcgatggcaaaccgcccggcgctttcgcgcggggcggttcggggtggtccggagccctggggccagaggacgcccgtcagcctctcaggcctcggcggtcaccggtgcggggtcggtgaccagggcgcgggcctcgcggctgaccttcggctcgacgaagaacgaggcgaaggggatgcagcccgcggccagcacccacaggagcttgccgaagggccacttcgccttggagccgagatcgaaggcgaagacgacgtagacgatgaacagcacgccgtggatctgcgagatcaacatggtgtcgccggtctcgaagccgtacttcgcgatgatcgccgcggtgaagacgagcagccagacggcggtgacgtaggccatcacccggtagcgggtgagcacgttctgtttcatggctacgagcgtaacgggacgaccggggcgatcttcgcgcgaccccggcctcaccggaagcccgcgttcacttctcctcgaagtcctgggccgccacccgcagcggccgcagcatggcgaagatctcggcgcactcctcggagtcgtacaccccgagcccgaagtcgatcgcgaccaggtcccgggtggccgcctcgacgacgtcgcggcccttgtcggtgatggacgccagcgttccgcggccgtcgttggggttcggccgcttcccgacgagaccggacctgaccagccggtccacggtgttggtgaccgaggtgggatgcaccatcagccgctccccgatcttggacatcggcagctcaccggccttggagaaggcgagcagcaccagcgcctcgtaccgggcgaaggtcagcccgtacggtttgacgacggcgtcgacctcggcgagcaggatctgctgggcccgcatgatcgaggtgatcgcccccatcgagggcacgggcccccagcgctgccgccagagctcgtcggcgcgggcgatgggatcgaagggaaggctgagcggcttcggcacggcatcgaccttaccgactggtcacatgccggtcagccccgtctcgtccttcggtatcggacatccgtccgggggctgtcctgcggacctcggcgacgagcaggagcgtgcagacggtaccgatgattccggatccggcgaccacctggtgcacggggaagaactcggccgcgagtcccgccagcgccatcccgaggccctggacggtcatgagcccggcggtgagcagcgtcatggcccggccgcgcagttcctgcggcacggcgtcgacgaaccactggtcgagcccgatcacgtacgcggcgcccgcgccggccagggcgagggc

SEQ ID NO: 3060 - DNA, 7561 bp, Unknown
  Kingdom: Bacteria, Phylum: Actinobacteria, Class: Actinobacteria, Order: Streptomycetales, Family: Streptomycetaceae, Genus: Streptomyces
ccctccgggcgcttcccttcattttcttctttgtcctgcgtttccgactctatcagactctttcgtgtccgattcccggtcgaagcgggatgctttccaggttcttcgctttcgcgttttccctttccggcggttccgactttaccagactcttttccgttccgtttccggtccgaatatgatttccggtggcctgtggagtggccttgcctttcggcgtgttcactacgttagccgattctcttggcaactcataatcgagccgatagggcgaattacgggtatgccgaattcgcacccgccagggtgattcgtaggtagtggtgtggccgcttcgagtggctcggtccggtccgatggactgtgccgagagctgtacccgtgtcaagcggctcggactacattaggcgtccaccgagggtgcgtcaagttgccttgctgctcggccgacggcgcggtgcgtgggcgcggtacggactcaccgtgggatccccctcgatccagaagcgccacggctggtgggctccgtcgccgcccacccctgtgcgggggccgctgcgtacgaggtcggggggcggcggggttccgtgcagtacggacagggccggggctgggccgccgaagagatcgctgccgttcaggtcgcggtcgacgtcgagggcggtggcgaggcgggccgggcctttggccagttccttgtcattgcgggccgagacgcgtcggtcacgggccagggcggcgccgacgttgatctcgcccgcccggagcagcactccgctcgcacggccttccgggccgcagaccaggttgaggcagtgccacatcccgtacgtgaagtagacgtacgtgtggccgggcggtccgaacatcacgctgttgcgcgcggtgcggccacggaaggcgtgcgatccggggtcgacctcgcccgcgtacgcctccacctcggtcaggcggagttcgatcgtgcccgccgcgctgcggcggacgagcgtgcggcccagaaggtcgggggccacttccagtacggagcggtcgaagaactctcgcgtcagtggggcgcggtccgggctcttggtcatgccgaccgagggtaccgcgctcgcgcggacgggaaccggctaccgtcgtggcgcgtatgtaggggtcaggaccaagaaggagtgactatgggcttcaagcggctgctcgcgagtatgggtgccggcggtgcctcggtggagaccgagctcaccgaggtgaatgtcgtccccggcggggtcgtccagggcgaggtgcggatccagggcggttcggtcgcccagcagatcgaggggctctccgtcggcctccaggcgcgggtcgaggtcgagggcggggaccaggagaccaagcaggacatcgagttcaccaagctgagcctcgggggtgccttcgaggtgcaggcgggcgcggtgcacgtggtgccgttcggtctggagatcccgtgggagacgccgatcaccatgttcggcggccagcagctgcgcgggatgaacatcggggtgaccaccgaactggagatcgctcgcgccctggactccggtgacctggacccgatcaacgtgcacccgctgccggcgcaggaagccattctgaacgccttccggcagctgggcttcggcttccgcagcgcggacatggagcgcggtcacatccgcggtacgcgtcagcggctgccgttctaccaggagatcgagttcgtcccgccgacgcagtaccgcgggctgcaccaggtggagctgacgttcgtcgccgacgaccgcgagatggacgtcgttctggagatggacaagaagccggggctgttcagcgagggcagcgactcctaccgcgcgttcaaggtggggctgcacgactaccagcagaccgactgggccgcgtacctcaaccagtggctcgcccaggtcggcggacagcgcaactggctctagagcacggcgccgccccctatggtcggatgggaaggcagacgaaccgatcaggagaggtgcgagacgtgaccgagccgaagagggccccgctgccgcacgacttccatccggaggttccggcgttcaccgtggtgagcgacgacctggcgccgggggccgtgctgggcgatgcccaggtgcttgcgggcgggaacacttcgccgcagctgcggtgggagggtttccccgaggggaccaagagcttcgccgtgacctgtttcgacccggacgccccgacgggcagcgggttctggcactgggtgctcttcgacgtcccggcctcggtgacggagcttccggccggtgcgggcagcggagagttcgaagggctgcccgaaggggccgtccaggcccgtaacgactacggctccaaggacttcgggggtgccgcgccgccgcccggggagaaccaccgctatgtgttcaccgtgtacgcggtggacaccgagaagctcgggatcgacagcgacgcgtctcccgcggtggccggattcaatctccggttccacacgctggggcgtgcccagctgatcggtgcgtacgaggctcccgtcggcgattagttcgtttgctgtttgccctgctctggtcttggagagatcagagcagggcatttttttattgcgttgtccatcgcggcctgcccagccagagttgatccgggcctgccagggggcgggcggcacacgggaggtgggcaggatgcgtgacacgctggttctcaacgcgagcttcgagccgctgtcgacagtgacgctcaaccgtgcggtggtcctgatcctgacggacaaggccgtcgtcgagcagtcgcatcccgagctccgtatgcgtggtgccgccgtggacattccggcaccccgggtgatccggctctgccggtacgtacgggtgccgttccgaagacaggcgccgtggtccagaaggggtgtgctgatacgggaccagcaccggtgcgcgtactgcgggcggcgggcgtccaccgtcgaccatgtggtgccgcgtgcccagggcgggcaggacacctggctgaacacggtggcctcctgcgccgaggacaaccaccgcaaggccgcccggacgccggagcaggcggggatgccgctgctgaagcagccgttcgtcccctcccccgccgaggcgatgctgctggcgatgggggccggcgaccgctcggcgttgcccgagtggctggaccgggcagcggccgcgtagggcgccggagtggttgccggacgcggttgcggaaagccgtgacgtagtcggcgtacggccggtggcgtatctgtgggcccgtccctgtgagggggcgggcccacgggtgtcagcggagcagcagctggacgatggccatcgtgccgacggccacgatgagggcgcgcaggacggtgggactcagccgacggccgaccttggcgcctatctggccgcccagggccgagccgaccgcgatgaggacgaccgccgtccagtcgaagtgggcgacgaagaggaagaacagtgcggcgatggtgttgaccacggcggccaggacgttcttgacggcgttgagccgctgcatcgtgtcgtcgagcagcatgcccatcaacgagagatagatgatcccctgggcggcggtgaagtagccgccgtagacgctggcgagcatcagcccggtgaacaggagcgggccgccgtcggcgcggggcgtggcgccggtgttctcgcggcggcgctggacggctttgctgatgcgtggttgcaggaccaccaggacgagtgccagggcgaccaggaccgggacgatcgtctcgaaggccgtggagggcagggccaggagcagggtcgccccgcagaggccgccgatcgccgcgccgacgctcagcttgaggatgcgtcggcgctgtccggcgagttccttgcggtagccgatggccccgctgatggagccggggatgagacccagcgcgttggacacggtcgcggtgaccggtgggaggccggtggcgagcaggacggggaaggtgatcagcgtgcccgagccgacgatcgtgttgatcgtgcccgctccgacgccggccgcgaagacggcgagtatttcccagatggacaaggccatctccttcgttggtcagtgacgcctccccgccatgaaggtcgaggggcctcactgatcatgcacgaaagggctttcgggtcaggagaccgggggttcctcgcgtcgttccaccgccggggcggggatggaaccgtggccgttgccgccgttgccgccgttgccgccattgccgtggccgttgccgccattgccgccggtgttgaagccgggcatgccgccgccgaggttcccgaaggctccgctgaggcccttgagggcgtcgccgatctcgctgggcacgatccagagcttgttggcgtcgccctcggcgatcttcgggagcatctggaggtactggtacgagaggagcttctggtccgggtctccggcgtggatggcctcgaagaccgtacggacggcctgggcttcgccttcggcgcgcagggcggcggccttggcctcgccctcggcgcgcaggatcgcggactgcttctcgccctcggcggtgaggatctgggactgcctgatgccctcggcggtgaggatcgcggcgcgcttgtcgcggtcggcgcgcatctgcttctccatcgagtcctggatggaggtcggcggctcgatcgccttgagctcgacgcggttgacgcggatcccccacttgccggtcgcttcgtcgaggactccgcgcagggccgcgttgatctcctcacgggaggtcagggtccgctccaggtccatgccgccgatgatgttgcggagggtggtgacggtgagctgctcgatcgcctggatgtagctggcgacttcgtaggtcgcggcgcgggcgtcggtgacctggtagtagatgacggtgtcgatgttgacgaccaggttgtcctgggtgatcaccggctgcggcgggaagggcaccacctgttcacggaggtcgatccggttgcggatcgagtcgatgaacgggacgacgatgttcaggcccgcgttcagggtgcgggtgtagcggccgaaccgctccacgatggcggcgctggcctgcgggatgacctgaatcgtcttgatcagggcgatgaagacgagcaccaccagaatgatcagaacgatgatgatcggttgcatcgtgtctctcgtgcccttcggttggccggtggatcgcggtgatcggggtcggttgtcatgtgcggccggtggtcggcgggttgcgggccggtccgggttctcatgatgatcgacatgatcgacttcgagtctggcagacctcggcccgccccgtgcacgcttcggtcacatgacgacggccgtcgctccgtcgatgtccacgacatcgacctggctgccggggtcgaagacctggtcggagtcgagtgtgcgggccgaccagacctcaccggcgagcttgatgcggcccccggaggccgatacccgctccagcacgaccgcttgacgtcccttcagggcgtcgatgccgctcgcgtgcccggtctgtccggcccggtgtctggcggcgatcgggcgcacgacggcgatcagtgcgatcgagaccaggacgaagaccagaacctgggcgacgactccgccaccgagggcggcgacggccgatgcggccaccgccccgacggcgaacatcccgaattcgggcatcgcggtcaggacgagggggatgcccagtcccaccgcgccgatcagccaccacacccatgcgtcgatgtccacatggtcatcgtaggactgtcggtgcgtcaccgacagggcgcacgggtggccaactgcggtgaacggcctgccgatcgtggcgcggaacgtgttgtcgtggtctgtcgccgtgctttgtcgccgcgctcgggtgcctgtgccgttcctgccgtgccggtcctggggcgacgggtggacgggggggcgcgcgtcgggcgcacggcgggtcggtcaggagagcgggaggccgtgggcggtgtagcggtcgccggtgttctccacgatgagcggcaggccgaagcagagcgagaggttgcgggagctgagctcggtctccatggggccggcggcgaggatcttgccctggcggatcatcaggacgtgggtgaacccgggggcgatctcctcgacatggtgggtgaccatgatcatggagggggcgaacgggtcgcgggcgaggcggccgaggcggcgtacgaggtcctcgcgcccgccgaggtcgagcccggcggcgggctcgtccaggagcagcagttcggggtcggtcatcatggcgcgggcgatcagggtgcgcttgcgctctccttcggagagcgtgccgaacctgcggtccaggtactcggtcatgccgaggcggtcgaggaaggcgcgggcgcgctcctcgtcgacggcttcgtagttctcgtgccaggtggcggtcatgccgtacgcggcggtgaggaccgtctgcagcaccgtctggcgcttgggcagcttgtcggccatcgccacgcccgccatgccgatccgggggcggagctcgaagacgtcggtgccgacgccaccgagctgttcgccgaggatcgtggccgttcccgtgctcgggaagaggtagctggaggcgaggttgaggagggtcgtcttgccggcgccgttgggacccaggatgacccagcgctccccctccttgaccgaccaggagacatcgtccaccagagcgcgtccgtcgcggaccacggatacgtccaccagctccagtacatcgctcatggcgcgttgtctccccaagcagtctcgtcgatcgtcgcgtgccggtgggcacggctcccagggaaaacctacgccaccgcgcgagtgcttcaggcgtgagggccgttcccaggcgttgcctaggctgtcggcatgcttgtcgaaccacgttcagggttgttggccgcttggggaaacgctcttctggcgggactcgtctcgccggacgaggcggccctcgcgattgtcggggaggacgcggtgcaccgcgtcgacggactgccgggtgaggcggggccggtcgggctcacgctggcgctcggccggctgaggggtctgggagcgaccgggttccgggtcgcgctgccggtgccggggcatccgctggggctgagcggtccgcccgacttcaatgcgcgggcgctggaggcggaggaggcggcggtcgcgtacggggtgccgtacgggctggtgcccgaggtcaccgaggcgggtccggccggggatctgcacgtcgaggtggtgtggcgggtgctgccggtacgggaggcgccgccggcggacgtgccgtcgctgggcgaggcggagcgggagttggctgaggcgttgcgggatgcgacggctgtgctgtcgcggctggacgtggccggttccggaccggtggcggaggccgcgatggacgcgtatcgggcgcgggcggagcggggacgcgatgtgctggcgcccgggtatccgccacgcgcggtgcgggtgctggagatggcgcagcgggtgggactgctggtctcggtggcgtacgagaacgggc

SEQ ID NO: 3061 - DNA, 10197 bp, Unknown
  Kingdom: Bacteria, Phylum: Actinobacteria, Class: Actinobacteria, Order: Streptomycetales, Family: Streptomycetaceae, Genus: Streptomyces
cggcctcggcgaccgtgccgcgctgaccgtccgaaccctcccggctcagggcacccggccaccacgccttcggcccgatgtcccgcaccagcgccgggacgaggagcgaccggacgaccagcgtgtccaacaggacgccgaaggccacgatgaacgcgatctggagcaggaacgccagcgggatcacacccagcgcggcgaaggtggccgccaggacgacgcccgccgacgtgatgaccccgccggtcgtggtgagcccgcgcaggatgccctccctggtgccgtgccgcagcgactcctcccggacccgggacatcaggaagatgttgtagtcgacgcccagggcgaccaggaacacgaatccgtacaggggtaccgacgagtccgtgccgctgaagccgaacacatgggtgaagaccagcgaggagacgcccagtgtggcgaggaagttcagcgccacggtcgccacgagcagcaccggcatcagcagtgaccgcaggaggaggaccaggatcaccaggatgatcgccagcaccaccggcacgatcagcatgcggtcgtcctccgccgtccgctgggtgtcgtactgctgggcggtgtagccgccgaccagggcgtccgatccgggcaccgcgtggaccgcggtgcgcagcgcggccaccgcctccttggctccgtcgctgtccgccgcctccttgagggtcgcgtcgatgcggaccttgccgtcgacgacgaggggttcgccgcccggccgcccgctcgcgctcaccggtgcggccgaagccactccttcggtgcgttcggcagcctcggtgacctcgggcaggcggtccgccgcggcgatgatcaccgccggattgcccgaaccgccggggaagtgctcgctcagcgtctcctgggcggccacggacggggcgtcgttgacgaagatctcgtcgagcggaacccccttggaggtgagcgtgggagcgaacgcggcacaggcgatcagggccaccagggtgatcgcccacaccttgcggggtgcccggtcgacgagggccgcgaccttgtgccagatgccgtggccgccggacaccttgtcctcggcgggcttgggcttggccggccagtaggccttccggcccagcagcaccagggcggcgggcaggaaggtgagggcgctcaggaccgagcagacgatgccgatcgcgcccaccggaccgagggcccggttgttggtgaggtcgctgagcagcagggcgagcaggccggccgccaccgtcgcggcgctggccgtgatcgggccgaaggactcccgcagggcgatgcgcatcgcggcgaaccggtcgccgtgaacggcgagttcctcgcggaaccgggcggtgagcagcagtgcgtagtccgtcgccgcgccgatcaccaggatcgacagaatgccctgcacctgaccgtccacgcgcacgatgtcgtggtcggcgaggacgtagacgatcgcacacgacagggcgagggcgaacaccgcgccgaggatgatgacgaagggcagcagcacgctgcggtagaccagcagcaggatgacgagcaccgtgatcagggcgaccccgagcagcagcccgtcgatgcccgcgaaggcgtcggacaggtcggcctggctggcggccggccccgccagttggaccgccgtgccgggcacggacgcgcccgcctcctcgatcctctccagcgccgtcggcagtgcgtccccgagaccggggctcaactgcacgatgccctggagtgcgaggccgtccttcgagggcagcgcgggagacggtgctccgacgacgccgtcactcccggcgagcgaggcgagggcgccggtggcggcctcccgctgctcgtcgctcaccggcgcgttcttctccgtcgacgtccagacgacgatggcaggcagggtctcgttctgctggaacgccttctgcgcttcgatgacttgggtggactcggcgttctggggcaggaaggcggcttggtcgttggtggcgacctcgccgagcttcccggcgtacgggccgagcccgccgccgatgccgagccatgcgatcagcagcacgacggggatcagccagcggatcgaccgtgcaggggtggacatgtctctcccgggggtggagatatctcagcggctaacaatctcaatcgttgaaatacattacgggactgctcgcgcgggtatcgcggggggtggtccgcggcccgtcccctcatggacgcacctggccggggaaagactcagcgacgcgccgggggaacctctcccagctcctcgttcatggcggcgaggaagcgcaggacggtcgtcagctccgtctcgctgaagcgcgccctggctcgtgccgtggcctcggcgagcggcatgaagtagtcgcgggcggccgtccgggcgctcgcctcgtagtacacgtgcaccactcggcggtcggtgctctcccgggcccggcggacatggccggcccgctccagccggtccaggcaggcggtcaccgcgccggaggtgaggcccagatgctcgcgcagtgcccccggagtgaggggagacggggcgtcgaggatggccgcgagcgcgctcacgtccgtggggtgcagctgctggtgcgccgcgaaaccgtgggtcatccggttgatctcgccgttcatccggcggagctcgaccgcgaacgcctggaggtccgcgagcggcgcctcgggttccgaggcgccgctgcgggtcggtcggtcgtcggcgctggtcacgccctcagcgtatagaacggacgcgcggagggctgcggcgcgaccgccctcactacgacggcggcatgagcacggtgtcgaccagatttaccgtggcgttggccgtcggcacattgccgcagacgatcttcgaggagtcgttcaccgtgaactcggtgcccgagcccttcgtggtgaggtcgctgccctccagcgtcttgaaggtgccgtcctccatctgctgggtcgtggccttctcgcccaccacgtggtacgtcagcaccttggtgagctcggccttgtcgttgaggagcgcctccagatcggcctgcgggatcttctcgaaggcggcgttggtcggcgcgaacaccgtgatgtccttcgcgttgttgagcgtgtcgaccagacctgccttcttcaccgcgccgaccagggtggagagttcggggttgttggacgcggcggtggcgaccgggtccttcgccatgccctccaggctgcccgcgccctccttcggtacggaggagcaggcggggccgtacggttcggcgggcgtcccggccccggcctggggagcgaagaacgccagagaggcaggcaaggccagtgccgcggctgccgcagcggtgcgctgcggacgggtgatcgtcatgatgtctcctccggcgagcgggggtgggtcttctccttctctcccacgctgacgcgcatccgctcggaccgcccgccgcgtcgtttctgcgtcgatagtcacgttccgatgggctcatgacatcgatccatcggaccggggcaaccgggatgcatgaatacccgttcagtaacagcgcagggacgcggccaggcgaagagagccgcgaacagcaccgcgatggaggcgggagcccgcgcgggcttcgtgggccgcggggtgatctatgtcctcgtgggcgccctcgccctgcagatcgcgctgtccggaggtggtggaaaacaggccgaccggggcggcgcgatcggcgagatagccgagaagccctttgggaagaccctgctgtgggtgctgggcatcgccctcgtgggaatggcgctctggcggctgtccgaggccctgttcggcgcggccggacccgacggccgcaggccgaccaagcgggccatggcggcgggccgtgccgtcttctacgggttcgtcgcctactccgtcctgtccttcgccgccggcgactcgggcagcgggggcggatcgtcggaccagcagtcgaaggacatcaccgccaaggcgctcggctggcccggaggccagtggatcgtcgggatcgcgggtgtgggggtggcctgcgccggtgtctggatcgcggtccgggcgctcctgcggaagtaccacaagcacctgaagatgtccgagatgtccaagcgggtccggcaggcggtcgacttcaccggagtcttcggcggtacggcgcgcggcatcgtgttcgcgacggcggggggattcgcgctggccgccgcgatcgagcaccggccggacaggtccaagggcatggacgacaccctgcgctccttcaccgatacccctgtcggcccgtggctcctggtggtcgtcgccctcggactgatcgccttcggggtgttctcctgggtcaacgcgcgctaccgcaaggtctgagcgccactccgcccgagctgtccgcccgccgccgcgctcctgcgggcggcggcggcctcgcggtccgcctgctccgggtggcggcggcgccagtacggattgtcgtgcggcaggccgccggtcacccgtccgtacatgccgaacgtgaggatcagcagccccatcacgaagctgaagacgacgttcggcattccgaagtccagaatgttcgcggcccggtccaggatgaagaggtggccgaagccgctcagcaggaagagcgtgccgatcgtgatgttcagggtggacgcgacgtttccgcccaccgcggcgccggcgagcagcagcccgccgacgaccaccgagatcaggctcagcagaccgttggtcgacagccccgcgatgtgatcgccgctggtgtcgaagaagctcagccgactcgtgaaaccgaggatgccgaaggccagcaggatggcgccgcagaggcccgcgccgatccggtacaccttcgccagccggtgatcgacgggaagttcgtcgctcagtttcatggccgtctcctgtccgtcctgccgcggtcggggcgggatgatgcgtgtgagagggcatcgagcagggccccgatgtctccagcgaaccgcgcggcggcagactgggcaacatgcatcggttttgcgtcgtatggtgggattcgtggacccggtgatggaccctgtgacgcacccagtggcggactcggcgatgggcgccgagagccaccgcactggcggtcggcccccgcgagcggcggccgacggagggctgaccacgggtgcggtggcccgcctcctgggtgtcgcgccgacgacgctgcgctcgtgggaccgccgctacggcatcggccctgccgcacgcgaggacggccggcaccgccgctggaccgggtccgacatcgcggcgctgcggaacatgtgccgcctgacgagtgcgggcctgccgccggccgaggccgcccgtgccgtcctggccggaccgtcccgaaccaccgccgcgccagggcccgggcgcacctcccgggcctccggggcagctccgtccggtgcccgccgggagtgccgcggcctggcccgggcggcgctccgcctggacgcgccggccatggaggaactgctcagggaggtactcgaccgctacgggttgccgaccgcctgggacgaggtgatggtgccggcgctgcacgcggtgggccgcaagtgggagaccgggggagagcggtacatcgaggtcgagcacctgctgtcctggcacgtctccggcgcgctgcgcggtgtctcggccgcccggcctcccgtcaccggcgcggccctctcgctgctggcctgcgcgcccggtgagacccacacactggccctggaggcactcgccgccacgctcacccagcacggcatgccggtccgtatgttcggcgccgccctgcccgtcgaggcgctggaggaggcggtccgccgaaccggacccgacgcggtggtgctctgggcgcagtcgcacggcacggcgagccgttcgctcgcggcccgggtggaggcgatcgcgtggggcgtgcgaggcgcgcgcaggcggcccgtcgtcttcaccgccggacccggctgggccgggtgtcagcccccggggacccggcacccgtccggactcgccgacgcggcggacgccctggccgcactcgggtgcgcggccaccgcggccgtcaccgcggtggcgaccccggcgtcaccgtagccgtggcccacgccgtcagcgcagccagtccgacagccccgtcagaaggcgctccacgtcgtccgtgtcgttgtacgcgcagagtccgacgcgcaggccgccgctgtcgccgagccccaggtggcgggaggcctccagggcgtagaaggaaccggcgggcgcgtgcaccccggagcgggcgagggagcggtaggcgtccgtcgcgtcccggccctcgaaggtgagcagcagggtaggggtgcgttccgcggcacgggagtggaccgtcaccccgcccagttcgcccaccgccttctcgatgctctcccgcagctccgtctcgtgggcgtcgatcgccgcgtacgccgatcgcagccgctcgcgacgcccgcccgccgcatccgtgccaccgctcagtcccgcgaggaagtccaccgccgcgcgggttcccgccatcgactcgtaggggagggtgccgagttcgaatcgctccggcacggcgtcggtggacggcgccagcttgtccgggcggagggtgccgagcagctcgggccgggcggcgagcaccccgtgatgggggccgaagaacttgtacggggagcagacgaagaagtccgccccgagccgctccacgtccaccgggtggtgggccgtcagatggaccccgtccacgtacagcagggcgccggccccgtgcgcgagtcgggcgatggccgggatgtcgggccgggtgccgatgaggttggaggcgccggtcaccgcgaccagccgggtccgcccggtgatccgcgcgccgacggcctcgggggaaagctcgccggtcgacggatcgaagtcggcccatcgcaccaccgcccccgcccgctcggccgcctgcacccacggccggatgttggcatcgtggtccagccggctgaccaccacctcgtcccccgggctccaggtcctggacagggtgcgcgagaagtcgtacgtgagctgggtggcgctgcggccgaacacgatcccgcccgggtccgcgcccagcagatccgccatagcccgccggaacccgcggacgatctcctccgcgttcacctccccgggcagggcggcgccccggatcgacaggggtccgctcatcgcctcgccgatcgcggcgatgacggaggccggagtctgtgttccgcccggcccgtcgaagtgggccgtaccggaccgcagggcagggaactgcgcgcgcaccgcgccgacgtcgtacgacaaggaggctcctcgaatcgctgatgtgctgccggatctcgctgtgatcatcgcagcgcggtgtcctccggcggaaggagtgggggccctccggaggagccttgctccgaggcccgctccgaggtcttgctccggggcgctttcgggcactggtttcgcgcgggcgcaccgctccctgtcacatgtgcgcccgagcgtgggacagcggctcccggcgcaccggaatgcgccgtcctcaaacgtcgcgatgatcctacgaaagaatttctcgcacaaatgaactcgcctcggttgtgcgatccttctcgcattcccgtcatgggtaaatgcgccggacaatttctgcgagtcggtcgtgattaaagcggtgggaacgggaaatagatgatctgggctgatggggtcgggggcatcggttcacgccacggccgaatttcatcggggccgggtgtctgaaagtcgtcagtgcgggggccatggtcgccgtccggggtttcctgtcacgtcccaggggtgctctggcctgctctgatgcgatgcgatggtctctctccccgtcactgtcacttgtggagggtcacggatggacgagcgcgagcactctgtcgatggcggaatctattcggccgactattcggtcgaccggaagaggcaggccggtaattctgctgctcggcttctttgtgccgcggcctacccggttctcctcctcgcggtcgtatccgtgggcgcgtccgcattgtggctgcggtgggatccggcctgggtcagttcacttttcctggtcggggccatcgcctatctggctcttctggaatggctgattccttatgaccgggactggcaccccagaaagtccgaatggcgctggtacggcatctacttcctgctcaccatggccggaagcggactggcgcaactcctggtcgcgctggccgtcggcctgatatcgccgtcggaatcggcccgccacctctgggtcgagatcccgggcgcgctcctcgccggatccctcgtcagctatggggtgcaccggctgggccaccggaacgccctgctctggcggctgcacggagtgcatcacgtgccggagaaggtcaacgtcgccaacaacggggtcaaccatgtgctggacatcgtcctggcgcagggcctcgtccagctgactctggcctgcctgggattctcccgcccgcggtgctggtggtcggactcttcgtcgccgcccagggctacttcgtccacgccaacatcgatgtccgcatcggacggctcaaccatctgctggccagtcccgagcagcaccgtctgcaccacagcaccgatctgtccgaagccggccactacggctccgacctgtcgtgctgggaccacctcttcggcagcttcacctggtaccccggccgcgagcccgtcgccgtgggcctgcacgaccccacgtccttccccggcaccggcgagatcctcgccgccctcgcacatccctggcgacgccgaccggcacgggcctcccggccggagtgaccgccgccctccgacgctccaccacgacttgaggagttcgacatggccgacgcgaacaaccgggcgttacggaacaaggtggcgatcatcgggatgggctgccgcctgcccggcggcgcctcggaccaccgcacgtactggcgcaatctggtggagggcaaggactgcatcacgcccacaccgcccgaccggtacgacgtcagcacgctcggcagccggttccgcgacaaacccgggcgcctcgtcggtggccgcggcggatacatcgacggcttcgacgagttcgaccccgcgttcttcggcatcagcccccgcgaggccgaccacatggacccgcagcagcgcaaactgctcgaagtggcctgggaggcgctggaggacggcggccagcggcccgccgacctcgccggcggcaacgtcgccgtctacgtcggcgcgttcaccctggactacaagatcctgcagttcgccgacctgggcttcacctcgctggccgcgcacaccgcgaccgggaccatgatgacgatggtgtcgaaccgcatctcgtactgcttcgacttccgcggccccagcctgtccatcgacaccgcgtgcagctcctccctggtcgccgtccacctggcgtgccaggcgctgaacaacggcgagagcgacctcgcgctggccggcggcaccctgctgcacatggccccgcagtacaccgtcgcggagacgaagggcgggttcctgtcgcccgagggtcgctcccgtacgttcgacgccgccgccgacggctacgtacgggccgaaggcgtcggcctggtcgcgctgaagcggctggacgacgccgtacgggacggggaccggatccacgccgtgatcctcggcagcggcgtcaaccaggacggccacaccaacggcatcaccgtgcccaaccccgacgcacaggtcgacctcatccgccgggtctgcgccgaggccgggatcacccccggggcgctccagtacatggaggcacacggcacctcgaccccggtcggcgacccgatcgaggcgaacgccctggcccgcgcgctggccatcggacgggcccctggcgcccgcgcctacgtcggctcggtcaagacgaacatcggccacaccgaatccgccgccgggatcgccgggctgatcaagaccgtcctgagcatcaagcaccgcacgatcccgccccacatcaacctggagaacctcaaccccgccatcgacccggcgaccctgccctacgagatccccacccggcccaccgcctggcccgaacacgaagggccagcccgcgccggggtcaactccttcggcttcggcggcaccaacgccca

SEQ ID NO: 3062 - DNA, 5934 bp, Unknown
  Kingdom: Bacteria, Phylum: Actinobacteria, Class: Actinobacteria, Order: Streptomycetales, Family: Streptomycetaceae, Genus: Streptomyces
ccccgggcctgttccggcacccggcactccggcatccggccgtccgccggagcacccgggaacgctccgggggcgtacgccggacgtacgccctcacgcgcgctgccctgctccacccggacctcctccgcctgccgcggaccggctcgcgtgcgccggacctcctgtgcacgatagagggaggaggctgcggttcaaacatcgatggcatcgggtaaggtaagccttacctgcaaacgatcccgattcggtggtccctgcatgaccctctccccgccgttcaccggcgccgcgacgtcccccgtgaccgccgcgtacgcgcgcctgaccgaggtgttccccggcctgcgggccgacgtgctcgacggcgacgccgtagccccgtccggagcgggctgggtcggcgcggcggagctggcggccggcggtcacgccgtggacgccttcctcgcctgggacaacgcccaggtgctgcgcgactacgggcagcaggcccgtccggacgtggtggcgagcttcggtctgcaccggtacgcctggcccgcctgcctgctggtgacggtgccgtggtttctgcagcgccgggtggtgcggatcccggtcgaggacgtggccttccagcgtgcgctggggcacctgaccgtgcgggtccgggaattcgcctgcctgccggacgacccggccgccacgctgcccggcgcccgggtcgtcgcggacgaggcggcgctgcgggccgaggtcctggcttccctgaccgagcacctcggcccggtgctggagggcttcgggccgcgcatgcggcgcggcaagcgggccctgtgggggatggcgaccgacgagatcgtcgagggcctctggtacgtcgcgcatctgctcggcgaggagcgccgcgcgatggccgagctggaactgctgctccccggcacgacgaagccgtacgccggaggggccggcttccgcgagctgaccggacccgacggccggtcgctgccgacccgggaccgggcgagctgctgcctcttctacaccctgcgtcccgaggacacctgcgtgacctgcccgcgtacctgtgacgcggaccgggtgcggaaactcgcggcagcttcctgatccacaccgcccgtccggatgacgtgaaatcgaacacaactcggcttcaccgggcggccgttcgacaagattccacccatcgatagcctctcccacccccatggcgtgctcttgtcccgaaaccaccggagcgggacgggaattccgtcacgatggcgcacgaaacgccctacgtgacgcaagggaccgcgcatgagactgaccgacatatcgcttgactggctgcttccgggcgccgtactgctcgtgggagtcatggcggcggtgacggtggtcgcacgcggcaagcgcgccgctggcaaggccgcggccgacgactcctgggaacgcagcgaggaacgccgcagacgcaaggaagcgctgtacgccaccgccagttacgtcctgctgttctgctgcgcggcggtcgccgccgcgctctccttccacgggctcgtcggcttcggccggcagaacctgaacctcaccggaggctgggagtatctggtcccgttcggactggacggggccgcgatgttctgttccgtgctggccgtacgggaggcgagccacggagacgcggcgctcggctcccggctgctcgtgtggacgttcgccggggccgccgcctggttcaactgggtgcacgccccccggggcatggaccacgcgggcgcgccgcacttcttcgcggggatgtcgctctcggccgcggtgctcttcgaccgcgcgctgaagcagacccgccgcgccgcgctgcgcgaacagggcctggtgccccgaccgttgccgcagatccggatcgtccgctggctgcgggctcccagggagaccttcggcgcctggtcgctgatgctcctggagggcgtacgcaccctggacgaggcggtggacgaggtgcgggaggaccgcagggagcgtgagcaggaccggctgcgccgacgcgaccaggagaagctggaccgggcccgcatcaaggccctgaaccggcagaaccgggtctggggacgcggtggacgggtcgaccggcaggtggacgtgcccgcactcgccccggcctcgggcggcgcggcgccggccgtcgcggagcccgccatagcagagccgggtcagctgcctctgcgaccccggccatccctgcaagccgtcggcccgaagcaggcggacggttcgagctcgaagagcctggacgcttcgggccggggaagtgacccccggaccgtcgacctcactgccgaggacgacacccagacactcccccggctcgactcgctggaacagaaactgaaggatctggagcagcagttcggctgagggcgcatcgcggcggagggcccctcaaggccttccgccgtgcagctcgaaccagacgaccttgcccagggcctgtgcctccacaccccaggcgtcggccaggctccggaccaggatcagacccctgccgtgcgtaccgtcgtcggcgttcggtacgtacggcgcgggcagatcctccgacgcgaagtcctggacctccacccgcagtcgggcgggcgtcgccgtggcggtgaccacggccccgtgccgggtatggatgagagcgttggtcaccagctcgctcaccagcagctccgcggcctcggtctgctcctcgtcggagcgatgccgaaggaactcccgcagctcccggcgcacttcacccaccgccgaccgatcggtgtggcccaccctccggcgcatccgggccggcggtggagcctcgcccggtctccggccccggggaccccgcccctcgatgaccgtggtccttctctgacgtttcgccatttcccccgcccgcacagtgaacgacctcctctgatccgactgcccgtcgaacagcctcacgggatgcatgcccctgtacgcacacggtcacgcttgtcgcatcgtcaagaggtgaacggtcgggagcggcgaggggcgcacggaacatcccacccgcgcacgccatcaccacataggcgcagctccggttaacgtccggcgaatacacccgagttggcgttgacgacccaacttctacgcgcgtcatcatgatgggtatgcgcatccccccacgcatcacccggctcggcggctcggccgccctcctgtccgttctcctcgcctcgggcccggtcacggcccaggcggccaccccggccgccgcccccaccgcccactccgcgaccgccttccgggctgccgcggtgggcagcatctgctactccgccctgccgtcccaggcgcacgacaccctggatctcatcgagcagggcggaccgttcccgttcgagcaggacgggacggtcttccagaaccgggagggcctgctgcccggccagtccaccggctactaccacgagtacacggtcatcacccccggctccgacacccgcggcgcccgccggatcgtcaccggggagcaggtggaggaggactactacaccgccgaccactacgcctccttcgatctggtcgaccacgactgctgaccctccgcacgaggctgttcccggacactccgagggaacgggcgcgcctgaccccggcgtgacggggtcaggcgcctgccggctcaaggacggggcacgttccggaggttggagcgggccatctggagcatccggcccacgccgccgtcgagcacgatcttgctggcggagagcgcgaagccggtgaccatgtcggcgctgatcttcggcgggatggagagcgcgttcgggtcggtgaccacgtcgacgagcgcgggacccttgtgcttgcaggcgtccttgagcgcgctctgcaactgcttgggcttctccacgcgtacgccgtaggcgccggccgcacgggcgatggcggcgtagtcggtgttcccgttggcagtcccgtacgacggcaggcccgccaccagcatctccaactcgaccataccgagcgaggagttgttgaacaggacgaccttcaccggcaggtcgtactggaccagggtgaggaagtcgcccatcagcatggagaatccgccgtcgcccgacatcgcgacgacctgccggttcaggtcggtgaactgggcgccgatcgcctgcggcagggcattcgccatcgagccgtggctgaacgaaccgatcacccgccgcttgccgttgggcgtcagatagcgggcggcccacacgttgttcatgcccgtgtcgacggtgaacacggcgtcgtcgtcggccatctcgtccagcacggaggcgacgtactcggggtggatcgggacgtgcttgtcgaccttgcgggtgtaggccttgaccacgccctccagggcgttcgcgtgcttcttcagcatccggtcgaggaacttgcggtcggacttgggctgcacccggggcgtcaggcagcgcagggtctcgcgcacatcaccccagaccgcgaggtcgagcttggagcggcggccgaggtgctcggggcgcacatcgacctggacgatcttcacatcgtccgggaggaaggcgttgtacgggaagtccgtgccgagcaggacgaggaggtcgcactcgttggtcgcctcgtacgcggcgccgtagccgagcagtccgctcatcccgacgtcgtacggattgtcgtactggatccactccttgccgcgcagcgcgtgcccgaccggggacttgatcttctcggcgaactccatgacctcggcgtgcgccccggccgtgccgctgccgcagaacagcgtcacccgtttggcctcgtccaccatgcggcagagcttgtcgatctcgtcgtcgccgggccgtacggtcggccgctcggtgacgagggcgtgctcgatgctcttctcgggggcgggcttggaggcgatgtcgcccggcatcgagacgacgctgacgccgccacgcccgatggcgtgctggatcgccgtctggagcagcctcggcatctgttccgggttggagatcatctcgttgtagtggctgcactcctggaacagcagctccggatgggtctcctggaagtagccgaggccgatctcgctggaggggatgtgcgaggcgagcgccagcaccggggccatggagcggtgggcgtcgtacaggccgttgatgaggtgcaggttgcccgggccgcaggagccggcgcaggccgcgagcgagccggtgacctgcgcttccgcaccggccgcgaaagcggcggtctcctcgtggcggacgtggatccagtcgatggccgagttacgccggatggcgtccacgacggggttcaggctgtcgccgacgacgccgtacaagcgtttgacgcctgccctggcgaggatgtcgacgaactgctccgccacgttctgcttggccatgggtgcgcacccttccttgcccgtgctccgtgcacttcggctgtccggactccggagcccgaaacaccgtttcggtcggctccggagtccatcaacccacggcgtgcgcggttacgcctcccagacggcggcgcaggtgcggtcgtcggcgtaccccttgatccggagctgggtgtcggcgaggaaggcgggaagtccgggcggtccggcgctcccccagcgttcggcgagctcgccggggagcgcggcctcgccgcgcatcggctcggcgaggccgttgctgcacagcatcagcgtgtcgccggggcgtgccacggaggcccggaagcggaagggctcggcggtctgcctggcggggccctcggctttcggggagggcggcgctgcgatctggaggtccatggtcagccggtccccgtccggtccctcctcctgctcgtcgcccgtctgcgggacgccgccctgcgggacgaagggttccaggtcctgccagagtccgtcgcggaggcggaagaggccgccgctgc

SEQ ID NO: 3063 - DNA, 3783 bp, Unknown
  Kingdom: Bacteria, Phylum: Actinobacteria, Class: Actinobacteria, Order: Streptomycetales, Family: Streptomycetaceae, Genus: Streptomyces
gtcggcgggcggcagcgtctcgtgcagccatttccagacgaccagggtgagcacgatgccgacgacggtcagcacgacgaagatgccccgccagtcggtgatccgcaggacctgcccgccgatcaccggcgcgatgaccggggctacgccggagatcagcatcagggtggagaagaaccgggccatctccacgccgtcgtagaggtcgcgcaccacggcccgcgcgatgacgatgccggccgcgcccgcgagcccctggaggaggcggaagccgatgaggagttcggcggtgggggccagggcgcagatcgcggtggcgaggacgtagacgaccatgccgaggagcagcggcttccggcggccccagcggtcgctcatcggtccgacgacgagctggccgagtgccattccggccaggcacgcggtcagggtgagctggacggtggcggcgggggcgctcagggagtcggtgaccgcggggagcgccgggaggtacatgtccatggacagcggcggcagtgcggtgagtccgccgaggaccatggtgaccaggaggccggtgcgccgggcggccttcgccgccgggccggggagtccggcgggggccgtgacctgcgggacggccgggtcgacggagagtgctccggcgtccccgtgcgggaccggccggtcgtcggccccggtcccggtggtgggtatgtgtgctcgctgggcccggctaccgccgctgtccggcattctcatctccacatcgttgaatccgcatctatgctctcagctcggccggagtggtcgatacctttttctgggcggggctggggtggtgggcatgggcgggacggtgcgctggggtgttctggcgacgggcggcatagccgcgaggttcacgtcggacgtacaggggctccccgacgccgaggtggtggcggtggcctcgcgcacggaggcctcggcgcgggacttcgccgagcggcacgggatcgggcgggcgtacggcagctgggcggagctggtcgccgacgacgaggtggacgtggtgtacgtggccaccccgcactcggcgcaccacgcggcggcctcgctcgcgctgagggccggaaagcatgtgctgtgcgagaaggcgttcacgctcaacagccgggaggcgaaggagctggtggcgctcgcccgggagcgcggcctcttcctgatggaggccatgtggacctatctcaacccggtggtccgccggctcaccgagctcgtccgggacggggcgatcggcgagatccgcaccgtacaggcggacttcggcttcgcgggcgacttcaccgccgggcaccggctgcgcgatccggatctgggcggcggggcgctgctggacctcggggtctacccggtgtcgttcgcgcagttgctgctgggcgagccggaccgggtgcgggcggacgcgctgctgtccccggagggcgtcgacctgaacacggggatgctgctcggctgggactccggcgcgaacgcgctgctctcgtgctcgatcgtcggccaccacccgacggcggcgaccgtcatcggcacggccgggcggatcgacatcccgcgcgacttcttccacccggaccacgtcgtcctgcggcgggccggcgcggagccggagacgatcacctcggggccgggaccgcaagggctctcgggcatgcagtacgaggccgtcgaggtgatgcgggcggtgcgggcgggcgagagcgagtccccgctcgtcccgctggagggttcgctggcggtgatgcggacgctcgacgcggtacgggaccgtatcggcgtccgctacccggcggaccgctgagccggacacgacctaggcgggggtgagccccgggttcccggcctcggtgacgaaggaggccgctgtggtgaggggtgcgccgggggtcgtgacggccgccaccgtacggaagtcggcgcgggcctccttcgttccgagggtgacgagcgcgtagccgcgccgcccgttgtagtgcttcaggtgcgggttggcgcgggtctggttctcccagttggcgggccggtccgcgccgtccttgccgctgctgatggatgtggtgacgatctccgtgccgacggtgcgcgacgcggggtcgtcgaagtccttcttcaggtcgaaggcgtaggagacgtggacgtcgccggtgaggaccatgaggttctccaccccggcggcctcggctccggcgagcacccgctgccgggaggccgggtagccgtcccaggagtccatggagagcttgaaggcgtcggtgggaacgtctcgccgctgcgcgaaggtcacctgctgcgggacgacgttccaggtggcgtcggaggcgcgccagccgtcggtcagccagcgttcctgggcggccccggtcatggtgcgcgcggggtcctcggactcgggccccggggtgcgccagccgtcgccgtacgcctggtcgctgcggtactggcgggtgtcgaggatgtcgaactgggcgagccgcccgaacttcaggcggcggtagagccgcatgtcgggtccggtgggacgctgcggggtgcgcagcggctggttctcccagtacgcgcggtacgcggcggcccggcgcagcaggaactcctcgggcggcacgtcgttctcgggggtgccgcccgcgtagttgttctcggtctcgtggtcgtcccaggtgacgacgaaggggtgggcggcgtgggcggcgcgcaggtccgggtcggacttgtagagggcgtagcgcagccggtagtcctccagggtgaccgtctcgcggttgtagtgcgcgggaagtctgcggtcggtgtagttgcgggctccgccggtggcggtgacggcgtactcgtagaggtagtcgccgaggtggaagacgacgtcgacgtcctcggccgcgaggtggcggtgggcggtgaagtacccgtcgtggtacgcctggcaggagatggcggccagggtcagggagctgttgcgggctccgggggccggggcggtgcgggtgcggccgaccgggctggtccagctgccggtgcggaagcggtagtagtagaggcggcctgagtcgaggccctggacctcggcgcggacgctgtgggcgaactcggggtgggcggtgaccgagccgcgccgctcgacgcggcggaagcgctcgtcgcgggccacctcccagcgcacctcgacccggccgcgcggcagtccgccgcccggctcgtaggggcgaggcgcgagccgggtccagatgaggacggacgccgggtgcgggtcaccggaggcgacgccgagggcgaatgggtcctcggtgatccggcgggcgtcgagttcggcggcgctcgccgtgccggcggcgggcaggttcacggcgaaggcgagtgcggcggcggctccggtggcggtcaggaagcgtctgcgtcgcacgcccggttcgagcagccgtgcggcggcgcggagttcggttgtcggtgtgctctgatcgggcgtcatgatggtccgtgcggctgtcatatgcccctcctcagcccggatgctgtcgggcttcatggcagccgcacgcgacgacgcaccgttgtcgcgtgcacaacatccgcatggcgggtcgatgagcaccgcgtgccctgtgcaccgatccgtcccgtacgctgccgggccatgaacactgagcagaccggccggaaagtcgccgtcgtcacgggtgcgggatcagggatcgggagggccgtcgcgctcgccctcgcgagcgcgggctggtcgctcgcgcccgccggccggcgggccgagccgcg

SEQ ID NO: 3064 - DNA, 7192 bp, Unknown
  Kingdom: Bacteria, Phylum: Actinobacteria, Class: Actinobacteria, Order: Streptomycetales, Family: Streptomycetaceae, Genus: Streptomyces
ggacggcggtgagctcggcgccgtccagcagcgcggtgatctgccccgtctccagatcggtgagcgcgacgatcccgtggatcagcggcagcccgcgtaccgggttgccgggggtgagcgtggtgaccttgacgctgcccaccgcccgctgctcccagacggcggggctgaccaggaggacgcgccggtcgccgtgctcgacgaccgtgcgggccggggagcgggtccggcccgcggccaggtcgacgaacatctcgccgagcacgtcgatcacgcgcagcatgcgccgggtaccggccatgtcggcgaccaggaccatcaccggcgcgctcacgcggtacccccctcgcggccgaaccggctcgtccaggcgtcctcgcgcgccaccgtggtgcgggccagccgggcgaacggcgggccgaccatgttgccctccaggacggcgatcccgccgtcggccgccgtcaccgcctccaccacccggcgggcctgtcccagctcgtcgggccggggtcgcaggagtcggttgatcacgtcgagttcgcccgggtgcaccgtcgccttgccgtggaagccgagcgcccgggcccgggtggtttcctcggcgaggaccgccggttcggcgagccggtagttggcggtgtcgacgcacgccgtgccgtaccgggcgcaggccatcgccatcgcctgccgggcggccagcatggcttcccagctgatgtcgacaccgagtgtggcggccaggtcggccgagccgagcaccaggccgtcggcggagcgcgcgatggagtcgatgcgggtgaccgcctcgaccgtctccaccgtcacgtagatctcgggggacgcacccgccgacgccagcatccggcgcagcaggtcgacctcgtccgccgaggtcaccatcgtcatcaggacgatgccgggccgcaccgggctgtcggccagcatcaggacgtcctggacccccgcgaggctgccgagcacgttcatccgcacggcgacccgtcccggcctcggtgtcttctccagcgcggcccggcagaccgtgcgcgcggcctgcttgtcggcgggcggtacggagtcctccaggtcgatcaggtggacgtccgcgtcgtacgaccaggccttcaccaccttgtccggcgacagggcgggcgtgtagaggatgctgcgcggaatcgccctcggcgccccggtcaccggttcaccgccccggggagggtgcccgccgggcgggccccggcctcgaccaacgcggtacagagccgcttgatctggtccgcgctctggccggccctcagcatcacccgtagtccggcggtaccgcgtgcgacgatcgggaagaagaccggtgaggtgtagaacccggccgcgaagacctgtttggccgcctcgacgaccgtgtcgtcgctcatcggcaccacccggatcgggtaggtggcctcggcctgctcggtcaggacgagcgagtcgaacagcgcgatgttggaccgcaggcgctcctgcagccgggtgagttcctcggtccggtggatctcggccgaggcgagcgccgcaccgaccgcggcggcgttcatcttctgcgagtagcccagcgggcccgcgaaccgttcgatgagccggcgcgtctcctcggggtagccgtcgagcaggatcgccgtgcctccggccccgaaccccttggtcaaggtcgccacggtgatggtccgctcgtccagcaccggggagtgcgtgcgtacgtagccgatgccgcgctcaccgtacgcggagagcgagtgcgagtcgtcgtagaagaccaggaggttgtacttctcctgcagttcggccagctcctcgacgggcgcgtagccgccgagactgtccgagccgtccaccacgtagcagacgcgttcgtaggtgcggcacatgtccttgaggaaatcgaggtcgtggtggccgcaggtcacgacctcgctctcgtcggcgcagctcggcttggcgttggccagcgagacatgggcgttcttgtcgaagaccatcagcggccgcgtgccgttgcccaggtgccccgacgcgatcaccggaagcagaccggtgctggccgccgcggtggagagcgcgctgatcaccatcgcgccgaacagctcgcccagcgactcctccagctccagcagcaccggggtctggacgcgggtgcgcgggatgcagtggtcgagcaccccgaagcggcgcagcgaggcgaccgcaccgtcgatgaccttggggtgggtgtccagatccaggtaggagcagaccgtgaagttgacgaactcgtgcccgtcggccatgtggaacacgccgtcgtcgaggtcgccgacgatgccggcgaccccgttctcgtaggacctgttccagaagtcgttgccgatcccgatgagtttgtcgttgttgcggtaccggtgggtgggggtgatggtcctgcgctcgctcatcgggagttcccctcggtgggcttgtagctgtagacgcccttgagtctccggtaggcgtacgtgtacagggcgacgccgagcacatgcggcctgcggaggatcttcttggacttgagccagaagttgacgttgatgttcatctcgcccagcgactcggcctggtgccaccagccgagcggcaggtagagcatgtgccccggttcgaggacgaagtcgcggcgctgggcgagcttggccgccagcctcgggtagcgcgccaggtcgacgtcgtcgaggtcgaccacgttcgacttgtcgccggtcccccgtaggaccgacctcgggtagtactcccgcacaccgggaggagcgatgatgaaccgcttgcggccttcgagcgcgatgttgaagttctcgaactcgtcgaagtggttcttggtgaacacgccgcggtggctgatccacaggttggccgcatagaggctgtcgccgtatccgaagaactcctcggcgtcgaagccgatgacggcgttcacgtcggccggactgctgcggatgttcgacaccacgcggtgccaggtgtccgagctggtcaggtgtcgctcgtccgcgaagaactcgcggagcttgatgtcccgtgtctcccagcgcccggggtggttcttgtcaccgggctcggtgaacagggtgacggtcatctcggccaggcgggccgccacttcgtcccgtccgagtccctgcacgtcggccggcagcttgatcaccacggggcggtcggcctcgtacagcccccgggggcccacggcgaggaactcgtcgaacgacatacgggtgacctcgacacccgctgtcccgttcgactcgggcacagcttccggtactgccatgtcgtcggtccttccttcttcaccgggtctcatgcctcgtcagccgtggtcctgcggccgctcaactccgccaccacgtcaacgatcaggtcctcctggccggcgatggcctgccgcctgccgagttcgaagaagacttcgcgcggatccacccccgcggccccggagagttcgacgacccggtgcttgaagccggagaacactccggccaggccgctgacgatgctcatcgaggcggtcaccggtggtgcgggcatgagttcgcgctcggcgagctcggcggcgtccagcagcgcgtacaggtcgatgcccgtggcgaacccgctccgctccagcaccggtaccagcacttcgagttgggtattgcccgccccggctccgaagccacgggcgcagccgtcgatgatcagggcgcctgcgtcggcggcggccaccgagttggcgacggccataccgaggttgttgtgcccgtggaagatcaccgggacggtgccgaccgcctcgacgatcgcgccgatccgcgcggtgacgtccggagggaggaagtggccggcggagtccatgattcccacggcttgcgcgccgtatccgacggcccgtgcggcctgctcggccagttcgtccggggaggccatatggctcatcatcaggacgcagtgggcttcggcgcccgcatcgcgcaggaagcccaggtggtgctcggccaaggacgcctcggtggcgtgcacgccgacgcggaagacgtcgaccccgtgggcgatcgcccgtcggaggtcgtcggaggtgccccagccgggcagcatgaaggtacccagccgactgtggcgcagtgcctcgcggacggtcgacagcatcgcgtcgtcggtcgccgcggccagcccgacctgcagcgacgaggcgcccagaccgttgccgtggccgacctccaccaccggaatccgcgcggcgtccgccgcttccgcgtaacggcgcagagcggtcagtccgagctggtgccggaccgcgtgctggccgtcgcgcaacgtcgggtcgtggatcaccacctgcttcacgacgtcacccccgtccgggacacccggtccggcctggccgcgtactgctcggcgaccatgacggcggcggcgttgatgatgtcgaggttccccgcgtacggaggcaggacgtcactgtgcgccgtgaccttgaggacgatcgtcaccaggtcgtcgaccgcggtgcaggcgacgacctcgtacccgggtgcgaaggaccgcacctgctcggccgctcggtcgaccaccgcccgcaccgctgccggatcggcgtcgggcacccgggcgtggatgacggtccggaaggtggccggcggcaccgccggactgatgttgaggatcaccttgacgtcgctcactccggagaacgtcgtcacggcgtgaccggtcgccgccacgtactcgtcgaggttcagccgggtcgcgcggccggccacgtcactcgccacggtcgagacgacctcgagatacgtcaccgggaaacgggccgcgagcgcgtgcacgaccggaacggacgcctgaccgccgcagctgatcagattgacgttgcgcgcggactcggccgcgaccccggtcacggtgggcgcgaccatctgcccgaccttgctgggagtcagatcgatcaccagcgtcccgagcggctccagcagcggccagtgctcccggtgggacgctgcgctggtggcgtcgaagacgacgtcgaacggactcggcgcggccagtacggcttcgatgccggcggcggtggtggcgcagccgaggctttcggcgtaccgcaggcccgccgactccggattgcgtccggccaccagccggcagtccaacgtgggtgaccggtcgatcttgctgaccaggtcccggccgatcgccccggtgccgatgacggcgaccgtgaccgtttcgaggatgtccggacgggcgtccgtcaggcccgccgcgagactcaacgtatgcctccgggacgccggaggcggcggaccagcggatgacgtgagaggcggcagccggcgccggtcgtcggtctcgccgcatcgggttcgtaggttctcatgaacgttgttcccacccttccatctgcgcgcggctcctgcgtggcagtcctggccgcgggcagccgggtgcctcaccgggatttccgtccgttccggaccgtgcgcccgacgcggtcggtcacgttgcctctcctgcggagcccggtcggccgtcgttcagcgatccatgccggtcggatgccgggaggcgaagcgtcagtgagccgaagcgcggtcgcacgctcggaggacgaagatcaacagtcgcatgtcgtcgcgccgaaacaatcggccctgagctcgaaccggaggcttgatgcagtgtgttgaagccccgttgacggcatgtcctcccatgcatgcacgtcgctgaccgccgattcacccgtccagcggcggcgaacatatcagaagaccgcgggacacaacccccctcattcacccatggattgatcttcccgggagtcgagcgacgagtacctcccgggcacttgaccggcgactatgcgtctcctgtccgccgatcccgatctttccctcgactccgccgtggacgccgactactctcgggaaccccgtgcacctggctgtacgggcctcggcgggcgacgacgggttggtgggacgtcgacggcggggcagccacatcgaagggggaggcaatgtactgccggtcacgctgccacgcgctttcatgaccgcgtcgacgaccgacaaggccgacgcgcaacggccccttctgggacgcgacttctcccggctgtggtggtccgccgcggtgtcctcgctcggtgacggggccacgatcgccgccgcgcccctgctggccacccggctgaccgacgacccccgcctgatcggcgcggcctcggtcgccttcaccgcgccgttcatcctgttcggcatcccggcggggttgctggtcgaccgcatcgacatccggtcgatgatggtccgcgtcgacgtcggccgggccgtcctgctcgcggtgctcaccgccgggatcctcggcggctggggcgggctgccgctgctctacgtgtgcatgttcctgctcggcgtcggcgaggtcctctgccgcaacgcggcccaggtgctcgttcccttcatcaccccgcaggccggtctctccaccgccaacgcccgcatcatggcagcgcaggaggccggcaccggcttcatcggcccgcttctcggcgcgctgatgttcggtgtggcgacggccctgccgttcggcgtggacgcggccaccttcctctgctccgccgtcctgctcagccgcatccgccgcaccaggccggtcgagcgtggaccggacagggccggcgtgatgtcggagatgctggccggcgccagatggctgttctcgcatcacctgctgcgcagcctcgcgctggtgtcctgtctgatcaacctcgccggaagcgcgatgctcgcggtcctcgtggtgcacagcgggaaggtgctcggcctgggtccgttcgggtacggcgccctgctcgcctgccaggccgtgggcgccgtcctggcctcacgcttcgctcccgcgctgtcagaacgtctgggccgggagggagcgctggtcgccaccgccgtcctgatcaccacgagcgaggcggtgcttgccgccgtgccctcgatgtacgcggccggcgtggccctcgcgatcttcgcgtgcgggaccgtgacgtggaacgtcgtcgtggtcgtgctgcggcagaccctggtgccgcagcacctgctcgggcgggcgaacagcgtgtaccggctcgtggcctggggcggtctccccgtcggtgcggcggcgacgaagc

SEQ ID NO: 3065 - DNA, 2486 bp, Unknown
  Kingdom: Bacteria, Phylum: Actinobacteria, Class: Actinobacteria, Order: Streptomycetales, Family: Streptomycetaceae, Genus: Streptomyces
ctgcgcgtagacgcgcagcggagccgaccgcggcgcgctcgcggtccccgccgttcccaccgtcgccgttcccgacgtcgtcgccccgctcggggcgggtcccgcagcggccgaacccatcgccgcggcactcaccgccgccgcggaacgaacggcgtcggccgagctcatgacgccgagcgctcccacggagccgaggcgtccgtggtcctcggccgcccgcgagagcgcaacctggccatgcttatcctgaatatgcataacttcccccggttatgacgtctccccccggagacttcccgccgtttcagccggggagcggagcacaacgaaatccgcacccgacaccccgacgggttacgaacatagttgagcccgcgtcaattcagaagggggtagttccgcatgggacgccccccgatcggaccaagatccgatcggcaccggaacatcccccctccacttactccgtgcgtagctcctgacctgcgcggctgtcgttcctcacctcccagacgccccgcgtgccgtcggggaacctccagtcacacaatttgccgggcctgtggacaaaccactgactccgttgcgtcatggggtggtgatggctccagattcccgggggacgacccccggcacccggccaggtgtacgcattctcgtcgtcggcggtggctacgtcgggatgtacacagcgctgcgtctccaacggaagttgaagcagagactgaagagcggcgacgccgagatcgtggtcgtcacgccggagccgtacatgacgtatcagcccttcctccccgaagcggcggccggctcgatctcgccgcgccatgtggtcgtgccgctgcgccgcgtcctgaacgactgcacgatcgtcatcggcgaggcccggcgtatcgaccacgccaaacggaccgcgaccgtcaccaccctcgccaccggtgaggacggcaccggagccctggagatcgcgtacgacgagatcgtcatcgcccccgggtccgtctcgcgcaccctgcccgtccccggactcgccgaattcggcatcggtttcaagaccgtcgaggaggccatcgggctgcgcaaccacgtcatcgagcagatggacatcgcctccgcgacccgcgaccccgcgatccgcgacgccgctctgaccttcgtcttcgtcggcggcggctacgcgggtgtggaggcgctggccgagttggaggacatggcccgctacacggcgcggtactaccacaacatcaagccggccgacctgaaatggatcctggtcgaggcctccggacgcatcctccccgaggtcggcgaggccatgggcacctacgccatcggcgagctgcgcggccggaacatcgacgtacgcctcgacacccgcctcgacacctgcgaggaccgcgtcgccgtcctcagcgacggctcccgcttccccacccgcaccctcgtgtggacggcgggcgtcaaaccggctccgctgctcgccgccaccgacctgcccctcaccgaacgcggccggctccgctgtaccgccactctcggcgtcgaggacatgccgcacgcctgggccgccggcgacgccgcctccgtacccgacctgaccgcttccgaaccgggccgcgagaccgcgcccaacgcgcaacacgcggtgcgccaggcgaaggtcctcgccgacaacgtcctcgcctcgatcgacggccggccgctcaaggagtaccggcacgcctacgccggatcggtcgcctccctcggcctgcacaagggcgtcgcccacgtctacggccgcaagctcaagggctatcccgcctggctgatgcaccgtacgtaccacctcagccgggtcccgacgttcaaccggaaggcgcgcgtccttgccgaatggaccctgtccggactgttcaaacgcgagatcgtctccctcggttcgctggaacacccccgcgccgagttcgaactcgctgcgggcggcggctccggcacccccgggctccccggccccggccgcccgaagggtcccggagaatcgccggacgacgctcggacggacagctgacgggacggcgggcgcggccacgccgagcggctgacgaaggctccggccgcacatccgagcgaggccggcgccggaccgatcgagggtcggaacggcggcagggcggcgactgtcagtacggtcggtcacactggacgtgtgaccataggtgggcccacacctgcacagagtgacccggtcggcagtgaccaacagtgaccagcagcgacgcaccaacagcacgacgaggcccggctgcgccttcccgggggtacggcccccggtgcccccgaacacggcagaagaagcagcccgcccgagcggaccagaccgacacacgaggccagaaataccgtgaacttcacgcgttggagcgcccgccttcccggaacgcagcgccgagccgccggcgcgggacgaccgtagttccgtgccggcggcgcggcgcggcgtt

SEQ ID NO: 3066 - DNA, 1633 bp, Unknown
  Kingdom: Bacteria, Phylum: Actinobacteria, Class: Actinobacteria, Order: Streptomycetales, Family: Streptomycetaceae, Genus: Streptomyces
ggtcgaggcggtgcggggtggcgggccgcccgccggagagcccggccggcgcgggtgcgcccgccatccggtccgcccagtaggcgcggtcctgggtgaaccggtcggaggcccggtaggcgatgtcggcgtcgaccagcaccccgagcggggcgaacggggtggggccgggctcgtcaccggcggccagggcggtgtagacctcggcggtccgccgggccaccagggagacggtgaacccgtcgacggcactgtgatggtaggcgtgcagccacaggtagtggtcgtccgcgagccggaacaggacgaagtcgaagagggggtcgcggcggatgtccctgggcgtggccagcaggtcccgcatccgcagttccgccgcggcccgggggtccggtgccgccgacacgtcgagcaccggaagccgccactccccggccgggacgatccgctgccggggtccgtcgggggtgtccgtgaaccgcacccgcaggcactccgcctcgaccagcacccgccgcagcgcatcctcgaaaagcccggcgtccacccggccgcggatctccaggtactcgcccgcgttgtagatggtgttggccgggtcgagctcctgcgcgaaccagatcccggactgagcggcggtcaggggcaggagaaggtcctggacgtcggacaacgggaaccaccctcggtcgtttttcgggaacaccggagccgatgagcggtgcgggccgctgccggcagtcatcacggcggagcgcacaggaggcgcctgcgctcatcctgaccccgggcgcggccgttctccggggaggtgcacgttgttgcagcccctcccgggggcggggccggtgcgggtgcactgggggcgtcgccgaacggcggcggcacgacgacggaggtggagtgatggccgagcggtccgatgtgtggttccggcgattccgacgagtggcccggccgcggctgcgcctggtctgtctgccgcacgcgggagggtccgcgtccacgttccggacatggcctcggtggctcccggaggatgtggagctgctggccgtcagcctccccgggcggcaggaccggctcggcgaggactgtgtgagcgacatgggcccgctcgccgacgcggtcgccggggctctgcggccgttcctcggtgagccgttggcactgttcggacacagcatgggcgcctcggtggccttcgaggtcgcgcaccggctggagacccggcagggggtgacacccgccgcgctgatcgtctcgggtcagcagccgcccgcgcactaccgggtcaacgaggcccacctcggcggggactccgggctgttggcggaggtgcggcggctgggcggggagggtgcggcgttcctgaacagccccgagatgcgggagctgctgatgccggcgatccggggggacttcgccctgatgggcgcgtaccggccggacccgtccctgcggatcgcggcgccggtggacgcctgggtggggaacgccgactgcgatgtcaccgtcgaggagacgcgggcctgggcggagacgacgacgggaccgttcgcgtaccgcgtgttcgacggcgaccacttctatctcgccgcggagagcgcggagttcaccgcgggcgtcgtcg

SEQ ID NO: 3067 - DNA, 7001 bp, Unknown
  Kingdom: Bacteria, Phylum: Actinobacteria, Class: Actinobacteria, Order: Streptomycetales, Family: Streptomycetaceae, Genus: Streptomyces
tggggcgctgtgcccccgggccgggacccgggggcacagcgccccagggagggcgccgttcgcctacttgtccgtctcctccgtggagtcgggggtgctgtcggtgctgtccgtggtgtcggtgtcctcggtgtcggacggggcgtccgtcggcgtgctgccggcggcttccgtgtccagcagccgtgccagctgacggccgacgatccgcttgaacttgcgctgctgggggcgggtgcggtccaggaccgcgacctccagccgctccgcggggatctcccgctcgccgcctcccggctcccgcgagagcgcctgaacggccagcttgagcgcctcggccagcgtcatgccgtcgcggtggcgctggtcgaggaagctgctgatctgttcggagttgccgccgaccgcgaccgagccgtgctcgtccacgatcgaaccgtcgtgcggcagccggtagatctggtcgccctcggccgcgctgccgacctcggcgaccaccagctccacctcgtacggcttctcggccgcgctggagaagatggtgccgagcgtctgggcgtagacgttggccagcccacgggccgtcacatcgtcccggtcgtaggtgtacccgcgcagatcggcgtagcgcacgccgccgatgcggaggttctcgtactcgttgtacttgccggcggccgcgaagccgatccggtcatagatctcgctgaacttgtgcagtgcgcgggacgggttctcgccgacgaacacaatgccgtcggcgtactgcagcacaacgaggctgcgaccacgggcgatgcccttgcgggcgtattccgcccggtcggccatggcctgctggggtgagacatagaacggcgtcgacaccggctatccgtccctttctgtcagtgacgagtgcgtctggaggcgaggagtccggatcagagcagcgcggcgcgcgggccgtcgggctgctcgagtcggcgttccaggatggagcgcgcgatctcggaggactcctggtcggccagcctccggaagccttcgtcggtgatgacggtgacgatcgggtagatgcggcgggccacgtccgggccgccggtcgccgagtcgtcgtccgctgcgtcgtacagcgcctgcacgaccagggtgagggcctgctgctccgtcaggtcctcgcggtagagcttcttcatcgcgttgcgggcgaagatcgaccccgagccggtggccgcgtagccgctctcctcggtgcggccgccggtgacgtcgtaggagaagatgcggcccttctcgcggtcgacgtcgtagccggcgaagagaggcaccacggcgaggccctgcatggccatggcgaggttgctgcggatcatggtggagaggcggttggccttgccctccagggagagctgggcgccctcgaccttctcgaagtgctccagctccagctggaacagcttgaccatctccacagccagtcccgcggtgccggcgatgcccaccgcggagtactcgtcggccgggaagaccttctgcatgtcgcgcgacgcgatcatgttgcccatggtggcgcgccggtcgccggccaggacgacgccaccggggaaggacgccgagacgatggtcgtcccgtgcggcgcctcgatggccccctggagaggcggcagactccggttgcccgggagcatctcgggcgactggtcggacaggaagtccatgaacgaggacgaacccggcgtcaggaaggcagctggtagacgcccggtgctacgagtgttggcttccacgcgtttccctccaggtatgcgatggccctgcgcaagagagtcaggatcgtcccccaacttgccgatggccgaattgcagttgcagcaagtacgtacgccacggaccctacccgtccggcgggagtgatccacatgttcggcgggggttatccgcaccgatccggcgggaccgggaaccggcccccgggcggggtgacggcgcacgccgtggcggacgccgccaccccctcttccccgttgtcggcgcggggtccgcgcgagcgcccggaaagctcccggacgttcacactggtgaactactgtccacccttctgaacgaaggaacggacgaagtcctcggcgttctcctcgagaacgtcgtcgatctcgtccaggaccgagtcgacgtcgtcgctcagcttctcctgacgctccgcgaggtcctcggacgcctgcgcgtcctgcgcctgctcctcgacctcctcggtggaacgtgtcgccttctgctgtccgccgccggtgtccttggtcgccatgtagctcaccccgctcggttcgaagcaatcgaagctcttgatcagaccctacccacggggtccgacatttgacccggtagttgatgcaacgcccgcgcctcaggtgattgattcccagcccggaggcctttcagccacccgacagggcccggaccagctcttccgccgtccggcagcggtccaacaggtccttgacgtgttccttcgtgccgcgcagcggttccagggtgggcacccgctgcagggagtcgcggtccggcaggtcgaagatcaccgagtcccacgaggccgccgccacgtcgtcggcgtactgctccaggcagcggccccggaagtaggccctggtgtcctccgggggcttcgtacgagccctggtgacctcgtcctcgtccaggaggcgcttcatcttcccgcgggccgccaggcggttgtagaggcccttgtcgggccgtacgtccgcgtactggagatccaccagatgcagccggggggcgtcccagtccaacgcgtcgcggcggcggtaaccctccatgagctcccgcttggcgatccagtccagctcgcccgccaggctcatcggatcggtctccagccggttgagggtgtcctcccagcgggtcaggatgtccttggtctgctcgtcggcgtccgcgccgtaccgctcgtcgacgtacttgcgggccagttcgaagtactccatctggagctggaccgcggtgagcgtccggccgccgcggagcgtgatcaactgccggagatccgggtcgtgggagacctggtgcaaggtgcggacgggctggtcgaccgcgaggtcgacgttgatgaaggcgtcctcgatcatggacaacaccagggacgtggtgccgagcttgagataggtggagatctccgaaaggttggcgtcgccgatgatcacatggagccggcggtacttctcggcgtccgagtgcggctcgtcccgggtgttgatgatgggacgcttgagcgtggtctccaggccgacctcgacctcgaagtagtcggcgcgctggctgatctggaagccgtgctcgttgccgtcctggccgatgccgacccggcccgcgcccgtgacaacctggcgcgagacgaagaacggcgtcagatggcgcacgatgtccgagaacggcgtctcccgccgcatgaggtagttctcgtgcgtgccgtaggaggcacccttgttgtcggtgttgttcttgtagaggtggatcggctgcgcgcccgggatggcggccgcccgctccgcggcctccgccatgatccgttcgccggccttgtcccagagcaccgcgtcgcgcggattggtgatctccggggagctgtattcggggtgcgcgtggtcgacgtacagccgggcgccgttggtgaggatgacattggccaggccgatgtcctcgtccgtcagctgactggagtcggcggtctcccgggcgaggtcgaagcctcgcgcgtcacgcagcgggttctcctcctcgaagtcccagcgggcgcgtcgcgcccggtgcatcgccgccgcgtaggcgttgacgatctgggacgaggtgagcatggcattggcgttggggtggccggggacggagatcccgtactccgtctcgatgcccattactcgccgtacggtcatgcggccctccttgcccggcgtcggccccctccggggacgacgctcaagtaccgctgctgtgtccggtgcgtgtgcggtgcccgtcaccgcactgcgcgactcggcggtaccgcagagcctagagcgcctctgcgccggtggggagctccattacgacattgctccggcaccgccggaacgggggaatgaaaccggctgcggaggcccctgggggcttccgcagccggtccgcgtattacaggtactggccggtattggccaccgtatcgatggagcgtccggtgtccgcgccctgctttccggtgacgagtgtgcggatgaagacgatccgctcacccttcttgccggaaatcctggcccagtcgtccggattggtcgtgttcggcaggtcctcgttctccttgaactcgtccacgcaggcctgcaggagatgagcgacccgcagccccttctggccctgttccaggaatgccttgatagccattttctttgcccggtcgacgatgttctgaatcatcgcgccggagttgaagtccttgaagtacaggacttccttgtcgccgttcgcgtacgtgacctccaggaagcggttctcctcggactccgtgtacatccgctccacgacggactggatcatggcgtgggcggcggccggccgggagccggtgtgctcggccagatcgtccgcgtgcagcgggagccccggggtcaggtacttcgcgaagatgtccttcgccgcctcggcgtccggacgctcgatcttgatcttcacatcgagacggccggggcgcaggatggcggggtcgatcatgtcctcgcggttggaggcgccgatgacgatgacgttctccaggccctccaccccgtcgatctcggcgagcagctgcgggacgatggtgttctccacgtccgagctgacgccgctgccgcgggtgcggaagagggactccatctcgtcgaagaagacgatgacgggggtgccctcgctcgccttctccctcgcacgctggaagaccaggcggatgtgccgctcggtctcgccgacgtacttgttgaggagttcggggcccttgatattgaggaagtagctcttccccgcgggctgcccggtgacctcggcgaccttcttggcgagcgaattggcgacggccttggcaatgagggtcttgccacagccgggcggaccgtagagcaggatgcccttcggcgggcggagctcgtgctccttgaagaggtcggggtgcaggtacggaagctcgaccgcgtcgcggatcagctcgatctggtcgcccaggccgccgatcttgtcgtagtcgatgtccgggacctcttcgaggacgagctcctcgacctcgctcttggggaccacctcgtagacgtaacccgacctggagtccaggagcagggcgtcgccggagcggatggtgatgtccaacagcggctcggcgagccgcaccaccctctcctcgtcggtgtgcccgaccaccagggcgcgctcgccgtcctcaaggatctccttgagggtgacgatgtccccggcccgctcgaacgccatggcctcgaccacgttgagcgcttcgttgagcatgacctcctggccacgccggaggtcctcgagctcgacactgggactgacgttcacccggagcttgcggcccccggtgaagatgtcgcaggtgccgtcctcgttggcctgcaggaagacgccgaagccggccggcggctgcgcgagccggtcgacctcctccttgagggccacgatctggtcacgcgcctcgcggagcgtgttggcgagccgctcgttctgtgcggacacgcctgccaggttcgtctgcaactcgacgatccgctcttcgagaatcctcgtatgacgcggagagtcggcgagcttacgtcgcaggacggcgatttcctgctcgagataggcaacctggccggctgggtcttctgaccctcgcgcgggccggatgccgcggttgatgtcgtcgtcgtgggctgccacggtcctcacctcctccatggggagctggacgcttcctgaccctacctgggtgggtggtgattgaaacccctagatcacaaagactgcggggcgtgtccgatcttcacccttgcgctctccctcacgtcaagggaatacccacccttcggcaccggaaagccgccggttgtatcgtcgaactgttcaacacccgtcagggctggctccaattggttcagatacgcaggaacggcaggacacatgaccgtgcagcaggactcgccgggcgacagtgacacgcaggacctggaggtctggatcgaccaggacctctgtacgggcgacggcatctgtgtgcagtacgcccccgacgtcttcgagctggacatcgacggtctggcgtatgtgaagagcggcgacgacgagctcctgcagaacccgggggcgaccactccggtgccgctgccgctcctccaggacgtcgtcgattcggccaaggagtgccccggggactgcatccacgtgcggcgcgtcaaggacagcgtcgaggtgtacggacccgacgccgactagccggtacaggggctcgcgcctgacgccggacggcgtcgggcagagtgcgctcagacgctgcgggcgaggtccccggtggtgcggacgaacgtctgccccttccaccgccaggaggcctgttcctcctggtcggggcagcagcgggggacgtcgagcgaggagtagccgagcagggtcgcggagacgacgccgtcgcgtacggcgaagtccccgaccgtctttctgtcagcggggtccaccagggtcgccacgacccggggtgcggccccgctgctccgtgtcaggacgtagatgccgccgggcggggtccccgatccggcggcgcagtgcaccacggcgacggtttccggccgcccgtcgccgtcgaggtccccggaggcctttttcgcgacggtcgtcccggcgccgccgcactccagcgggaattccacgtcggccgggtccggggcgggcgcgggggcgccgtgctgtgtggtggtccgctgctcgggggccgtggcggtagcggtggccgtacgggg

SEQ ID NO: 3068 - DNA, 4610 bp, Unknown
  Kingdom: Bacteria, Phylum: Actinobacteria, Class: Actinobacteria, Order: Streptomycetales, Family: Streptomycetaceae, Genus: Streptomyces
gggcgggctgagccgtggcgccagagctcccgccgtcctcggacggcctgttccggcgggagcggagggtggtcgcgccgggggccgtccatgtgccggagtggctgccggtggagcgacgggcggagttggtggcggcgtgccgtcggtgggcgcgggggccggttccgttgcggcacacggtgctgccgggtggtggggtgatgtcggtgcggacggtgtgcctggggtggcactggcagccgtaccggtacgcgcgtacggccgacgacgtgaacggcacccgagtggccgcgttcccggactggctgggcgatctggggcgggctgcggtggccgaggcgtacggggacacgggtgcggcggaggcgttcgcgccggacaccgcgctgatcaacttctacgacgacaccgcgcggatgggcatgcatcaggacaaggaggagcggtcgagcgctcctgtggtgtcgttgagcatcggcgcgaggtgcgtgttccgcttcgggaacgcggagggacgcgggcggccctacaccgatgtggagttggcgtccggggatctgttcgtcttcggcgggccgtcgcgtttcgcgttccacggagtgccgaaggtgtacgcgggaccggccgacccggccgcgggactgcgggccggccggttgaacctgacgttgcgcgagaccggaatgacgtcacgggaggtgcggtagggcgcggtgtgcgcctgccgttcgggtcgcggtgtccgtcccggggtcagcggcgttcgcgggagttgccgaacagcagtcggtaggcgatgagcaggaccagcgaaccggcgatggcggcgatccaggtcgcggtgtcgtagaagtcgttactgatggggcggtcgaggaattggctggagagccagcctccgacgaaggccccggcgatgccgatgagggtggtgccgatgatgccgcccgggtcgcgtcccgggaggaggattttggctatgactccggcgagcagcccgagaatgatccaactgatgatgcccatgtggctgcacctaccccttgcttcgtcttgaaacccaagacgtcgcgggcctgcgttcggttgcccggggcgtgtccgccgaggtcaggaggggtgccccggccggtggacggcagggcgggctaccgggtggcgaagggctggtccgtgcggacgatctccttgccgaagggcatgagggagacggggatcagcttgaagttggcgatgcccagggggatgccgatgatcgtgatgcacagcacgatgccggtggtgatgtggccgagggcgagccaccatccggcgaggatcagccagaggacgttgcccacgcaggagggcgagcccgcgtcccggcggtcgacgacggtgtagccgaacggccagagggcgtagacgccgattctgaaggcggcgagcccgaaggggatgccgatgatggtgatgcagagcaggaggcccgcgaccaggtagccgaggaacatccagaatccgcagaggatcagccagatgacgttcaggatggttttcacgggcgatgacctgccatctgttctagtcgggcgatccgctcagccatcggcgggtgggtggagaacattctcgccgtcccccgaccggggcggaagggattcgcgatcatcatgtggctcgcggtctcgatcctgggctcgggcggcagcgggagctgtttcgtcccggcgtcgagcttgcgcagggcactggcgagagccagcggatcgccggtgagctgggccccggaggcgtcggcctcgtactcccgggagcggctgacggcgagctggatgacggatgcggcgagtggtcccaggatcatgatcagaagcatgccgaggaggccgggcccctcgtcgtcgttggagcggcccaccgggatgagccaggcgaagttgaccaggaacatcacgacggaggcgagggctcccgcgacggacgagatcaggatgtcccggttgtagacatggctgagctcgtggccgaggacgccgcgcagctcgcgttcgtcgaggatctggaggatgccctcggtacagcagacggcggcgttgcgcgggttgcggccggtggcgaacgcgttgggcgcctgcgtcggggagatgtagaggcgcggcatgggctggcgggccgccgtggagagctcgcggacgatgcggtagagctgcggcgcctcgaactcgctgacgggtcgggcgcgcatggcccgcagggcgagcttgtcgctgttccaatacgcgtaggcgttggtgccgacggctaccaggagcgcgacgacgaggcccgtgcgtccgaagaaactgccgatgacgatgatgagtgcggacagtcccccgaggagtacggcggtcttcagcccgttgtgccggcggtgcacggtacgccctccaagtggtgcagcaggggaaccctttgcgtggtggtgctccactccccagtggagcctcctgtactggtcaacgccaggcgagaggagctagttcccttgtgcgtgcggccggagggcgggggctgtgccgcgtgttcgcgccggtcgggcgcccgaccccgtacggagtggcgctgggccgtacgggtggccggggttcctcgtggtgcgacggtcctgcgggtatgcgtgcgtcgccgcgcggtcggtgccgccgcgcgatcggtgctgctgtgcggtcactgccgctgtgcggtcactgctgctgtgcgttcggtgctgctgtgcgttcagtgctgctgtgcgttcagtgctgctgggcggggagcttgacgagggagagtgcctcggggtcgggctcgacctcgctcgtgcagtggccgcagcgggaggcgatggcggggatctcgctgaagcagcgcgggcagtcgcggagggcggccttgatgttgacggcctcctcctcttcttccttggtgaagcggttctgcaccttggccatggggaccacgacgcagaagtagaggaccgcggcggtgatcaggaaggcgatcgcggcggcgatgaagagtccataggggaacacgactccgtcgacctcgtaggaggccttgctgaaatctccggtgccgcgggtggcgaggccgatcagcggcgtgatgaaggcattgctgaagcccgtgacgacggcggtgaaggcggccccgacagcgagaccgatcgccatcgagatgacgtttccgcgcaggatgaagtccttgaacccgttcagcactgctgtctctttcctcttgctcccggcacgtccacgccgattacgtgacgtatgcagccaagaccatgccctgtcgcgggggccgtgggcaaaccgatcttgcggggccgggaggcctcagaaaaggctgacggaggcgaagcgcaggacggcctgcgggaccccggagagcaggattccggcagtggccgtaagtgcgatcgccgtggtgagcggggtggggacccggaatcggcgcggtggagcggaggccgtgggtccggtggcgtcctcggtggtctccggggtgccgtcgggcgtacggaagaggatcgcggtccactgaaggtagtagtagagagcgatcaccacgttgacggccatgatgacggcgagccagccgaggcccgcgtcgacggccgcggagaagacggtgaccttcgcgaagagcccgatgatgccgggcggcagtccggccaggcagagcaggaagaacccgagggccagggccgtgagcggacgggtggcgtacaggccccggtagtcggagagccggttgccggggtgggtacgggcgacgacggcggcgaccgcgaaagcgcccaggttcacgacggcgtacatcagggcgtacgccacggtggagccgatctggtcgtcgctggagtacgcggcggcggcgatcgggaccaggaggtagccggcctgggcgaccgaggaccaggcgaggaggcggacggcgctgcgggcgcggtcggcgttctggcggagggccgcgacgttgccgatggtcatggtgagcgccgcgaggacggcgagtgcgggtccccagacgtcggcgtaggaggggaacgcgatgacggtgaccagaatgagccccgagaacccgacggccttccccacgacggagaggtaggcggcgatcgggaggggcgcgccgacgtaggtgtcggggacccagaagtggaagggcgcggcggcggtcttgaaggcgaagccgacgagggtgagggcgacgccggtcttggcgagggtgtcgagcaccgggggcacgtcgtcgaggcgggcggcgatctcggtgaggtgcagggtgccggtggtcgcgtacacgaagctgacgccgagcagcatgacggcggtggcgacgacggaggagaggaagaacttcagagcggcctctgaggagcgccggtcgccgcgcacgatgccgacgagggcgaacgcgggcagcgaggcgacttcgagggcgacgacgagcgtggcgaggtcgcgggaggccggcagcagggcggctccggaggcggaggccaggagcaggaaccagtactcccccgccggcagttcgcgggtgtcgtcgagcgagagcaggacggtgaggaacgcgccgccgaggacgagggc

SEQ ID NO: 3069 - DNA, 6198 bp, Unknown
  Kingdom: Bacteria, Phylum: Actinobacteria, Class: Actinobacteria, Order: Streptomycetales, Family: Streptomycetaceae, Genus: Streptomyces
gccgctgaactccagccctcctacgcccccgacgtcccactcgccggcacgtacgccggcgcgcctccggccgacctgacctcggtcatgaagggcatcgacggcagcgcgctcgccggcgcgctggcctggtcgatcaacggattcgcccaggccgatcccgacctgcgcgcggtcgtcgaggcgaacatcagcaccaccgggaaggccgccctggcggacgcctccaccatgtgcgtcggcgacgcgctcttcggctacggattcaccaagagcagcaaatggaccaccagtggcaggaccatcggggagatcatcgccggcgagccccgcgcccgggccgccctggacaagcagcgcatcggaaccctcaagccgtccggccccgtgcgtgtggccaccggcgtccacgacgacatcgtccctcacgcgcaggcccgccaactcgccgtcgactggtgccgcaagggcggcgacgtcacctatgacgccgtcgtactgcccaacctcggcgacaagatcctcaccaaccacctcgtgcctctcctcaccgaccagggcgacgcgatcggctggctgaccgaccggctctccggcaagccgtccacctccaactgctggtccatgccgatccagccctgacctccggaccggctctccgtacgcccgtgggaaagctccgccccgcgccgatcgacgcggagcggggtcacgagaagtcgttgagccagtcgcccggaatcagctcgcgtacgcggtcgaggtccgccgccgtccgaccccgggccaggacgacctcgccgtcgtcctcgcgcaggatgacgttttcggccaggaaccaccgggagccgggctcctcatcggcgggatacgaaggaaacggcaaccggacggccgccctctccagaagcgcgacgctctcgtcgtccacaccgaggaagtcgcaccgtccgtcgtccgcctgcacggactcggacagaacgatctcgacgaagcagagggacagccgctccagccagctctcccaccgttcggcgtccttgtcggccaggtcgagccgcacgaacaccgcgggatcgtcctcctggaggctttccaggaggacgccccaggacgcggctccctggttctcgtgccggaagacgagggcttcccccgcgtcgtccacatacagctcggccgggtccagcagctcatcgtgattgctggtcaggtcctggcggcggccgaacagcagatacgcctcgcgcaacgccgtcggcagccggacaccgagccgctcctccgccgctgtgagatcggcctcggcccacccgtcaccgtcctgcagaccgtcggcccaatgggcggcgaagccctggacaaagctccacgcaccacggcggcctcggacgccctcggcgagagacgcggcaagatcgaacccttgtgtcatgccaggacggtatccgaccaggtcgtggctcgacgtatcccggcgcagtccccatctcctcggaacctccccatacatccagtccggatcagtaagtcgtaggtccaggtgtgccgttgacggacgtgtagcgggcgcgaatcgagccgctattggccggaccggacgccgaagcggggtgaccggtggcggcactcgcgtggcgctccgcgacgcaccggccaggtccggtccgctgcccggatgcgcccgcaggatcggcgtccgtcccgtccagcgatcgggtagggtctccgaatcaccaaagggggaagcggcgttggacgctgaaatagagcgctttttcactcacccgcgctactggttgatgtacgcgctgccgtggccggcgacagacccgaacgccggcatggcggaggcggcccacgtgatcgcgcccccgaccgtcccggccggacagcgggaccgtctgcccccggacgtggccgatctcctcgggttcgtcggcgtgtacgcgcgcgagcatccggaccagcgcttgatctggttcaccgacgtcacacggtggctggagtgggagaaggacagcagctggagtgcgctcggcgttgactgggagcacgcgctcgcacaactgacgcgacccccctttctggggttgtacatgacggtcagccgccgggcgtaccaccatctgatcaacacggccgagcgcttccgggtgacctacaccgacgggcacagcgaggtgctgaccggcgaggaacgccaagcggtgcacgaggcgttcgagcgcaagctggacgcggactggccggcgtacgtccgcgacatggtggcgagcggacacctcaccgtcggctaggcatttcgttcggatcatcgggcggaccggaggaagatgcccgcgatgtggagtccggccaggtagatggtcgcggtcttctcgcagcgggtggcgataccgcgcgccactgcttcacgtgtccgcgacccgcagtcgcccgccgagccgagcagtgccgcgctatggcccgaggcacggagtgatcactcctagcggcgacatcagccagccctgcgttccgggccggtccggagtacccgaaccggactccgtgtgacaggctcgtttatgctcccgctgggggctgaccggaaggcaagctgaacatgactgggcaacgcgaccgttgggcggaactgaccggtggacaggctggggaggaatatgcccagcggttcgcacggctcgccgaatcgggccacgacatccacggggaggcctccttctgcgccgcgttgctgaaaccggccgcccgggtgctcgatgcgggctgcggcaccggccggatcgcgatccggctcgccgaactgggccaccactgcaccggcgtggacgtcgacgcctcgatgctcgccgtcgcacgccgcgaagcacccacgcaggactggctcctcggtgacctggcccggctggatgtcctcggtctggatccggacttcgacctggtgctcgccgccggaaacgtcatccccctgctggcccccggcaccggcgccaccgtcgtcgggcacctggccgcggcactgcgtcccggcggtctgctggtcacgggcatgggactggacgcggcacacctgccgctcgatgaagcgccggtgaccatcaccgagttcgaccactggtgcacccgggccggactgaccttgcggcagcgctacgcgacctggagcggcgacccgtaccacgacggcggcggctatgcggtcagcgtgcacacccgcgccgccacgtgagcctgtcgcctttccggggccggttcctgccgctcgctcaccgaaggtccccttccacgtcctttcctgtccaggtcctggagataccggcatgtcacgcgtcgtccttgtcgaagatgatccgtccgtacgcgacggcgtcgagatggggctgcgccggcgcgggcacgaggtcctcgccaccgcgaccggcgaggccggcctggaggcgctggacgtgttccgccccgacctcctgctgctcgatctgatgctgcccctgatggacggcgtcgaggtgtgccgccgggtacgtgccaccagccagttgccgatcatcatgctcaccgcgcgcggcgacgacgtggacatcgtcgtcggcctggaggccggtgcggacgactacgtcgtcaaacccgcccgtaccgaggtcatcgaggcccgcatccgtgctgtgctgcgccgtatcgaaacccccgtcggtgtgcggcctgccgtcgagcaccacggcgacctggacatcgaccgggccggtcacaccgtcctgaagtcgggcgggccggtcgctctcgccccttccgaactgaagctgttgctgttcctgtccgcggcgccggcaaaggtcttcagcaggcagcggctcctggaagaggtctgggatcacagctaccacagcgacgtgcgcctggtggacgcctgcgtgcgccgactgcgcatcaagatcgaggacctgtccgacagccctcggtacatccagaccctgcggggattcggctaccgcttcggcccgctgtgaagatacccggagcggccgccgcgttcggagtgcgtacccggctggtgctcgcgttcctcctggtggccgcggtcggctcggtcacgaccgccgcgttgacctaccgggaggcgcgcagcgcggtcctcgaacgcgcacaggacaccgccgtggcctccttccgcgaggaggtcgagcggttcgtccccggcctgcccctggacccggaatcggtgcggtgggagctgtacgacatcgcggcacgctccaaaccccatccgtggatcgtgttcgccgagtacggctcgatgcgcgtctcctcgggcgaccggcccgtctccggagtgctgaccggggagctgcgccgtgccgcgcggacatcaccgcacggcggcttccaacgggtcgtcaaggacgggcgcgcgtacctgacgatcgcgatgccggtgatgacccgggtcgtcgcgggcggcggtgcggtgcccagcggtctcgtcctcttcgccgtgatgcccatggcgaacgaggaggcggacatcgaagcgctggtgaccgcggcccgcgagggtgcgctgccgggactcgccgtggcgctggtgcccgccctgttcgcggcgcgcagcgtgctgcgacccgtccgcgaactgcggcgtgccgcgcactccatgggcggtgggcggctcgacacgcggatcacggtacgcggcagggacgaaatggccgacctcgcccggacgttcaacagctcggcggcccggctcgaacactccgtacaggaactgcgggacgccggggcccgggcccggcgcttcgcctcggacgtctcgcacgaactgcgcaccccgctcgcggggatgctcgccgtcacggacgtgctggacgaggacgccgggacgctcgacccggacaccgcccgggcggtgcgcctgatcagtgccgagaccggcaaactggccacgctggtggaggacctgatggagatatcccgcttcgacgcccgcgcggccgaactcaacaccgacgaggtggacgcggcggaggccgtacgcagaaccctctccggcagacagtggcaggaccgggtccgtgccgagctgcccgacggagtccgtatccgcctcgacccgcgccgcttcgacgtcatcgtggccaacctcgtcggcaacgccctgcaccacggcgccgaaccggtcaccgtacggctgtcgtcccacgcgggcgcgctgatcaccgaggtgcacgacagcggccccgggatcgcccccgacgcgctgccgaacatcttcgaccgcttctacaaggcggacgccgcacgttcccgctcgtcgggcagcggcctcggactcgcgatcacccaggagaacgtacggctccacggcggcacgatccgcgcggagaacacgcccggcggcggcgcgctgttcacggtggaactgcccttcgacgggcccgcgtcggggtgcggtgcgccggaagatccggcggccgcacacggcgaagtgccgggaaccggccccggccgcacggaggccaccgcgtgaggaagcggactctccgcgcggtccgggcggcccggctcgccatgctgctggtgctcgccggaacgccgctctccggctgcggcatccaggagacgggcgtggtcggggccgggagaccggcggtcggcgacctgttgcccccgcgtgactcacgggtgctgttgttcttcttctctcccgaggacgaactgctgcccgtgccacggaccgtcgaagtcgcctggcagggcgaccccgggagctcccccgcggagagcgaggaagcgagcgcatccctgtcccccctgacggccgtcatcgccctgctccgcgggccgaacaaggccgagcggctggccgggctccgtaacgcctcctcgctgccccgtgaggcgtccgccgcggagcgggtcgtgacgggcggctccaccgtcgaggtcagactgaacctgcgggtgaggcggctgaccgcccccgcccgcgaccagctggtctgcacggccgcctatgccgcgcacgctcagggggacctttccgtcacgctggtcgggcaggacggcggcctcgccccggccgactgctccctccgcccggtcccggctccggcacgctgagcccgcgccgggggcaggggaaaccgccggctgtaccgcccgccacgccgacggcaggacagcggcccgccggaa

SEQ ID NO: 3070 - DNA, 6443 bp, Unknown
  Kingdom: Bacteria, Phylum: Actinobacteria, Class: Actinobacteria, Order: Streptomycetales, Family: Streptomycetaceae, Genus: Streptomyces
  misc_feature (489)..(537): n is a, c, g, or t
ggggccgggtgcgggggccgagtttccgctgctggtggaccggccgcaggtgggcggggagccgaccgcgtacgtctgccggcacttcgtgtgcgacgcgccgacgaccgacgccggtgagctggcggtgaagctcgggggctgagcgctgtcgtggaaggcgctgaggggccggtcgccgtgcggccggcccctcggtcgtacgcgtaacgcctatccgtgctggtacgccaccagcgagatgcccacgtagtgcgcgatgaaggccgccagcgtcagcgagtggaagacctcgtggaagccgaaccagcgcggcgacgggttcggcttcttgatcccgtagatcacaccgcccgcgctgtacagcagcccgccgaccacgacgaggaccaggaccgcgatgccgccggtccgcatgaagtcgggcaggaagaagaccgccgcccagcccatcgcgatgtagcagggggtgtagagccagcgcggcgnnnnnnnnnnnnnnnnnnnnnnnnnnnnnnnnnnnnnnnnnnnnnnnnngccgccgcggcggcccagaccgcccacagcaggggccgggcggtggactcgggaagcaggagcagcgtcagcggcgtgtaggtgcccgcgatgatcaggaagatgttcgcgtggtccaggcggcggagcaccgcctcgccgcgcggtccccacgtgccgcggtggtagaccgcgctgacgccgaacagcagacaggcgctgaggatgtagacgccgcaggcgatccggcccgtcgtgctgtcggtcagggcgatcagggtgatcccggcgatcagcaccgccgggaacattccggcgtgcagccagccgcgcatgcgcggtttgacggggacggggtcgagtacgacggggcctgtggtcgctccggtcgggcttgtggtcgcggaggcagcagcggcgtcagtcatatccgcatgctacctacgccaccgtaagtagtggatttggggcgcaaatgagtggcgatgctcacgtgtgaggccccctggacatatgggcggaacggtcggatgatcaaatgagtgcagtcggcaccggatgagcgccaggggaattcgaagggtacgaagcatccgggtcgcagcccccacggggccttcagacaactgacaccctcaactaggagcgatcgtggcgcgcgacatcgcggctcccctcactgtccccacccaccaccaggagctggtctcctgggtcgacgagatcgcagcgatcacccagccggaccgggtggtctggtgtgacggctccgaggccgagtacgagcgcctgtgcggggagctcgtggccaagggcacgttcaccaagctggacgagaccaagcggccgaactcgtactacgccgcgtccgacccgagcgatgtcgcccgcgtcgaggaccgtacgttcatctgctccaaggaggagaaggacgcgggcccgaccaatcactggaaggaccccgccgagatgcgggagatcttcaccggtgcggacggtgtgttccgcggctccatgcgcggccgcaccatgtacgtcgtgcccttctgcatgggacccgtcggctcgccgctctccgcgatcggcgtcgagatcaccgactccgcgtacgtcgccgtctccatgcgcaccatgacccgcatgggccgggccgtcctggacgagctgggcaccgacggcttcttcgtgaaggccgtccacaccctgggcgctcccctggaggagggccaggaggacgtcccgtggccctgcaacaccaccaagtacatctcgcacttccccgaggaccgcgagatctggtcgtacggctccggctacggcggcaacgccctgctcggcaagaagtgctacgccctgcgcatcgcgtccgtcatggcccgcgacgagggctggctcgccgagcacatgctcatcctgaagctcacgccgccgcgcggggagagcgaggcccccaagtacatcgcggccgcgttcccctcggcctgtggcaagaccaacctcgccatgctggagccgaccatccccggctggaccgtggagaccatcggcgacgacatcgcctggatgcggttcggcgaggacggccgcctctacgcgatcaaccccgaggccggcttcttcggcgtcgcgcccggcaccggcgagcacaccaacgccaacgccatgaagaccatgtggggcaactccgtcttcacgaacgtggcgctcaccgatgacggcgacgtctggtgggagggcatgaccgaggaggcgcccgcgcacctcaccgactggaagggcaacgactggacccccgagtccggcacgcccgccgcccaccccaacgcccgcttcaccgtccccgccggacagtgcccgatcatcgcgcccgagtgggaggaccccaagggcgtgccgatctcggcgatcctcttcggcggccgccgcgcctccgccgtcccgctggtcaccgagtccttcgactggcagcacggcgtcttcctcggggccaacgtcgcctccgagaagaccgccgccgccgagggcaaggtcggcgagctgcgccgggacccgttcgccatgctgccgttctgcggctacaacatgggcgactacatgaaccactgggtcaaggtgggcgccgacaaggccgaccagtcgaagctcccgaagatctactacgtgaactggttccgcaagaacgacgcgggcaagttcgtctggcccggcttcggcgagaacagccgcgtcctgaagtggatcgtggagcgcctggagggccacggcgaaggcgtcgagaccccgatcggcatcctgccggccaagggcgcgctcgacaccgagggcctggacctctccgaggccgacctcgacttcctcctcacggtcgacaagaaggtctggcgcgaggaggccgccctggtccccgagcacctcaacaccttcggcgaccacacgcccaaggagctgtgggacgagtaccacgcgctggtgaagcgcctgggctgagccccgcgctcccgctgaaccccgcggccgggtccgtcggacatccgccctgacctgtggggccgaacgacccgccgcggtacggggcctgtcctcgccgacagccccggagggagtgtccccgaccaaggacaccctcccggcccccggaaccccctcacggttccgggggccgctcctcttccgcgggtggcgtgcgccgcaggccgccaccacccccgttccggtcctccaggtacttcgtgtgggaccgctggcgcagctcctccgcctcccgcaacatgtccaccagttcctgcgcctccccgcgcagcagcgccacctgccgctccagctcctcctccggagcccgcgcgcccggcgccagccgcgtccaccaccgggtccgcagatacgcgtcgacggactccggaacgtcccggcgcaccgcccgcgccaccacgtgcacgccctccggatcctccgccagcgcctcggagacccagccgggggccagcagtccgtccagcaggccggtcagcgcggcgagccgttccgtcgcggcggcgggcaggtccacccggtccagatacgcccgcagggtcaccaggtcggcccgcagctcgtccagccgggacgacggatcctcgaacgcgggggcgggcggccggggcggcggggcgagcagcgcgcccgccccgtacagcccgccgaccaccaccggccagtacgccccggcgaacccggcgaaggtgagggcgagaccgccgagggccgcggcgctgccggtcagattccgggccgactccagatagccggccgcccgggccgccacggatctccctccgcccgggcttctactggtagccacggatctcctcgaacgccccgtccagcgaaccgggaccctcctccttcgtcccgtcgaagagccggccgccggtcagtgaggcgatcgactccagctccgagcggtcggagtcgccgaacacgatcgggaacaccggggtgacctggcgggcggcgggcagcgcccggtagaacgccgcgaactccgacgccgaccggcccgccgtgttctcgccgtccgtcatcagcacgacggaggtgaacgccgactcggtgtccgggccgaggtggtcgtaggccgcggcgagcgacgagtagatcgcggtgtccccctcggccgtcagcgccgcggcgtccgcccggatcgccgcggggcccgccttcgggtccgccgggtcgacggtgtgcgtgcggacctgtttgacggtcgagccgaacggcagcagcgtgacctgttcccgctcccggaagtcgccggtcagcccgttcagcgcggacttcagctgcgccagccgtccgcccttcatcgaaccggaggtgtccagcacgtacacggtccgcgacggccgcctcagccggtgctcgtacgaggacagcagcccgtccgcgaccgaccgcgtaccggggaacggcagttcgcggcgctgctcgggggagagcggatcggcgggacgcgcggcggcgacgaccggccggcgcagggtccgcgcggtgatctcccgctgcaccccggtggaccggaagtgctcggccagggcctgtacggcgtcccgggcgtcgggtgtggcgccggtgagcgcgctcagcgggtagtcggcggtcaccaccccgtcgcgggggcggatcaccgtcagcccggcgccggtgtcccggttcagggacagcagcaccgactcgtagttgatcagcgcgtccaccgtcgagcgccgggcgtacgcggaggcaagccagcccgaggagccggaggtcagccgctgcccggcgaagaactccttcagcttcggcccggccttgcggacatcggcgtcggtgagcgccgcctgcgcgccggagagcccggacgccaccgagatcagcgcggcgaaaccggagttggagcggctcgggtcggtcatcccgtacgtcaggtccccggccgcgaccgcccggtggacctgcgcccagctgaccgcaccggcatcccagccgagccgccgcaccgtcgcgggccgcaccccgagggcgaccggggaggccatcagcggggtctcggaggcgatccggcgagcggcctccgggtcgaggcgcagatagtcgttggacgacagccacaccgcgtcgaacgccccgtccgccttcccggacgccaggcgctccacggcgtccagcgtgcccgcccaggtgggtcgcacagtgatcccggtcgcctcgcgggccttctccaacaggggttccatgtcgctgagttcgctggaggccagcacccggacggttcccgcgcgaggccgtccgtcgtcgccgcgccggccggtgtcccgttcggtgccccggtccgtcgtgcaggcggcgagcgggacgagcagggccgcggcgagcagcgggaggaacgcgcgccgggccagggagccctttcccgggccgctgttcatgagcggcccccttccagcgtggagtcggcggcccggctgcgatccagccgggccccggcctcctggagttcggcggtcagcgactccacggtggcggccatggtctcggtcgcccgcgccttgtacgtgtcgatggcgtcgagcgtcgcgtagatctgcccgaacgcggtgcgcagggtctcgacgcctaccgcggggtcggccgccatgcgctggatctccccgctctgcgtggcgagcatctccgcgttgccccggatcaggtcctcggtggtcgagcgcagcacctgtacctgctcggtcacccggcgctggttctccagcgccgaggacagcatcaccgcgatccgcagcgccgacacggtggtggtggccgcccggtcgacacccttgatcagctcgtcgttgttgcgccgtacgacgtccatcgccaggtatccctgggcgcagaccgcgatctgggtgagcaggtcctggtgcttctgccgaacggggaagaggacgtcggcccgcagcgcttccgcacgtaccggatcgcccgccgtcccggcctccgcgatgcgccgctccaccacgccgtcgagggcctcggtgagcaccgcgtactcctgcagcctgcccatggagtcccagagacgggtgcgctcggtgtgcaacgcaacgttgtcgcggcgcagttcgtcctggccgccgcggagcgagccgacgatccggtcgagagtccccttggcggaggcgtacttcgcgacgtggtcgcgcagccggcgcccgcccggcagccgggacagcagccggcgggctccgcgccccggggtgtcgcgcggatcgaggtcctccaccgtgcggcgcagctcgacgagcgaggaccccacacgggccggggcgtcgccctcgccggaggcgagcgctcggacggtgcggtccagcatccggttggactgctgggcggcgctgcggatgtcgccctgcccgagcgcggcgatc

SEQ ID NO: 3071 - DNA, 1891 bp, Unknown
  Kingdom: Bacteria, Phylum: Actinobacteria, Class: Actinobacteria, Order: Streptomycetales, Family: Streptomycetaceae, Genus: Streptomyces
tcgcgaagtacttcgcgatcatccccgccatgttcgccgtggcgtacccgtcgctggacaggctcaacgtcatgggactcacctcgcccgagtccgcgatcctgtccgcggtcatcttcaacgcactgatcatcgtcgcgctggtgcctctcgcgctcaagggcgtgcgctaccggccggccagtgccgaccggatgctgcggcgcaacctgggcgtctacggactcggcggcatcgtcgccccgttcatcggcatcaagatcatcgacctgctcctctccctccttcccggaatcggctgatccgccatgaccaacaactccgtcagcagcaccgcgcgcgtgctcggggccggactgcgggccctgctcgtcctcaccctggtgtgcggggtcctctacccgctcgccgtcaccggcgtcgcccaggccctcttcaacgaccaggccaacggctccgagatcaaggacagcggcggccgggtcgtcggctcctccctcatcggccagcggtacgacctcccgctgaaggacggcgaggagtcacccgccccggacctgaagtggttccagcctcgaccctccaacggcctcggcagcaacagcgtcaacacgcagtactccctgatcctctccggggccaccaaccgctccggcgacaacaaggaactggtccagtgggtgaccgacgccaaggcggccgtggtcgaggacaactccacccccacgtacaaggtgaagcccgcggacgtgcccgccgacgccgtcacctcgtccggctccggcctggaccccgacatctcacccgcgtacgccgaactccaggtccaccgggtcgccgagaggaacaacctcgacgtcaaggaggtcgagggcctcgtcgccgatcacaccaccggccggctgctcggcttcatgggcgagccacgggtgaacgtcctggagctgaacacggcgctcaggaacctgacccggggctgatggtgctgcggcaggacaccggtggggtgcgagaaccgaccgcgcccctgccccgaagacctggacgagcccgatccgatgggacaggacgacgttgcgttcgacgcgtgcgctgtactcgtcgaagccggatcaccagatcggcgagggccaggacgtccggcagctccggcccgacgaccggggtgaggtggtacctggcggcgagggccgcaggcgaccctgcggcgcgagcggacagcgcctcctggtgggcggggccgcactggtgcaccaccttggcgcgcttcagcagccacggcagttcgccgccgcccgcacgctctccggcaggaggggcagggtcgactccgaggacacggcgatcgtcaccggctacctggcgtccgagaacgcgctcacccggaaggattcgccgacgcgttggtcacgccgttggtcacggaggggtgggcggcccacaaagagcctggccacggggccagatgctggagcgacgaccggggccgccaccccccacaggagaggccccggccgtcttccacggggtcgcagcacgaccccgtactcatctcagcgccatgactgcgttttctgtcacaccgcaggatggcgcggcgaattgttgcgggttgtacaagtcatggacgtggcccccgccgagcacgtagcgtgctggttcgcgcagggttgcgcagcagttgaccagctgcgatcgaggacggcagagcgggttgagggagtgctgggggacgacgcggagctgactgccgcggtgctcgcggcacaggacggggacgaggacgccttccgtgctgtgtaccgcgcggtgcagccacggctgttgggctacatacggacgctggtcggggagccggacgccgaggacgtggcgtccggctccccgacca

SEQ ID NO: 3072 - DNA, 10155 bp, Unknown
  Kingdom: Bacteria, Phylum: Actinobacteria, Class: Actinobacteria, Order: Streptomycetales, Family: Streptomycetaceae, Genus: Streptomyces
ggggggcgtgggggagggtgaagccgccgggtcgggcgacgcgggtgttgaagtcctcgaagccggggacgacgcgcgagatgcggtcgcggatggtggcgtagtcccgttcgaaggcctcccagtccgtacgggagccggcgccgaggacggcgcgggcgaggcgggcgacgatggccggttcggagagcaggtgggggctcgcgggggtgaggttgccgcgtgaggcgtggaccatgcccatggagtcctcgacggtgacgaactgtttgccgccggcctggacgtccttgtcggtcctgccgagcgtgggcaggatcagggcgcgggttccggtcacggcgtgcgagcggttgagcttggtcgagacgtggacggtgaggcgggcacggcgcatcgcggcctcggtgacggcggtgtcgggcgtggccgcgacgaagttgccgcccatcgcgaagaagaccttcgcgtcgccgtcgcgcagggcctggatggagcgcaccacgtccaggccgtggtggcgcggcgaggtgatgccgaactccttgtcgagggcgtcgaggaaggccggtgcgggccgttcgaagattcccatggtgcggtcgccctggacgttggagtggccgcggaccgggcagacgccggcgccggggcggccgatgtttccgcgcaggagaaggaagttgacgacttcccggatggtgggcacggagtgcttgtgctgggtgaggcccatcgcccagcagacgatggtccgtttcgaggcgaggacgagggcgagggcctgctcgatctcggcgcgggtgaggccggtcgcggtgagggtctcgtcccagtcggctgcttcggcggccttggcgaactcctcgtagccgtgggtgtgttcggtgacgaacgcggtgtcgacggcgccgtcggtggcgaggatcagcttgttgaggaggcggaagagggcctggtcgccgccgatgcggatctggaggaagaggtcgttgagggcggtcccccggatcatgccctgcggggtctgggggttcttgaaccgctccatgccggcttcgggcagcgggttcaccgagatgatcttcgctccggagttcttggccttttccagggcggacagcatccgggggtggttcgtgccggggttctgtccggcgacgatgatcaggtcggcctggtggaggtcctccagggagacgctgcccttgccgacgccgatggtctcggtgagcgccgagccggacgactcgtggcacatgttggagcagtccggcaggttgttggtgccgaactcgcgggcgaagagctggagcaggaacgcggcctcgttgctcgtgcgtcctgaggtgtagaagagggcctcgtcgggggagtcgagggcggtcagttcctcggcgatgatcgcgaacgcccgctcccaggtcaccgcctcgtaccggtcggcgccttcggggaggtacaccggctgggtgatcctgccctgctggcccagccagtatccgctgcgttcggcgaggtcggccagcgggtgggcggcgaagaagtcgggggtgacgcggcgcagcgtcgcctcctcggcgacggccttggcgccgttctcgcagaattcggcggtgtgccgcttgtcgccctcgggccaggcgcagccggggcagtcgaagccgttcttctggttgaccttgaggagggtctgcgcggtgcggcgcacccccatctgctgctgggcgatgcgcagggagtgggcgacggcgggcagcccggcggcggcgtgcggggccgcttcgacctgcggggcgtcctggaccgggtctccggtcggcggcttggtggccatgatgctgctccccttcgagcgcttcttccgcgtccgtacgttctccgtacgtcctcaccgtcgatcctgtcacggccccccggatgtcgtgccggtccggattgtcagtgcgccgtggcaggatcgggggcgtggctgagacggcatcgaagaagacggcagacaaccgaccgcgcctgctcctcatggacgggcactccctggcgtaccgggcgttcttcgccctgcccgcggagaatttcacgacggcggtggggcagccgacgaacgccgtgtacggcttcatgtcgatgctggcgaacaccctgcgtgatgaggcgcccacgcacttcgcggtggcgttcgacgtgtcccgcaagacctggcgggcgcaggagttcccggagtacaaggcgaaccgctccaagacccccgacgagttcaaggggcaggtcgagctgatcggcgagctgctggacgcgatgcacgcggaccggttcgcggtggatggtttcgaggcggacgacgtcatcgcgacgctggcgacccaggccgaggcggccgggttcgaggtgctgatcgtcaccggcgaccgggactccttccagctgatcacggagaacgtgaccgtgctgtaccccaccaagggggtctccgagctgacccggttcaccccggagaaggtcgtcgagaagtacgggctcaccccgcggcagtatccggacttcgccgccctgcgcggcgacccgtcggacaacctccccggcatccccggggtgggggagaagacggccgcgaagtggatcaaccagttcggctccttcgccgagctggtcgagcgggcggacgaggtcaagggcaaggccgggcagaatttccgcgaccacctggacgcggtgaagatgaaccgggtgctgaccgagatggtccgggacgtggagctgccgaagaccccggccgagctggagcgcgccccgtacgaccgcacggcggtcaccggtgtcctggacatactggagatccgcaacccgagcctgcgcgagcgcctcctcgccgtcgatccgggtgcggcggaggccgagccgcccgcgcccgccgccggtatcgagctggacggggccgtgctcggctccggcgaggtcgccccgtggctggaggcgcacggcgggcagccgctcggcgtcatgacggtggacacctggtcgctgggtgccggtgcggtcaccgaggtcgcgctcgccgccgccgacggggccgccgcgtggctggacccggcgcagctggaggaggccgacgagcgggcgttcgccgcctgggtgtcggacccggcccggccgaaggtcctgcacaacgcgaagaacgtgatgcgggtcctgcccgagcacggctggcggctcgaaggcgtcacgatggacaccgcgctcgccgcgtatctggtgaagccgggccgccgttccttcgccctggacgcgctggccgtggagtatctgggccgggagctggccccggccgccgccgccgacgggcagctggccttcggtgcggacgaccgggccgaggcggacgccctgatggcgcaggcgcgtgccgtgctcgatctgggcgacgcgttcaccacccgcctcaaggaggtgggcgcggcggagctgctgcacgacatggagctgccgacctcgatcctcctggcccgtctggagcggcacgggatcgctgcggaccgggcccatctggagggtatggagcagcagttcgccgggaccgtccagcaggcggtcaaggaggcgcacgcggcggtgggccgggagttcaacctcggatcgcccaagcagctccaggagatcctcttcggcgagctgggcctgccgaagacgaagaagaccaagacggggtacacgacggacgcggacgcgctggcctggctggccgcgcagaccgagcacgagctgccggtcctgatgctgcgccaccgcgagcaggccaagctgcgggtcaccgtcgagggcctgatcaagacgatcgcggcggacggccggatccacaccacgttcaaccagacggtggcggcgaccggccggctctcctccaccgaccccaacctgcagaacatccccgtccgcacggacgagggccgggcgatccgccggggcttcgtcgtcggcgagggtttcgagacgctgatgacggcggactacagccagatcgagctgcgggtgatggcgcatctctccgaggacgccggtctcatcgaggcgttcgcctccggcgaggacctgcacaccacggtcgcctcgcaggtcttcggcgtcgagaaggacgcggtcgacgcggagatgcgccggaagatcaaggccatgtcctacggcctggcctacggactttccgcgttcggcctctcccagcagttgaacatcgatcccgccgaggcccgggtgctgatggacacctacttcgagcggttcggcggggtacgggactatctccaccgggtcgtcgaggaggccagggccaccgggtacacggagacgatcctcggccggcgccgttatctccccgacctgaacagcgacaaccgtcagcgccgcgaggccgccgagcggatggcgctcaacgccccgatccagggcacggcggcggacatcgtgaaggtggcgatgctgcgggtggaccgggcgctgaccgaggccgagctgacctcgcggatgctgcttcaggtccacgacgaaatcgtcctggagatcgcgaagggcgagcgcaagcgggtggaggagatcctgcgccacgagatggcccacgcggtcgagctgcgcgccccgctcgacgtctcggtcggcgtcggcggggactgggagtcggccgcgcactgagccgcggggaagcccggcacagaggggcccgcgaccgcgccgcggtcgcgggccccatcctgtttcgctacttcccgtcggcggacacttccgtacgggacgcctccggcacggacgcggtcccgccctgacccggcgtcccgcgtcggccgcgcggcaggcgcatccaccccccgtacagcagcagcccggccgccaggccggcgcccgcgccgaagcaggccgtggggatgatgtcgagcgggctctccacccggccgaagtgggcgtaccagcgggcgcaccggtggacgacgccggccagtacgcacaggcccagcaggccgagagcgcccccccgttcacggcggccgagcaccgggacctcctcgggcgcgggggccgccggggtcagccggagcccggtgacggcgaaccagccgatgaccacgagagccagggccgagctgccgtactggacgaactggaacaccgggaagccgccgacgctgcgagtgagcaacggcaccagctccgtcccccaccggctgtggtgggtgaacgcgtcccacaccacatgggtggccgcgcccagcgcgccggagacggcgaaccacagccaggcggacggcccgaaggaggaccgcgtccaccgctgtccccggacgaaggcgtggacgcgtccccgtacgcgtaccggcaacagcgccgccaacggctcccggagcaggacccacaccgtcaccagcaccgcggcgatggccacgttcaccgtgaccaccccgaggaaggtgtgcgtgaacgacccgaactccatcgccccggggatcaccgtgtccgcgaagtaggtgatgtcgggtgcgaacgatccggcgacgagagccgaggggaacagcggccaccgggccgtcccgttccggcggatcgccgggagtaccgcggcggcatgactgagcgtgaacggcatggcggcaagtatgcgggaccgttcgggcaccctttcgtggccggcaggacaacatgcgcccgcgaacgtgaaaaaacagtaagaagcggtcagggctcggtgcccgggcgacacgagttgccgtagggtcgctggagtccttgcgctggggagcgcgagcagccttcgagggggagggaccggaacgtatggcagcgcacattcgccgacgtctgcgcaagggggccacgaccaccgcggtggcggcggccgccgtggcggcactcgccgcctcgcaggcgcccgcagcgaccctggccgacggacccgccggcggcggtgacccgaaggcggccggtgaggacaccgcgagcgccgaggacgacggcgccgcgaccggcaactcgccctactacacggaccttccgcccctgctcacgcccgacaagcccggatcctccagcaatctgccggtgaccggaagcgcggaagcgggcattccggcgtcgatcctggccgcgtacaagcaggccgaacagaccgtcgcgaccaccgaccccgcctgccgcctgccctggcaactcctcgcggcgatcggcaaggtcgagtccggccaggcccgcggcggacgcgtcgacaccaacggcaccaccacttcgccgatcctcggcccggccctcaacggccagggcttcgccctgatcaaggacaccgacggcggggcctacgacagcgacgcggtccacgaccgcgcggtcggtccgatgcagttcatcccgtcgacctgggcctcctggggccaggacgcgaacggcgacggccgcaaggaccccaacaacatctacgacgcggcgctcgccgccggccgctacctctgcgccaacgaccgggatctggccatcgccgccgacctggacaaggccgtgctgagctacaaccggtcgacggagtacctgcgcacggtccgctcctggttctcgtactaccagcgcggtacgcacgagatccccgacggcaccggaacgctgcccaccgccccgagcaccccctccggctcctccccgagcccgaacccgggaagcccgggcctgagcgccacgccgagcccgaagccctctccgtcccggccgggcggaaagccgaccccgggcccctcgaagccgggcgacggctccaccagcccgacgccgaagccgcccacctccaagccgacgccggccgagaccttcggctcgctggagaacgcgggcaccggcccgctgcgcgccaccgcgggccaggcgttcgacgagcgggtcgccgtactcgcccgcaacgcgctcggcgccccgctcggcaaggtgtccgtcacgttcaccgtcaccgggaacaccggcacgctcttcgccggcggcaagaagaccgtcacgctgcggaccggtgccgacggcaccgccaccgcgccggagctccgggcgggcgagaaggccggggagttcacggtgaccgccgtcgcgggaaccggccggccgcgcaccctgacctacgcggcgaccgtcaccgcccgccaggccgacgcgatcgcccgggccgacgagaaggcgctcgtcgccgcacccggcgagaagttcgcggacgcggtcaccgtcaaggccacgtacaaggacgccgcagcggccggagtggccgtcacggccaccatggtcaaggaccccctgggactcttcgacaacgacaagggcccgtacttcaaggacgcggccggcaagccggtgcgcaccctgacgaccctgaggacggacgccgagggcatgctccggctcccggagatcttcgcggacggcaccgagggcaccttcaaactgcgcctcaccaccgagggcggcgcctcggtcgtcatcgaactcaccattcaggccccggaggaggccgctccggaggggacgaaccccgaggagaccgctccgaaggagacggaaacccccggagcctgatcccgccgcaccgcgcagctcccgcacagcccctcggtcatccggccgaggggctgtccgctgtgttctcatctcgcgccccggttgctacggtgccccagccctgacggcccatcaggtcgccgtcatcggatcaccgccccgggaggccgagcatgcgtgccctcgtcgccgccgccatcggactggccgccgccctcgtgctcgtgttcaccgtctccgccgtcggctccccggcaggggagacctcgccgaaacccctgctgaccaccgtcccgggaccgaagagatagccgccgcagagggagaggtcaccaccatgcgccgccgagccggtctcgtactcctggccttcgccgtgttcttcgccgccctgtcaccgctgctgcgctggtacgccttcccgcgcctggccaaggtcccgccgagccagtaccaggaagtcgtcctggaggcgtcccccgcgaccctcctcgactacaccaccctcaaggccaggaaggtcgagaaggtcaccatcgtccagacgctcaagggcaacgtgaaggagtccgagaagatcgaacgcagcgcgggacgcgacgtcgtcgtctgggacgccctctcctacattcagggccccgacggcaagatggtctccgagatccccgagcgctacatcttcgacgcccacacccaggcccccgtcaacgccaccggcgagatggtcgacggcgacccggtccggcgtgagggcatcgagtacaagtggcccttcctcacggagaagcgggactacgagtacttcgacgcccagagccgcaccaccgcacccatccactacaagggcacccgcaccttccgcggcctggaggtctactacttcgagcagaccatcccgtggaccgaggtcccgatgccgaagaagatgcccatcgagggcatcaccgccgaacagatcgcgcagaccggcatgacccgctggtacaccacgaagcgcatgttctgggtcgaccccgtcaccggagcccccgtcaacggagaggagatccacgaggaagaactgcgcaacgccaagaagatgggcatgtccgaggacaccgtcaccgcgttctccggccatgtgaagatgcgcgaggactacatcgtggacaccgtcgacctggtgaagtcccaacgcgtcctggtcctcctcctcacctcgtacctgccctggggcttcctcggcctcggcatcggtctgctcgcgctcgccctctggctggaggcccgctcccggcggccgcagagcgcttgagaagccctgccgtcaggaaccctgccgtttcagccgcgccgaggtgaaccgcgtcgccggtacggtcgcggggtcctccggccacggatgcttcgggtagcggccgcgcagctccgcccgcaccgcccggtaaccctcctgccagaacgacgccaggtccgccgtgacggccgcgggccgcccggcgggggagagcagatgcaccaggaccggcaccccggccacccggggtgtctcgcccatcccgaacaactcctggagcttcaccgccaggacgggctgctcgccgccgtactcgaccctgatacgggagccgctcggcacctggatccgctccggcgccagctcgtccagccggacggcctccccggtcgcccagggcagcaggcgccgcaacgcctggcccgcgtcgatccggcccaggtcggcacgcctccgcgcccgcgacagctccggctccagccacgccccggtctccgcgagcagcgccccgtccgagacatccggccacggcgagcccagcacccggtgcaggaacgccaggcgcagccgcaactgctcactgtcccgggtccaccgcagcagcccgagcccctcgcgccgcaaaccctccaccagggccccgcgcaccagctccggatcaggctgcttcagcggccgtgccgccagctccaccgccccgagccggtcaacggccctggccaccacctcgccgtcgacccagcggacctcctcgccccgcacccgcagatgtccggaggccagcagtgcggtggactcgtcgatcacggccgccaaccgcacccgcgcagaggccgcgtgggagggccggtccgcgaccgccacggccacccagggcgcgctgcccagccgcgaggagtcccgcagctccgcgcccgtgcccgacgccatcaggaaggacccgtcgccccgggcccgcgccacccgctccggaaacgccagcgcggcgacgagccccaccgccatgtcgtcggaaccgccgcccttcctgtcatcggaaccggaaccggaacccagtgacgacgacagccggcgcacctcctgcttccagcgcgccgcgtacccgtcctggccccgtcgggcggtccgcagcgccgccgcgagatcgtccccgtactccctcggcggctcctcgctcaacagggccaccacctccgcggcccgccgcgccccgacctcccgcgcgccgtccagcagggcccgcgccagccggggatgcagccccagccgggacatccgcacgccgcgatcggtgacccggcccccgccgtccaccgcgc

SEQ ID NO: 3073 - DNA, 11976 bp, Unknown
  Kingdom: Bacteria, Phylum: Actinobacteria, Class: Actinobacteria, Order: Streptomycetales, Family: Streptomycetaceae, Genus: Streptomyces
cggccgggtacgtgcgggggagaggggccgcgttgcgcggaccggtgcggcgcggcacggtcgaagtacccatgcaaggaggccactgccatgcccatcgcgacggtcaaccccgcgaacggcgaactgatcaggtccttcgacgccctcggcgaggaggagaccgaacgcaggatcaccgccgccgcggagaccttccgccagtaccgcaccacccccttcgagcagcgtgcggcctggctgaaccacgccgccgacctcctcgacgaggaccgtgacaccatcgcccgcacgatgaccgtcgagatgggcaagcccatcacggcggcacgcgcggaggcggccaagtgcgcgaaggcgatgcgctggtacgccgcccacgccgagggcctgctcgccgacgaacacccggaccccgacgacgtgaaggactccggcgcctcccgtgcgctggtccgctaccggccgctcggcgtggtcctcgccgtgatgccgtggaacttcccgctctggcaagtggtgcgcttcgccgcccccgcgctgatggcgggcaacgtcggacttctcaagcacgcctcgaacgtcccgcagacagccctctacctggaggacctcttccaccgtgcgggcttccccgccggctgcttccgtacgctgctgatcggctcggccgccgtcgaggcggtcctgcgcgacccgcgcgtcgccgccgccaccctcaccggcagcgaaccggccggccgctccgtcgccgccaccgccggtgacgaggtcaagaagaccgtgctggaactcggcggcagcgacccctacctcgtgctgccctcggcggacgtggagaaggccgcggccaccgccgtcaccgcacgcgtccagaacaacggccagtcctgcatcgccgccaagcgcttcatcgtgcacgccgacgtctacgacgcgttcgccgagcggttcaccgcgggcatgcgcgccctgaccgtcggcgacccgctggaggagggcaccgacatcggtccgctctccaccgaacagggccgcatcgacctggaggaactcgtcgacgacgccgtcgaacggggcgccggggcgctgtgcggcggccgccgccccgacaagctcggcggcggcctggagaacggctggttctacgagcccaccgtgctcgccggcatcaccaccgccatgcgcgtccaccgcgaggagaccttcggcccggtcgccaccctttaccgggtcgccgacctcgacgaggcgatccacctggccaacgacacccccttcggcctcagctccaacgtctggacccgcgacccgggcgagcaggaacgctgcgcccgcgacctggaggccggaggcgtcttcttcaacgggatgaccgcctcgcaccccgccctgcccttcggcgggatcaaacgctccggctacgggcgtgagctcgccggccacggcatccgcgagttctgcaacgccaccacgctctggtacggccccgaggcgtcctgacgacagcccttcccgtgcgccgtccccccgacgaggagggccgcccgaaccgtgagcacccgcgttgttctgccggcggcagaacaacggccgaaccgggctcgacgatcactacagtcccgtctcatggcgacgatgacgacgcgtacggtcgagtatccggccgacggattgacgatgatcgggcacctcgtgctcccggccggtgacgaccgccggcccgcggtgctggtcggacccgagggcatggggctcagcgacgtcgagcgccgccgggccgatgctctcgccgaactgggatatgtagcgctggccttcgacctccacggcgggcgctatctgggcgaccccgaggagatgctggcgcgttgcctgccgctgctcgctgatcccgaccggatgcgaggcatcggccatgcggcgctcgacgtgttgcgcaccgaaccgcggaccgaccccgaccggatcgccgcggtcggctacggcaccgggggcgccgtcgggctggaactcgggcgcggcggcgtcagcctgcgcgcgatcgggacagtgaacgcactgaccaccggccgaccgggcgaagcggcgcgcattcgctgcccggtgtgggccggggtcgggtcggaggacccgatcatgccgcccgcgcaacgggacgcgttcgccgccgagatgcaggccgcgggcgtcgactggcgcctcgtggtctacggcggcgccttgcacgccttccaccacccgccggtcgaccaccctgtggtccccggcgtcggctaccacccacggcacgcgcagcgagcctggcgcgacgtcgtcgacctactcgcggagtgcctgcccgtgacggaggatccggggcacgacccgggcaagcgcgcaagtgccgggcactgacagtcctctctcctcgggtccgcacagcagaaccgcgttcgagtggactcccgatcgtggcaacgcgttcggaactggcgcagtggacggcggatttgctgcggcagaacacacggcacggacccgcaggaggtcgtggacgggaagtggggtgaccgacagggtctttcaccggccgccgtccctccggaccggccgatgagcgatcatgggcggcgacccgagacccaccggagaggccgccatgaagctgcgctgcgccgtgatcgacgacttccagtccgtcgccaccaccgtcgtcgactggtcgcccgtgaccgccgacgtcgaggtcgtgtcgttctccgagcaccttgccaccgaggacgcagcggccgccgctctcgccgagttcgacatcgtggtcaccctgcgggagagggttcccttcccggcggacctgttcgcccggctgccccggctgcggctgctcgtcgcctccggcatgcgcaactccgtcatcgacctcgacgccgcggagcggtgcggcgtcgtcgtctgcggcaccgccagctcctccactccgcccgtcgagctgacctgggcgctgctcctcggtctggcgcgcgggatcgtccccgaggcggaggccctgcgcacggacggcccctggcagtccacgctcggcgccgatctgcacgggcggacgctcgggctgctgggactcgggaagatcggcggccgggtggcgcaggtgggccgggccttcggcatggacgtcctcgcgtggagccagaacctcacgaaggaacgtgccgacgaggtgggggcgcagctcgccgcgtccaaggaggacctgctggcctccagcgacttcgtctccgtccacctcgcgctgggcgaccggacccggggcctgatcggcgcggccgaactcgccctgatgcgcccgaccgcgtacctgatcaacacctccagggcggccatcgtcgacacggacgccctgctcgccgccctgcgctccggcgccatggccggggccgcgaccgacgtgttcgacatcgagccgctcccggccggccacccggtacgtacggccccgcgcctgctcgccaccccgcacctgggctatgtgtcgcgcgccaactacgagacctactacggccaggccgtggagaacatcagggccttcctcgacgggcagccggtccgccgcctgggctgacggcggaggtccccatcgcaggcttcggtcagtagcgcagcgccgccgcgatccggccgtgctccgccagtgagtcgtcctcgacgaagaccacgtcggcgccgctgtccagcgccgcttcgaccagttcgtcgacgatgtcctcgcggatcgtgccgtccgcgctctgcgtgctcccctcgggcaccggctccaggtgctcgtcggtcacctgaacggccgcctggaagtgttcctccaccgcgaccaggcccgcccggccctcacggacggcggcccacacctcgtcgagtccaccggcgaaggagtgggcgctgcgggcgttgtcgagccgggtctccacctccgccgccgcccggcgagcgccctcttcgagggcgggccgcagctctttgatgacctcggcgggcgacaggtcggccggcgcgcccttggtgacccggccgacggccgccccggagctctcgccgacctcgtccagcagggagagggcgggggcgaggcccatcagatacagcgggcgcgggtcgtcggcgagcaccgcgcgcagcttttcgtcgaccgtacggaagaagttccgcgtctcctcgtcgctgaaggtgctcggggtgtccccgatccgctcctcacgctgcgggttcggcggttccttcggcgcggtcagcgggaagccgcccacctcctcggatcggatgccgtcgcccgtgccgatccacagcgtggcgtggtcggcggcgaccgtcagcacccggaacggccgggtctgggccttggccgcgacgaggttgcgggtgaggtaggtgtcgctgagcaccacccgttcgggcgcggtgcgcggaagctgccagatccagtactcgtcggtggtggcgaggagtaccagggagtccatcgccccgcgcgggtccacctcgcccgccgcccgctccaactggtccacgagggcggcccggacctcgcggccgacctgcgggtcggcgtcgagacggcgccctgcctcggccaccaggttccgcaggcggaccgcgtcctgggcgttgtcgggtgccttgcggtgggtcggcatggtcagggacagggccggatagggccgggtcgcccgcagctcccgcaacaggtcggcggtcagggcgtccgtatccatcgttccctcccaggactcgaacccgctcccgtatgaagcggatgcttcgacgagtcaattcataccttttgatcctaatatgagcgagttgttgcccttggagtgcgggaggttgcgcgatgtccacgctcaccgtgtggaagttccggacggccgacggcgcggagagcgtcgaggaggcgctgaaatcccttcagaaggaagggttgatcaagattctcgacgcggcggtggtcagctggcccgccgaccgggccaagccgcgcacgaagcagctgttgaacctcgtcggcgccggagccctcagcgggaccttctggggcatgctcttcggcctgatcttcctcatgccgctgctgggcgcggccatcggcgcggccgccggggcgctcggcgggaagctcgcggacgtcggcatcgacgacgacttcatcgccgaggtcaaggagaaggtgacgcccggaacctcggcgctgttcctgctgaccatgaacgaggtgcccgagcggatcggcgcacagctgcccggtgacggcgccgagctgctccacagcaacctcgacaccgagcgcgaggcgaagctccgcgacatcttcggcgacgagacggcgtgacccgcgcagagccctccacctcgctcgcatcccctctcctggattggacggaccgtccgtgaaagcgaaccttcccgtgcgccgtacccgccccgccgtacgcgccctggcccccgtcgccgtcgcggccctgctgttcgcctccacggcggcctgcgactccgacaccagcggcgaaggcaccgaccagggcgtccacaccctcacacccgagccggaggaatcgccgtccgaggcgccgagcccgcgcacccagcgcagcttcgccgcctcggtgtccgccgagaccgaacgcgtacggcaggaggcggccaagcggctggaggaggtcgagggacggggcaacgccgtcggcgacgtctcggtcaacgggcttccgctcaccgcgtcggaagaggtccgcagcgcgctcgtccgggtcaccaaccccaccgacgaggcgacgttcttcgccgtgaaggtggagttcctcgacgccgaggacaaggtcctcgacaccgtcgtcgtcggcgtcgaggacgccccgccgggccgcacggtcaccgcccaggccaacagccgcaaggccgccggggtgaagaccttcccccgggtcgcccaggccgagcgcggctgagggggcgcggcccatgagcgccgccgacgcggtgaccgactccctccggagtctgcgcgaccggttcatcgacgtacgggaggggaagccggccgactacattccccagctggccctcgccgacccggacgccttcggtctcgcgctggtgagcatggacggacaccgctacatggcgggcgaggccgaggtccccctcaccctccagtcggtctccaagccgttcgtctacgccctcgcgctctccctgctcggcctcgacgaggtgagccgctgggtgggcgccgagccgagcggcgaggcgttcaacgccatcagcctcgaacccggaacgggccggcctgccaacgccatggtcaacgccggtgcgatcgtcaccaccgccctgatccccgacaccccggacgcatcagccttcgaccggatcctgcactgcctcggctgtttcgccgggcgtgaactggacgtcgacgaagaggtgttcacctcggagtcggtgaccggcgaccgcaaccgcgcgctggcgtacctgatccgctccaccggcaccatgccggtcgacccggtcctggcggtcgaccgctacttccgccagtgcgcgatccgcgtcaccgccgtcgacctcgccacgatggccgcgactctcgcctacggcggcgtgaacccggtgacccgcgagagggtcgtctccgccgaggtcgccgcccgggtcctcgccgtcatggcgacctgcggcatgtacgacggctccggcgaatggctgctgcgtgtcggccttcccgccaagagcggggtgtccggcggcctcatcgcggtgggtcccgcccgtttcggggtggcgacgtacagcccgccgctggacgccaccggcggatcggtacgcggccacgccgcgctggaggcgatgtcggaacgctacgggctccacctcatgctcaaccccgcgctccccggctccaccgtcaccctcgtcaccaccgcggacgacctgccgtcggcgccctcgtccgggcgcgaacgggtgctccgcgaacaggtcggcgtcgtcgtcgcccaggggtccatcgacttcacggccgcggagcgcgtgctgtacgccctggacgagtccgggccggacgggggctcggtggtgctggacctgcacgacgtcacgtccgtcgactccgtggccctggcgatgctgcacaccggtctcgcccggctcgccgccgacgggcggcgcgcggcggtcgtcgatccgaacgatctgctgggcccgcccgacctcgtgcgggaacggaccggccaggacctgccgcgctacgccacccgtgaaggcgccgtcgaaggctgcgcgcaggccctggccggggagggctgagccgggactgccggtctaccagatggagccgacccactcggggtggtcgatgaacgggttccggttgtgctggaactggtcgaatatgacgtcgttgcggcgcttctcgaaggtgtccggcgggtcttcctggctccactgcttcaggacggacagcctgcccatcttcggcgcggacccgttgttcacctggtcgttgggttcgaggtcggcgaaggagtcgttgccctcgtagcgcaccgccatgtagaggatcatgcgggccacgtcgcccttgacctcgtcgcggggttcgaaggagtcgccgtcggtgaagttgccgggagcgtcgcccagttcgctcccgccgttgtcgaagtccttgttcccacgcgtggagttgacctggacgtcggtgggccgcagatggtggatgtcggtgcccgggcccgttgccgtgccgaagtcgccgtgcgacttggcccagacgtgctcccggttccactggcccgagttgccgccgttgtcgttcttggactgggagcgcccggtgtacagcaggacgacgttggaggagttggcgggatcctcgtcggtggccttgagggcgtcccacacctggctgtaggagagcttggtctggtcgctgatgatcgtgttcagggcggatttcagctcggcgccggtcttgccgagcgcgtcctggtagtaggtgtcgtcgagggccgccgcggtggcggtgaaacgaccgggcgaggcgtccgacggggccgcggcagcggtgccggcgagcacggtgacggctgccaccgcggcgagcagtggacgcgcgtagaacgagtgacgacgggacatgtggggtgtcctctccggaacgcgggcgtcgcgacgaggaccctgggtgggggtgctcgcacggcggccgtgcggtaggtggtcaggcgggagccttccacacgcaccgtgccccacgtgtgaacactgtgtacctatcatgtgcaggtcaagaataggtgcgccgggagccgtcggggacgccgtacgccccggtgacccagaggctccgggggcgtacggggtctgcgggacgtacggggtgttccgtcccctaccggccggccgcccagtcgcgcaggtcccggaccgagtcgaagtcggccacgttccggtcgagcggatcgtcggtgaactggtggatacgccaggccgcctcgatgcggggcctgcccgcggccacgtagtcggcgatccacagcccgtcgcccgcgtagccggtggtgtcgtggttgagccagaaggagcggttgcagtacaacaggacccggtggtcgggccgttcccgcttcaccgcgcggatgaaccggtccttgtccgcgttgctcgcccgcgttccgccgcctgtctgttcccagtcgaccgcgagaagatcgcccgccttctcgggggtcttgctcaggaagtacgccacctggtccgccacgtcccccggccagaggaagtggtagaagccgacgacgcactcggcgtccctggcccttttcacctgcgcgtccatacgcggattgacataggtgcggccttcggtggacttgatgaggacgaagtcgagtccgtccgtgtcgtaggagggctgataggcgctgacgtcgacaccgtggagcatgggaaccgcctcggaggatggggcaacgacctccctctcctgcccactccccgggtcccccaagggctgattcaccctcccgggtaacgggtgctcgctcctcggatgcggccgggtccgcggggggcgagaattgccgcaaggacgaggaggcggcatgagcgaagagcccgaatccgtatccgcggccgtgtccgggccggagggcgtcacgcccgaccggctcctgcacacgggcgcgagcgaccggccgagcgccgaggacctggtgctcgcctccgggcgggacctgacgccggagaccctggaatgggcacggcgcaagctggcgaccgagggacggtcggccatcgacaaacaactgccctgacggcccggcgcggcccgcgggcgcacccggtgggcgggtgcgcggagccgtgcgccgaggtggagcggccggggagccggggagcgtgtggggcgcacccggctccctcggctagcctgagtgacatatgaaccgtttgacgacctcacagggcgctttcgagctcgcccgcttccccgagcacccgcgcgaccccttccgggcgtgggacgccgccgacgaatacctgctccggcagctgacggaccccgagacgggcccggtcgacctctcggggacggtcgcggtcgtgggggaccggtggggagcgctcgccaccgcgctggccgcccatcggcccgtccagatcagcgactcctacctggcccggcgggcgaccctcgccaacctcgcccggaacggtctcgaccaggacgcggtccgactgctgtcctcgcgcgacaccccgccggaccggatcgacgtcctgatcgtccgggtgcccaagtccctggcgttcctggaggaccagctccaccgcgtcgcccccgccgtccatgccggcaccgtgatcatcggcaccggcatggtcaaggagatccacacctccacgctcaagctcttcgagcggatcatcggcccgacccgcacctccctcgcggtgcgcaaggcgcggctcatcttctgtaccccggaccccgctctgccgcgtaccccgagcccgtggccgtaccgctacgagctgcccgccgacgtgggcccggtcgccggactgaccgccgtcaaccacgcggggatcttctgtgcggagcgcctcgacatcggcacccgcttcttcctgaagcacctgcccacccggtccggggcggtccgggtcgtcgacctggggtgcggcaacggggtcctcgggctctccgccgccgtcgccaaccccgaagcgcacctcaccttcgtcgacgagtcctacggggcggtcgcctccgccgaggagaccttccgggccggtgcgccggacggtgcgaaggccgacttcctggtcggcgacggtctcgacgacctcgtcccgggcagcgtggacgtggtgctgaacaatccgcccttccactcccacatggcgaccaccgacgcgacggcccgcacgatgttcgccggggcgcggaccgctctgcgccagggcggtgagctctgggtcgtgggcaaccggcacctctcctaccacacccacctgcgccggatcttcgggaactgcaccacggtcgcgggcgacccgaagttcgtggtgctgcgcgccgtcaagcgctgaccgcggggcggcgcaccgcacctgaggccggcagccggttcgcgcgactgccggacgcacgccggcccttccggattcttgcaacacgttctactgtgtgcgccgccgcacacggacgacgccgtagcgagactctggaggggccgtgcacctcgaatacacacctgagcagcagcggctgcgtaccgaactgcgcgcctacttcgcgaccctggtgcccgacaacgcctacgcccgctacgcggagcccgccgcacagaagcgcttctaccgcgacacggtccgcaggctcggcgccgacggctggctgggggtcggctggccgaaggagtacggaggccggggcctgaccccgatggaacagttcatcttcttcgacgaggccgcccaggccggcgtaccgctgccgctgatggcgctgaacaccgtcgggcccacgatcatgcagttcggcaccgacgagcagaaggcccacttcctgcccggcatcctggccggggagatcgacttcgcgatcggctacagcgaaccggacgccggcaccgacctcgccgctctgaagacccgcgccgtccgcgacggggacgagtacgtcgtcgacggacagaagatctggaccaccaacggcgacaccgccgactgggtctggctcgctgtgcgcaccgaccccgacgccccaccccacaagggcatcaccatgctcctcgtccccacgagcgacccgggctactcctgcaccctgatcaacaccctcgcctcgcacgacacgaccgcgagctactacgagaacatccgggtcccggtgtcccgccgcgtcggcgaggagaacaagggctggcggctcatcaccaaccagctcaaccacgagcgcgtcaccctcgccgcccacggcacgatggcggtccgcgctctgcacaacgtccagcgctgggcctccgacaccaagctcgccgacggccgccgggtcatcgacctcggctgggtccgcgccctgctcgcccggacacacacccgcctcgacgcgatgaaactgctcaactggcagatggtcgcggctctccaggacggcacgctcaccccccaggacgcctcggcggtcaaggtctacggctccgaggcgcgccgggacgcctacgcctggctgatggaggtggttggctccgcgggcgcgctgaaggagggctcggccggtgcggtgctccacggcgagctggaacgcggctaccggtcggccgtgatcttcaccttcggcggcggcaacaacgagatccagcgggagatcatctcgtggatcgggttggggatgccacgcgtgcggcggtgagcgtggcatccccaacccga

SEQ ID NO: 3074 - DNA, 2937 bp, Unknown
  Kingdom: Bacteria, Phylum: Actinobacteria, Class: Actinobacteria, Order: Streptomycetales, Family: Streptomycetaceae, Genus: Streptomyces
atccacgacgacatcatggacggcgacgagacccgtcggcgtcggccgacgctgtggaaggcgtacggcacgggtccggcggtcctcgcgggggacgcgctgttcgcgctggccgtctccacgctggcggaggctccgggtccgggcggcccggcggcggtccggcaactggcgggcgaactgggcgatctggtgagcggcgaggtcgacgtcgccggccggaccacggtcctgcgcacggtcggcatggcgatcgaggacaccgccgccgcgctggcgctgttcgaggagtgcgatacggccgagcggggaacgggcggcccgactgccgttccgtcaccacaggagggagagtcggatggacacgcatgaggacctcggtccgggaaacgggcacccctggttcggcggccaccggctgcggcccgccgcgtcggcggacacgatccggcagatgctgcggcacgagctgagggacaccggctggccgcaccagagggtccttcccgcggcgccgatgacgatcccgcgcgcggcctacgccgagatcttccgggcgagcgtcgcgctggtcgatctgttgcgccgtgccgccctggagagcgggcacaccaccgccgaccggctggcggcctacgagatgcccgccgccgaggaccggctgtgggtgagtgacccgttcatcgaggagcggtacgccgactccgtggtccgtccggatctggtcatcggacccgatgggccgcagttcctggagttcaacgtcagcggtgcgctcggtggcgtggtggagacccggagccgtctggcggtgtggcgcggactccacgccgacgaggagggccgggtgccgttccggtcgccgagcccgttcgccgtacgcgccgagatgttccggtcgctcagcgcggagctggccgtggcgccgagggtggccgtcgtcggcagtgcccgggtgaccggcgtggagcggcggtacttcgagatggaggccgactactacaacagccacggcctgaccgcacgcttcttcgagccggaggaactgcccgaggcgtgggactgcgccccgcatctgcgttatccggtcggcctgcggaacttcaccattccggactggctcgacgcgggcctcgacaccactccggtccagggcgccctggaccacggctgcctgctggtggggacccagacctcgaccttcctgcacagcaagctcaccatggggctgctgtcggagggacggccctggatgaccgagggagaccgcaggctcatcgagcggtacctgccgtggacacggatcctctcggagcgcaggaccgaccgcgaggggcagcaggtcgacctgctgccgttcgtgctgaagaaccgcgagctgctggtgctcaaagccgccctcggcgagagcggacaacaggtgatcatcggccgcgaggccgatcaggcagcatgggagtccgccgtcggcgaggccgtccagggccgcaccagcgtggtgcaggagttcgtgcagccgcagacctgccgggtcgcgctgatcgccgacggggtcgacgagccgtacgacgccgaggtcgccccggtgctgggacctctgctgttcggcggccgtccggccgggctgttctgccgcttcttcggcgacggttccgccgggatcgtcagtgtccgaggaggaacgagcagctccgacaacgtgatggtggcgatctgacggcagcaccccacacgctctgcccccggcgccgcgtgccgtccgcgccgccgcccctcatcgagtgacatcaccggagagatgccgcatgaccctgcgtcacgtcaaggacaacgagtacgtcgaggagcacggcggggacttcgaggacttcgagccgggcatggtgatccgccactggccgggccgtaccctctccgaggccgacaacacctggctgaccctgctgacgatgaatcagcacccgctccacttcgaccagcactacggcgccggcaccgagtacggaagggtcctggtgaacagcggcatcacactgtgcctggtcggcgggatgaccgtgcaggcgctgtcggcgcgggcggtggccaacctgggctgggacaaggtccgtctgaagagccccgtcttcgtcggcgacaccctctacgcgacgagccgcatcctcgacaagcggctgtcccggtcccggccgggtcaggggatcatcacggtggagacgacgggcacgaaggcgacgggagagaccgtcatcgtcttcgagcggtccttcatggttcgctgccgtgagctgcccgacccgccgacggatcagggatccggggatacgaccgccgctgccgacggcccgcccgcgtagagcacggagccgccggccccgtatcgccccgtgcccgcagttcacggccggccccccacccggccgcccgtgaactgcgggccgcgtgccccgccgctacgctcgaacgatggaagacagcggagccggctccgggccgccgaacggcgccgacgcccaggaccctgcggtacaggcccggatcgtcgccctggtggaggaatggtccgccgcgatcgtctcgaacgatgtgccgcggatcagggccttcatggcggacgagtgggtcatcgtctccgggtccggcatcacggatcaggacgcgttcctcgactacgtcgcgtccggcgacctgacccactcggccatgcggacgatcggcccgtcgagggtccgcgtccacggggacaccgccacggtcaccgcacggatgacgaacaccgcccactacggtggccgccgtttcgacgccgacgagtgggtcacggacgtcttcgtccgccgcggcggccgctggctgtgcgtgctcacccacatcacctccgccgccccggcggacccgccgcccgacgcatgagtccgacgaccggctccgcccacc

SEQ ID NO: 3075 - DNA, 4172 bp, Unknown
  Kingdom: Bacteria, Phylum: Actinobacteria, Class: Actinobacteria, Order: Streptomycetales, Family: Streptomycetaceae, Genus: Streptomyces
cgtggccgcgaccgccgcggcggtcaccgcggcggtcgcggccacgccgaggacgacgagcagcagcttcgtgcgctcgacgcgtacgcccagcatcgccgccgcgtcgtcgcccagttcgagccatcgcatccggcgctgcgccaccggggccgccagggcgaccaccgccatcagcgcggaggccatcagcacggcgggccagccgatggcgctgagcgaaccggcgccccacaccgcggccctcagcgcggtgtccacgtcggccttcaccgagaaccacgtgttgaccgaggacagcagcgcaccgaccgcgatccccacgatgatgagccggaaaccccgcacgccccgacggaacgccagcagatacacggcgagggcggtgacgagtcccccggcgagggcgcccgccgcgagtgccgcgtaactgctcgcacccgcgagcagggtgacgacgactccggtgtaggagccggtcgtgaagccgatgacgtcggggctgccgagcgggtttcgggtcagggactggaagaccgcgccgcccatcgcgagggcggccccgaacagtacggcggcgacgatgcgcggcgcccgccactccaggacgacggtacggacgctgttcccggcggtgccggacatgaccgaggccaggttgccgaggctcagcgagtagttgccgagggtgaaggcccacagggccagcgcgagcagcgcggccgacagcagcccgcacaccgcgaccccgcggcgggtcgctcgcaggctcagggtccccgccctgaggacgaatgccccgctcacagttccctcacccggcttccgcgcaccagcaggatcagtacgggcgcgccgatgagcggcatcatgacgccgacctgcaactcggaggggatcacgatcagccggcccagtacgtcggcgaacagcacgatcgccggggcgaggacggcggagtggacgaggatccagcgccagtcgggaccggtgagccatcgcacggcgtgcggcaccaggagaccgacgaacatcagtggacccgccgcggccgtcgccgaaccgcacagcagggccaccgcgatcaccacaccgcaccgggtcgcgccgacccgcagcccgacggcccgcgccgcgtcgtcgccgagcgcgatcgcgttgagggggcgcgcgcagaaggcggcggccagcaggccggccaggacgaagggcgcgatgtcggcggcggtgcccgtcgggcggtcggtgatggtgcccgctccccagaacctcatacggtcgaaggtctccgtgtcgatcagggcgagggtctgggagatgccgagcaggaccgccgtgaacgcgaccccgacgagggtgaggcgcaggggtgtgggcccgccccggccgccgctcgcggcgaggtagaccaccgccgagccgacgacggcgccgacgaaggcgaagggcaggtactggtcgatgcgcgtgacgccgaagacggtgacggcgagagtgacggcgaagctcgcgccggcgttgacgccgaggactccggggtcggcgagcggattacgggtgagcgcctggatgagcgcccccgccacgcccagggacgcgccgacgacgatgccgagcagcgtgcggtccacgcgggcgccgctgatcgtggcgtgcgaggcggagccgtcgggagcggtcagtgcctgccacaccacgtcgaggggaaggagtgccgagccgatcgcgacgctgagcacgaccgccacgaggagcgtgccgacggcgacgcccaggccgaggagccggcgggtcctgcggcgcgaagacctcgacggcgtggccggtggtggcgcggtggtccgtgcgagcgcctgtgccatctgttctccctgtgcaacccgcccccggacaggccgaagtgccgtgcgtgatcgacgtacatgaactgctggaactgcccggctcccggttcagcggccgccgagcgcccccaccgcgtccgtggtgagcgcgctcatgggtaccccggactcccggctcagcgcgcgcagcagtccggcccgggtcgcgtagccggccgccctggccgccgccgtcagctctcccccgccgcggaggtgttcgacggcggcgttcatcctggcccggttgcgccaccgtgtgaagggcagtccggtctcgtcgaggaagacgcgctgcacctggcgagggctcatccggtgctgttcggcgagccgttccagggtcgcggagggagcgcgcagggcctcgcgggcgagaccgcgcaccgcgggatggacgggcagcacgaccgggaagaactgccgggagatgcccttcagtacgcgtcccaactcctgacggaacggctcgacctgttccggcgtggtcggcgccgcgccgagtgcggtggtcatgacctcgacgatcgcgggtaccgccccgagcagctgaactcggcatcgtggctggtcaacggggtcgagcaaggggccgagtgccatgccgcccggctcgatccgcagcgcgtgcggcacgcgcggcgcgagccagatggcctcgtgccgcccgagccgccactcctcgccgtcggcggacaggcgggcgctgccggtcaccaggtagaccaggtgcggcgcgtcgtgccgatgcgtgtcgtgccccagaaagcgaatggcgttctcggcgaccacggtgccgagggatgtcgtcggcaagcgtgcctcccgttgtgcggtgcgtcgtgtccgtcactggcgatgtcgtactcggatcgacgcagcggaaccagcgaggttagcctcaccttaccaacagctcgaacgttcgagcctatccagccacatgaggtcccatgtttgctcctgcccgccttctcaccgtcgcggtcgtcgccgcgctggccctcagcggctgctcggccgccgacccgtcgggcgacggggacaaggcctccgccgcgaagacccgaaccgtcaccaccgactacggcaaggtgaaggtgccggccgagcccaagcgggtggtcgtgctgaaccacgccctcgccgggtacctctacgacctcgacgtgccggtgcacgccacgattcccgaggacgccgagggcaatggcgagttctccccgtactgggagaaggaggcgaaggaggacgggacgacgttcctgccgtggagtgtcgacggcttcgatctggaggcgatcctcgccctggagcccgacctcatcgtcggcggcggcatcggcttcccgctgttccaggcggagaaggtgtacgacgacctctccgacatcgctccgaccgtgctggtgggcaagaagctcggcgactggcggagccagttctccttcctcgcggatgacgtgttcggcaaggccgacgtctacgacaagcacctggccgcctacgacaagcggatcggcgaggtgaagaaggcgatcgagccgccgaccggtccggtgtccttcctcaccttcaccggggacggcaccgccttcggtctggtggagagcgtgggcctgccccccgagctgaagaaggtcggcatcgagccggctccggtcttcgccgacggcggtttcaaggtgtacgggcagggcggcgacatgttcgagctgtcgaccgagaaggtgggtcagacgatcacccagccgtccgtgttcgtgatgggcttcaacggcgacacgaccgacgtcgccacgctcaagaagaaccccgtctacagcgcgctgcccgccttcaaggcgaaccaggcctacgacctgccgtactgggtgctgcgcggcgactacgacgagtcgatggccctgctcgacatcatcgagaagcagttctcctgatggccgcccaacgcgcgtacacgacgcaccccctcgtcctgcgccgggtcaccgtgcgccgcgtccacgaggtgacccccaggatgcgccgactggttctcggcggcgacgacctcgcggcgttcacccgcgacgggaccgcccaccccgccttcgccgcacccgggttcgacgaccacatcaagctgatcctggccgccgacggggacgtccgggcggcgctccccgcccagttgccgcacggcatcgagtggacgccggccgaacaccggctgacccgcgactacacgccccggcgggtggaccatcgggcgggagagcttcacctcgacttcgtcgtgcacggcga

SEQ ID NO: 3076 - DNA, 1603 bp, Unknown
  Kingdom: Bacteria, Phylum: Actinobacteria, Class: Actinobacteria, Order: Streptomycetales, Family: Streptomycetaceae, Genus: Streptomyces
gtcgaggctctgcgcgaggcgctgaaccggccgagcctcgcgcagagcctcgacgacctgacgaccaccggagtgccggtcaccctcaccgaggacggcaaggtccggcggggccaccacacgctcatcctgcgcgcccgcctcagcgaccggcggttcgagaccaccctcagcgaacgctcgctgcgcaacgccgtcatcggcaccgaggtctccggccaggggcaacaggagtccaccaccctctccgccggcgtcgaactgggcatctcgccgcgcgaccacgacaaggaccccggcaccgggctgccccgccaggcgggcaacgtctccctgggcgcccgtcacgcgcagacgcgcacccgcgccaccaagaacaccgtcgcggtagcccacgaccagctgaccttccagaacggcgccgatctctacagctaccaggtggagttgggcgccactttcgagggccatcgccgcccgcgcggctggacccggctggtctcggtggggctgctgggtgcgggggtcttcgtcagcaggatcggggagcggtcgctgttcacccggggaaccgagaccgtcggccgggtcgagctggccgtaccggcagcccacggctccgaccgtcacgcccccgccgaccctccggccaccggccccgcaccgtcgcccgccaccgccaccgtgccgcgtcccctctccgccacggatgcggaccaactcctcgacggcacgccgcccctgccccggaccagcgcgtccgaccggcagctcgtgaacaagctgctcagcgccccgcacgtggtcctcagcgccgagggcggcgagcagcgccagcggctcgtccaggacaccgccgaccgcgccaccggcacctcctggcacgtcagcgcgcccggcaccccgatccgcaccgccctgcgccgggccatggccaacctcggcgtcgccggacaactcggccaatacctcggcccgttcggctcccgcatcaccgggctcaccggcgcgggccccttctcgacccactacctcaaggcggcggtccggggtgagctcgacaacgtacgcgtcaagagcgacccgaagccgggcagtctcgaagccacgatcggcaacgagcaccgcgtcgccggcacctccggcagcggctcccggaccaccctcggactccagggcgccgtgaccccggtgcagcgggcgccgggccaacaggcagtagtgggtgcgtactcgaccgctctccagtacgcctggggcaagggccgcagcgtttcccagaccctcacccggggccgcaacaccaccctcagctactccgggcggatgtacctggtggtcgccgacgccgccgagaccgtggccgtacgggaccgctggacagccgcgatgggggccgtcggcacccgctccgggggccggatcggcgccgcggccggccggatctccgaccggctggggcgcggcctctccccgcgccgggccgccgccgcgctccagcgcatccgcgacgcggtgatgttccacctgccgatgcgggacgccatcgaggccggactcgcccccgacggcctcggcacccgcacaccggccaacctcggcg

SEQ ID NO: 3077 - DNA, 5017 bp, Unknown
  Kingdom: Bacteria, Phylum: Actinobacteria, Class: Actinobacteria, Order: Streptomycetales, Family: Streptomycetaceae, Genus: Streptomyces
ctcgaagacgtcgcgccgcggcagccgcccgtaccggccaggagggcggccgatgacgcggcgcgacgtcttcgagtacgcgctcctgcgcgtcgtgccccgcgttgagcgcggggagtgcttcaacgcgggggtgctcgtctactgccgggcccactcgttcgtcgccgcccgtacgcacctcgacgaggcgaagctgctcgcgctggacccgcgggccgacgtcgtcggggtgcgggccgccctgcgcgccgtcgagggagtctgtggcgggggtgagggcgccggtcaggcggcgggtgacgacgccgggcggcggttccgctggctgatcgccccgcgctccacggtcgtccagcccggccccgtgcacagcggcctgaccaccgacccggccggcgaggtggaacggctgctcgacctcctcgtgcgctgatccacgcctcggcgggaccacgacggcacagcggcgggcgctcccgcccggtgtgacgtgcggcccgccggggcgtgcgccgttgacaccgggtgccagggcttctagcgtctcgtctgctgaaggtactaagcggttgctcagcgatcgggagtctttctgtcagggaaacgccccgacgtccgctgagccgcgatccaagggcgaggagaaccaagcatgtccaccaccgagcagcgtgtcgccatcgtgacgggagcggcgcggggcatcggcgccgccaccgccgtacgtctcgcggccgagggccgttccgtcgccgtactcgatctcgacgaggcggcctgcaaggacacggtcgagaagatcaccgccgccgggggcaccgcgctcgccgtcggctgcgacgtgtcggacgccggtcaggtggaagccgccgtcgcgcgggtcgccgccgagctgggcgcgccgacgatcctcgtgaacaacgcgggcgtgctccgcgacaacctgctgttcaagatgagcgagtccgactgggacctcgtgatgaacgtgcacctcaagggtgcgttcctgatggcgaaggccgttcaggcccacatggtcgaggccaggttcggccggatcgtctcgctctcctcgtcctcggccctcggcaaccgtggccaggccaactactccgcggtcaaggcggggctccagggcctcaccaagacgctcgccaaggagctcggcaagttcggcgtcaccgccaacgccgtcgcgcccggcttcatcgtcacggagatgaccgcccagacggccgcccgcgtcggcatgggcttcgaggagttccaggaggcggccgccacccagatcccggtccagcgcgtcggccgtcccgaggacgtcgcgaacgccatcgccttcttcgcgggcgacgacgcgggcttcgtctccggccaggtcatgtacgtggccggcggacccctcaactgatccgaagggcagcggacatcatgacggtgcaggacagcggaaaggtcgccctcatcacgggcgcgagccggggcatcggctacgggatcgccgaggcgctcgtcgcccgcggcgaccgggtggccatcaccggacggggcgaggacgccctgaaggaagccgtcgaacggctcggctccgaccgggtgatcggcatcgcgggcaaggcgcacgacgaggcgcaccaggcggtggcggtcgagcgcacgatggaggccttcggccgcgtcgactacctggtgaacaacgccgggacgaatccggtcttcggccccatggcggagctcgacctgaacgtcgcccgcaaggtctacgagaccaatgtgatctcggccctgggcttcgcccagcagacctggaaggcctggcagaaggagaacggcggggcgatcgtgaacatcgcctcggtcgccggggtctccgcctcgccgttcatcggcgcgtacggcatgagcaaggcggcgatggtcaacctgaccctccagctggcgcacgagttcgctccggtcgtccgggtcaacgccatcgccccggccgtggtcaagaccaggttcgccgaggccctctatgaagggcgtgaagcggaggccgccgccgcctacccgctgggccggctcggcgtgcccgaggacatcgggggcgcggcggccttcctcacctccgcgcagtccgactggatcaccgggcagaccctcgtggtcgacggaggaattttcctcaacgccggtgtgggctgaggcggcctgagccggtttggccccgattgagtcaagtgccccgccgggccagcggattgacccggtggggcgctgcggtatggtctgccgacccatggctgatcgaggagcgtgcacgtgttctaccgggccagtctgcaggctgctgcagccctagcttccctttctctgctggccggctgcggtctcttttccgacagcggatcggaagcggagcggaagatagtcgtcgggacgaccagctccccgtccacactcgatccggcggcggcctgggacaactcctgggagctgatgcggaacgtctaccagaccctggtgagcttccccaccggcaccacgagcccggagccggacgcggcggactcctgcgagttcaccgacgccacgagcatggcgtaccggtgcacgctcaagaagaacctcacgttctccaacggcgagaagctcgacgccgaggccgtgaagtactccatcgaccgcatcgtggacattcacttcaagggcggcccggccgggatgctcggctccctggaccggatcgagaccaagggcgacgacacggtcgtcttccacctgaacaagtccgacgccacgttcccgttcatcctggccacgcccgccatgtcgctcgtcgccccgggcgactaccccaaggacaggatccgcgacgacggcaaggtcaccggctccggtccctacctcctggagtcctacgacgaccgggtcaccgccgagctgaagaagaacccggactacaagggcttcgccgaccggaagaacgacgcggtcaccatccgctacttcgacaagtccgccgacatggtgaccgcgctcaaggcgaaggagatcgacgccacctaccggggtctgaccgccgaggaggtcgtcagcctggaggacaacaaggacgacaacgccggcctccagatcgtcgagagcaccggcgcggacatccgcttcctggtcttcaacccgaaggacccggccgccgcgaaccccgccgtccgcaaggccgtcgcccacgtcgtcgaccgcgacgccctggtcgccaaggtctaccggggaaccgccgagccgctctactccatggttcccaagggcatcgccggacacaccacgagtttcttcgacaccttcggcgacccggacgtgaagaaggcgaagaacatcctcacccgggccggcatcaccaagcccgtgaagatgaagttctggtacaccaccgaccgttacggctcctccacggagcccgagttcgaggagctcaagcggcagctggaggactccggactgttcgagatcacgctgcagggcgagccctggaagaccttccaggaaggcttcaacaagggcgagtacccggtcttcggccgcggctggttcccggacttcccggaccccgacaacttcatcgcccccttcatgggcaaggagagcgtcaccggcaccccgtacctcaacgaggagatcacccagcagctgatccccgcctcgcggcaggagagcgaccggggagcggtcagcaagcagttcgagcgggcccaggagatcctcgtcgacgacgtccgtctgctgccgctgtggcagggcaagctgtacgtcgccgcgggcgaggacatcggcggcggcgagcgcgcactcgacccccagaccgtgatgcagctgtgggagctgtaccgcaaggccagctggtagacgccgcacggaagggctcccggggccggttgtcagtggcgcccggtaggttctgggatcaagaacctgttgctcaccggaggttgtggacgtgaccgatatcgacctgctgcccgagtcctggcgcgctgtcctcggcgaagaactccagaagccgtacgtcaaggaactggcggacttcgtcgaggaggagcgggccaagggtccggtgtacccgccgcgcgagcaggtctttgccgccctggacgccacgccgtacgagaaggtgaaggtcctcgtcctcggccaggacccgtatcacggcgagggccagggacacggactctgcttctcggtgcggcccggcgtcaggacgcctccgtccctgcgcaacatctacaaggagatgcagcaggagctcggcctgcccatcccggacaacggctatctgatgccgtgggccgaacagggcgtcctcctgctcaacgccgtgctcaccgtccgtggcggcgaggccaactcccacaagaacaagggctgggagaagatcaccgacgcggtgatccgcgccgtcgccgaccggcccgacccggcggtcttcgtgctctggggcaactacgcgcagaagaagctgcccctgatcgacgaggagcgccacgcggtggtgaagggagcgcatccctcgccgctctccgccaagaagttcttcggctcccgtcccttcacccagatcaacgaggccgtggccgcccaggggcaccagccgatcgactggcggatccccgacctcggctgacgggccccgaggcccgtgtctgaccggttgtacggaagcccggcgttagcgtcggaccgacggcaaccggctggacgggcgacgaggagaccgcagtggtggagcagcaggaggcgtccgacgacgccgtcatgaccaggatcggccaggcgatcatgctgctccacggaggtgaccgggaggaggcccgcaaccgcttcggcgcgctctggtcggagctcggagcggacggcgacgccctgcaccgctgcaccctcgctcactacatggccgacacccaggacgaccccggcgacgagctggcctgggacctgcgcgccctgacggccgccgacgggctgggagcagccg

SEQ ID NO: 3078 - DNA, 947 bp, Unknown
  Kingdom: Bacteria, Phylum: Actinobacteria, Class: Actinobacteria, Order: Streptomycetales, Family: Streptomycetaceae, Genus: Streptomyces
gcccggtcccggcgcgagcgccggcgcggcgccgggcggacgctcacgattcgctcatgatcggccgtccatgatgtgggggcaggttccgaagcccacgcacgggagtcacgtatgtcccagcacgccgtccgtccgttcctccgccgcggaagcacgctcgccgctctggccggcggcgtcgtggtcgcggcgggagcgggactgctcctgtcccacgccttcgcctcggggtccgcggcgaaggccgcgcccgaggtcgtgccgcctgcggcgaacgtgaccttcgactaccagatcggcggcgcgtacaccccgtccgccggggtcggagcggtctcccgcgaccgtggcgacgagccggccgagggcctgtacaacgtctgttacgtcaacgccttccagacccagcccgacgcgctgggctggtgggagaagaacaaccccgatctgctgctgcgcgacggcgacggagacctcgtcaacgacaaggcctggggcgaggcgctgctcgacacctcgaccgcggaccggcgcacccggctggcggacatcgtcgggggctggatcgacggctgcgcgaagtccggtttccaggcggtggagccggacaacctggactccttcgagcgctcggaaggtctgctgaccccggagcacaacgcggcgttcgcgcaactcctggccgaccgggcgcacggcgccgggctggcgatcggccagaagaacaccaccgatctgctggagcagcgcgggaggatcgggttcgacttcgccgtcgccgaggagtgcggccggtacgacgagtgcgccgactacgcctccgcgtacggcgacagggtgttcgtcgtcgagtacaccgatcgcgacttcacgaaggcgtgttcgtccgtgggggcgcaggtctcggtggtgcgccgcgacctcgacgtccggccggccggacg

SEQ ID NO: 3079 - DNA, 2223 bp, Unknown
  Kingdom: Bacteria, Phylum: Actinobacteria, Class: Actinobacteria, Order: Streptomycetales, Family: Streptomycetaceae, Genus: Streptomyces
ggccgcggcggaggcggcgcggctgcgggccctggtggaccggatccggaccgtggtggccgagcgggtgcccgatgtcgaggtggtgggcgatccggagcggcggttgccgcatctggtcaccttctcctgtctctatgtcgacggggagaccctgctgcacgagctggaccggagggaattctccgtgtcgtccggctcttcctgcacgagcagcaccttgattccgagccatgtgctcaaggcgatgggggtgctctcggaggggaacgtccgggtgtcgctgccgacgggcacggccggggcggaggtggaccgcttcctggaggttctgcccggggtcgtcgccgaggtgcgcgagcggctcggcgccccggtcaccccgctcccgacgcctcactcccccgggcccgccgcctccctggtggtcgacgcgctgggccgccgctgcccgatcccggtgatcgagctcgcaaaggtgatcggggaggtagctgtgggcgccacggtgacggtgctcgccgacgacgaggcggcgcgcctggacatcccggcctggtgcgagatgcggggccaggagtacgtgggcgaggagccggcagacctcggctcggcctatgtggtccgccggctcagctgatcaggccaggtgctgccggacctcggcggcggcgtcgtggccgtacgccttggtgaagcggtccatgaagtgggtgcggcgcagggtgtactcctgggtgccgaccgtctcgatgaccagggtggcgagcatgcagccgacctgggcggcgcgctccaggccgacaccccaggcgaggccggagaggaagccggcccggaaggcgtcgccgacgccggtggggtcggccttggtgtcctcctcggggcagccgacctcgatgaccggctcgccgacccgctcgatccggacaccgcgggcgccgagggtggtgacgcggtggccgaccttggcgaggatctcctcgtcgctccagccggtcttggactcgatgagccccttctcgtactcgttggagaagaggtaggtggcgccgtcgaggaggatgcggatctcctcgccgtccatccgcgcgatctgctgcgagaagtccgcggcgaacgggatgttccgggagcggcactcctcggtgtggcggagcatcgcctcggggtcgtcggctccgatggagacgagatcgaggccgccgaagcggtcggcgacgttcttcagctcgatgaggcgggcctcgctcatcgcgcccgtgtagaaggagccgatctggttgtggtcggcgtcggtggtgcagacgaagcgggcggtgtgcagtacctcggagatacggaccgatccggtctcgacgccgtgccggtcgagccaggcgcggtattcgtcgaagtccgccccggcggcgccgaccaggatcgggttggtgccgagcaggcccatcccgaagcagatgttggcggccacaccgccccggcgcacatcgaggttgtcgaccaggaaggacagggagaccgtgtgcagctgatccgcgaccagctggtcggcgaagcggccggggaaggtcatgaggtggtcagtggcgatcgagccggtgactgcaatacgcacggggaggtttctcctgcggaaggcgaagggccgtgagtgcgccctccgggacgacgtgacagttcacgctaccgggtgagtcgacggccaggaaaagggaaaactacccgatagtagggctttctacctgagcgcgaccgtggttacggtgcggatatgtcgaagcacaccgcattgcccgagtcggaattgagcctggccgcactgcgcggtgactgcgcgcggatggcgccgcactggacggcggccgtgaagagcgacccgatcccggtgaagccgtccctgatcaacggggtgacggtcccgccctcgtcggcgcggctgatcgacgcgatgtccgagtacggcgactgaggaacggccggaccgggccggacgacaccacgtttcggcctttcccgtgcaggttccggcaggaagagtacggtgcccgtgcccggtcggccccggtcgcgggaaccgcacgctcctccgctccgtcccaccggtgtccccgtccggggagacgcggtaggcaccgcgacggcaacgcagtcgaaggagcgatccggtgagcaccgagcgacccgacaacgacgtgaccggcccccggcggcggcgtccgccgc

SEQ ID NO: 3080 - DNA, 9770 bp, Unknown
  Kingdom: Bacteria, Phylum: Actinobacteria, Class: Actinobacteria, Order: Streptomycetales, Family: Streptomycetaceae, Genus: Streptomyces
ccggggggaggcagggccggcgtggcagttcctcgagcactccgagaaccgccggtgggcggtcgctccggaagggccgaacgacgtcggctgcatcagtcgtcccgattcccgctgacgagaaggacgccgccgaggacgagcctccgtcgccgtgcggacgatccgcctcagacggtgtcgatctgcaggaactcccggaactccgccgtgccgacctgatcgttcagtgcggcgttccaccgcgcgatgtcgtcaaccgagacgtcggcgtcgagcggcaggaagacccggacggcgtttggccactgctcgaagaatccacgggcgacggagtccgtcaacgcctgtgagatggagtcccacaccgccctccggaattcgcgaaggcccggcacggcgacggggtcggcattcgcaccggtgaagcgttgcccggcccgttctgcctcggcgcggatgggcgccagcgggtcgtcgatcccctgaaccccggcgatgtccagatcccactcgccgaggtgccatttcacgtcgacggcgaactccgggtcctcggcggtcatctcgtcagaatgtcgccgcgaatgcgcgaaggcgacgatcgacgtggcgtcggcgtcggtcgcgatgccgacgccgaccacgtcgtccgccggcacctgtcctgcgaccgccaggacggcccgctcgaccgccgattcgaggcgatcggaccaatcgcgtgcccacgtgcggagctcaagatccatggccccattgttgactctccgaccggaacccgccgacgcccgacgaccccgtactcttcacagccatggtcaactggtgggacgtcgtgccggacaacgagcgacggcagtggtcgatggatccgttcgtggcggtggggccgctgcgcttcggcatgacccctgatgaggtgtcgacggccctgagtggcacctcgacggaatgtcagcaacgcactctgcaccagcctgatctcgacgccgccccgatggtcgtgaagggcagatactcggacttcggcctgtatctgcactaccgggaagagcggctcgcagcggttgtcgtcgacgcgcagcgcggacctcaagtcctcgcagacgaaacgccattggtggggagggtcccctcaacgattgagcagtggatgatcgaccgggccgaggctcacgacccccacgacgaacttgtctacagggacgctggtgtgcccggctcggaatcgtggggagtcgtggttgacgtacagcgagtcggcgaccgcctgctcactcgaccggtgttcgttccgtccgaagccatggacgacctgtcccactggcttccaagggacgcgtggtcacgttgttgaagactggctgaccaggccctgagccggagtcgaaccccgacgccggtgacggtgccgtccgccgcgcccagtccgacggcgacatgcggccggacgtggacactggcgacctggccctgctgatcgctgcgagcccgcgacgacaaccggcagctgccgtgccaggggatcaccatcgccgatctcgttcccggcggctaagggctgtcccgcacctggcgcagaacgcgatcggtgcgcgtgctggggcgggcgtcctttcggcctctggcgggtggctcgttcctccctcgccgtttcccgggccgcgagcagggcctggcgcgcgaggccgacgccggacacctcgccgccgctcacgcctgcccccaggatgcgtagccgagatccggttgcccgagcccccagcgggtcggggccggagtggccggctgccggtccaggtgccgggtgacggtggggctatccggcccatcaccccgtcgggtgtccgggaggcgacggtcaggatccctccgggccggcagacccggatcaactcgggtcagccgctcacgtgcagcccgaaacccgtgcgacccgcgggctccagtccctccttcaggtgcagtgacgggatctcgtagtcaccgaagttctgccgccggaacgcgatcggctcggtcgactccagggtgatcaggcgctgctcccaggccttggcgacgtccgggtagtcctcaccggtcagccggtcggtgccgtacagcacgaacggcggcagcacctggatacccgggtagtagaggatgccgtggtggatcgggaacagcagatcgtcgatggggccgttgatcccgcgagcggcgtaatgcgactccgggccgccggcggtcaccgacagcagggcccttttgcctgcgagggttccttcgccgaagcgctcgccgtacttggtctcgctgtgttcgccgacgccgtacgcaaagcggtaggtgaatacccggtccacccagcccttgaggatcgcgggcatgctgtaccaccacagcgggaactggaagacgatcgtgtcggcccacaacagcttctcctgctcggcgaggacgtccggggtgagcgtcccggcctcgaaggcccggcctgagtccagcggtaccttcagccgacttgaggcgttggggccgtagtccgcggcgtccacgaccgccttccagttcatggcgtacagatcgctgacccgcacctcgtgcccggcggtctccaatgtggacaccgcgaggtccttcagcgagctgttgagcgacttcggctccgggtgcgcgtagacgatcagcgtcttcatgggaactccttcggatcggatgccttcgatcctggacgtcacggcgcccggcgttcaggggcgcctcttccatcggacgggacttcctggtatcggcagggccaccctcacgggcaacaccgaggcgatactgggggcatggacgatctcgctggattcctacggacccggcgttcccgagtcgacccggcaggcgtcggcatcctcaccgacagccgccgccgggtcgaagggttgcgccgcgaagaggtcgcacacctgtccggagtcagcgtcgactactacatacgcctggagcagggccgcgcgacccagccctccgagcaggtcctcgacgcgctcgcccgcgtcctcggcctcgacgagaccgaacgcgggcacctcgaccggctcgcccgacagcgccaccgccgtgcgaaggcgccgggcgggcgggtgcggccggaactgctgcgcgtcctcgccctggtcaccgacgcacccgcgctgatcatggaccaccgcttggacgtgctcgccgggaaccggctcgccgggctcctcttcggccgaccgatgccgggtctgaacaccgcccggcacatcttcctcgaggaggccgagcgcggcctgtacgcggactgggagaactgcaccctcgacgtggtcgggcacctgcgcctggccgccgggaaataccccgaggacccccgcctgacctcgctcatcggcgagctggcgatgggcagcgagcgcttccgtcgcctctgggcccgggcggacgtgcgcgcccgcacgcatggacgcaaggcgtacaggcacccgctggtcggactgctggacctgcaccaggagaacttcgcactaccgaatgaatcgggcatggaactgctggtgctggcggcggcccccggcagccccgccgaggacggcctgcgcctgctcgcgggcctggacacggatgacggtgacgcgcatcccaccgtgaacgctcaggttcgcgagtagcccaacgttcccttcaggagggcgccaggacatggcggtcgcggctcgcgccgaaggccgcgacggtctgcgcgacgagcacggcgagcaacagggcgaccggcagcgaccatcccccgctcgcggagtgcagcaggccgataccgagcgggccgaggcaggcaatgaggtagccggtcccctgggccatcgtcgagagccggccggtgtggtgcgcgtcgggcgagcgggcgacgatgtaaccgagggcgaggcccatggcgaggccctggccgagtccgagggcggtcatccagaggtaggtgcccgacacgggggacgtgagcaggccgatgagtccggtcgcgcacagcagggcggccgccaggggtgcgacgaaggccgggcgcagacgctgctgcagccagggtgccgcgaaggatgcggccatgccggggaggctggtgaaggagagcatccacccggcccggctgtcgctcatgccgtggtcctgcagaagcgtcggcagccaggagaggatcgcgtagtagccgagggactgcagccccatgtacagggtcaccgcccaggcggtccggtcgcgccacagcgccctgagtgcgggtgcggcggtatcggcacctccttgcctctccagctcctgtcgccggcggttcggggaacgccggtccggcgcgagcagttcgggaagccaggcgagggcggcgatgagggacgggatcgcccacagcgcgagcacgtgccgccagccccagccggtggccgacaccagtgggacgaccaggcccgcggcgagcgcggctccgcccgacagagccagggagtagcagccgagcatcagcccggggcggtcggcgaagtcgtgcttgatgagctgcggcatgaggacgttgccgaccgcgatcgccgcaccggcgatcagggtgccgccgaacagggcgagcactcccgggaccgaacgcagcacaatgccgccggtcagcgcgagcagcgcgtaccacagcaggtggtggggtccgaagcggcgggtgagccggggcgcgaggaacgcgaacgccccgaagcagacgaccggcaccgtcgagagggctccgccgccgaacgatgagaggtgttcgtcgtgctcgacctccgcgaggacgggggacagggacgcgacggcgatgcgcaggttcagcgcggccaggccaaacgcgaaagcggcttgtacggtgcgcgccccggccggtccgggaagggacggctgccgggaggccgacgggcgggctgctgggacctgatgggccactgggctgttcatgccgtccactctcgggcggagccggggcggcgggccaccgataggatgccaaactatgagggaaacccgccaccttgatccggtggaccgcggccgcatcgtcctggcgcacgggcagcggctgcccacccatgcccatgaccgcggtcacctggtctattcggccaccggcgtgctgtccgtgaccaccggcagaggtacgtggatcgctccgccgacccgggtggcgtggactcccgcggccttcgagcaccaccacaccgcgcacggcaacgcggacatgcggattctcttcctgcccgacgcactcgccgcccggctgcccgcgcatcccgccgtgctcaccgtctcggggctcgcccgcgaagctctgctcgctctcacggccgaggaggaggacgccggcggccgggcgccggaggcggccgaccgtctgcacatggtcgtcgtcgacgagctcaccgcggcacccgagcagccgctgcatctgccggagccggccgacgaccggctccgggcgctgaccggcatcctctacgccgaccccgccaatcagcagacgctcgccgagctcggcgcgcgcgtcggggcgagtgagcgtacgctcagccggctcttcgcgcaggaactccggatgagttttcatcagtggcgcacccagctgcgcgtccaccacgccctcacccggctcgccgcggggaagtccgtcaccgacaccgctctcgcctgcggctgggccaatccgacgagcttcatcgaggctttcgccgctctcgtcggcgagacccccggccgctaccgcaaccgtcaactcccccccgggcgcggctaggagttctcttgcgggatcccttgacggggccggtctccgggccgaccaggacctacgctgaacccttcaccgggccgcggcggagggaaacgggatgagcgggacgacgacgtacgtacggttccagagcacccgacggagtccccggggccacttccccgggatcttcgcgctggccaacggcctggcccgggagggacgcctgaccgaggagcagcaccggttctggcgggccgcgaacgactggtacgacgccgcctacaccgacccctcccgggtcgaccccgcggtgtacgaccccggggtgaacccgggggcggtggcctggttcaaggggacggcgacccatctgctggaccggattcccggctatctcgcactgctggccgcgcacggggtgccgtgcgagcggctggagtcggcggatcccggccgggtcgtgtacgaggacgagcaccaggtcgtcgtggtaccccgccccgggaacgcgcaccctgcggataccctcaactcgcgtactccacagggggcctgacggattccggtcacgcctgtcgtcgctctggtggagcgctgcccccatcctgttcgatggggttcgaacagtcgcgcgccgggcagtggcgcgctccacggagcggagttcctcgatgtcctcgcagaccggcccggcgctcgacacccagcctcgcggccatgcgttcgtgccgggtcccaaggggctgccgctcgtcgggaatctgccgcagttcggcaagaaccccctcgccttcttcgaactcctgcgcggccacggggacatggtgcgctggcggttcggccgcaaccgctgcgtcttcctcgccgacccggacctggtgggcgagttgctcaccgagacggagcgcaccttcgaccagccgaagctcggcatcgcgttccgtacggtgctgggcaacgggatgctcgtggcgcggggccgggactggtggcgcaagcgctcgctggtgcagccctccgtgcggcccaggcaggtcacgtcgtacgcgaccacgatggcggactgtgcggtggagctggcggaccgttgggcggacggccaacggatcgacgtcaaacgggagatgtccgcgctgacccagcagatcgcggtacgcacgatcttcggggtggacacccccgcggactccgaggcgatggggagggcgatggacatcgcccagatggagatcggcaaggagttcgccgggctcggcgcactgctgccggactgggtgccgacaccgggccgggcacggatcaggaaggccgccgccgtcatcgacgccgaagtgcgccgggtcgtcgcccggcaccggggcggcgaggaggaacgccccgatctgctcagccggttgctcaccgccgtcgacgagagcggaacacacctcagcgacgaggagatccgggacgaggcggtcacgctgtacatcggcggtcatgagacgacgagtacgacgctggtgtgggcgtggtacctgctcgcccgcaacccccgcgtccgcgacgcgctcgccgaggagctggaccgggtgctcggcgaccgggagcccggcttcgaggactacgcacaactgcactacgcccaggccgtggtgaaggagaccctgcggttgttcccgccgatctggctgatcaccggaatagcgaaggaaggggcgacgatcggcggcctgccggtcgaggagggcacccgggtgtggagcagccagtgggccacgcaccgcgacgctcggtggttccccgagccggaggagttccggcccgagcgctgggacgccacgggcggcgacgagataccggagtacgcgtggttcccgttcggcggcggtccccgggtctgcatcggcacccgcttcgcgatggtggagtccgtcctcctcctcgccgtgctggcccgccgtttcaccctggacgtggacccgggcgagatcactccgctgacgggtctgacgctccagccggaccgggccgtgctggcgacggtccgggcgcggtagcggcgcgagcggaggacagccggcgcccggcacctcgggagaggggccgggcgccggacggcgtcagtccttcggcagccacttcttccagacgtcggggtggcgctcgatccagcgctccgccgcctcctgggggtcaagcttctgcgaggcgatcatctcggagacctcgttctggtccttctccgaccagtggaacttcttcaggaacgcggacgcctcgccgccgcgctcggcgaagccggcgttgaggaacttctgcagcggtgtcgtcgggtacgcgcagtcgatgtccgccgggtccttggccgcgcacgcgtcggtgtactcgggaagtttcacctcgaccatcggcacctcgttgaacagccactgcggctggtaccagtagctgaggaagggtttcttctccttggcgaactgctggatctgggtgatctgggccgcctcggacccggcgaagaccaccttgtagtccaggtccaggttcttcaccagggccacgtcgttggtgacgtaggagggcgagccgtccatcagctggcccttgccgccgctctcggcggtcttcagctcgtccgcgtacttgtcgaggttcttccagtccgtgacgtcggggtgttcgtccgcccagtacttggggacgtaccagccgatgtggccggtgaccccgaggtcgccgccccggacgatggtcttcttctcgtcgacgtacagcttctcctggtccgggtggccccagtcctccaggatcgcgtcgacccggccctggctgagggcgtcccaggcgggcacctcgtcggtctggacgaggtcgacgcggtagccgagcttcttcttgagcagctgctccgccacggcgacgttcgcctgggcgccgacccaggactggaccgagagcgtcacggtcctgaccccggcgggggccgcgaagggggaggcctgcttggtcatgtcggcggcgccgcagccggccgtggccagcagggccccggccgaggcgagcgccacgagcaggcgggtgcgggagcggttcatctcagctctcctgtcgctggcggcgggtggtgggctgggtgacccggtcgagcatcaggccgaggcagacgatcgccgcaccggcgacgaggccggtggccaggtcgccctgggcgaggccgagaacgacctcgtaaccgagcgcgcccgatccgacgagtccgccgatgatgacgacggcgaggaccagtacgaccgcctggttgacggcgagcagcagggagggccgggccagcgggatctggacctggcgcagttgctggcccggggtcgcgcccagcgagcgggcgcactccatggccgccgggtcgaccccccgcaggccctgggtggtgatgcggatgacggcgggcagcgcgtagacgaccgcggcagcggcggcgggagcgcggccgaccccgaagagggcgacgacggggatcaggtagacgaactgcggcatggtctggaagacgtccaggaccggtcgcagcagcctctccaggcgttcgctgcgcgcggctccgacggcgacgccgaagccgatgaccagggtgaccgcgacggcggcgagcacctggctgagggtgtccatggacggctcccacacgccgagcacgccgatcgcggccatggcgagcacggcggtggcggcggtgcgccaggtgccgatggtccaggcgagggcggcgacgatcagcagcaccgaccaccagggcaggccggtgagcccgctgcgcagcgggttgaggacgccgctggtgaagtgggaggcgaggtcggcggtgccaccgacgacgggtaccccggtgtagaggtggtcgaccatccagtccttggcggtgttgaccggtccggcgatggccacggtgacatcctcgggccagacccggccgtcggtggcccgtccggcgacggccgggtctggcccg

SEQ ID NO: 3081 - DNA, 13114 bp, Unknown
  Kingdom: Bacteria, Phylum: Actinobacteria, Class: Actinobacteria, Order: Streptomycetales, Family: Streptomycetaceae, Genus: Streptomyces
ccaccgcccccgcgccctgagccgcagaccgacccgaaccggttcgtcctgcgctacccggacgaccccgccgacgtcggcaggtggctcgcccaacacggctaccgctgcctgaccccaggcgccctgaggggtgaagcgggtgtcctctacgcccgccccggcctgcccgcagagatcgccgtcattggcgacaccctcgtctacgacggccacatcgtcaccgtcgaaccccgaacgacccccacctgaccctccggagcccgcgccatggatctccacacctggatcacccagcaagtcgatgagaccgaggttgaggggcgggcgatgctcctcgacccgacgccaatcctgcgccgctgtgaggcggaccgccgcatcctcgcccgacaccggatcgactcggctgctgttgcgttcccgggatcctgcgaaggctgcggactcgacgactggggactgccgaacgtcgagaccgtcaacgactgccccgagctgctcgatctcgcgcacgcccacagcatcacccccgacgtgctcgccggactcgaccgaccggagacgcccgagcagaagccgcgtggtcctgtcgacccagtactcgctggcatcttcgcccgaaccttcgacctacccaccccgcccatcaccaccagcgacgtgcccgaagcgctacgcggaccccgctggaagccgtaaccctcacaggagcccgcgccatgggtaccaactactacctccagaccgagccctgcccccaagcctgcgaacactgctccgccagcgaacgcatccacctcggcaagagcagcatcggctggcgcttcagcttccaagcccagcccggctgggggtcactgaacgccttcaccgagtggatcaagctcgccatgagcggcgtgatcaccgacgagtacgagcaggcccacaccctcgccgacctgctggacctcatccacagccacaaggaactccgaagccacgccgaacccgacccccatgaccgccgcgccagcgacggctggttcatcagcgaagggcacgagttccgcacccgctacttcagctaacccaccaccaggagcccgcgccatggcccgatacgagatcaactacctcgacggaagcgtcgacgaggtcgccaacgcccccggtcacgaatggtcgggaggcatcttcctcgtcctggacgcccagaagcggacgatctacctcgcccccaccgcgaacatccgcagcgtcctcatccacgacgaggcggtggccggcgagtgagcaccgcaaccgactggtacgaagcaggctgcgcacgcgactgcaccaaccagcacacgaagcagtggggccgctgcgcacacgcccccgagtccgcccgtcgtgaaccgaccgtcatcatcggcggcgtcgaaaccgccgaagatggctacggcgagatcatcacgcgcagcatcccgctgtccgcatggaacgacctgatcaccgtcgccaagtgggtaagccgaggccgcagcatggccttcgacccggaccccgacattgccccccggtacccagacgccaccgcacgccgagcactcggcgcactcgacgacgccggggtcctcaaccgacagacctgtacagaggcggtgaccggctgatggcccgcttgcagatcctcgaactccccgaaggcgccggcgacgaccggccgccattcatcctcgtcatcgacgagtacgtcgcgcgtcgctacatcaccggtctcgaccagtcggagcccgtcagcgagttcgacggcatcgcagagaagatcggcgcccgagctgtcctcgtcttcgaagacaccatcgacatccccgccaacgacaccagcgcctacgcccagccggccgccgcgctccacctcggcgaccacgaagtacgtgccgaccttgccgcagccgccaaggcccaagccgaagcgatcgacgacctcgtcaccgacgcccacatcgtcctcaaggtcgtcaaagccgacggcgagaccagcctcatcaaagccaccagcgaagccctcgactggatcacagcactcggcatgctcaccgccgtcctcgccatcgaaaacaccggctacgccaacatcgccgaagacgacgactaggaggcgggcgtgagcggaggatgggccaactcggaccgcaagagccggctccccagcgggtgggccaagatccgggcacgcatcctcgaacgggacaggacgtgcgtcctgtgcggcgtgaggccctccgccttctgcgaccacatcatcgccaaggccgacgaccacagcgacaccggactccaaggcgtctgcggaccctgtcacgaccagaaatcggcccgagaaggggcatccgctgccaaggccaaggggcagcccggacgaaagcgaccgccggagcaacaccccggcctcctctgacagggcggtgaccgtgccccgcttcttgatccggcaccccggcaaaaccagcgacgacatcctcgtcgaagaccccgccctcaccctccacttcgaacacgggtgggccgtgttcaccgacgcggccggtacctgcctcgccatcccggctgatgctggcgcccacatcgaacgggtagacgaaccccaagacgagcccgcgccgcagaaggagtgaacactgtggcaagcaagggacgaagcaagcgtggcaacgccgagacgctccgcaggtactggaccagcggagccggcgcagccaagatccgatggggaacaccaggcgactggaccaggtgcaaccggcagctgtcccgctacatgggagccagggccaagggctactgccagctcatgcaccgacgggcaaccggggtgtacaccgggagcagggccaacgccggccgacggcgacgctgacgcatcagcatgcgagacgacagtcgctcgcccagggtgggcgacgaggccagtgcccgcaggccccgaggctgccggctccggtggtcggccagggcaggcagcagggcgaggtcgtgatggtcatgtgtcaggtgatcatgcgattggtgatcaaggttcagtgatcaacgatcaagatcaagtcgaagcgacgaagatcgattctgcttccgtcgagcacctggctgaacgaatggtgatcttgccgttcggctcgccgtccgctcagccggcgaggccaacttgatcacgcctctgacctgggggaatgcccctgacctggggttatccggatcggagccgtatacacgctacggccgcctacggatctggggactttggatcatgaggggtggtggtctgaatggcaggccgtggagccgccccgaaggatccgagtcgacgggcgcgggcgaacaaggacccgatcgcccagaccgttctccgcttcgagcaggctgagcctcccgagctgccgacgttgtcggtgctgaaggacggcgacttggtggagtacgcctggccggcgcgcacgctggactggtgggagatgtggaaggcctcaccgcaggcggagcacttctcttcgacggactgggacttcctcctcgacacggccgtggtccatgcccgcctgtggtccggcgagatgtctgcggccggcgagctacgcctccgcgtcgcgaagttcggcgcgactcccgaggaccgggcccggctgcggatgcagttcgcgcaggctgatgaggcggacagtaagcggcccgagggggctggctcagcccggcagcggcgcggggttctgcgtgcgcttccggatccgaaggctgagggcgagtagtgccttggatgccgccggagccgggggcggttccgacgctcgggtatgacgtcatcgactggatctccgagatgctggccgcgccggaccgcggcgactacgagccgttcctgctgtacccggagcaggaggatttcgttctccgctactacgagctagatccccggaccggcaagcggcgcttccgccgcggggtcattagccggccgcgaggctggggcaagagccctttcctggccgccctggcgatcgtcgaggcgttgggcccggttgtccctgatgggtgggatgccgacggtcagccggtggggaagccgtgggctgaggtccggacaccgttggtgcagatcgccgcggtgagcgagacccagacgaagaacacatggactcctctcctggagatgctgcagggcccggtgctcgacgagtacccgggtctcgaaccgctcgataccttcgtgaacttgccccgcggccgcattgagccgatcacctcgtcggcccgcacggtgaagggcaacaagcctgtcttcgctgtgctggatcagacggaggagtgggttcggtcgaaccgcgggaaccggctcgctgagaccatgcggatcaacgcggcgaaggtgggcggcaccactatcgagtcgccgaacgccttcatccctggcgaggggtcggtggccgaggaatcggcggcgttctggacgaagatccgcgaggggcgagccaaggacgacggcctcttctacgaccaccgtgaggctccccccgagacggacatgactgataggcagtccctcacggccgggctcgccttcacctacggagactcggcggaccgtaacgggggacacgtcgacctcgacacgatcgtcgcgacgatctgggaccccagcactgacccacagacggcccgtgccgacttcctcaaccagatcacgcacgcctccgactcgtggatctcccagcccgagtgggctggcgtggccgctgcggacaaggttgtagggcgtggcgaggaagtggtcctggggttcgacggatcgcggcgccgcaaccgcggtgtcacggacgcgacagccttggtgggctgccgggtctccgacggtcacctcttcctcctggggtgctgggagcagccggacgggccgttcggtcaggactggcaggtgccgacggtggaggtgcttgcgacggtcgaggatgcgttccgcgactacaaggtggtgggcatgtacgcggacccggcccggtgggagtcgcacgtagcgaagtgggaggccgatcacggtcgccggctgaagctcaaggcgtcgacgcaacatcccatcgagtggtggatgaccggtggccgttcagggcacatcgtgcgggccctggagaagttccggtccagcgtcgtcgatggcgagctcacgcatgacgggtcgagcgtcatgacccgccacattctcaacgcccggcgccgcgagtcgcgcagcggcattcagatcatgaaggagcacccggacagttcgaagaagatcgacgtcgctgtcgcagcggtccttgcctggcaggcccgagtggacgccatggccaaggggctgggcaagaagaaggccggcaggtcgggacgggtggtggtgttgcgatgaccgtttcgattcccgagctgccgatgctgcatctgtcggacgacgagatggcgttgatcaacgtcttgcgtgccgacatgctgcgcgaccggtggacccttcaactgcgggacgcctacttcaacggtgagcagctggtgcgcgacctgggcatcagcatccctccgcagctcaagggcttgcacacggtcatcggctggccgcgggtgggcgttgagtccctggaggagcgcctcgatctcgaagcgttccggtggggcgacggttctgactcatcggagctgacggagatcgtcactgcgaatgatctccttgacgagtcgagtctcgggcacctggacgccctgatttatgggcgcgagtacgtcacgatcggctctggcgatgatgacggctccccgccgctgatcagcgtggagtcgccgctggacatgacgctgatgtgggatgcccgcatccgcatgggcgttgcggggctgcgtgagtgtcagtcggatgggctggtcgagtcgggtgccgacgagcggatgatcgtcctgtacttgccggatcagacggtgacggcgttgccgaatccgtcgggcggctgggaggtcgtcgaccgggacgttcacaagctgggtgtggtgccgatcgtcaggttggcgaaccggcagcgaacggctgaccgcgtgggcaagtccgagatcactccggacgtcatgagcatcacggacgcggcgtgccgccgactgatgggcatagaggtggccagcgagttcttcggcgccccgcagcggtacatcttgggtgcgtcggagtctgccttccaggacgctgagggcaacgccaagagcgcttgggagacgtacatcgggcgtgtgctggcgctggagcgggatgaggacggcgccgttcctgacgtcggccagttccctgcgcacgacccttccggccagacgaagatcatcgacctgtacgcgcgaatcatgtccagccagttcggtctgccgccgcacatgctcggctacaccacggacaacccggcctctgccgatgcgatccggtcgactgaggcgaagctggtgaagcgctctgagcgccgcatccgccgcttcggacgcgcttggcaggacgccatgcgtctcgccctgtgggtccgcgacggcgaggcgcccgataaggcccgccgtatcgagacggtgtggcggaaccctgcgacgccgacggtggccgcgcaggcggacgccacggtcaagttggtccaggcggggatcctcccggcggactcggacgtcacgttggagatggcgggcctgtccgaggggcagcgacagcaggtgcgtgcggaccggcgccgctcgggtgccgcggctgctggcggggggctgttggaccgtctagccgctttgggtgacgagccggctgcggcgtctccgagcgtggtggaggtcgacggtggcgacgacggtctctgatggtggcggtgacgcggaccggtatcgggcggcgcagcgcgggctgtcgcggttgttggtgcgggatgttcggcggctaaggcggttgatcattccgtctcggttgcaggcttcgatgccggactggttcaccgcgatgcaggaggtcgtcgaccagtacgcccgcacgtcggtcgccttgggcgccgacttctacgacgcgcagcgggaggcagcaggtgtgccgggatcgtttacggttccggtgcccgatccgccgccggctgaacagaccgaggcgtcgctgcgctgggccaccaaggatgtctgggagcgggacctggacgacccgaagaccacgggtgctcagcgtgagccgctcgacgtgcgactggagcaggccgagaagaaggctgaggccgtcgcgcagaagctcgtggcggacaccgggcgcggcgctgtgcaggaggcggtgcggcgggatcggcaggccacggcgtgggcgcgggcagcggcccttggggcgtgcgccttctgcaagatgctcgccgtgcgcggtgccgtctacaagcaggacacagcagactttcgggctcatgacggctgccactgcggtgtgatcccgatcttccgggggcagcggttcgagctgtccgacaaggccaaggagtgggaccggctgtaccgcgagtacgcggccccatttcctggtgatcagttgcgccggttccggcgtgcgatcgccgagcacggctagtccgcgctcacttcacaacgtggtcgccctggtggcggcctttctcatttcgacagcccctggagggccgattcgtcatgcctgaagagaccgagagcaccgagcagcaggccgagaccggcaccgaggagaccgtcgaggagacggcgaccgaggagagcagcaccgagtccacggatgacgcccaggaggcggagaccgaggacaagccgttcgaccggaagaagttcgaggcagagctgcggaagaagaacagcgaggccgcgaacctccgcaagcggctcaaggagcaggagcctctgctcgccgagctgcagaagcggaaggacgccgagaagtccgacacggaccgactcaacgaccagctgaccgatgcccaggagcagatcaccaagacgcgtcagcgactggtgcgctcccaggtgcaggccctggcgatgacggggttcgcggacccggaggacgcggtcggcgcgctggatctgaactcgtacatcgactctgacggcgacatcgacgaggcggccattaaggcggacctcgacgcgctcctggagcgcaagccgcactgggcgaaggcccagccccaggagggcccgcggcgtcctgcaccggatcgcactcaggcgtccggtgccaacaagagcaggccccccgcacccggcgatgagttcgccggctggctgaagccgcagctcaagtagctgcagagaaagaggacaccatggcggttaccgccccactgaagatttccgatgtcaacgatgcgcttctgccgcggacgctggccgggcccatcttcgagaagagtgtcgagcagtcggcggtgatggcgctggcgcgtcaggcgccgctggcgctggacgcgacgacgtcggtcccgatcccgatggacgtcccgaccgcggactgggtcggacaggcggcgcggaagcccctgtcgacctcgtccgtcggcgtgaagcagatgacggcgaagaagctcgccgtgctgatcccggtggccgaagaggtcgtgatgaccaactccggcggtctgtggacgcagctccagacggatctcccgacggcgttcgcccgcgccttcgaccacgcggcgatccacggcaagacgatgaagggcgccaccggccccttcaccgactatctcgccatgaccagcaacgcggtggcgctgggtacggccacgcaggcgcagggcggaatctgggcggacttcgtcaacggcatggccgaggtcatcgacgacgactgggactacaccggtaccgtcgccgaccaccgactgaagccgtcgctgctgctggcgacggacaccacgggccggccgatcctggtcgacacgacggtcccggggacgcagatggcatcggcgggcacgctgatcggtgagccgctcgcgtactcgcgctcggtctccggcaagcagggacgccagtccgcgtcggcggacacgggcctgcgtgcgatcggcggcgactggtcgcaggcggcctacggggtgggcatggacatcaccgtgcggatctccaaggaggcgacctacgtcgacgaggagggcggcgtccactcggcgttccaggagaacctggttctcctgctggcggaggcgtactacggctacgtgcagggtgacgcggacgcgttcgtgaagtacaccggcaccccttcggggtcctgatggcggccgtcccggtctccgcgccgggcgggacggctaagccgctgaagatcgtggccagggttcacgcgatgcctccggagcacaatgcgggggccgagcacatgctggtgtcgatgcttcgcccgctggtggagcgtggtcacgatgtgtccgtgtggctgtcccggtacgggaaggctcacgccgagtacgagtaccggggcatcaaggtggtgccgctggagtcccgcttggacttcccgaccgcggtccgccgggcgaacgtcctggtgtcgcatctggagacggtgccgtcgacggcgtccttggcccgtgggtatggggtgccgctggtggtggtgtgccacaacacgcacaggccgacgttccgtgacgctgctgctggcgggactgctctggcggtctacaactcgcagtggatgcaggcggaggcggagcttttctacgcggagttcccgaagtcggtccggccggcgtccgagctgatcgtgcgcccgccggtgttcgccgaggactatgcgacgaagcccggcaaggccatcactctggtgaactgcaatccggagaagggcggcagggtcctggaggccttggccaagcggatgccggaccagcagttccttgccgtgcgcggcgcctacggaacgcagatccttccggacctgccgaacgtggagatcgtcgaacacgtgtgtggtgaggacatgcgagagcaggtgtacgcccgcacgaaggtgctgctcatgccgtcctcctacgagtcgtggggccgggctggcgtcgaggcgttggcgagcggcatccccgtggtggctcacccgacgccgggcctcaccgagtccctgggcgaggccggggtcttcgtggaccgcgaagatctcgacggctacgaggcggttctccgcaagctcctcaccgcgccggagtaccggctggcgtcgaagcgggcgaaggcccggtcggcggagctcaatccggccgccgagctggcggagtggtgcactgcgatcgagggcgtggcccactaggaggtcccgatggtgttcgtgtccccgacggctgagcagttgggcatgtacctggggttgccggagatcgacggcgacagggctgacctgctgatccagcaggcggtttcgctggccgagtcggtggtgaagccgctgcccgatcaggcgaccgccgtcgtcctgtcggtggccggccgggcctacgtcaatccgcagcaggtgtcttacgagacgatcgggccgatgtcggtgcagcgacccagcggaagcgggggcttgtacctgacgaaggcggacaaggcggcattgaagtcgttggcgggccgcggcggtgcgttcaccgtggatccgacgccggcttcggcggatccgtcgccgacgtggccggtcgatgagacgtacttcggtgacgccttcgagccggggtggtcgtgatgcctgccccgtacccgtatggggagacggtgcgggtcctgcgcaccgggacgtctcctggtcgggatcctcgcggtcagcctctgccaggcccggacgagtcattcgatctcgtgggctgcgtggtggctcctcgtgcggagactccgcaggtgggtggggatgaccagcaggcgcgggacacggtgatcgtcgggtacacggtgtacgccccgccggggagttcggtccgcacgacggatcgggttcggatccgtggcgagacgtgcgaggtcaccggattcccaggcgactggggtcggtccccgttcacaggcacccgtggcccggtgcagttcgctgcggaccgggtgaccggctaggcgcgcgcctgctcgacggcctctaccagcatcgcggcggcgtcgttggcgctgtgtcggatggacaagctgtgcgggtcggactgtggcggccggcctccggtgagcaggcttttcgtctcggtggcgggtgcactgccggggagcacgaactgcaagtagccgtggaagaggcgggtggccggcttgagccgggtaccggtgacgtcggccgcgcggatacggaactgccgttcctgctggccgacttccttcttcgtgatggtgatccattcaccgtcgaagctgacgctgcccatgacgcctttgacgtccatgccgccccctgtgtgagtcgaggtggtcatgatgcccgcgaagttcaagatgtccaagaagggtgtcgggcagcttctgcgaagccgcatgatccaggcgaacatgctgggccgcgccgaggcgatcgaggacgcggccatcgctatcgcccctgttggtgggccgtcagacccgcaccctggccggtacaaggccaccttcggggtcacaacaacgacccgcggtggccgacgcaaggatcgcgcgacggcgacggtcacgaacaccgcgtactacgcccgatgggtggagtacggcaccgagcgggtcccggcgcaccatgtgctgctgcgggcggcacaggccggcggtggtcgctgatggccgcgactgcgcatgtcgccccgctcgacgatctcatcgagcacgagacgggcggcgatgagccgtcgtgcgtctgtggcccggaggctgtcccggttgagattgctgggctggtcgtctgggtctacgtgcatgcctcgctcgacggccgcgagttcgctgaggaggttccgtgacggcgctcctcgacatcgaggcggagctcatcggcagagccaccccggtctggcctggcgccgtggtccgcgacgagctcgacaacaacctcctcgccgagctgccgacgatccagttcgagcaggtcccgggtggcagcgaggacgggctgaggctagcccgtgccctcgttgacatgaacatctacgccaccaccagggccggggcgttcgctctggccatcgaggtgcacaactggctgacccgcacagtgcggggtagcaccagcgccactgcagtgattggccgtgtcggctgcctgactctgcccgctgttcgcccctacgagaacgtcggactccgccgtgtcggcggcacctacgagatcttcttccatccggtctcctgaccgccttttgggcccgcgccgcgcccttctgtcccgcccgtgcgcgggttcttccatgtctggagactcatcatggtcaacatcacccgcgccgctgacctggcgcttgtcggagcgaacggcgggggctgggtgtcgccggtggatacggcggcccctgcttcgccgctggagcagccggcgtctccgtgggagccgctgggagcgatcgcagacgacggcctgacctacgggttcgacgaggacagccagacgttcaccccgtggggcctcacgtcgccgttccgcacacagatcacccagagcatccggacgttcaacctgacggtgtgggagaccagccgcgtggcggtgcagtcgctgcagtaccggctggacccggcggagctggagccggacgtcggcgggcttacgaagtacgcggagaccgcgtccccggttccggacaggcgggcgttctggttcctcgtgatcgacggcgatgcctacaagggcttctacgtcccccagggagagatcaacgaccgcagcgacgtgacgttcaagcaggacgagatgtccggctacgagtggacgatcaccacgtacccggacgcggccggcaacaccgtctaccacgtcgacaagattcccgtgacgcctgagtacacgggctcctgagctgggtgggcgggtcacttcccctttctgcccgcgccacgatttgaggaggcccgcgccgatggccgcgaccagccgcaccaccgcccgaaagaccactacggcacgacccgcccgcac

SEQ ID NO: 3082 - DNA, 7000 bp, Unknown
  Kingdom: Bacteria, Phylum: Actinobacteria, Class: Actinobacteria, Order: Streptomycetales, Family: Streptomycetaceae, Genus: Streptomyces
gcccggcaccggccgctctgtacaacgaggtccgctaccgcggcgcaccccgcgcgcggaccggtgagctccggccggtcgacgccttcttccacgccgcggacgccttcccggacgcgaacctgctgtacggccggggcggtctggtgcggtaccggttctccgtcggatacggccaggaggagaccctgcaccgggtcgtgcggcggatcgcggcacgccggagccccgccgtgcgggccgtgctccagcggttcggggcggcggaccccggagggctgtcgttcgccgcgcccggctggtcgctggccctggatctgcccgcggcgctgcccggcctggcccgcttcctcgacgacatggacgacgaggtggcctccgccggcggccgggtctgcctggcgaaggactcccggatgcggccggagacggcggccgcgatgtacccgggactggctgacttccgggagctgcgggcgcggctggacccgacggaggcgttccgctccgacctgtcgcgccgactcgggctgtaggcctcccctctcgacccgttccccccactcctccctccacctcatccgaccaggagatttccgtgaaggatgccttcggcgccccgcagtccctgctcgtcctcggcggcacctccgagatcgccctggccaccgcgcgccggctgatcgccctgcgcacccgccgggtctggctggccgggcgcccctcccctgccctggagtcggccgccgccgaactgcgcggccggggagcggacgtccggaccgtcgacttcgacgcgctcgactccgcctcccacgaggccgtcctcggcaaggtcttcgcggagggcgacatcgacgtggtgctgatggcgttcggggttctcggcgaccaggcgcgggacgaggaggagccgatggccgccgtccgggtcgcccagaccaactacacgggggcggtctccgccgggctggtgtgcgccggcgcactacaggcgcaggggcacggttcgctggtggtgctgtcctcggtggccggggagcgcgcccggcgcgcggacttcatctacggctccagcaaggcgggcctcgacgcgttcgcgcagggactcggcgacgcgctccaggggaccggggtgcaggtgatggtcgtccgccccggattcgtccggacccgggccacggcggggcggccggagcagccgctggcgaccggcccggaggaggtcgcggcggcgatcgtcaccggcctgcggcggcgctcggagacggtgtgggtgcccggttcgctccgggtggtgatggcggcgctgcggcacgtcccgcgtccgctgttccgtcggctgccggtctaggggatagggccactgccggtccggggcccgcggcactgccggtccggggactgcggtcccgggtgctcagggccgtagcgacggggccgacggcgcgtcgatcgtgtagccgccctgggcggggaccgcgggcaccccgccgcccccgccgaacgggaagtccctgatcttgcgccagacggcgtccgggccctgctcgtacagcgagaaggatccgcaggtccaggcggcctcgtagtccgcgagctcctcgtaggcccggtccatggcctcctcggcgatgccgtgggccacggtgacgtgcgggtggtacgggaactggagctcgcgcaccagggggccggaggcgtcccgtacccgcttctggagccaggcgcaggccgaggcgcccgcggcgacctggacgaagacgaccggcgacagcgggcggaaggtgccggtgccggacagccgcatcgggaacggccggccggccgtggcgatcctgtcgaggtgcgcctcgatcgccggcaggtcggccgactccgcctcggtcggcgggagcagggtgacgtgggtgggaatgccgaaggcggcagggtccccgaagctcgcgcggcgatcctggagcaggctgccgtagggctccgggaccgcgatcgaaacgccgagcgttacggtccccacgtcgttctcctccaccgtcgatagtcgttttccggtcatgccgcgtgggccgggtttccggcccacgctttccgtcgccgcaagtgtgacccctccggccatgatctcgccagggtccttggactcagtgcttggcgggcaggaagcccatccggtcgtacgtctgcgccagggtctccgcggcgacggccctggccttctccgctcccttggccaggatggcatccagcgtctccgggtcgtccagatactgctgggtgcgagcccggaaaggagtgacgaattccaccatggcctcggccagatcggtcttcagcgcaccgtagcccttgccctcgtaacttcgttccaggtcctcgacggggctgccggagagggtggagaggatcgtgagcaggttgctgacgcccggcttcttctcggcgtcgaaccggatcaccgtgtcggtgtcggtgaccgcgctcttcaccttcttcgccgtgaccttcgggtcgtcgagcaggttgatgaggcccttcggcgtggaggccgacttgctcatcttgaccgccgggtcctggaggtcgaagatcttcgccgtctccttgaggatgtacggcgcggggacggtgaacgtctggccgtaccggccgttgaaccgctcggcgagatcgcgggtcagctcgatgtgctggcgctggtcctcgcccaccgggacctggttcgcctggtagagcaggatgtccgcgacctggagcaccgggtaggtgaagaggccgacggtggcccggtcggctccctgcttggcggacttgtccttgaactgcgtcatccgggaggcctcgccgaagccggtgaggcagttcatcacccagccgagctgggcgtgctcgggcacatggctctggacgaagagcgtgcagcgctccgggtccaggccggccgccagcagctgcgccacggcgagccgggtgttggcccgcagctcggcggggtcctgcgggatcgtgatcgcgtgcaggtccacgaccatgtagaaggcgtcgtggctctcctgcagcgccacccactggcgcaccgcgcccaggtagttgccgaggtggaacgagcccgcggtgggctggatcccggagagcacgcgcggacgggcggccgcaccggcgcggcccgtctgcggctggtcggtggggagcgaagggcgatcagaggccatggccccattgtctcaggtacgggggcgatctccggcagccggtgcgggcggagagggcgcgtacccgcaggagcccggagcacgggagcgcacgcccgagacgaaccgcacatttcggccgcccagcgtgcgacggcgggcgcgccgggcgatggaggtttcccggcgcgggttccgaccgacgatacaaagtgggcaccacccccgcccacgccgcacgacgaacggagatcccgtgtcgaccacggaaactgccatcgcctccgccgaggcgcacagcgcgcacaactaccacccgttgccggtcgtcgtggcctcggccgagggtgcctggatgaccgatgtcgagggtcgccggtacctcgatctgctcgccgggtattcggcactcaatttcggccacggcaaccgccggctcatcgacgcggccaaggcccagctggaccgggtgacgctgacgtcccgggccttccaccacgaccggttcgccgacttctgtacggagctggcggcgctgtgcggcatggagacggtgctgccgatgaacaccggcgcggaggccgtggagaccgcggtgaagaccgcccgcaagtggggctaccgggtcaagggcgtgccggacggcatggcgaagatcatcgtggcctcggacaacttccacggccgcacgaccacgatcgtcagcttctccaccgacccggaggcgcgggccgacttcggcccgtacacccccggcttcgagatcgtcccgtacggggatctcaccgcgatgcgggaggcgatgaccgagaacaccgtggcggtgctgatcgagccgatccagggcgaggccggggtgctggtgccgccggccggctatctccccggcgtacgggagctgacccgcgagcggaacgtcctgttcatcgcggacgagatccagtcgggcctcggccggaccgggaagaccttcgcgctggagcacgagggcgtggtgccggacatgtacgtgctcggcaaggcgctgggcggcggggtggtgccggtctccgcggtggtctcctcctcggacgtgctcggcgtgttccggcccggcgagcacggctccacgttcggtgggaacccgctggcctgcgcggtggcgctggaggtgatcgcgatgctgcggaccggtgagtaccagcagcgggcggccgagctgggcgaccatctgcaccgggagctgggcctgttgacgggcggcggcgcggtggagtcggtgcgcggccggggcctgtgggcgggcgtcgacatcgctccggcactgggcaccggccgggagatctccgagaagctcatggagctgggggtgctggtgaaggacacccacggctccacgatccggatcgccccgccgctggtgatcagcaaggaggacctggactggggtctggaccggctgcgggcggtgctgagcgcctgagagtccgccgggcgcgtaacgggacggcccggcctccgggacctcagaggatgacgtggggcaggaagcgggcgtactcgtccgtgaccggccccgccgactcccggatgccgagcccggccgcctcgtcctcgacgacccacgcgccgagcaccacccggttcccgtcgaagtcgggcagcggggccatctcctggtagcagcacggctcgtcgcgctccacgggcggcgagcctgggccgtgcagctcgacaccggctccctcgcggcccagcagcggcttggacacgtatccggccccgccgggtccggccagctcgcgcggtccgtcgagatgggcggggagcaggttcgggtggccggggtacagctcccagaggatcgcgagcagcgccttgttggagaggagcatcttccaggcgggctcgatccagcacgtggtgccgctgccgccgccgttgtcgagggtgtccagcacctgcgggccgaagcggtccgtggccagccactcccaggggtagagcttgaagcagctgcggatgaaccgcagccggtcgtcgacgaagcggcccgacagccggtcccagccgatctcctcgacggacagcgcctcggtggcgagtccggcctgctgggcggtctcacgcagatacgcgaccgtcatcaggtcctcgcccagctcgtcgccgtcggagtggacgaagtgcagcggcccgggcggcagcagggacgcctgccgtttccaggcgtcgaccagccgctcgtgcagggagttccactggtcggctccggggaaccggtcctccatccagaaccactgcgcgctcgcggcctccaccagcgaggtcggggtgtcggcgttgtactccagcatcttcgccgggccgctcccgtcgtagcgcaggtcgaaccgcccgtacacggagggcagttcggcacggcgttgccaggactcggcgaccagcgcggcgaggcgggggtcggtgatgccgagctcggcgaagcggctccgctcgacgatgtgcgcggcggcggccaggcacatcgtgtgcagttcctcgacggtctcctccagcgcctcgacctcgggcagcgagaagacgtagtaggcgctctcgtcccagtacggacgcagcgagtcgtccgggtagcgggtgagcgggtagacgacgccctgcgactcgacggtctcctgccagccgggacgcggctcgatcgtgcggcgctccacggcggtcagccgccgccggagccggagcagccgaagccgccgcggtcgaccgccgacttgtcgaagctgccgccctgcaccttgccgctgtcgctcttgccgccgtagtagtacgacccgttcccgccgctgcggcactcggaactcggcagggtcttctgcgtcgtgcggtcggcgcagcgccggtccggctccgaaccgcaggacgtgatcgtcagggcgagcagccccatgccgccgagcacgaccgtgctcgacctcagccttcgtgcggccatgtccggttctcccccgtggtacgcgatcggatccggcgtcccttttccgccaccggacctcttgtcagattaataggaggggtggcttgttcggaacctggccctcacggcaacacccggcacagggcgtccagcgcgcccgcccaggcgctctccgacggtgagccgtagccgatcaccagggcgtcgcgggcggccggggcggccgggtggcggtagcgcgcgaggccgtccagcgccaggccctggaacgccgccgcctggatcaccgaacgctcggaacccgccgggagttcgaggaccgcgtgcagtccggccgcgatcccgctgacctcgatacccggcgcgcgctccgcgagcgccgcgacgagctggtcgcggcgacggcggtagcgcagccgcatggagcgcacatgccggtcgtacgcccccgaggcgatgaactccgcgagcgtcagctggtcgggcgagccggacgtccagtcggacacgcccttcgccgccaccgcctcccccaccagactccggggcagcaccatccagccgaggcgcagtcccggggccagcgacttgctggcggtgccgagatggacgacccgttccggatcgagtccctggagcgcgcccaccggctgccggtcgtaccggaactcgccgtcgtagtcgtcctccaggatcagcccgccggtggaccgggcccagtcgacggcggcggcccgccggtccgggtgcagcggtacgccggtggggaactggtgcgccggggtcagcaggaccgcacccgcgccgcgcagcgcggccagctcgccggtccgggacccgtgctcgtccagaggca

SEQ ID NO: 3083 - DNA, 2185 bp, Unknown
  Kingdom: Bacteria, Phylum: Actinobacteria, Class: Actinobacteria, Order: Streptomycetales, Family: Streptomycetaceae, Genus: Streptomyces
cggccgctggccggactcacccccgcccagttcaactcctaccgggggtccctcggcgagggctccgggttccagtccgcgatgtaccggcggatggagttcctgctcggcgacaagtccgcctccatgctggtcccgcaccggggtgcgccccgcgtgtacgccgagctggagaaggcgctcggggagcccagcctgtacgacgagaccctcgccctgctggcccggcgcggctacgcgatccccgaggcggtgaccggccgggacctgacccagaggtacgagccgtcgcccgaggtcgaggccgtgtgggcggagatctacgcctccgacgaccagaacgacgagctggtgcgcctcggcgagctgctcaccgacgtcggcgagctcgtctggcgctggcgcaacgaccacctcgtcgccacccggcgcgcgatgggctccaagaccggcaccggcggctccgccggggtggcctggctggagaagcgcgccacgaagaacgtgttccccgagctgtggacggcgcgcagccatgtctgagaccacccgtgacagcctccgtgagcgggcgctcgtcctcgacgccgccgacccgctggccgcgcggcgcaagctgttcgccctcgacgacgacggcgtctacctcgacggcaactcgctcggcgcgctccccgtccacgtccccgcccgggtgcaggacgtcctcacccgccagtggggcgagctgcgcatccggtcctgggacgagagcggctggtggaccgcgcccgagcggatcggcgaccggatcgccccgctcgtcggggccgccgccgggcagatcgtcgtctccgactcgaccagcgtgaacgtcttcaaggccgtcgtcgccgcgggccggctcgcgggggagggacgcgacgagatcctggttgacgccacgacctttcccacggacgggtacatcgcggcctccgccgcccggctcaccggtcaccggatcgtgcccgtcgcgcccgccgacgtcccggccgcgctcggtccgcgtaccgccgccgtgctgctcaaccacgtcgactaccgctccggccgactgcacgacctgcccggactgaccgctgccgtccacgcggcgggggcggtcgtggtgtgggacctctgtcacagcgccggcgcgctccccgtcgggctggacgagcacggggtggacctcgcggtcggctgcacctacaagtacctgaacggcggccccggttcgcccgcgtacctgtacgtcgccgagcgccaccaggccgcgttcgactcgccgctgccgggctggaactcgcacgccgacccgttcggcatgacccccgactacgctcccgcggacggttccgtacggggccgggtcggcacgcccgacatcgtctccatgctgacgctggaagcggcgctggacgtatgggacggggtgtccgtcgacgtggtgcgggccaagtccctcgccctgacggacttcttcctggagtgcgtcgaggcgtacgccccggcgggccgggtcacctccgtcaccccggccgcacacgccgaacgcggcagccaggtcgccctgcgctgcgacggtgcggagagcgtcatgcggcggctgatcgagcggggtgtcgtcggcgatctgcggcggccggacgtgctgcggttcggcttcaccccgttgtacgtgggattcgccgacgcggaacgggcggcacggattctcgccgaggtgctcgccggggataccgtcggctgacgggccgtcaccgtctgttcggccgggcggggacggtgccgagtgctggtaccgtccccgcaggtcagcccagttgggcaagaacacaggcactggacacaggcataggacggttgagcagcatgtcggattctgccgcgcgtgatcgggacgtcgccgagacggagtcggcgttcgcgcatccggaggtcgcgcccgaccggtccgccgcctacggggaccaccccgaccaggtcgtcgacttctacgcgccgcgcgacggccgcaccggcgccccgctcgtcgtcctcctgcacggcggcgcctggcgagccccgtacgaccgggctcatgtctccccgctcgcggacttcctggcccgccggggattcgccgtggcgagcgtggagtaccggcgcggcggtgacgacatcccgcagcagcgcggcgggg

SEQ ID NO: 3084 - DNA, 11023 bp, Unknown
  Kingdom: Bacteria, Phylum: Actinobacteria, Class: Actinobacteria, Order: Streptomycetales, Family: Streptomycetaceae, Genus: Streptomyces
acggcgcacggcaccgcgcacatcgctctgcgcggtgccgtgcgccgtcgcccgcgttccgtcgccgccgccagatcgctggcgatgctggtgggcgatctgctgatggggatggccgggcagctgttcaccaccagcggtctgcccgccgcctatctgggccgggcccgcccgttgtggaccgtgctgggccgggagctgatcgcgggcgagtgcctggagatcctgcgcaccggaacggagccggacaccggcgcctcgctgaaggtgatccggtacaagaccgccaagtacacggtggagcagcccttgttgatcggcggtgcgctggccggggccggcggtcggctgcgcgagggctactccgcctacgggctgccgctgggcgaggccttccagctgagggacgatctgctcgggctgttcggagaccccgcacggaccggcaaggccaatgccgacgatgtgtgcggccaccggccgacggccctgctggcggagacctggcgtgtcgccggtgacgacgaccgtgaccggctccgggctcttctgggccggcgcgacctggacgaggacgggttgcacgcggtgcgcgacgtcatgcgcaggttgcagacccctggcctcgtcgaagacatgatcacggcgcgcgtcgaggaagccctcgacgccctccatgagctggacgtgccgtcgcgcgcggccgacgccctgaccgcgctggcgaagtcggcgaccgtccggctgtcctgaaccccgcccgccgcgcaccgcaccgcaccgcaccgacaacaaggaagtacctcttgacctacaccgaggcttcgatgaacgccctgcggcagggcggcgacgaactggccgacgccaccgtcgccgcgctcttcgaccgcggggaggtgggcacgttcaacacgctgatgcgctacgtctccaccgccggcgctcccctgccggacgggctgcccgacgtggcccgggactaccttcaggccacaagtaccccgccgtcctgggtcgactgggaggagatggagaaggcccggctgttcttcatcgacaacaacgtgcatatttccaccgcactgtcgttcgcctccatgcccgcctgctacgtggtcccgcacgtggcgaagctcctttcggccacccacggcctgaagtacccctccaaacggatggcggagaccggccagttcaccgtctatctgatgcggcccgacgccttcgaggccgggggccgattcatccccgccgcccagaaggtccgccttctgcacgcgtcgatccgccatcacctcctgcgcgagaaacggtgggacaccgacgcgctcgggacgccgatctgccaggaggacatgatcggcgggcagatgttcttctcgctgctcgtgctcgacagcctgcaccgcctcggcatccacatgtcggaggaaggcgcggcggcctactactacgcctggcgtgtggtcggcgcgatgctgggcgtcagccaggagtccgtcccccggtccctggacgaggcacgccagttcctcgacctgtacatgatccggcacatgggcccctccgaacagggcgcgctgctgacccggcagctcatcgacctctacgaggaggtcgtgcccgggaccttcttcgacccgatcgtctccgcactcatccggcacctggtcggcgacacctgcgccgactggctccaggtgccgcgcacctcgtgggacaccgccgtcaaggccgtaccccaccttctcggcgtcctggagaccgtcgaggaccgctccccactgggggcctgggccctggaccgcctcggtcacctcaccaccgtcctcgaactgtcctccctcacccgcggacgcgtgatgcactacgccatccccgaacagctcaaggaggagtacggcgtctccaccggggcctcccgttcccgctggaagcctcccgccgtcaccgtctccggccgcacaccccatggtgacaattaggtaaggctcacctaatattcgatgagtcgtcttcgggtccccacacgccaagaagccggtatccccccttctttcgttcgcctcccggaacggctccgttcagacgtgcgccgtacccctcccccgaaggagacatgcagcgcatgtccttgccccgccgcggccgcctggccgcactcgccgccctgaccgtcgtatccgtgggcgccggtgtcctcgccgttcccgcctccgcagcccccggcgtccacgccgccgagcgggccgaggccggcggcacgacgtcggcgtccgccccgatcctggtgaccggccggtcctcctggggcttcaaggactcctgggtccgctacgtcaccggcatgggcggctcggtgaacgtggccggcggcgcgagcgcggatgcggccggacgggtcgactatcccgtcaagcacggctcggtggaccctgcgaagcggtctgccgatgtgcgcttcggcggctcggtcacctacgcggtcccgagtcacgggataaccgccatcacgctcgccaacccgcgtgtcgtcctcaaggacggcaagggcacactccacatggacgtgacgaccgacctctccgtcggccaggccccggtgaccacgcccggcgtgccgctcgccgcgctcacggcgtccaccgacgccctcgacggagccgtcctcgactggacgggcatcacagccacgctcaccgacgagggctcggccatcttcgcctaccagggccgtcccatgtacccggccggcacggcgctggaccccgtcaccatcagcggcggcgtcagcgtccccacactgacggtcagccaggtcagcgagctgggagccgagaacgaggtcaccgtcagcggcaagggataccagcccgggcgcggcgtctatctggcgcagtccatcgccctgcccggcaccacgtaccccagcgtcttcggcaacgcggcgtacatccgtcaggtcggcgtggacggcaccttcaacatcacgctgaagctcaccgagaccttcgcgccctccgggtcccccgtcgtcgactgccgcaccactgcctgcttcgtcacgagcttcaactcgcacgacggcggcgaccccacgtggatgccctcccgggcccaggacgtcgcccagccgctccggttcggcgtcgaggtccccgccgccaccgtgacccggcaccccgcgtcacgtaccgtccgctcgggcgcgaccggtacgttcaccgccgccgcgaccggcgcggactcggtccgctgggagcgcagcaccgaccgcggcacgacctggagcaccgtccccggggccaccaccgccaccctgtcggtgaaggcggccgccgctctcgacggccaccgctaccgtgccgtcttcgtcaacgcctccggtgagacgcccacgtcggccgccacgctcacggtgtccgccgtgcccgcccggatcgtctccttcaacgcctcacccgagcccgtgggcaagggctcccagctgaaggtggccgccacgctccagaccgcctccgccacggacaacgtgtggcgtccgctggccaagaatcccgtcgtgatcgagttccggccgaagggcggaaagacctggagccgggccaccacggtcagcaccaacagcaagggcgtcgtctcggcgtcggtcaccgccgtcaaggacggcgcctggcgcgctcgttacgcgggcaccgccgaccgcgccgcggctgtcagctcctccgacaacgtggacgtcaagctgcggaccgccgtatccggcttcaacgcgtcccccgagccggtccgcaaggggcgcaccatcaccgtcaagggcaccctgcgcagcctggacggcacctggaagaacgcctccggccagtccgtgatcatcctgttcaaggccgacggctccagcaagtggagcaagtcggcgaccgtacgcaccaatggcaagggggtgttctcgaaggggttcaccgccaagaaggacggcacctggaaggcgcagttcaaggccacggcgtcccgtctgggcacgatcggctccggcgaccgggtcgacgtgcgctgacccggatcccgttcgtcacggcagccgcgcctctgcccctctcccgtcgtccggggagaggggcagaggcagcggcagtggcagaagccgtgccggtggcggagcaggtcagggggcggtgccccaggcgagggtggagccggtgaacacgccgaccctcggggcgtcggcgaaggtggtgttggtggtgcggctgtagtcgtcgctctcctggaaggccgaccagtcgctcttgttgagccgcagttggatctctccggtcgtggcgcccgccgccaggctgccgctgccgaagccgacctccaggtagtggctggcgccggtggccggtgcgcttgccgaccggacgccgtgcgtcacgttgccgcagccgagcaccgcgtagtcgcaggcggtggcgaaggtgctcgcaccgccgtcgggggtgaaccagtagcgagccgtgaccgtggacaggtcgatcgcggccgaaccggtgttgaccaggcggagggacatccggatctggttgtcggtcggggaggcgtcggtgttgcggtactcggccttgagcgctcccgttccggtgccgccgcccgcctcggtggtgacctgcgcggccggggtcccggccgagacgttgcctgccgcgtccttggccctgaccgagtagctgtaggcggtcgaggccctcacaccggtgtccgtgtacgtcgtcgccgccgtcgtccccaccggggcgccgtcgcggaggatgtcgtaccccgtgacgccggtgtcgtccgtggacgcggtccaggcgagggtgacgctgctgctggacttggccgtcactcgcaggctcgtgggcacggtcggcgcctgggtgtcctcctcacctccgctgccgccgtccagcggcgggtgggcgttgcggagcagctcccggaactgtccggagaaccagtgtccggccaccggggagtcgggcagggctcccgtgaggttgaagccgttgcggccgttgccggtgtacgtcggatcgcacatccggtcgaagcccttgccctcgtcgttgtcgacgggctcgctgctgccgtcggactcgcccgggggcttggcccagacgtaggcgtcgatccccggctcgggtgcggccgtgggtcgctcgccgatgcccgcgccgctctggttgcaccagttgcccgcgtggatgcggcggtccgtccggccaccgtcgacataggcgtcggcgctggtcagcggtccgggtccggtgggccgggcggagccgccccagccgttgcgggcggtgtcgatgagcatgccgatgtcggaggcgaagccctggcggaccagttccgtgcgcagggccttggcgaacgagagctcgtccacgtagtagttccagtccacccagcgcgactggcgcaccgtggtcccgttcacggagtcggtcaccgcgaagtgcggctccttgagcgccgagtagttggccgtgttcacgatgaagccgtgcacgtcggagacggttgctccctccgtcgtcgcggccttcttgaactgctgcgccgcggggacgaagttggagtcccagccgagccagccgtggtgggcggcgtcgacgtagttgtagacgttgggcagagcgcccagggtgtgcagggcgtatccgatgcccttctcgtagttgccgttggccttcatcgtggcgcactcgggcgtggagccggcggtccctccggcgttggtgacgaggttgggcagcgagtccggttcgatgagcgtgacgatgcgcaggctcgcgtaggcggggtcgccgaggatgtcggcgatggggtcgatgtagtcgtccttgtagcggcccagctcggtggggccgagttcaccgttggaggcgagtgccgcgcagtcccggccgggcaggttgtagatgacgacctggaagaggtcggctccctggttcacggccgtgtcgaggtgcgcgcgcaggcctcgcgcgccgggtgtgccgccgatcgcggcgatgcggtccatccagacgaacgacggctcgtccgcgatgacttcgccgccgggctcggatgcggccttggcggaccagtcggggttcacgtacgcggtggcaccggcgtaggggttgtcgacgcgggcggcggccgacgcctgtccgggtacggcgaccgcgagtgccgcacccatgatcagtgcggacagtgcggcggccgctctcctgcggaatgcgtgcggtgcgtgcggggtggtgcctctggttctcattgcggctccgtgctcctctcgtacgtccgtcgggggtgtcgacggacgggttcaggggtccgtgacgctcaggaggtaagggattctgctggggcaagcgtgcgtgtgggagcgctcccaaactggcgcggcattcgacggctgtcaagcggtgtagcgcaataacgttgcatggaaggccagttggagagaattggagcgctcccatcaaggctgaacaggcggcacgagcacatcaccggtcgagttcgcgtcgacgattggccgactaccgacttgcggaggggtgcgcgcgtcgccacgaaagaagatgccgcaacgctggtctaggccaggccagctccgtccccctatcctcacctgtagccggtgacagaccaactcccccacccaggttgcctgccggctcgcgccccccactcaactccgctcgagcagccgggtgacctccccccttcgccgcctccaggaggccacggtgaaatttcgcaccagaagctcggcgatcatcggcacgctctgcctcgtcacgtccctggccctggcctcggcgtcggccgtcgagcccgccgccccggtcaggccggtgaccgcgtccctgaccgaagtggccagggcccaggggccgtcggccgggacggccggacccgatgacacgctatggatcgccgaacgcgcgggcaccgtaagggtcctggacgatcgaggcctcggggcacccgtgctcgacatctccgacgagaccaccaccgacggcgaacgcggcctgctgggcgtcgcgttcgaccagacgttcgcgcacttctacatctcgttcacggacctcgaaggcaccagcacggtggacgagttcgccgtggagggcggccggctccagccggatacgcggcgaaccgtcctcacccagacccagccctacgcgaaccacaacggcggggacatcaagttcggccccgacggctacctgtacatcgccttcggtgacggcggctcgggcggcgacccgcacggcaacgggcagaagctcgacaccctgctgggcaagctgctgcggatcgacccgaccggcggcgagccgtacgcgatcccggcggacaacccgttcgtggacgacgccaacgcgaaggacgagatctgggcgtacgggctgcgcaatccgtggcggttctccttcgacgccggcacgggcgacctgctgatcggcgatgtcggccagagcgactgggaggagatcgactgggccccggcggacagcaagggcggtgagaactacggctggtcctccatggagggcacccatcccttccggggcggcacggagcccgcgaaccacgtcccgccggttcacgagtacgaccgtacgggcctcgggtgctcggtgaccggcggattcgtctaccgcggcgacgcgctcccggaccttcgggggagctatgtgttcagcgactactgcgacggcaccctgcgtacgctccggatgaaggacggtgaggtgaccggcgtcggcgacctcggagtcagcggcggcgaggtgatctcgttcgtcgagggcggtgacggcgagctgtacgtcctcggcagcggtggcgtcgtctcccgcatcgatcccgcgtgagctgctgaaacgcgcgggaggccagctgcgcggaccggtgaccggggcccgccgatcatgacgatcggcgggtccctgtcctctggtccgggcgtacgcgaggtggctcggaccctgatcgtgcggcaggcgccccgactcgccgtcccgcgctcgtcacggcaggctccgcccgcgcggagccgggcggctcaccttctccgcgccttcgccgcgctgatggccacggcgggcgtcccggtcgaagatgcccagcagctcgcacggcccgccctcggcaccgatcgcgtgcggaagcatcgtggggaactccgccgcctggttcgtctcgatccgcaggcgccgatcgcccaggagcaggatcgcggtgccggagaggacgacgagccactcgcggcccggatgcgcgcgcagtcgtgaagggtggtcgggcggcggctcggtcatgcgctgacggatgacggtcatgccgggttccgctctgatgggccaccgcatctgaccgtgggccccgtcgatcatcgggttggagacgatgtcgtcggaggcggtctctaccaactggtcgagggaggtgtccagggcacgagcgagagtgaccagctggtccagggccagtcggcgccgaccgttctcgatgcgactgagcgtggactggctgatcttcgctcgggcggccagctcctccagggaccagccctgggccacgcgcagggcgcggatgcgtttacgcaccaggctgtccagctcagcatcttcttgcgtcataggcatgagcctatgccattgaggcaaggcccactgagtgtcggttgatcaaggagcgcttgtccgggccacccgaggcacccacaccgcgggcgtaggtccccggatcgggcgacgcgggccggtcctccccctgtcacaaccgatcgttgacggcctggactcgaccatcctgacaggtccgtgatccaacatccgagctctcgcgtgccacaaccagtggttgtgctcacttagggttcagggcatggacatcgaagccgtgcgcaccttcgtcaccgtcgcggacaccgggcagttccaggaagccgccgtggacctgcgcatcagccagcaggccgtctccaagcgcgtggcgggcctggaacgtgtgctcggggtgacgttgttcgtccgcacagcccgcggagcgcaccccactccggacgggcaggcgttcctgcctcacgcccgcgaggtactgcgagccgtggagcgggccgccgtttcggtacgtcccggggaccgtgcgctgcgcgtggacgtgctccaccggcgtatcgccccggcgctggccgtacgcggcttctaccaggcccaccccggcacggacctcgacgtggtgaccctcgcggacacgaacgtgaccggggcggtggaggcggtgcgggccggcgagatcgacgcgaccttccgctccgtgcccgcgggtgcgctgcccgacgggatcagcgccgaacgcgtcctggacgatccgttgcagctcctcgtcgggccgcgccacccgctggcctccgcccggtcgttggccccggcggacctggccggccaccggatctggatcccgggcatcaagcagggcaccgagtgggccgcctactacgaccggctcgcggaggacttcggtctgcgcatcgacgcggtcgggcccgacttcgggaccgaggcgctgatggactcgatcgccgactcggccgcgctggccacactcgtcggctcccgggacaggtacgtgtggccggccgcgcatgacctgaggcgggtcccggtggtgggaccgacgccggtctatccgcacgggttcctgtaccggacgggcaacccgcatccggttctggcggcactgcgcggatatctcgtgcagacgcggccgaagccgccggccgatgcctggacaccggatcgggcccgctgacgcccgtcggcggaggccccgcctcgacggccgccggccccgagtcgcgagcggcctcggctcaggggcgtcgcgtgggaacggggcggtggagcctgggccagcgggcgagcatctgccggcgcatgtccgtgcagaggctgctcagtccgctcagaccgtcatggccggcggtcataccgccgacgacaccgagccggtggacgagacgctgccgggcggtcacggtgccccatttccagtcgcggaccgggatccgggccaggtgatcggtgccttcgcggtgggctctctggaccagggcgtctccccggatcagccagccggcgcaggagtcggtgaggtcgccgtggagttcgccgccggtctcggtgcgccatgccgtgcggtaggcggcctcggcccgttccagcagcggggcgggtgccgcggtgacacaccagcaggtcggaaagccgatgcgcaggtaggcgagttccaccagtccgctgcccagtgaggcctgctcgaagtcgatgaaccgggtgccgccggtggtgtgcaggtcattgccggggcacgggtcgccgtggagcagggcgtgcccgggagcccgggcgagccggtgcacgaggccgtcgagctccccggggactccgggagggacggaagcgtcgagggccgcggccagccggaggaaggaggcggcgtcggcctcgtccgggccctgccagcggggcagcactccggcgtgctcggggcgggcgacggcatgcagccgggccagtgccgccgcgtagtcgacgatccagtcgccggtggggtgtcggtggtccagatgctccaggaccagcacccggtcgccgggggcggtgcccagcagtgcgggcaccacggccggatcggctcctgcggcgagccgcaacgcggccagttcacgggcgtaccgctcgtcggcgtcgggaccgccgacgatctgcttcaccaccacgggcgtcccggccgtctccacccgccacacccgtgagcgcgggctgctgctcagccgtcgggagcgcctcggagcgcccagtccggcccgtaactcgtccccccacggcagccgcgatcccatgcgcccatcctcgcacgcgggcccggcctgatctgtggggtgcacgaaccacctcggcggcccggcgcgccgggc

SEQ ID NO: 3085 - DNA, 5326 bp, Unknown
  Kingdom: Bacteria, Phylum: Actinobacteria, Class: Actinobacteria, Order: Streptomycetales, Family: Streptomycetaceae, Genus: Streptomyces
cggaggcgatgatctcctcgccgagcagccgccgcagcgtcgagtccgccgcccgtatccgggcgtcgagaaccacctcgggggaggcggtctcccagacggcgggcacatggcgggccaccagcacggggttgaagttgtagaaggtggcgccgacggtccccgcgcccaccgcgccgagcgcggcggcccgggtcgcgaagtaggcaccggcggggtcctcgataccgatcttcgccatctccgcacccaggtcgggggagaagaagaggcaggagtgcagggggttgacggcgttgtggcagcggcgctccgcgcgggccgggagattactcataccagcacgttaccgactggtcggtacggagcggaaccccgggggagcggggtgatcctccaggtcgggtccagcgtaggccgaccgcggatcgagggcgtccgatggcaggaaaggtggggtactcgtcattgcggccatcgtcgccgaccgcacaggatgacggacgtgaagcagcgaaccgtcctcgtcgtcctcttcgacggcatccagagtctcgatgccaccggtccgatggaggtcttcgccggagcctcccggtctccgggcgtctcctacgacctgcggaccgcctcgctcgacggcggccccgtccggtccaccagcggcctgaccctggtgccggacagcagcctggccgacgcgcccgcaccgcacaccctgctggtgcccggcggacagggcacccgcggctcccacccggagctgaccggctggctgcgcgagcacgcgcctcgggcggagcggctcgtctccgtgtgcaccggcgccctgctgctggccgaggcgggcctgctggacggccaccgggtcaccacccactggaactactgcgagcggctggcccgtgactatccggccgtccgggtcgaccccgaaccgatcttcgtacgggacgggcgactggccacctcggcgggcgtcaccgcgggcatcgacctcgccctcgcgctcgtcgaggaggaccacgggcgggacctcgccctggacatcgcccggcacctcgtggtgttcctgcgccgccccgggaaccaggcccagttcagcgcccagctcagcgcccagaccgcccggcgcgaaccgctgcgcgaggtccagcactggatcacccagcaccccgacgccgacctcggggtcgacgcgctcgcggcccgcgcgcgactctcgccccggcacttcgcccgcgcgttccgggcggagaccggaacgaccccggggcggtacgtcgaacgcgtccgcctggagcacgcccgccggctcctggaggacaccgccgacggtgtcgagcggatcgcccgcgccagtggctacggcaccccggaagccatgcgccgagccttcgtgaggacccttgcgacggccccggccgaataccgccgccgcttccgcacccccgcatccagcaactgacctcccccagcgactgacctcccgcagcaattgatcatcaacagcgctgaccgcccacacaccgccaccgaccgaaccgagaggcagctcccgtgcagatcgccatcctgctcttcgaccgtttcaccgccctggacgcggtgggtccctacgagatgctcggccgtgcgcccggtgccgagcccgtcttcgtcgccgaacggaccggccccgtccgcaacgacagcgggagcctcgcgctcgtcgcggagaagaccctcgccgaggtgccctccccggatctggtgatcgtccccggcggtcccggccagagcgaccagatggcgaacgaggccctgctcggctggctgcgctcggtcgacgccaccagcacctggacgacctcggtctgcaccggttcgctgctgctggccgcggccgggctcctgaaaggcaggagggccacctcgcactggctggcgctggaggcgctgaaggagttcggcgtcgagcccaccggggagcgcgtcgtcctcgacggcaagtacgtcaccgccgccggggtctcctccgggatcgacatggggctgaccctgctcggccggatcgcgggcgacgacgtggcgcgctcggtgcagctgctcacggagtacgacccgcagccgccctacgactgcggatcgccggagaaggcgcccgcggcgctcgtcgaggaatggcgggccaagagccgtcacatcacccggtagggcccgtggtccaggtgaaccggggcgtgcgccgctccaggaaggcggcgacgccctccgccgtgtcaccggtgttccgcgcctcgtcggcccagtgggcgtcccggtccgtccggcccgcggcgaactccttcgccgcggcctgggtgagcagggaccgggacgccaggacccgtacgtactcctcgacccgcttgtccaggccgcccgcgggcagcacctcgtcggccaggccggtgcgcagcgcccgttccgtgccgatcagctcgccggagaacagcaggtgcttggccgtggccgggcccacgagtgcgaccagccgccgggtcgaggaggcggggtagacgatgccgagcttggccggggtgaccccgaaagaggccccctcctccgcgaaccgcagatcgcaggcggccgcgagctgactgccgccgcccacgcagtagccgcgcaccgcggccagcgtcggccgggggaacgcggcgagcgcgtcctcggccgtcaccgcccaaccctgggcggattccggggtctcccgcagcgtggagatgtcggccccggcgcagaaggtgtccccggctccggtcagcaccagcacgcggacggccgggtcggccgcgagccgctccagcagctccggcaggctccgccacatcgcggtggtcatcgcgttgcgcttggcggggttcgcgatcacgacggtggcgatgccgcgctcgacggacgtgatcagacggggttccgtacggtccatgcgccggatgctagccggagggttcgaacctatgatcaagaaggggtcgcggggcgggcacgcaccgtaaggagtcatccatgaacgcacccaccgccgagggcaggaagctcagccgcagtctcggctggctcgcgctactcggcacgctgctggtgatcgcgggcgtcatcggcctcgtctacaccggcgtcgccactctcacctcgatgctgctcttcggctggctgctgctcgtcggcggtctggtcgggctgctgcacgcgatcgagtcacgcggtacgaactacttctggctgggtgtggtggtcgcggccctcaacatcgccgcgggcgtcgtcgtcatcaagcaccccgagggcacggccgaggcgctgaccatgttcgccgccctgctcttcctgaccggcggggtcttccggctggtcggcagcgtcgtggtgcgcggtccgcagatgggctggacgctgcttcagggagctttcggcctgctcctgggtctgctggtgctgttcgactggccgcacagcagcctctacgttctcggctgcttcttctcgctggccctgctgttcgacgggctcggcctcatcgccttcggcctcggcggccggcgcatcgtcagcatggtctcggatcggctcgatgaaagtgctccgcccccggacgagccgatcaagtcaccagaagacggccggaagtagtccctgggctgccaggaacatgcacgtttggtcaaatagcgccgatacctggctacttccggtcagtggcacggtccggaccaggccattcccaacactctttactcgacggtcagtgcagtgcgagtgagagctggtgccggacgatggagagcctcgggagtgcccccgccgaccccgtgtcgtacgagggggtgtggcgcttcaccgcctccgccgtggacgcctccgtgccgagcgcccggcacgccgtacgcgacctcctcgaccggcagggcgtaccgatcgaggacgacatcctccagggactcctgctgatcgtctcggagctggtcaccaacgccgtcaagcacgcggcactcctctcgcccgagctggccgtcgaggtggccatcgccgccgactgggtcagagtgtcggtcgaggacaaccatccctaccgccccacggccctggagacggactacgcgcagaccggcggccggggcctgctgctggtcaaggtgatcaccgcggaggcgggcggcacctgcgacgtcgagcacaccgcgagcggcggaaagatcatctgggcggcgctgccgttgaagacgcagctctgaccgccccgtacggatacgagcgagggttcaccagcccgcggaggggcccgtcagctcgcggatcgccggccgcgccgcgtccagcaccgtcatgaaccacgccgagaacggtgcccgcgcgtgccgctccgccagctcggccgccgtcacgaaggccgtctccccgacctcttcggggtccggcttcagagccgtctgcgccatccccacgaacaggtgattgaactcctgctccaccaggcccgaggcgggatccgggtggttgtagcggaccgttccggcctcggccagcagcgagggggagagtccgagttcctcgtacgtacgccgggcggcggccgcgaacggggcctcgcccggataggggtgcccgcagcaggtgttcgaccagacgccgggggagtggtacttgccgagtgcccggcgctggagcaggagccgcccctgctcgtcgaagaggaacacggagaacgcccgatgcagctgtccgggggcctggtgggccgccagcttctccgcggtgccgatggtggtgccgttctcgtcgaccagttcgagcatgatcgcttctgcggtgccgttcgacgagctgtgcgtcgcggtggctggtgtggtcggcatacccatccttcgctttggttcccggcctcgtgcgccgggcccctggagtccggtcaagtctgccgtacaaaagccgcttgtccgcacttcgggtccgggcatgtccgccccgccgcgcctcccgggcacggcgggacggacgggtcatcagactccgaaggccgccggataacggatcatgcccgccggaacagggacggaatcgtccagcaccagggccatcatcgcctcgtccggcacctcgaaacctggccggatcccgtaccgcgaggccggtacgaaaccgaagcgcgggtagtactcggggtggccgagcaccagcaccagcgcctcaccgcgcatccgggcggcgctcagcaccgcccgcaccacggcctgccccgcaccctgccgctggtacgcgggagaggtggccaccggggccagtgcgagcgccgcccggatgcgcg

SEQ ID NO: 3086 - DNA, 2743 bp, Unknown
  Kingdom: Bacteria, Phylum: Actinobacteria, Class: Actinobacteria, Order: Streptomycetales, Family: Streptomycetaceae, Genus: Streptomyces
agggtcctctcggtcttcgcggcggcggcccgcgcgccggagtgcgccggcttcccgcctcccgccgcgtcgtcgccgcccccgcagccggtcagcaccgcacccagggcgagggctcccgtagcggtgagcgcccccctgcgcgtcgtccccgtgcgccgcacgtttctccttcgggcctggaccggtcctgacaggatctgtcctgatgtgatcaccgcaggcgagcgtacccgcggccgagcggcaggcggacggcaacacccctggcgaccggataccctttgacctgacgcacgacgatccccacaacagcacacgcggccgaggagtcacccggatgagcaccacccagagcgagaggctgcgcgggttgctggaaccgctcgtcagcgcgcagcagctggacctcgaggagatcgaggtgtcccgggccggccgccgaggagtgctgcggatcatcgtggactccgaagagggcgtggagctggacgcctgcgccgagctgagccgcgcgatctccgagaagctggacgagaccgacgcgatgggcgagggcgagtacgtcctcgaagtcagctcccccggcgcggaccgcccgctgaccgagcaccgccactacgtacgcgccatcggccggctggccaggttccacctggccggcgacggatccgatgagctggtcgcccgcatcctcgccgtggacgaggacgggctcgacctcgaagtgcccggcgtcaagggccgcaagcccaccgcgcgccgcctcgccttcgacgagatcgccaaggcgcgtgtggagatcgaattcaaccgcaaggacaagaaggaagaggaggcgtagccgtggacatcgatgtgaagcttctgaagggcttggcgcaggacaaggagatccccttcgacgtgctcgtcggggcgatcgagtcggccctcctcatcgcgtaccaccgcaccgacggcagccaccgccgggcgcgcgtggagctcgatgcgaacggccacgtcacggtgtgggccaaggaggacccggccgacctcgaagagggccaggagcccaaggagttcgacgacaccccctccggcttcggccggatcgccgcgacgaccgccaagcaggtcatcctgcagcggctgcgcgacgccgaggacgaccgcacgttcggggagtacgcgggccacgagggcgacgtcgtcacgggcgtcgtccagcagggcaaggaccccaagaacgtcctggtcgacatcggcaagatggaagccatgctgccggtccaggagcaggtcccgggcgaggagtacgtgcacggcctgcgccttcgtacgtatgtcgtacgggtcgccaagggtgtccgcggtccgtcggtgacgctctcgcgcacccacccgaacctggtgaagaagctcttcgcgctggaggtcccggagatcgcggacggctcggtggtcatcgaggccatcgcacgcgaggccggtcaccgcaccaagatcgcggtgcgctccacccgcgccggcctgaaccccaagggcgcctgcatcggcccgatgggcagccgtgtgcgcaatgtcatggccgagctgcacggcgagaagatcgacatcgtggactggtccgacgacccggccgagatggtcgccaacgccctctcgcccgcccgggtgagcgaggtcgaggtcgtcgacctcggcgcccgctccgcccgcgtcaccgtgccggactaccagctgtcgctggcgatcggcaaggagggccagaacgcccgcctcgccgcccgcctcaccggctggcgcatcgacatccggccggacaccgagacggacgaggagcgcgagagcgccgaccgcgagcgggccgagcgggcccgggagcgctcggaaaggcgttgacccggagcggctccagggaatagatctgggcagtacgccgctgagatcacgacaacatccgttcgatttttgccccaaagcggcgaggtcggtacggggaggtagacttaaccgtgtctggccggacgcaagcccgcgcttgccccgagcgaacctgtgtgggatgccgggagcgagcggccaagagcgagctgctgcgcatcgtggtggacgagggcgcttgcgcccctgatccacgcggtacgctgcccggccggggtgcttacgtgcaccctgtctccgactgtctcgccctggcggttcgccgccgggcgttcccccgggccttcaaggccaaggggccgttcgacaccgcggcactgacgcggttcgtcgagcgggttgcaccgtaagaaaagtgaacggcacgggtccccgtgcggtcaggtacctcgcgagttggaagtaggtcgagattgcgatgagcactcgatgagtacgcgatgagtacgcccatgaagtagcgacggtccggcggtaacccggacctaaaaggagcgaagtggctaaggtccgggtatacgaactcgccaaggagttcggcgtcgagagcaaggtcgtcatggccaagctccaagaactcggtgaattcgtccgttcggcgtcctcgacgatcgaggcgccggttgtacgtaagttgaccgacgcactgcaggggcccggcggcaacgccggcaagtccgctgccaagcctggtgcgccccgcaaggcggcgcccgtgaagcccgcagcgccctccccggccgctgcggcacgtcccgctgccccgaagcccggcgcaccggctcccaagccggccgaggccgaggccccgagc

SEQ ID NO: 3087 - DNA, 900 bp, Unknown
  Kingdom: Bacteria, Phylum: Actinobacteria, Class: Actinobacteria, Order: Streptomycetales, Family: Streptomycetaceae, Genus: Streptomyces
gggccgctgcctccggctccggctccgcgtcctcgtcgtccacggccttctccggctcacgctccggcagttcggcggccagcgccgccgccgcctgcaccagcggcagggccagcagcgcgccgctgccctcacccaccgtcacaccgtggtccagcagcggggtcagcgccatccggtcgagcgccttcgtctgcgcgggctccccgctgacctgaccggccagccaccagtccggcgcccggaacgccgcccgctgcgccaccagcgcgcaggccgccgagacgaccccgtccaggatcaccggcatccggcgcaccgcgctctgcaacaggaaacccgtcatcgccgccagatccgcgccgcccgacgtggccagcagctccaactggtcgccgagcaccggcctggcccggcgcagcgcgtcccggaccgccgcgcacttgaccatccacgccaggtcgtcgatgcccgcaccgccacgaccggtcaccaccgaggcgtccgttccgcagagcgccgcgacgagagtggccgcggcggtggtcccgcccacgctgaggtcgccgagcaccaccagatcggtgccggaatccgcctcctcgtcggcgatggccatgcccagacggaccgcctgctcggcctcctccgcgctgatcgcgtcctcgacgtcgatccgacccgacccccgccgcacccggtggcgcaccacggaatcgggcagcagctccggatcgcagtccagggagacgtccacgatccgcatcggcaccgagaagcgccgcgccagcaccgagaccgggctcgcgccgtcgagggctgcccgcaccagctcgtgcgcgcttcccgccggccggcccgagacgcccagctccgccaccccgtggtcaccggcgaaga

SEQ ID NO: 3088 - DNA, 3701 bp, Unknown
  Kingdom: Bacteria, Phylum: Actinobacteria, Class: Actinobacteria, Order: Streptomycetales, Family: Streptomycetaceae, Genus: Streptomyces
ggccatcagcaggacgagggtgccgcgcagccgggcgacggcttcccagtcgaccagcgagcgcgggtcctcgggggcgacatggccgctgaccacggtgaactcatgggccacgccccggtgggtgaccgggatgccggccgccccggggacggagatggtgctggagatcccggggacgaccgtgcaggggatgccttcggcggccagcgcctgggcctcttccatgccgcggccgaagacgaacgggtccccgcccttgagccggaccacggacttgcccgccttggcgtgctcgatgagcgcctggttgatcgcttcctgggccatgaacctcccgtacgggatcttcgcggcgtcgatcacctcgacgtgcggcgggagttcgtcgagcaggtcgcgcgggccgaggcggtcggcgatgaccacgtcggcctcggcgaggaggcggcggccgcgcaccgtgatcaggtccgggtcgccggggccaccgccgacgagcgcgacaccgggggcgtggttgcggtggtgcggggcggcgagggtgccgtcgcgcaggccttcgacgatggcgtcgcggagggcggcggagtgccgggggtcgcggccctgggcggtggtgttgaggacggcgacggtgatgttgtcgatacggccggtggccggggtccaggcggtggcggcctcggcgtcgtcggcccggacacaccaggtgcgggtgcgctcggcctcggcggaggcggcgtcgttggccgtggtgtcggaggaggcgatcagggcgtaccaggtgtcggcgaggtcgccgtcctggtagcggcggcgctcccagcggatctccccggcgtccgccatggcctcgacggagggcgtcgcggacggggagacgagcgtgatgacggccccggtggcgatgagctgcggcagcctgcgctgcgcgacctgtccgccgccgacgacgacgacgcggcggccgtgcagacgcaggccgacggggtacgcggggtggtcggcgtgacctgcgcggtcggcgcggtcggcgtggtctgcgtgctcggccatggcggtacgggctcctcgtgcgggtgctgcgtaggggccgctgcggcggtggagcggctgtgacgtgcggaaagctgaggtctgggtcggggacacgatacggggtggggggcgcctgcggcgggcctgtcccctacccggcccttcccggaatcggggctccgctccggatcccctcttgtccccaagcgccggacgggctggtttcggggctccgccccggacccgctcctctaacgccggagaggccgggcgggcgaaggatcgccagaggtgaggcgggggtcggaggcccccgcctcaccgcttgctacttctccgtcacgcccgccgagtcgaacgtcgccacctcgtgcatcgcgcgtgccgcgctctgcacgatcgggagcgccaggagcgctccggtgccctcgcccaggcgcaggtcgaggtcgaccagcgggcgcaggcccagcttgttgagcgcggctacgtggccgggctccgcgctgcggtggccggcgatgcaggcggccagtgcctcgggggcgatggcgcgggcgaccagggccgccgcgcccgcgctcacgccgtccaggatcaccggcgtacgcagggaggctccgcccaggaggaagccggccatcgccgcgtgctccaggccgccgaccgcagcgagcacgccgatcgggtcggtcgggtccggctggtgcaggtcgagggcgcggcggacgacgtcgaccttccgggcgtgcatctcgtcgttgatgccggtcccccggccggtcacctcggaggcgtcgatccccgtgtacacacagatcagcgcagccgacgcggtcgtgttggcgatgcccatctcgccggtgagcagggccttgttgccggctgccaccaggtcccgggcggtctcgatgcccacctcgatcgcggcgaggacctcttcccgggcgagcgcggggcccgtcgtgaagtccgctgttcccgggcgtaccttgcggggcagcagacccggggtcgccggcaggtccgtggccacacccacgtccacgacacagacctccgcgccgacctgggccgcgaaggcgttgcagacggctccgccgcccaggaagttcgccaccatctgggcggtcacctcctgcggccaggccgtgacgccctgggcgtgcaccccgtggtcaccggcgaagatcgcgacggccgcgggctccgggatcggcggcgggcacatccgggagagcccggacagctgtgcggagatgatctccagcatgccgagcgcgccggcgggcttcgtcatccgcttctggcgctcccacgcctcgccgagcgccttcgcgtccagcgggcggatcgcggagatcgtctcctggagcaggtcgtgcggctctgcgccgggcagcgcgcgacggccgtacgtctcctcgtggacgacccaggacagcgggcggcgcttggaccagcccgcctgcatcagctcgggctcctcggggaactcgtcgacgtaaccgacgcacaggtaggccacgacctccaggtgctcggggaggccgagcgcgcggaccatctcccgctcgtcgaagaagctgacccagccgacgccgaggccctcggcgcgcgcggcgagccacaggttctcgacggcgagggccgaggagtacggcgccatctgcggctgggtgtgccggccgagggtgtggcggccaccgcgggtggggtccgcggtcaccacgatgttgaccggggtgtcgaggatcgcctcgatcttcagttccttgaactgcttcgcccggcccttgggcagcgacttcgcgtaggcgtcgcgctggctctgggccagctcgtgcatggagcggcgggtctccgcggagcggatgacgacgaagtcccacggctgcgagtggccgacgctcggcgcggtgtgcgccgcctccagcacccggagcaggacctcatgcggaatcgggtcgctgcggaagccgttgcggatgtcccggcgctcgcgcatgacccggaggaccgcttcccgttcggcgtcgtcgtaaccgggggcgggcggggtgaacggctcggcctgttcggcgggctgcgctgtcgcttcgggccgctctgccgcttcgggctgttctgctgcctcggtctgctgcggtgcctcggtcggtgcctgctggtcgggctccgggagttccggtgtctcgatgacttcggggccggtgccgtcctcggcgtcgggcgcgagcacgtcggctgcttcggcctccgtcgccacgccgggctcgacagcgggctcggggacggggaccggggtggcttcctgctccgtcacggggagttgctgggccgtcggctgctgcgcctccgctgcctccgcttcctccgtcacggactcggcggactccacaggtgctgctggcaccaccggctccacgaactccgcgacgacgggctcgggctgcacgggctcgggtgcgagcggctcggccaccggctccgccacggcggtctccggagccacgacagcttccggagccgcggcagtctccggagccacgacggcttccgggctctcggccgcgggtaccgccgggatcggctcgggggccggtgcgacgagctgctcctgctcgggctgcaccaccggctcgggctgcaccaccggc

SEQ ID NO: 3089 - DNA, 6042 bp, Unknown
  Kingdom: Bacteria, Phylum: Actinobacteria, Class: Actinobacteria, Order: Streptomycetales, Family: Streptomycetaceae, Genus: Streptomyces
ggcagatcaccgcgctcgcccacctcggccgcgacgcgcgctcggcccaggccgccctgcatgccgctctcggcgccaccgacgccgccgagctcatcgccccgctggcgggcatccgcccctatctcgatgcccgccacaccggcctcgtcgaatccctggacgccatcgaggcccggacgcacaaccacgccactggcgatgactgactcccaccgctcagaggcacatgcgggtccggcccgcgccgaaccacgccggtgacgggcaacggaccgtcctggcccgactccgattcccttcatgacgttcccacagaaagagatccccatgggcagcaatgtcgagacgctggaattccaggcggagacccgtcagttgctccggctggtgattcactcgatctactcgaacaaggacatcttcctgcgtgagctgatctccaacgcctccgacgccctggacaagctgcgactggaatcgctgaccgactccagcctcgagatcgattcggccgacctgcacattgcgctggaggtcgacccggaagcccgcaccttgaccgtccgtgacaacgggatcggcatgacccgcgacgatctggtggagctgatcggcacgatcgccaagtccggcaccgccggcctgctggagaagatcaaggagtccaaggacgccgccatcgccgagagtctgatcggacagttcggcgtcggcttctactcggccttcatggtcgccgacaaggtcaccctgcgcacccggcgggccggcaccgacaccggcaccctgtgggagtccgacggcgagggcacctacgccatccagaccgtcgacggcctgcccgtgggcacctcggtcaccttgcacctgaagcccgccgacagcgaggacggacgcgccgactacctgtccgagccgaagatccgtcacatcgtcaagcagtactcggacttcatccgctggcccatccgcatggcaaccgagcgcaccgccgctgatggcgcgaccagccgcgagaccgacacgctcaactcgatgaaggccctgtgggcccggcctcgcaccgaggtgaccgaggacgagtacaaggagttctaccagcagatcagccacgactggctgcccccggccgagacgatccacatgcgcgccgaaggcaccttcgagtacgaggcgctgttgttcatcccctcgcaggcacccttcgacctgttctcccgcgagtccaagcccggcgtgcagctgtacgtcaagcgggtgttcatcatggacgactgcgaagcgctcatgcccaactacctgcgcttcgtcaagggtgtcgtggacgcccatgacctgtcgctgaacgtctcgcgcgagattctccagcacgaccgccagattcacggcgtgcgcaggcgcctggtcaagaaggtcctcggcgccctcaaggacatgcagaccaaggacgccgagcgctacgcgaaggtgtgggagcagttcggccgggccctgaaggaagggctggtcgaggacacggacaacaccgaggccctgcttcagctggtgtcggcggcctccacccacgacccggacaggaccaccacactgcgcgagtacgtcgagcgcatgaaagacggccaggacaccatctactacctgaccggcgagagccgcgcgatggtggagaactccccgcacatggaagccgtcgccgcgaacggctacgaggtcctgatcctcaccgaccccgtcgacgaggtgtgggtcgaccgcgtctcggcgttcgacggccaccctctgcagtccatcgccaagggccaggtcgatctcggcgatccggccgacggagagaaggaagccgacgccgcccgggcgcagcgcgaagaggacttcgcctccctgctgccctggctgaccgacgccctgtccgaacaggtcaagcaggtccgcctgtcctcacgcctgaccacctcggcagcctgcatcgtcggcgacgagcacgacgtgacgccgaccctggagaagatgtaccgggcgatgggccagcagatgcccaccgtcaagaggatcctggaactcaacccctcgcaccctctggtcatcgccctgcgcacagcacacggcgcggacgccgacgaccccgcgctcgcggaggtcgccgagctggtctacggcagcgcactgctcgccgagggaggcgacctgcccgacccgtcccgcttcacccggctgctcgccgaccacctggcgcgcacgctgtagccacagggtgcggtccggcacccggtgaacccgctcgcggcggcgcccccgtagggggcgccgccgcaggcgaatgcggtggggcaggcgatgccgtccgatcccgcgcctgaaggaggaggcacagcggcctcccacctgagcggccacttagccacaccttaaaacgaccataaggatcgtcaccaccccctctcatcaggccttttcgaccttccgagcggctagcttgctgatcgccacccgcacagccgtgccgtctcgaaggagatccatccatgaccgctcgtcgcaggaccgccggtatcctcgccctcggtttcgcaccgctcgcactggccggactggcctccgccccggccgtcgcgcacggttcgctcaccgacccggtgagccgggtgtccgcgtgcttcgcggaggggccggagagccccgcgtcggcggcgtgccgggcggcggtcgcggcgggcgggacccaggcgctgtacgactggaacggggtgaacatcgccaacgcggcgggcaagcaccgtgagttgattccggacggcaagctgtgcagcgcggccaacgacaagttcaagggcctggacctcccccgcgccgactggccggccaccgcgatgtcggcgggcaagcacaccttccggttccgtgcgacggccccgcacaggggctcgttcgagctgtacctcaccaagcccggttacgaccccacgaagccgctggcctggtcggacctggaggcgaagcccttcgccgaggccaccgacccggcgttggagaacggttcgtacgtcttcgacgggacggtccccgagcgctccgggcggcagctggtctacacggtctggcagcgctccgactccccggaggcgttctacgcctgctccgacgtgacgttcggcggcgggacgcgggacggcggcgcggaggaggatcagcagggttccggtggcgattccggcgccgagaccccggcgacggcgccctccgcgccgtccgaggaggcgatcgccgaaggctccgggaagtcgtcggtcgagcacaacggccacggggacggcgacgcgaacaccggggccaaggtcaccgccgccgccccggccggttcgcccgtctcgccgcggtaggtcagcagcagcggctccagatgggcccccgtcgtacgcatcagctccgcgcggtccgcgacgacgtcgtccatgacgtcctcgtggggcagcacgatgccttcggcggcgggggagagggccagggtgccgatcaggccccgctggaggatctcgtcgttccgctgctcgtagacgtacagcaccgggtccgggtccggggcgatgaccccctcggccagccagcggtccagtgtggcggccgcctgccggtgccggccccgggccgtgtcggcctgggggaggatgagacgcacgatgttgtgcggatccgcggactccaggtggtgcagcccgtcgggccggacgaccacgtcgtacgggggcgaggtcacggcggcaagactgccgacccgctcggggacgtaacgcagtccgcggaacgggaaaagccgcagcccctggtcgacgggacctgaagtgttcatcagggcatcgtatgtgtgcagagggcatacgcgatgatcggggcggaagcctggaatgaggagcgatccatatgagccaccagcaggacaggtcccggccgtcggggagcagcacggcgctgagcgaggcgtacgacacggctctcctcgacctcgacggggtcgtgtacgcgggcggggaggccatcggccacgccgtggaatcgctggccgaggcgcgggccgggggcatgcacctcgcgtacgtcaccaacaacgcgctgcggactccggacgcggtggcggagcacctgacggagctcggggtgcccgcggaaccctccgacgtgatcacctccgcgcaggccgtcgcccggctggtcgccgatcaactgccgcccggagcccgggtgctggcgatcggcggcgaagggctgcgggtcgcgctgcgcgagcgcgggctggtgccggtggagtcggcggacgacgacccggcggcggtggcgcagggatacggcgggccggacatggcgtggggacggttcgccgaggcgagctacgcgatccggcgcgggctgccgtggttcgcgtccaacaccgacctgaccatcccgggcgcccggggtatcgcgcccggcaacggggccgcggtcgaggtcgtacggatcgccaccggggccgagccgcaggtcgcggggaagccgttgccgccgatgcatcgcgagaccgtgctgcggaccggggcgaagcggccgatcgtcgtcggggaccggctggacacggacatcgagggcgcgttcaacgggggcgtggactcgctgctggtgctgaccggggtgaccgacgcggcgcaggtgctggccgctccgccgcagcaccggccgacctatgtggaccgggatctgaggggactgctgaccgggcagcccgaggtggcgccggccggtgaggcgtaccggtgcggaggctggacggccgccgtgcgcggcgacggcctggtgctggagggcgagggcgaggcgctcgacgggctgcgggcgctctgtgcggcggcctggagcttcgccggctcgggtgcgtgcgggctggagacggggaaggccctcgccgggctcgggctctgaaccggatcccccgagccgcccggccgaccggtccccggcgccgcccgacgcccttggcacgcgaaggcgttgagggtgtcgagggtgtggggaagcggcccgggaccagtggtgcgaagaggaagataggctagcctaacctggtgctgctcggtggtctgcccgtgccccgcgccgtgccgctccacctcaccgactccgggagtaccaccatgcagcgcctcaccgcagaatcggtgaccctcggctacgaccagcgggtcatcaccgagaacctctcggtggagattcccgacaactccttcaccgtgatcgtcggtcccaacgcctgcggcaagtcgacgctgctgcgcgccctcgcccggatgctgaagccgagccgggggcaggtgctgctggacgggcagaccatccaccagttgcccgcgaagaaggtcgcccggacgctggggctgctgccgcagtcctccatagcccccgacgggatcaccgtcgccgacctcgtcgcccgcggccgttacccccaccaggggctgctgcggcagtggtcgccggaggacgaacgggtcgtcgccgagtccatggagtccaccggcgtcgccgagctggccgaccgctatgtcgacgagctgtccggcggccagcgtcagcgggtctggatcgccatggcgctggcccagcagacgccgctgctgctgctcgacgagccgacgacgtacctcgacatccagcaccagatcgatgtcctcgacctgtgcgcggagctgcacgagacgcagggccgcacgctggtggcggtgctccacgacctcaatcacgccgcgcggtacgccacgcatctcatcgcgatgcgggacggggacgtcgtcgcggagggaccgccttcggaggtggtcgacgcggcgctggtggagcgggtgttcgggatgcggtgccaggtgatcgacgatccggagacggggacgccgctggtcgtgccggccgcccgtaaggctcggaaggcggccgtcgcgtagggggtgggccgggggtacggcggtgggtgtgctgggtgcgccccatgcgtgatgtgtcctcgatcgccggacgggc

SEQ ID NO: 3090 - DNA, 1688 bp, Unknown
  Kingdom: Bacteria, Phylum: Actinobacteria, Class: Actinobacteria, Order: Streptomycetales, Family: Streptomycetaceae, Genus: Streptomyces
cagaagaatcatccagtgcgccgccgcgacgatggcggcggccgtcctgccggcctccgcgcgggccgtggcggcgccgaagggccccaccgactacgcgacggcactctgggctccggccgctcccgccaactacacggtcccctcccacccctccgagcgccgggtcgaccgcgtcgtcatccatgtggcccaacagttgttcacgccgaccgcgggcatcttccgcaacccctccaagcaggtgtcggcccactacgtggtgcgttccggagacggccatgtcgcccagtgcgtacgcgagaaggacatcgcctggcacgcgggaaactggagctggaacacccggagcatcgggatcgagcacgaaggatgggtggaccggccggagttcttcacggacgtcatgtacctccggtccgccggactcaccgcggacatctgcgaccgccacggcatccccaaggaccgggagcacatcgtcggccatcacgaggtaccgggcagcgaccataccgacccgggagtccactgggactgggaacgctacctccggctcgtcgtcgacgccgcctgagcgtcctcccccgccacccgtggtgatgactctccgcaccgaggttgtcgttggtgccgacggcgacgacgatgggagggcaccacggccctggacgggagggtgagttgacggatccctgggtggctctcgcggcggatgcggatcccggcgaacggagcggtgcgctgcgccgcgcccacgacgtgttcacctcggcgggacgcctggagcggccggtacgcgcggtggtcggcgcgtcctggcgccgctcggcgcgggcgcgggtcagcccggaccacgcgcccgcggtggagctcggccctgacgagctgggcccctaccgggcggcgcatcccctggcccgtgcgatgcccgtgatccgcgagctgatgggtgcgtacgcgacggacggggaacacctgctggccgtctgcgacgcccacggacgcctcctgtgggtcgagggacatacggcggcgcgacggcgggccggcctgatgaacttcgtggagggcgcccgctgggccgagtccgttgccgggacgaacgcgccgggaacggccatcgcggtggaccgtccggtccaggtcttcgccgccgaacacttcctgcgaccggtccagcagtggacctgcgcggcggcgccgttgcacgatccccgtacgggccgggtgctgggagctgtggacatcacgggcggcgaccgcctcgcccacccgcacagcctggcgttcgtccaggcggtggcccgggccgccgagtcgcagctcgcgctgctgacgccggcgtccgagtccgacgtcgagtcggtgcggctgaccgcgctgggcaaggacgaggcactgctggtggcacgcgggcgccggctgcggctcagccggcggcacagcgagatcctggtggccctgacccgccggcccgagggcctgagcggggaggagctgctggtcgagctgtacgaggacgagtcggtgaccccggtgacgcttcgggccgaactctcacggctccggcggctgttggggcccgatctgctggactcgcgcccctaccggctggccgtcccggtggacgccgatttcgacacggtgacacgccggctgggttcgggcgcggtggcggcggcgct

SEQ ID NO: 3091 - DNA, 32471 bp, Unknown
  Kingdom: Bacteria, Phylum: Actinobacteria, Class: Actinobacteria, Order: Streptomycetales, Family: Streptomycetaceae, Genus: Streptomyces
  misc_feature (9263)..(9264): n is a, c, g, or t
  misc_feature (26696)..(26793): n is a, c, g, or t
cctcaccgacaccaccgtcaaacacaccctgagcgcggcgatgccggacctctcggacctcttcgaggtcggcgacgcgtcgaagttcaccgtgggccagtggtgggccgtggagatcaacgccctggccgggaagtacgagagggagatccagcgtctcgtccaggtcaccgacgtcgtcgactcgacgcacatccgggtcaactaccagatcggctgggacctggccgcaggccgcaccctgacatggacccgcgtcgagcccgtcgaccgcgcccacgtccgcaacatggtcttcgagggctggggcgaggacgagatgaccggctcgcacccggtcgcctacgagtacgcggtgcgctgcgacgtctcggggatcgaggccatcggcaccttctggcccgtcgtgatgcgccgctggtgcacgtactaccgcaccgagcagtgctcgctgaccaacccgaagtccgtcacctatggcggcgcgggttacctcacccagcagatctactgcctgtacgggcacgtggaggactgtcacacctccaacgcccgtcatctcaacgacttcacggcctccgcctactgctacgtcaccaactgccacggcgacggtgacgacgagggcccgttcgtgacgcacggccagttcgagcacgaccttgtctacaccggcaactccggcctgatgaccttcgccaactccggtgccgcctggggcggcagggccaagcggatcaccgtacgccggcacgcctgctcctggttcgtcgcccgggtcaagatcaccgatctgaccctggaagacgtcctggtcatcggcaagaagtcactccccggctccggaatgctctgggtcaacgcggacggtgtgcagatgcgcggctgtacggccacgggtccattgatcgtctcccgggcctccgacctctccgcccggcccaatgtgatcgccgactcctcgttcgcgttcgaggcaggtgcggagatcacccaggcccatgtcaccgctccgctcacccttcagcgctccactctgaagggcgtcggcggcgcggtgttcaacggcaccggctcactcaccctggaccagtgcactttgaccggatccgaggactcagcgccggtctcgctcgcgcacaccgacatcaccgtactgggcggcgaactccgcgacaccgggctgaaactggtctcgtcgagggaccagcgactgcgcgtcgacggcacccggctgaacggcaccaacaaggacggcgccctgctctcccgtaccggctccggacggaccgtcgactggcagctcaccggcctcgactcgaccgcgcccgagggcaccgcccatgtgctggtcaccgagggccccaaccgctaccgggccaccggctcgaccttcaccggcggccggctcgaactgcggcccacggcgttcggcggcgcctcaagccatctgctgcacaccggctgcgtcgaggacggcaccgagcgcaccgcgctgccggacgagggcgaccgcgtcgcccacaccgccgccacgctgcggttctgaccatctcggggtccttcgttcggatcagacccccgcgagccgggcccgatccgaacgaagaccccatcccatcgagcaccagggattcccgtgtccacgcatactccgatcaccggccggcccgtacgggtcgcgctcgtcggcgccggcaaccgcggtctgacgtacgccgagtggatcaaggcgcaccccgaccgcgccgaactcgtcgccgtcgccgatccacgccccgcggcgcgggccgccgccggcgcacccgtcgaattcgacgactggcggccgctggtcgagaaccgcatcgcggacgccgtcgtcgtcgccacccaggaccgcttccatgtggagccggtgctggccctggccgaggccggatacgcgatcctggccgagaaacccctcgcgccgaccgaggaggagacccggcggatcgtcgagggtgtgaagcggtccggggtcctcttcgcggtgtgccacgtcatgcggtacaccccgtacaccgacctggtgaaggaagtcgtggactccggcgtgctcggtcagctggtctccctcgaccatctggagccgatcggctggtggcactacgcccacagttacgtgcgcgggccgtggcgcagcgagaaggactcctccccgatgctgctcgccaagtcgtgccacgacctggactggatcacctacgtgatgggcggccggatcgagcaggtttcgagcttcggcgggctgaagcacttcctgccggagaacgccccggccgggtcggccgaccgctgcctcgactgtgcggtcgagaccggctgcccctacagcgcgctgaagctgtacctgccgaccctgcgcgagaagggcgcggtctggccggtcacccatgtcaccgaggcgaccgacgaggccggtctcgtgcaggcgctacgggagggcccctacggcgtctgcgcgtaccgcggcgacaacgacgtggtcgaccaccaggtcctcgccatgcagctgacggacggggtgaccgcgaccttccagatggtggcgttcaccgagcagacgcaccgccagacccggatcttcggctcgcacggctcgctgatcggtgacggcgaacgggtcacggtgcaggacttccgtaccggcgaaaccaccgtccatgaactcggcgcgtccggttcgaacgcggcggacgggcacggcggcggggacgccgcgctcgtcgaggcgttcgtcaccgccgtcgccacgggtgacgccggggccgtccgctccggtcccgccacctcgctcggcagtcatctcgcggcgttcgccgccgaacgtgcccggcacaccggcaccgtccagacggtcccggcgcagtgactccccctcttccctcccccgccctcacgtcctcggaggaccagctcatgtcccgtctcctcacccgccgtcccagagtccgtgccgccgtggccactgcgctcgccgccggtgtgctggccggatgttccggcagcggcagcgacgacaacaccgtcaccatgtggacctacccggtcatcttcgacgaggccaagaacaaggcgtactgggacggcctggtcaaggcgttcgagaaggagcactcgggcgtcgaggtgaaggtggagaccttcccctgggccaaccgcgacaccgcgctggccaccgcgatcgcctccggcaagggcccggacgcggtctacctcgtcccggaccagctgccgaagtacgccgagaacatcgtccccgccgacgactacctggcggccggcgccgaggcggactacaccgacttcgccctggagtccgtcacggtcgacggcaaggcgctcggcaccccggtcctgaccagcgccaaccctctcatctgcgacaagcgggtgttcgccgcgatcggcgagaagacctacccgacgagctgggcggacctggaggcgctggcccccaggctgaaggagaagggctactacgccaccagctacagcggtgacacccagcagaccctgaacatgaccttctacccgctgctgtggcaggccggtggcgacgtcttctccgaggacggcaagaacgtcacgttcaacgacgcggccggcgtcaaggcgctgacatacctgaagaagctcgtcgacggcggttacaccgacaaggacctggtcacgaccaccccgaagctggagcagaccccgaccgccaagggcaaggtcgcctgcacctggcagaacacccccgcggacgtcgagccgttctggggcaaggagaacatcgtcgtccagccgccgctgaaggacgcgaagtcgatcggctacggcacggtcggcgcgctgtcgatgctgaagggcgccgacaggaagaacaccggcgactggctgaacttcgtcgccgagtcgaagaacgcggccggtctgcagaagggtgccggctacttcccggcccgcgagtccggcggcgacctctacccgggtgacgctctgcagacggcggtcggcgccctgctgccgcgcatgaccgtgggcccgctccaggacaaggcccgcgaggtccagggtgtgctcgcgcccgagatccaggcggcgctgctgggcaggaagagcccgcaggaggcgctgaacgccgcgcagaaggccgcgcaggcgatgctcggccgctgaccgggcacggtgcccggatccggccgcaccccgccccgggcaccgtaccgctctcccgggggcgctcccccgacccccgtaatcccccgtaccgcaaggagatccccgtggcagtcgtcgcggaaccaacccgccggggccgtcgcagcgggccgcaggctcgccgcgaggcccggatcggcctgctcttcgtccttccgtgcttcctgctcttcctggcgttccggttcggtccgggcatcgccggtgtgctgatgagcttcaccgactactccctcacgggcggcggcagcttcatcgggctggacaacttcatccgcctgtgggacgacccgctgttctggcaggcgctgaaggtcacggtcctctacaccgtgctcgccgtgccggggacgctcatcgcctcggtgtcgctggcgctgatcacccgccgcgcgttccgcggcgccaagttcttccgttcggtgttcttcctgccggtcgtcacctcgctggtgctggccgccaccgtcttcgtctggatcttctcgaccggcggaccgtggtccaccctgatgagctggttcgggatgtccgagggctcctggctctccgacgacgtgctggtgctgcccgcgctcgcgatcgtcggcgtctggtcccgcttcgggtacgggatgctcatcctgctggcccggatgcaggacatcccccgtgagctggaggaagccgcgctcaccgacggcgccggaccctggcagcggttccggtacatcgtgctgccgcagctcaagccggccctgttcttcctcgccgtgatcgagacgactgcgtccttccaggtcttcgacgcggtgtacacgatgaccggcggcggccccgccaacgccagttacacgctcgtcttccagctctacgacgcgggcttcaagtacttcgacctgggttacgcctccgccatcggcgtcgcgctcttcgcgctgaccgtggtggtcgcggtgatccagcggctcgtgatcgggaaggaccagtgaccatgaccgcgacacccacccagaccgggaccccgcccgcaccgaaggcccccgaccggaccgcccgccgcgccgcacgcaagctgcgcaagctctccgagcaggacaccgtcccgcacggcgtgcggcccacccgggccggccggatcggccgcgccgtgctgctgacggtggccgcgatcgtgacgatcttcccgttctacgcgatggtcgtgctctccttgaagccgtccgcggcggtcgagttccccggcagtctgctgccgtggccgctgaccggcgaggcgtacgacaccgtcatgaacgcccaggacgtaccccgctggctgttcaacacgctgatctactcggtcgtctcggtcgtcggcgtgctgctgctcgcctcgctcgccgggtacgccttcgccaagaagcgcttcccgggccgggaaacgatgttctggtccttcctgtcgatggtgatggtcccgtaccacgtcacgatgatcccgacgttcgcgatgatcgcgaagctgggcggcgtggacacgtactgggggctgatccttccgaccctggccaacgcccaggcggtcttcctgatgcggcagttcatccaggggctgccggacgaactcttcgaggcggcccggctcgacggctgcaacgagtggcagatcttccaccggatcgtgctgccactgctgaagccgatcctggccacgctcggcgtcttcgtcttcctgtggcactggaacgacttcctgtggccgctggtcatcggccagtccaccgacatgcgcaccctcaccgtcggcatcgcctcgctccagcagcagaacgtgccgctcaatgtggtgctctccggctccgtcatcgcgttcgtgcccatcttcgccgcgtacatggtgggccagcgctacttcaccgagggcgtcaccgcgtccggaatcaagggatagtcacgcatgttcaccgatgagtccgcgctcgaagagcggctcgccaccccctcccccgcgctcgtcgccgatctcggccgcctcgaaggcgatctgctggtgctcggcgcgggcggcaaaatgggccccagcctgtgccggctcgcccgccgggcgctggatgccgcgggccgcgacgacgtggtcgtgtacgcggtctcccgttggtccgacaggtccgccgccgacgagctggaggccgccggggtctccaccgtggccttcgacctgatggccccggccgccgatctcgccgagctgccggacgcagggaacgtcgtcttcatggtcggcgccaaattcggctcctccggcgcgccttcgctcgcctgggcggtgaacgccgcgatgccggaccgggtggcccgccgctggccggggtcgcggatcgccgcgttctccaccggcaacgtgtaccccctggtgccggtctcctccggcggctgcacggagaccgacccggtcggcccggtcggggagtacgccatgtcgtgcctcggccgggagcggatcttcggccacgcggcactgacccgcggtacccgggtcgccaacatccgcctcaactacgcggtcgacctgcgctacggcgtcctcgccgacatcgcgtaccgggtacaggccggcgagcccgtcgatgtgacgaccggtcacgccaatgtggtgtggcaggggtacgccaacgaggtcgcgctgcgctcgctgccgcacgcgaccgacggcgaggcgttcaccctcaacctcaccggccccgagaccgcttcggtacgccgcatcgcccggtggttcggcgaggagttcggcagggagccggtcttcgccggcgaggaggcacccaccgcgctgctctccgacgcgagccgctgccacgcgctgttcggctacccggacgtcacgctgcgcaccctcgtcgagtggcaggccgactggctgcgccgcgggctgccgctgtccggcaagcccaccaagttccaggtccgtgacggaaggttctgatccactccatgtccacttcctcccccgcgccgcaccccgccctggacgcgctcgcccgcggtgccgtgatccccgctcacccgctcgccctgcgcgacgacggctccttcgacgagcggcggcagcgtgcgctgacccgctactacctcgcctcgggcgcgggcggcgtcgccgtcgccgtgcacaccacccagttcgagatccgggaaccggaggtcggcctgttccggccggtgctggagctcgccgccgagacgatcgactccgaggccggtcggctgttcatcaaagtcgccggtgcctgcggttacacggcacaggccgtcgccgaggccgagacggccgccgaactcggctacgacgctgtcctgctcagcccggccgtccccggcgcggacgagaaggggctcctggagcgggcgcgggctgtcggtgaagtgctgccggtgatcggcttctaccttcaggaggctgtcggcggacgctacctgtcaccgcacttctggtcctcgttcaccgacctgccgaacacggccgcggtgaagatcgcccccttcgaccgctaccgcaccgccgaagtcgtacgcgccgtggccgccgccgaccgggccgacgaagtggcgctgtacaccgggaacgacgacgacatcatcggtgatctgctcaccccgtacgagacggcgggcggcaagccgcgctggttcgcgggtgggctcctcggccagtgggccgtctggaccggctccgccgtcacgctcctcgacgacgtcaggaaggcccgcggcggggatcacgaggcgatggtgcgctgcctggcccgccgcccggagctgaccgatgccaacagcgcggtcttcgatgttcggggcgctttccgcggctgcatcgccggggtgcacgaagtgcttcgccgccagggcctgttggcgaacatccggtgtctggacccggccgagacgctctcccccgggcaggcggaggagatcagccgggtggccacggcctacccttggctgaccgatgacgtcttcgttgcggagcacctcgatgcctggctctcctgatcctgccgaccgctcccgggtggtcgtcgccgtaccgccggaccttcgggcccagttcttcaccgccgaggtgtggcggaagctggagcgggtggccgaactcgccgtcgtcgatgcccactccgaccgggcggaagtcgcggccgcgctgcccggcgcccgtgcgctgatcacctcgtggcgagcgccccaggtggacaccgggctcctggaatcggccgaccggctggagctggtggcgcacaccggttcggcggtcgcaccctatgtcaccgaggaggtgttccggcgaggcatcctggtcacccaggcgggggacgaaatggcccgcccggtcgccgaggtggccctcgctttcacgctctcgctgctccaccgcatccagcgtttcgaccatgccctgcgcggcgggcgggagtggtcggcagcaagcgaggccccgccacggcacgagatccacggcagtgacatcggcgtgatcggtgcctcccgcaccgggcgggcctacatcgccctggtgcgggcgatgggagcgcgagtgagcgtcaccgacccgtacctgtcggctgcggacgccgaggcgctcggcgtggagtccgtatccctggagacgctgctctcgcgcagccggatcgtggccgtgcacgcgccggtcaccgcggagacccaccggatgatcggcgccgagcagttggcgctgatgccggacggcgcgggtctggtgaacaccgccaggtcgtggctggtcgacgaggacgcgctcctggtcgaactggcctcgggccggctggacgcggcgatcgatgtcttcgacgccgagccactgcccacggaccaccccttccgctccctgccgaacgtgctgctcaccccgcaccaggcggcgggcagtgtcgagtgccggcagcggctcggcacgagcgcggtccacgaggtgctgcggctgatcgccgggcgacccccggcccacgccgtcaccgccgacgccctcacccgcctgcactgagtcgggtagccgggtnnacccggctacccgactcagtacgtcaggtgccgggtgtcagggggtggggtgacggctgagccattgttggagttcgcggtgacggaactggtagctgggcccgttgtagcggaggagaccggcagtgacggcccagtcgaggaagacaccgaggcggaagggtagcttgccgcgcgagtacagcaaaaacagggtgtatctccgtgccgagcgaccgagcccgctggcgagcccgaccacaactccaaccatgaccccggccgtgagtccgaccacgagcaccccgatcacgaattccggtatgggcccgcgcgtgtagctgttcgtgaatccgctactgattccgctggtgagtccgcccacgagtccgcccaggagcgcggttacgagtccggccaggggaccgatcaagagtccatggactaggtcgtcgcggataatcccccgagggttggccacggcagtgggttcccccgcgaggccgcggttgattcccccggcgagcccgccggcaagcccgatcccgagccagagcgagggcccttcgccgagccctaattcggcgccctcgtagttgaggaagaggacaaacacaagcccagccgggaaccagatccagaaccacgctttgaatccgtccgcgaatccacccgccagcccgcccatgaatccgccgatgaggccggtcccgatccctaggcctatcccgaacacgacgcccgtgccccatctcgggagcgcggacgtgaagtcgaccgtgaagccgatcgtgaagccgatcgcgaagccgacggcgaaccacgtcctgattcccgtccagaacctggccatgaacccgctggggagtgttccccggctcatgcggaaacggttgggcctgggtgtcgggcggaaggcgatggcactgacgagcgcgccgagcacggccgagacgaagggcaggagtccacggtcggattcgtggaacaacggcccggaaaggaaccctgtgaaggcaccgatgagtgcggcggggacaacggtgaggaggaggtcggtgacgcgggttcgggtggtgcctgcgaggggccagaggtggtggagggtgagatcggtggccgggactcctgtggtggtgccggtgaggtgtctggtgaggtagtggagccagcggtggacgtcttctggccggtatccgcgagggtttgcggtgttggtggtggcggcggggaggtagcgggccaggaggtactggtcgaggtcgtgtccgtcggtgtggctgaggagttcggaggggttgccgtcgcggtggtagacggtggcggtcaggcacagccgccagggcgtggacaaggtggtggcgagaagtccggcgggctgggcgtagaggtggtcggtcaagggctgccagcggggccggtcccgggcccgggcagaaaggtaagcgacggcgttacgggtgtcgatgggggcgatggcgacgcgcgcggcatcgatgagccgggacacgggagggagcgcatcgtagtgaccggtgcggcacgtcaggacgagcgggcccgcctcccggtcggtctggtagtcgttgagcgcttccagagccgcgcgggcacggggcgcctcagggtcgggggagccatccgtgcgcagggggtccatctcgtcaagcccgtccaggaccggcagcaccatcccgtgagcgaccagtccggcagccgcttcggcagaacagtggtaggcatcggtaagacgccgcaccagcagggtgcccaagggctggtcggtgtcccaatgggccagcggaagccgcaccgggacgggatcgccctcggagcggtcctctatgagggcctgcatgagttccaggaccaggaccgtctttcccgctcccggggccccggtgacgaccagacgcctgggccgggtggcacggtagtagtccagaacatcgggtaagccggccggaccgtcggcgaacgtattcccggccgccggagccagcgcagcgcgctcggccgcagagtgcagaacataggcgacattgatgcgctgggtgtcgttccccagcaactgtcgccgcaccaccttctcactgtccaggacctgcttggccagcgccttggcatgctcgcgcgcgcgcccggccccaccgtcctcgtccggcctgcgcaacgccacgatcgcgaccaccaccccggtcataccgatcggaacaccgagaagagtcgcaacatcgacgggtttggtcttcttgtcatgggtgatgttcccaacggcgaaaaccacgcacgccgcgatgaacaccccacaaaccgcatgaacaacccgccacctaggcggataccggcgcttccatggcacagacatcccccgatcatcccgcctcgccaggcccatggtgaacccaggaccgttgcgtgaacgcagccccgccgactacgtcgtcgcagtccgatcgaagtacgtggtcagggctgcagcgggctgacctgcggtactccaccgatcgatgaggcgatctgctccggttgcgctgggtcgagcaatccggtccggcgccgacggggcactcaccggggtccgagcacgttctggcgctgtgtcccgagccggctgatgccgagctccatgacgtcaccgggctgcagccagaccggcggagtgaagcccatgcctacgccgggcggcgtacccgtgttgatcaggtcgccgggctccaggacgaggaactggctgaggtagtgcacgatgaagtaggggtcgaagatcatcgtcttggtgttgccgctctggcggcggacaccgttgacgtcgagccacatgtccagggcgaggacgtcgtcgatctcgtcggtggtggccaaccaggggccggccgggttgaaggtctcggccgacttgcccttggcccactgaccgccgcgctcaagttggaaggcacgctcgctgacgtcattgacgacgacgtacccggcaatggctccgcgcgcctcgtccaccgtggacaggtagctggtgcgcgcaccgatgacgatgccgagttcgacttcccagtcgggcttggtcgagccgcgggggatgcgcacgtcgtcgtcggggccgacgagagtgttgggcgacttcgtgaagagaatcggctcgtcgggaacggccatcccgctttcggccgcgtggtcacggtagttgagcccgatgcacaggatctgatgcgggcgtgcgatcggggcgcctacgcgctcaccgtcgaagcgggacacacggccgacagccgtgcgttcggatacgacaggccggatgcgttcgatgccgccactgccgaagaacgcctcgtcgaagtcggtgacgacgtcggagaggtcgacgtacgtcgcgtcgtcgagccgggctacgggcttctcggcgccgggggcgccaatgcgcatgaggtacacggggcacagtctccgagggtcttgttgtcgggtgagctggtcagctggtggtcgcggccggccggtgcaggcccgcccaggcgggcacggaagcgcccggcacatcgacgcgcgtggtgaaaagccgtcccgagtcgggatacgcggccagtcgggcgtcgtcgagtccggcagtcgcggtggtgatgacgagggtgcgcaggtcggaaccggcgaaggcgatgctcgacgtgtgcggcgccggaacggtcagcctcgtcaccggagtgccgtcgggcgcgtatcggcggatctcaccggctccccagacggcgacccagagatggtcctcggcgtccagagcgatgccgtcgggcaatccgccgtcgatccgcagatgttcgcgacgctcgtacggcactgcgtagtcacgtacgaagacggtcctgcgctcgctgtcgacgctgtacatccgtcgtccgtccgtggaccaggccagcccgttggagaggcccaaatcggtgtccagttcggtgatctgaccgtcggcttcccagcgcaccaggcgctcgcgctcggacgggccgttcagggaaagagtgccgaccagaaagcgcccggcgggatcggtgccgccgtcgttgaggcgccgctgctcccctgccggaacgatgcgcgggccgtcctgtcgggtgccgtcgttccccaggacgatcaggtgctcctggccggcgacgaggagcgacccctcgtcggcgacgctgaccgcgccgaccatcccgtcgaactgatgccgtcgcgtgacggtgacgcgtccttcgtcgagtgcgccttcgaggacgagtccgccgaggatgtccacccagaggaggcgctctcgggcggcgtcccaaacaggtccttcggccagtcggaatcgttccgcggtcgcgggaatgacggtgctcatcggtgtgggtctccccatgcgccgaggaggcctcgtacctcgtcgacggcgtcggtcaacgtgctcaggggcgtccggtaggtcagggcactgacactcacggcaccggagggccgcgtcggcgaggtcagatacatcggcagcgaaaggcagttgactccgggctcgttctcctggtcgtcgagggcgtacccacgctcgcgggtgagtcggagctctcggtacaggtcttcggccgtacacaaagtggtaggcgtgcggcgctccaggacggagtcaccgatccaggccccgacggcgtcgaggctgtccaactcgtaggcaagcagcaactttcccacgccggtggcatgggcggggttgcgaccgccgaccgtcgaagtgagtcgcacggcgccggaaggcgggtcgaccttggcccggtagacgacctcatggccgtcgagaacggcgtagtgcacggtctccccgaaccgctcggcgagcgcgtcgagcaccggctggatacgcacgtgctcagggcgggcctcgtgatgcgcaaaggccatgcgaaggaactcgtcccccagcacgtaccggccgcgcgcgtcctggtccgccaggccggccctccgcagggatgccagcgcccgatgcaccgtcggcttcgggctcccgatcacctgggtcagctcttccagacccacgccgtccgggtagcgggcgagctccttgagtaccgcgaggactcggtccgaccccacaagacggctgtcggcggctcgttccgcgttgtcttctccggggactgccggtctgtcgaacgtctgcatatgcttcatggcgttccaaacattagatcaatgtgccaactattggaaagagctgatggcagcgctgtcggccagatcctgtgggcggggagggcgtaagaggctgcgcagacaggcgcgttggtcgacccctgcagcagatcgggcacaggccctcgtcgatcatggagttgcgacgttctgtgatggccggggaggtctgtgcctgttttctgccgtcatggctgaccgaaccgctccgggaccagttcgcggccctgttgcgcgagcgatcgatctacgtgccgacccatccactcggctgtcaccgcccgcgcatcagcgaccggatcgtcttcggcatcatgctgcgactcttgcggttcggctgctcctaccaggcgatcgcggacacgacctgctgggccaccacgatccgcaaccgtcgcgacgagttgatccggctgggcgtcttcgccgagctcaggcggatcgcgctcgacgctgacgaccgccggcatcaccgtacggagtctgataggccgagtgtggatcacacaccgctggctccaccggccccacggctgtccctgagcacccgcgtcgcacctcgacggcacccatgccttcggctgtccgggctcggtcagcgacgggccagcaccgccatcccacaaccgaatcccaccaccagccgtccatccggggcaacagccaccgcacggacagacgacggaaacaccaactccggcccgaccggctcgccggcagccacgtcccacatcgtcaccgccccatctccactgccagtgatcacgcggtccttgccatccacctccaccaccgcaagcaccccgacagggtggccgctcaggaacgcaccggcctgcccacccgtcgccacatcccacacccgcaccgacccgtcttcgctgccggtgacagcgagacccccgccgtccgccaccgccaccgcactcaccgggccgtcgtggccggtgaggagcccgcccgcctcccaaccggcgctcgtgtcccacacccacacccgcgccgccccgtcgtcacctccggtgacagcgagaacgcgactactgtcccccgccaccgccaccgtacgcaccccatcatcgttaccggcgaagagcccatccggctcctcacgagtggccaggttccacaccaggaccgtttcgtcaccggcgctgccggtcacagcgagtacggtcccgtgcaccaccgccgcagcccccaccttgtcggtgtggccgatcaggggctcaccgaaaggctctgcggtggccatgtcccacgcccgaaccgcaccatcctcactgccggtgacgacgatggggagaccgttgaccgcccccaccgcaacagcacgtaccgcgctgccgtggacgaacggctcacccagtgactttcccgtggcgaggtcccacacccgcaccgtcttgtcgtcgctgccggtgacgacaacggggcggccctccacagcagccgtcgctaccgcccgcacccgaccggtgtggccgggcagaattttctggatccgacgttcgagtcgagtgtcagtcgcccactccacaccccactgagaggcaggacccggggccgcgtccaggagccccggcatctccccgggggtgccattcaccagaaaccccggatccaccagtcgcccacccgtgtccgcaaccacggcccaggctccgtcaacgctcgaatcgtcggacatccccgcatccaaccagccaccactaccgacccaccacctccaaccgggcatcccaccagccgactaccgagccacctacgtaacgtcaccggggaaccctcagcagccccggcgatatgacctacgggagacccacatgcgcccgcgcctcaccaatccgcgcgggttccaggtggttcaacgcgaaagagacttgccctcgggagtggacttgccctcgggagtgaagcccggcatggcctgcgtcatcgcgagcgtgaccggcccgccatcggcaagtcgcggaggcccgccgatggcaggacgcaggacggcggagcgccaattacccggacgttggcctcgtcgggcaggacgatcagcagatcgccgagcaccccggtacggaaggcggcctcaggcttcacccccagggcctccgacaggccctccggcaacgggctttcagcggcggccgtgtcggcagaaccgctcggccgagaccggcggcggctcgccagagcctcgtcgaggccgacctgagccgtctcgcgcttcccggaccgggcatcggcacccggccggtcatgccgcgctccgggccgccgcgcgacgcgacctggcccttcccagccgttcgactcctgtcaacttgaaaaaccgactcgaatgtatttattatcggtgcatgggaaggcctgtggatcaactgacaccgaagggcgcggcgacgcggcgggacattctgcgcgccgccgcccgcgtcttcgacgccaaggggtactcactggcacggatggacgacgtggtccgcgagaccggcctcaccaagggtgccgtgtacttccacttcaagagcaaggccgccctggcccacgcggtcgtcgacgatcagaagaagggaatgctcgcgcatctgcgcaggcatctggaggggctgggagggccggccgcacagattcggggactcgtacccgtcctcgtggagctcgtcatcgccgagcccgcgggatggtccgtcgtgcggctcgaccgtgagctcagcaccgagtcgccgcaggaacacgccgaggcgtccgttctcgcggagtgggtcagcctggtcgaacaactcctcctcgccggcgcccgtgcgggtgacctgcacctctcggccgacgcccatacgctggcgaccgtgttcgtgggcgcgttcgacggactgaagggcgtccttgaggccacggggcgcgccaacccggaagaactgcgtcgcgcggcaggcgttctcaccgatgtcatcgaggccgccaccaggacgcactgaacgccggacggggtcggatttcacgcacgtcgaccacctcggccttttcaccacccagaaaaaaaccttcgagtcggtatggagacagaaatgaactactcggacacactcacttcccaacttgccgtcgtcaccggcgcctcgtcagggatcggcgccgagttcgcccgccaactggcagcacgcggcgtgaacctggtcctcgtcgcacgctcgacagaaaagctggaggaactcgccgcgaccctgcgggccaggcacggcgtcaccgtcgtacccctcaccctcgacctcgcccggccggactcctccgagaccctcgcgcgcacactcgacgagcggggagtcgtcgtggacatcctcatcaacaacgccggcttcgcatcacacggcgacctcgccgaggccgaccccggccacatggcgtcccaggtgcagctcaacgtcggcacgctcgtcggcaacaccacccgcctcctgcccggcatggtcgaacgcgggcgcggcaccgtcatcaacgtcgccagcacggcaggattccaggcagtgccgcacatggccgtgtactccgcgacgaaggcattcgtcctgtccttcacccgctccctctggggtgagacccgcggcaccggcgtgaccgtcctcggaatctgcccgggcgccaccgacacccccttcttcgacgtggccggcgacaacgcgtccgtcggctcccagcgcaccccgcagcaggtcgtcaacacagcactcaccgcactcggcggccgcaaggcaaccgtcgtcgacggcaccggcaacgccctcgtgtcacgcgtcgtcagccgcctgacaccggaacgccccctcatccgcatcgccgaacggagcgtacgcccgagcgcgtgacctccgaagagccacggaaaccccggcgtcgcgtatggcttcgagctcgtcgggcaacccggccgggaccgctcgatctcgacgtcgcagatcaccgaattcggcaccaggactgtcgacacttccggcgagcttcctgggctgcgccttcaaatgatcacggttagcgcctccaggatctggccgacgtcctcgcacaggttatggagccgacggcagccgcgatcccacgcctgcgctcacgccgctgcgaggtgtcgggcgagcaactcccgcagccgctccgagtcctgtggagcgtccagaccacgcttcggcaggaccagtacgccggttccccacacgtccggggtaaggagcacgaacacccgtcggccctcgacgtaacgcccgtagaacctccaggcggtctcattcgcgtgccgctcagtagcggtccggatgccggagtcgtcgaccgtgacgcggtgctcacccaggtgccgggcgtagccgagcagagcgagagccatgagccagcggaacgccacgagggagaggcaggcgatcagcaggatcttccatgctcctacgcccgcggcgccaacgcctttggtcatcacgttggctgcgatcaccacaccaaggaaggcgcacagtccccaaaggatgcgatagcaccaccgtccgaccgggctgtttctcatctgcatcttcagcccatcggatatctcccgccacgtcaccacgtacgtcaactgcaccgacacatcaacggccatgcgtcctccctggatctgatgggcagggactgtacaggcaggtgatcaagggcaaggccaggcggactgaagcgaccgcagtgacgttcggggccgcggatgcgcttggtccgcgaggggtcgaaggggactcccgcagggcggtccggggggagttcggccgtgcgtgaggaccaggggttgcggtgtacgcgagcaggagcggcaaacggcttctccactcgggcgagatgccgtccggggtcgccgagttcgcacggcggacgacggtgcggaagcggctcccaccggactacgcgaggtgttctggcctggaggcgacgcgggcgaagtgtccgtgcggcgggcaggcgccgagcgggtggactttgcgaccgacaagcacccgcgccgctcccttgatcagcccgcttccgtcaaggctgcgcgcgcggcggcgaggatctccccggagagcggggagccgttggtggcccgggacaggaccagcgcaccgaacagggtgcagagacggacgatgccgtcctggtcgtcgtcggcgaggaaatcggcgaagtcggccaccccctcggcgtagacgcgacgggcctcgctccccccgccttcgcgcgcgatgtcggtggcgagcgccgcgaccgggcagccgtccgccgggtcgtcgcggtgctcggcggagaggtaggcgtcgatcagcgcctgctgggcggcctcgcgctgcccgtcatgccgctcaagcccagcaccatagcgctgggcgagttcggcgaaggcgtgggcggtggcctcgtcgacgagcgcctccttggaggcgaactgcttgtagaacgcgccgtgggtcaggccggccgccttcatcaggtcggcgacgctgacctgcgtgccctgctcccggaacagccgggatgcggtgtccaccacccgcctgcgattttcctccgcctgcgcctgcgatacacggcccatgaccacctcccgtttggatgtcgactggcatctatcatagacccgtgtttagattggatgcataatctaaatcgtgcgggtggccgacggcgccgccggaacaaggagcgagcatggagctgaagaactcggtcgcgatcgtcaccggcgccaaccgggggctcgggcggcacctggcagcccagctcgtcgagcgcggcgcgaaggtgtacggcgcggcccgacgtcccgagacggtcgacgtgccgggcgtcatcccgctgcggctggacgtcacggacgaggcgtcgatacaggaggccgcccgcgtggcgtccgatgcgacactgctgatcaacaacgcgggtatctccaccggcgcgacgctgatcggaggcgacgtcactgatgtgcgccgggagatggagaccaacttcttcggcccgctcgtcgcgacccgcgcgttcacccccgtcatcgagggcaacggtggcggcgccgtactcaacgtcctgtccgctctgtcctggttccacccggcaggcctcggctcctacgcggcctccaaggccgccgcctgggcgctgagcgacgcgacccgtgaggagctggcaccgcgcggcatcaccgtcttggcgctgcacgtcggctacatggacaccgacatggccgcaggcgtgccggccgatcagaaggtcgccgccgccgacgtcgcggcccaggcccttgacggcatcgagaccggcctgcccgagatcctcgccgacgagaccagccggaccgtcaagcagagcctgtccgcagcacctcagccggccgcggactgacgctcacccctccacccggcgcggtcgccttcctcatccgtcatgcaaggacacctcccctgacgggtgaacgcggctcaggaagtaacgcgccggcgccgcggcagaagacccacacaagccatcgcgtacggggaggaacccggggcgagcggagacccgccctcacggacgggacacggaacggagacaacgatgagggctctcatggtcgagaagtacggcggccgagccgggatgcgcgccgccgagacacccgacccgcaagtgggcgccgacgacgtcctggtcgagatccacgcggctggtgtcaacccgctggacctcaaaatccgcgatggggacctcaaggcgttcctgccctaccgtctcccgctcgttctgggcaacgacctcgcagggacggtcgtccgggtcggccggtccgtcacccgcttcacggtgggtgacgaggtctacgcccgccccgacaagaaccgtatcggcaccttcgccgaactcatcgccgtgcaccaggacgatctggcacccaaacccgccaccctcaccatggccgaggccgcctccctccctctggtcgccctgaccgcatggcaggccctggtcgagcgggcacacgtgcagccgggtcagaaggtcctcatccatgcgggcgccggcggcctcggctccgtcgccgtccaactggccaaggcactgggcgcgcacgtggccaccaccgtgagcaccgccaaggtcgacctggccagggacctcggcgcggacatcgtcgtcgactaccgcacgcaggacttcgaggaggtcctcgacgactacgacgtcgtcctcgacagcctcggcggcgacaacctcgccacctccctgcgcgtgatcaagcccggcggcacggccatcagcgtcgcgggtccacccgacccggccttcgcccgtgagctcggcgcgaacccgttcctccgcctggccatgaccgccctcagtttcaagacccggcgcgacgccgagcgccgcggcgtgacgtactcgttcctgttcatgaaggccaacggcgaccaactgcgccggctcacccccctcatcgacgcggggaagatccgccccgtcgtcgaccgcgtctttccgttcgacgaaaccctccaggccatggagtacgtcgaagacggacgggcaaaggccggcaaagtcgtcgtcaggatgatgtgagggcgggaaggagcccacgctgatcaccttcgacgaccacggcgtcggcgcgtccggaggctccacaccccgacaccatcgaggcgatgtcccgccacaccgtgctgtttctccgggcagtcgggtacggccgggtcgtcctgctcggtctgtggatgggcggcttcatcgcccaggccatcgcggctgaggaacccgatcgcctacgcaagctgtcgctggaggatcgggcgctgctggtcgccgcttactggcggccggacgtggggaggctcagtcgaggcagaactcgttgccctcagggtcctgcatcacgatgcaggactcgttctcgccgtcggcacgcatcgttcggacatgtaccgcgccgagcgcgaccagtcgtgcgcactcggcctcaagtgtggcaaggcgctcctcccccacgaggccgataccggcccgcacgtcgaggtgcagtcggttcttcacgaccttgccttcgggaactcgctggaagagcaggcgcggacccgcacccgagggatcagtgcacgcgaagtagatcacctgctcctcggggggcagcgagcggtggtactcctcccacgtggcgaaaccctccgggaccgtcggtacgacgtaccccagcacctcacaccagaaaccggcgaggcgcgcaggttcctcgcagtcgaaggtcacttggaactgcttgatcgttgacatcagcgcaccgtaccaagggtgtcccgccgccctttccccaggtagaccccgcgccgtcgaaataattgagtcaaccccgccgaaacctggtccggatcggactgcttttctccacgcggcccctctcgaaagcttccacaggattccgctgctcaccttccaccgatcacggaccgggatggccggtgctgaatgccggtaccggcgccaccgtcttccgcgaccggcttcagtcgcggagcgcggagaccaggctggcgacggtgaccgtgttgaagacgaaggcgatgatcgcgttcgccgagatggtccgccgcatgtcgcgtgaggtcacgttgacgtcggtggtgccgaaggtcgtcatgaccgccacggcgaagtagacgtagtcggcccaggccgcggtaccccctccggggaattcgagtgcctccccgttctccaccaggttgtcggcctggaaggtgaccgcgaacgcgacgacgacgcaggtccaggcgatgacgacgagcgacagcgccagtagcgcgcgcgagccctcgccgaaagtggtgctgaggtggccgggcagccacacgacggccacggccaacgcggcggccgcgatgaggatggacgcccccggtccgggcgcggtgcccaggacgtaccgctgcaggaacgtaccgcgggcttcgcggtccgcccaggaacggatctgctccgatgaggccctcaggaaggcgatcaaggtcatggccaggtacgggaccaggtaggcgaagagcaccaggacgccgacgtcggaagccgagatccgcacgacactgtcgaggggcaggaccacggccacgctcaccgagatgagcaggcacacgagtgaacggcgtcgttcggacagccaggaattcacggacaggttcctccggacgttcacggtgcggatgcggcgacgctagacgaatgagctccccctgacgccgtgagctctcgcggcatccacgaggcagcgctgtccgtcccccgaacggcgcacggacggagcggcaccgccgcgtcggtcgccctccaggtcgatggccggcggccggcggccggggctgggagcccggagcagcgacggagatcgctgacggcccgccggccggggccctgtggtggtcagagggtgagaaggcttcgcagcgtgaggctgatgcctacggtgaggacggcgagcgcggtgaggaccgtcgcatagcgggtacagcggcgcagggagggcaggtggcgttcgctcagcgcggcaagtctgctccctcctccggagagcaggaggccggcggcggtgagcgtgatggccatgcccagcccgtagccgacgacgaggaggacgccgaagagggtctggctcagcgcgatggccccgagcaggacgacgagggccgagggactggggacgagaccggccgcgagtcctacaccgacgagtgcgggcaggccggtgcggcgcggcgtcttcggcgcgcggcggtctgcctcgtgcgtgcggtcgccgtggctgtacgggaggtcgggggcgtggtggcgtgcgtggtgatggaggcggtcgtcccggtgaccgtgcgcaagggcgtgctctcgcgtctcgttgcgcgtgtgcccgtgcccgtctccgtggctttgtccgtgtccgtggctgtgttcgtgtccgtggctgtgtccgtggccgtggctgtgtccgtggtgccagtgtgccggtgggcgtcccgtgcgcacggtccgtaccgctgtcaccaccagcaccactcccagtgccgcgatcaacgcgccgctgaccgcacccagccatgccagcagtcgttctccggcgaggccggctcccgcggtgaggatcaggcccatggccaggaccccggcggtgtgggtggccgtgacggtcgttccgaccgcgagggcggcccggacgccgccgtcccgtcgggccaggcaggcggcgacggccagtttggcgtggccgggcagtgcggcgtggcccgcgcccaggaccagggtcagcaggacggcgagaagaccgaccgaccacgtcaggtcccggcccgcggtcaggccggtgagccggcgttccagcgcggggaagagcacggtgccacggtccagtgtctgaaccgccggggacgctcccggtgcacccggaccgggagcgccggccgcgcctctgcccggctccgtacgcaactccgcggtggccacggcgagtggctgtctgctccctgtttgcgggtagtggcgcagcccatcgctcgggctctgggagggaacggacgatgcggccagccctacgcggtcgcccgggacggcggtgatctccttccagccggtccgtttcgcatccgcccccgaggcgaaggcgatgtcggcgggccgggagagatctgcttcggcccgcagagcgcaggtcagccgggagacggggacgccggcggcccctttcccgtaggtcagggtggagcggttcacgtgccaggcgacgcgcctgccgtccaccgagacgcgggtgcgaccggcgagtcgggcgcaccgatcggctgccctgtctgccgcttcggccggtgcgatcgtgccgtcgtggtcggtgtccgtcgcctcttcgtcctgtgcggtgggaatctccgcactgtcgacgaccgcggtgtcctcgatccggtcgtgcgacaggcgcagtccgtcgtagtggttgacgctgaagttgcccaacgggtgggcctgggcggtcggtaccgcggtcaggccggacagcacgagcagaggcgccgcgacggctgccgcacggcatggaaacttcatcgactacccatctgcgtcgggtcggtacagggagaggtacgggttcagggcatgggcctcgctcagacggcgggggccttcgggcatggcgagggactgctcgatcgttccccggtggtagcggaacagagcgttcttccagccggtggcggcggcccggcgtgcgtgggcgagggcttcggtgtcgcgtcccgcgcggtgcagggaccaggccagtgcatcggcgacgatgacgctgcggacgtgctgccactccctgcgcgcgagctccaccgcgaccttcgggtcgccgtggtcggccgcgtagaggatgagatgcgggtcgacgggtccgccgtccgcccgggccatgcgcacctgcgccgacaggaccgcccgctcgctcccccggcgggtatccccgctcgcgcgccgaaggtccaggctctccagcaggaactggggcagggggatccgctcgacgagccgcgtgtacagctcaagtgccttacccgtgtgaccgcgtgcggcagccacccgggcgagtccggcctgcccgtaggggtgggccggcacagcgctcagggcgcgcccgtagtgccgtgccgccaggtccgcccgcccccgggaccaggccaggtcgcccaggcgggcctcggcgaaggctcgttcgtcctgggtgaccgcgctgtccacggctcgctggagtgcgatggcggcgtcctcgggtcgcccgccggtctccaggtcgtaggcggctctgctgtaggcggccgtggccggggcgatgtcgagcatccgctgtacggcttcgcgcgcctgcggatagttcccgagctggatctcggcgtccgccaggaccgcgtacccgtccggccggtcgggtgccatccgggtcgcgcgcagcccgtgcacgcgcccctcgccgaagtcgtgccgggcattggccagcagtccccggcctgtcacggcccggtagttgtccgtgccgtcgagggcgagggagcggcgcagcgccttgtcggcggcgtccagcgggcccgcgtcgaaggtggtgcgggcccgttcgatctcggcgtgtgccaggtcggcccaggctgccgggtcgtcggggtgggtctccgtcctcttgcgggtggtgtcgacggaaccggtgttcttgtcaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccgcgcccgcggcggtgatcagacgcctcacgggcccgcgtggggcagattgaggtacgggaaggtggtctgcgcgtcggcgggttgcagactgaggaccggccgcgggagcaggtccgcggcggacggcccggcgggctcgccctccagcatgcggatcagcggcccgtcgatgttgtcgttgagccgccgtccgttcgggaagccctggagatcgccgtcgaggacaccgtgactcttcgggccggtggtgacgggggtgctgaggttcaggcgcaactgctcggcgagcacgatgcgttcggggtcggcgtcggcgttcatcgtgtgggtgttgaggtcgaagccgaacgcggatccgttgtccttgccgatgcccttcatgaacagggcctggatgtcacggcgcggagtggccggtgctgtgcggccctgggccctctcgatccgatgcggtgggacggggtcgagggtggcggcgaggaagtcgctctccaggtggtcgtccttcggcagacgtgcctggaagcggtcctcgggcccgccgggcgcggccaggccgacggtggagccgaacagggcgaacgcgatgtgcggggtgccctgccgggatacctgccggaaggtgggtgcctgctccgaaaggctgcgctccaggttcgcgccctgccgggagacggacgcccacacgccgacgaccgggttgcgctccgggtcgcccttcagggcgatgtccttcttggggacctgcaggatcaggctgttcacgttcagcgccgagagcggctgggcatcgggcagccatcccggcaccggtccgctggtgccgaccgtgtacaggccgaagacctgggtgtcggccttgaacgcctccgccgcctgggtggccacagtccgtcctccgcccggcagttgacgggtcgcctgcttccgcagcttgccgtattcgggcatcagggtccgaccggtgtgggtgggtgaggcgatcgcgtccttcagcagcgtccggccggcgccgcccgactcgaccttctccagggtgtacctctggcgtaccccgagcgaccggtcgtcgagcgagttcaccggcagcggcccgaccttcggtcccaccccgaagggcctgcggtcctcgtcccggaaggtccagcggtaggtggtgtcggccgcgccgtcgccgtcggcgtccgtgtggatctcgtaccgggcgccggtcgcgaacgggaagtccaccagtgcgttggccgcggtgccggggacctggaaggggcgcacgttcgcgatgagcgtgaccatgtccgcgtcgtccgggctggtgaaggcgtacacgtcggtcaggtccgccggggagtccagcacggtcgagggggcgtcgatgtggccgcccgcccggccgacgcccatgaactgtccggacagggcggctgcggtgagtgcggccgtggtggcggcgaggagagcgagccgtggacggaccggcgagctgatcgcggacgttctgggagttccaggcatgcgtgtctccagggttgttgggggaggggagtcacaacagccaacggcacaagtgatcttggagtgactgctccgcgtcgcgcaccactcgccgcgtggcactttcccaccggatggcctaacgaccggcccgcatggtcgccaacccatgcatcggtaggcatactcgtcgcgaagtcgatcttcgacctcttcatcgtcccgacgccgaactctgtcctgttcccgcgttcgtggcctctccgggaagagcgtctgccgccttccccaccctcctcacagactggaaccccccatgggtatgcacgcgatccgccgtctcatcgccgtggccgccgtggccgcgctctccgtcccgctctgcctgacgtcgtccggagcggccgcccagcagccggccggcgccaccagggcggcagccgtcgccgagccgctgccgggcgcctacatctccccgtggggtgacgcgcaggtggcgatcggtgacgagaccctcgcctggatggagcgtgagggcatcaccctggaggccatcagcccgttcgtgatggacgccgacggccggggtttcagcatgcccatcggttcgacggccggtgacgggctcgactccaagggacgcatcttctaccccggtggtctcaggatccagcaccaggcgtccggcaagtccatcaccctgaagtccacgttcatccgcgtcatgccgacacccgcgtactccgcgggcgtatcgatcgacggcaagaagctcctcgaggaagtggtgatcgccgagtccacctacgccgaggtcatggccggcgcccgcccgagccagaccggcttccgcatcaagaaggcccccttctacgtcactcaggaagccgcggacctcttcgcggcggcgaccggagccacggccccgcgcgccggcagtctcttcggcacgctcacgcccaacttcgactacgtaccgggtgcggcgacgccgccgacgttcccgaccttcccgtaacccgtggcgtgcgaccggcgtcgcgtgtcgccggcgccggtcgcgcagcgctcggagagcgtggacgacaagcttgttccgccgtcgaggacctcgtccggaggcgcttcacggacctcgccccggcactgctcatcgcggcacgccgatcacagcgagatgttccggagggtaagagccgctccggctgcctcggtactgtgacgcagatgaccgacaccgagatcaccgcagacctggtccgcggcctgctgcaggagcagcatccagacctggcagggctggccgtccgcgaggtggcgggcggctggggcaaccagatgtggcgcctgggggacgagttggccgtgcgcatgcagcgtatggacctcaccccggagctccagctcaaggagcggcggtggctccccgtgctggccccgcgcctgccgctcccggtgccgaccccggtgcggttcggcgaaccgtccgagcgcttccccaagcactggaccgtgatgacgtgggttcccggcgagccgctggaccacggctcgatcagtcgcggcgcccacgcggcagacaccctggcgaacttcctccgggcgctccatgtggaggcgcccgccgatgcgccgatcgctacggaccgtggtgcccatcccaggaactgcacggacggcttcgaggactgcctccggtccgttgcccccgacgacatcactgccgacgtccgggccgtctgggacgacgccgtcacggccgacgcgtgggagggcccgcccgtgtgggtgcacggcgacctgcatcccgcgaatgtcgtcgtctcggacggaacgctcgcgggcatcgtcgacttcggtgacatgttcgccggcgatccggcctgggacctcgccgccgcatgggtgctgctccccgcgggcacggcctcacggttcttcgacaggtacgcggatgcggacgaggcggcgatccggcgcgcccgcgggctggccgccatgaagagccttttcctcatgctcatggggcagaacggcgatcgaggtcttcccggcggcaagccgcactggggacctgcgggtcgagcggcactcgaccgggtcctggagggtgtttgacgcacgcttcggcggcagcgtcccaggcccacccggccaggccattctccccagcggcttcggccgcatccgtcgcggtagccattcctccacggcatggcacacatgccatccagttgctggtggaacgcatcaccgcgccctaccgtcgatcggggcggccgtgcacgtccgccccgatcactgcgggggcccgattccccgtgccgaacgagggggagtgccgtgttaccaggacgtaggcgcccaggcggccgacgagtacgcggaggggcggggaccgtgacttcccgggcctgtccgctcgccggcctgatcaccacgacgctccggtgagccgccccggacgcgccctcgtgccgctgctgctcacggtcgtcacctctgtactgctcacgggctgcgctggagccgactccgacccggccgcgggcggcgcgacgtcgcccgcacgaccgaccccgacggcgacctcgtctccgcctccgagttcgacccgccccccgtctccgaccgcatcgccgacaccgagtacggccgccgagatcaccgaggccgtcacccagtggtacgagtacggaggcgagacggcgatggtcagcttgatcaaggaagccgagaaggcccagtccggtcgtcccggcgaggatgatgaattcgccctcgtgatcctggacttcagcggtctcgaggaggcgctcagcacagcccggctgttcggttcgatccccgacctcaggacccagaggacctggacggccgccatcgagcgcctcgacgagggtgcgcgtgaggtccagatgtcggcgccggagggcaggacgttccagtcgcccgcggaggccggtcaggcgttgcgggggtggaaaacctttgacgaggggctcaagagcctcaagaggaccgggacgagactcgaccgcgccttcgggttgaagcctccgtcggacccgtgggaagcgggttagtccggtcccgtccgtgccgtcgcacgcctgcgagcccgcgggcctgagccgggcggacctctggtgcgaaccgacaccacgggctcatggatgccgcagacggacgtggcgagcggccagacgccgtactttcagccggtctcccccaccgccgtcttcaccaactccctcacctggctgacgatgtccgcccggttgcgctcgaagtccgggtcggtgaccgcgcccgtccgcgggttcgtgttctccgcgccgaactgcaggaccggtgtgtgcagatgaccgcccggcagcttcggcagacccagccggtcgcgcagcagggtggcccggtaggcgatctcgttggagaggtagtcgccgccgcctccggcgcgcgacaccgagccgggcgtcggtcccgccggcctggtcaccggtcggtcgccgcccgccgggatctcggtgacctcggtgttgtcgtacaccgggaagcggcccgtgtccgcttcggtgagctgtcggtacgggagtgtggtcgtcgtccactgcggctgcgagccggggtcggcgacggggacggtcccggtgctcgtcgcgttctcgttgtcggggaagccgccgcgccaggcgccgttggttcgctccacgtcgaagcggccctggcggccctggctgacggtggtgaacaggtccaggtggggcagctgccgggcgaggacccgctcgacggttccctccgcgaagtccgtccagcgcaccgggaagacggcggtctcgatccgggccggtccgtcggcggtccgcaccagggttccgtccagggccagcgcgctcgcgcccgagggattgccgatgcgggtgtccctgtccagcgtgaacgggtcgaagccggtgacgaggacccgcttcacccggtggcccgggaagcggatgtcgtcctggccgcgcgaggaggtctccagggccatgtgcaaggtctggcgctgctcgtcggccagcgcgaaccggggtgtccacgcgcgcagttcgcggctgagcgcgagccgggcccagtacaacgggcggtcgtcgccccggctcagatcgcctgtggcgggtcctcggccctgggcgc

SEQ ID NO: 3092 - DNA, 1814 bp, Unknown
  Kingdom: Bacteria, Phylum: Actinobacteria, Class: Actinobacteria, Order: Streptomycetales, Family: Streptomycetaceae, Genus: Streptomyces
cgccggccccgcccgccgtgacgtacaccgacgagcggacccgtatcgtccccgtcctctccggcaacaagctggagctgcgcaccgaacgtatcgcggccgtcctgaccgggcagtcggcggtcgaggacgccgtgcgcctggaggtgaaggtcctcggcgactcagggccggtcgctctcaggctcacggagtggcgcaccaaggagacccgggagttcgccctgcgcggctcgctcggctcccgggccgcggacatcccgctcagcgccttccggggggaggacgacatctggggtgtccaactcatcggcgagggcaagccgttggctgtggcggcccggaccgacggccaggacggacggtacgcgctccccggcggccgtgagctgtacgcggcccccaacccctcgggcgacctcgtgctcaccgaccggcccgtccagcccgtcgttacctcggccgtccgggaggagtcgggcgccctgatcctcgaaggggccttccccgagcccacgggtgccttccgggaactcgtcctgcggcacagcggccaccgggaggaggtggtcctcggcctggagcggggagacggcgaccacttccgggccgtggtcgcgcccgccgccgtcgagggacccggcgggaccctgccgctcgccgagggacgctggtatctcttcctgcgtgaaccgggggagcgggacccggacgcctatcggccgctgcggctgagcacctctctgcaccacaccctcccgcggcgacagcgttcggaacaccgggacttcgtccttcagcggcgccaccacgaccggatcgtcctggagtcgggctccgccctccccgtcggcgagcggggcgcgtacgggcagcggatccagcgtgagcggtacgccggactgcgcgccgccacggtcgacgaaccgcgcccggccgtcctctactccagcttcgacggccgccagtactccgactcgccccgggccgtccaccgcgaactcgtctcgcggggacgggacatcgaacacctgtgggtggtgcgcgaccagcaggcgtccgtgccggaaggtgtccgtcccgtcgccctgcacagcgccgactggtacgaggcgctggcccgcagccgctggatcgtcaccaacacccacctgcccgagtggttcgagcgggccgagggccagtgcgtcgtccagacctggcacggcaccccgctcaagcgcatcggccgcgacctcgcgggcaccccgcacgccgacgccgcgtacatggcgtccatggagcaccggtccgcccagtggagcgtgctcgtctccccgaacagcttctccacccccgtcctgcgccgcgccttcggctactcgggcgaggtcctggaatgcggttacccgcgcaacgacctgctgtacgcccccgaccgggacgaggtcgccgccgccgtacgcgaacggctcgcgatccccgaggggcggcgcgtgatcctctacgcccccacctggcgcgacgaccacccccggcggggcgggcgctacggcctcgacctccaactcgatctggaccgggcgcgggagagcctcggcgaggaccacgtcctgctggtccgccgccactacctcgtcggcgggagcatccccgacaccgccgccgtccgggacgtctcccgccaccccgacgtcgccgaactgctgctgatcagcgacgtcctggtcaccgactactcctcgatcatgttcgacttcgcgcagaccggccgcccgatgctcttccacacctacgacctggcccactaccgcgacaccgtgcgcggcttctgc

SEQ ID NO: 3093 - DNA, 4383 bp, Unknown
  Kingdom: Bacteria, Phylum: Actinobacteria, Class: Actinobacteria, Order: Streptomycetales, Family: Streptomycetaceae, Genus: Streptomyces
gccgacgagggccagcagcccggtggcgctgcgcgccggatccgccgcgccgaggcgcacccggtcggaacccagcgccgcgaccaactcggcccaggagtaggtcttctcgggccagccgagcttccgggaggccgacggcaccatggccaccgccaccggggaggaggccaccgagtcggacggggagacgggaatgccctcgcccaaccccttggcccgctccagccacagttcggagtcgggcagccagacctggaagtcgggctcctcgtcccctgccgcgagggattcggcgaccttgtgcgaatcgcgggccagcacctccacgacgaggcagcggccgtcggttctcatctcttcctcgggggcctgttcggctatggagcgcacggcgggggcgatgtcgggggaggccaccacggacagtcgcacggccgagtcctcgcaggaccgggagaacgacagcagaccgaccttggccgccacggccgttcccgtcgccacggtgaggacgagcagggtggcgatggcgacggtacggcgtcggcgccgcgggctcgggtggtcccggcgtccttccgccgcgtggctgtcgggcaagctatgacgtcccatgtcggtggtgcccctcgttgaggatgaaacaaggaaaagggggaccgcaccatcagtgatggtggtcgtcccccggcctgtcgcgcatgatcttcgtacctgtattcgagaccctagtgtgacggtcggtgggatgagacgcgattgcagaactaaaggcaggtgtacaggtggaggccgggcgcgtggctgattcttttcctcaagaggccgtgtcacgaaggatcttgcggtccgaggtggtcctggtcctggcgctctcgctgggcgccagtggggtgtccgccctgatcagttttgtcggatcactgacgaaaccagggggtttgaaggaccaggcggcgacgctcaacggctcgtacgctccgggccgcccatggcttgatctgtcatggcaaatgttcggaatcgcaacggctctggtgccggtcgcgctggtggcgcacctgctgatccgggaaggagcggggctgcgggccatcgggttcgaccgcacgaaaccctggttcgacctcggccggggcaccctggtcgcggccggcatcggcagcgccggcctcgccttctacctggtggcccgcgccagcggattcaacctgacggtcgttcccgagtccctgcccgaggtctggtggaaattccccgtactgatcctctcggcgatccagaactccgtggtggaggaggtcatcgtcgtcgggtatctgctgcgcagactcgggcagttgggctggacgccgatggccgctctggtggcaagctccgtgctgcgcgggtcgtaccacctgtatcaggggatcggcggcttcatcggcaacatggtgatgggcgtcgttttcgtgctgctctaccggcgctggggccgggtgggtccgctggtcgtcgcgcacgcgctcctggacatcggggcgttcgtcggatacgccctgctcgcgggccgggtcgactggctgccgacaccctgagcgcggtgccgtcgaggtcgtgaaaggggtgcgccggaggctcggcgcaccccgacgggccgtcagagagcggtgagcagttcgccgtcgatcaccgtgaccgccgtgccggtcagcagggtgcgtccgccgcgcagtgcggtgcggaccagtcccgagcgggcggacgcctggagcccggtgaggtcgtcgcggccgaggcgggccgaccagaagggggccagcgcggtgtgggcgctgccggtgaccgggtcctcgtcgacgccgacggccgggaagaagccgcgcgagacgtagtcgtagccccgggcggggtcctcggcggcggcggtggcgatgacaccgcgccgggagtgggccaccagtgcggcgaagtccggggcgagcgtccgtacggccgcctcgtcacggagctcgaccagcaggtcgccgatgtgctcaccggtgtcgtgcaccgagacggggtccgccccgagggcgtcggcgaggccgtacggcaccggctcctcggtgagcggggaggtggggaagtcgagggtgagagtgccgtcctgtccggcggtcgcgctcaggatcccgcagcgcgcggcgaagcgcaccgggcccgtggccaggcccgtggtgtgcaggacatgggcggtggcgagcgtcgcgtgcccgcacatgtccacctcggtggccggggtgaaccagcgcagcgcccagtcggccgtgccgcccggcggcagcgggtgggcgaaggccgtctcggagaggttgacctcggcggcgatctcctgaagccgttcggcggccgggaacgtaccgccgtccagcaggagcacgccggcggggtttccggagaaggggcggtcggtgaacgcgtcgacgatgcgaatcctcatggggcgaccgtagatcgcgggggcggcgacgggacaaggccaattccggatgtctggcccctgcacggcgttccggagcggccgtgtccggcaggggtccgccgcccaccgatgacttcccgggcccgacggagtcaccaggaggagaacgtacgcgtccagcccggagcgtacgcatccagtcacgggagagtggcatgcgcacccttgcgatcacccagaacatcaccgtggacggctcgatcgaaatgatcacggactggttcgatccccagggtcacgcgggtgcggacatgagcgacgtcctggaggagagccaccggcaggacgaacgttccgacgcgctgctcctcgggcggcggacgttcgaggacttccggggctactggccgatgcggaccgatgacgccacgggtatcaccgcctacctcgaccgggtggccaagtacgtcgtctccggcacgctcaccgaccccggctggcggaactcgacggtcctgaagggcgaccccgtcgaggaggtccgccggctcaaggccgaggagggcggcaaggacatcgtcctcaccggcagcatcaccctggcccacgcgctgatcgcggccggactggtcgacgagtaccgcctcttcgtccacccggccgtccagggccgcggccggcgtctcttccccgacggttacgaggtcccccggctgcggctgctggaatcgagggtgttccgcagcgggatcaccctgcagcggtacgccccggcctgaccccgccggggaatgcgtcacgtctgcgtacgtcgtcccggcgtacgtcactccgtgggccgcggctcctcccgcgaggccggaagcacccgtcccagccgtgcgagcggggacgcggccatcaggaccggcgacagcatcatgcccgcggccgtcaccaggaggccggtgcgcagaccccactcctgcgcgaggaggccgccgagcagcgagccgagcggggtgaaccccatgcccacgaaggtgatcgtcgcggccgcacgcccctgcatcccgtccggtgtgacggcctgccgcaccgacatgaccgtgacgttcaccaactggctgaacgtcccgaacacgaagttgacggcaaggagcgcgaggaccgtcgtggtcgtggagccgtgcagggcgggtacgcacagcagcgccccgttgccgagcaccgccgcggacacgagcaccacgccgtggccgaaacggcccggcagccgtgcagccaggaccgagcccaggagcgcgcccggaccggtcgccgcgagggcgaggccgacggtggcgcccgtcagatgcagttcgcgcgggaggaagagcagatagacggtcatcgtggccgcgaaggagaactggaaggcggcagaggcgaggcacacggcccgcaaccaggcgttcgcggcgacgaagcgaaggccttcccggatccggccccggtccggggcggcgcgctccgggcgctccggaaccggtgcgacgtgctggggtacggcttcggggcggcggatccgcctcagcgacacgaacgacaccgcgaagaacaacgcgccggcggcggcggcgaccggagccgacagaagcgacaccaacgcgccgccgagagcggggccgccgatctgcgccgcggaccggctgccctccaacgcactgtttccccgcacgagttgatcgcgccgaaccatccgtacgagggatgcctggtacgccacgtcgaagaggaccgacagggctccgacggtgaacgcgaccacgaacagggcgggcagtccgagcagtccgaggagccctgccacggccgccgcgcccagggccacggcgcgggcggcgtcggtgagcaccatcaccgtgcgggcccgccaccggtccacccacgcacccgcgaggagcgcgagcagc

SEQ ID NO: 3094 - DNA, 1150 bp, Unknown
  Kingdom: Bacteria, Phylum: Actinobacteria, Class: Actinobacteria, Order: Streptomycetales, Family: Streptomycetaceae, Genus: Streptomyces
ggcggccgagccgaccggaaggtgctcgccctcgccggaaggcggggtgatcatgacgcgggcgacctgccggtccacccgccacagggcgctgccgtcgagctggctgaggcggctgagaccgggcgtcgagtcgaggacccggctcatctgacgcggtgctccgtcccggacgaggacgtagcggatcgcgaagccgctgagctggccgccctggtcggcgccggagccggcgacgaggttggcgacgaccttgtcgaggtggctgttgctgccgcccgcctcggtgagttcgccgtcgccgaggcgggcgcccgagccgcggaccaggctgtacgccacggagtcgggcgagctgccgccgaggacgagggtgcggggctggtcgcgggtggtgctctcctccgccacgaaggcgggcacctggacggggtcgcgtcgctccaggggtccgtccgcgccgccgatcatccagccgaacgcggccagggccggggcgagtccggcggccagcgcgatcagtgcggcgacgggctgacgccagccgaagctctgctcggcgacccggatgcgggccccgtccgcgcccaccagggcggcggcgatcagggcggcgccgtagacgagggtggcgggtccggcccaggtggacccgttggcgacggcggcgaagaggaagccgacgagtgcgaccgcccaggcggtgcggacggcgaactgccgctccccgcgcagcagggcggcgagcgccgccagcacgatgccgaggagcaggatgccgcccgccgcgccgggtccgccggggctgatgccgagcaggtcgaggccggatgccgttcccgtaccgatgtccaggcccgcttcggtcaggagcgcggacgggttcgtcaggagggtgagggaccagggggcgaggaccagcaccggggtgccgacggcggcgacgaagcggagtccgtacgccgtgatgtcgccgcgccgcagcacgagcacgccgatgccgaggaccacggcgagcggccagacgatcggggtgaacgccatcatgacggtcagcagcagtgtgtacgcccaggtggcgcgccagctgccgcgctcccccgccgcgctgtccacgcgcagcccgtgggcggcgacgcccgcgcgggcg

SEQ ID NO: 3095 - DNA, 5462 bp, Unknown
  Kingdom: Bacteria, Phylum: Actinobacteria, Class: Actinobacteria, Order: Streptomycetales, Family: Streptomycetaceae, Genus: Streptomyces
gccaccggccgcgtgcggctgggcggcctcggcggcgcgcaccgggtcgagctccgcgagatgtccgaggccgacgctctggccatgctgcgcggcagcatgggcgggcggccggcaccggccaccccggcggacctgtccgacctggtacggctgtgtgcgcggctgccgctcgcgctgcgcatcgccggggcgctcctggcgtcccggccgcactggagcccggcggatctcgtgtcacggctggcggacgaacagcaccggctggacgccctgcgttatcgcgatctcgaagtacgggccagcttcgggctgagctacgagggtctcaggcccgggacacggcggctgttccggctcctcgggctgctggaggcgcccgacttcacgctctgggcagcggccgccgccctcgacaccgggctgcgcgccgcccaggaactcctcgacgaactggtcgacatccacctgctcgacgtcaccggaacacccaacggccaggcgcgttacgggttccacgacctgatccgcgcgtacgcccgggagcgcgcggaggcggaggagccggtggcggcccgggacgagtccgtcttccgtgtcctcagcgcgctcctcgccttcacggacatcgccgaccgcgaccacatgggacagaacatgttccagcgggacgccgcccggtggcagcctgcgctggtagaggcgagtctgccgctctcggtaccgccgatggagctgctggacgcggaacgcctccccctggtggcgggcgtgcggcaggcggcggagctgggcagggacgagctctgctgggaactggccgtgggcgggcacgcgctgttcgagacggagcggtacttcgacgactggcaggagtgctacgagacggcgatgggcctggccagggccgcgggcaacctgcggggccgggccagactgctcatctcgatggccggactgctctacacccggcgtcggtacggtccggccgaggagtccaacaccgaggccatggacctgttcgagcggatcggggaccgcaggggctacctggaggcgttgagcaacgcgccgttcttcctcgtgcccaacggccggctgaccgaggcgatcaccgccggccgcgaggccttcgagcggctcgacgcgggcgggcagccggcggcggccctgcacgcgtactcacaggtcggcctcgcccatctgcaggcgggcaggccggaacgcgcggcggcggtcctcacggagatcgtcgacggggcacggaagcaggggatccggaccctgatcgcgcgggacacctactggctcggccaggcgcagctcgcactcggccggctcgcggaggccgaggaggcgttcaccgagctgaccgagtgcgcccggaacatcgggtcgtcgggcgggttctacaccgcccacgcctggggctgtctccacctggcccggggcgagtacgacgaggcacgccgccgtctgctcgaaggcgtcgagatcgcgcgcgcactccacgaccccatgttcgaaacccgggtcctcaccgacctgctcgatgcccgcctgtacggcccccacgacctgccggccgcgatcggccggggggaacgcgcggtcgaggtggcccgcggaatcgactatccgtacctgctcgcgggcgtactggagaagctcgcccggctgcgggccgccgcggggaacaccgccaccgcgcggcagctgaccgacgaggcggctgccctgcgggaccggatccgctgaaccgcaccgcgggtggcgttcccggcgtgtactcgccgtattccacgctgtggcaccgtgcatgtcaacgacggaacgccgtcgggaggccgctccgcgcgtccggcggcagtgggctcctcccggagcaatcgaacgttcgaagccgccgtgtcgggcggctctcgtaaccagtgaggtagaggtagcagtagtgcacaagcgacgtatcgtgtccgcggccgctgtggtcgccctgggactcgggctttcggcctgcaacgacgacagcagcgaccctgcggcgaaggaatcaccgcaggcgtcggccccggccccgtccgcgccgagcgagccgagcagtgagagcccggctgccggcggcggcgacgctgccgccgggggcgagggggacgccaccgcgccgggcacggagctcaaggtcggcgacagggccgtcctgccgttcgcgtacacgagtgacaagaagggcaccatcgccgtgaccgtcacggcgatcgagaagggcgccgaggccgatatggccgccttcggtgacaaggccaagggcatgacgccctacttcatcaagatgaaggtggagaacgtcggcggcaccgacctgtcgtacgcgtcgctgaagctggacggtgtgctggaagggggcgcgggcacgggcatcgtgctgatcggcgacctcccgggcaagtgcgacagggagagcgcaccccgcgagttcaccaccaagggcgcgtcgtacgagacctgttcgctcaccgccacgaagggcgcgccggtcacggccgcgcagttcgacgagggcgacgcgtacagcgacagtccggtcgtctggaccaactgaggtacagagccacggctttgacgacggcgggagcgagatcgctcaacgcacggggaatccgtaggagtaaccctgctccttcagccagggcaggacctcgcgcagggcggccaacgtctgcgagcgctctcctcccgcgtcgtggaagaggacggtcggcccgttggagatctcgcgcttgacggtggcgaccatggtgtcggcaccggggtgctcgaagtccttggtgtcgacgttccagcccagcggtcgcatcccgtgggaagcggcgagctgccggctgtacggggtgaaggcgccgcccggggcccggtagtactgcgaccggacgccgccggacgccttgatgatcatgcgttcggcgtccaggatctgctgggactggtaggcctcggacttggtgtccatggtggtgtcgtgcgagacggtgtggttgcacagccggtggccgtccgccacgaccgccttgaccaggtccgggtacgcctgggcctgggtgcccaccatgcagaacgtggccttcacgccttggtccttcagcaggcgcagcacctgcggcgtccagaccggatccggtccgtcgtcgatggtgatgttgacgccccgggccccgcgttccgaggcgtgcgcgatgtccgccgccaccttggccacgggccggtcccgctcgtccggcgacgtgacactccccgacggccgccccccgttggtgtcggcctgcgcggtccacaccgaggcaccggcggccagggccgtcacgccgagcgccgccgcgaggagccggctgtgccaggcccttcccttgtgcttacccatgtccgcccgccccttttgccgtccaccgatgccgtgcacccatctagacggacgaacacccctgcgggatgcctcggttaccgatcgcggacacagccgcagggaggccgcgacaaacgagggccgtcgggagatcggaccagcggcggacagcggcggatcagcgggagttgtcctcggcgagggtgtgcgcgaccagggcgttggcgtggccgtgacccagtccgtgttcggacttgagccaggcgaccagttccatgtgcttggtcagcggggaggtgcggatgaggtccttccactcggagaccgggcggccgtacttcttctcgatcgaggggaagtagctggcagggcccttcacggcgtcggtcatggcgtgtcccgtctgtagtgccttccccgtccggaaggcgtcgcgggtatgaccggcggcggagggtgaagtcatcggcgtccgggagtggatcaggtcacagtcccgtcccgtgcgccgtgccgccggagaccaggccaccggaggcagactccgttctttgcccagactttgcccgcaccggggacggtgccgggatgcacacgcgccgggagcgtgttggggccgggtggacaccccccggctatggacaggaaaccgacgtgacagacgtgacggcacacgcgccgacagacgtgacgaccgacgtgacgaccgacgcggcaggcacgccctccccggcggacgccgaggtgtccgcggcccgcgcggcggccaccctctcccgcccgttcagcgtccgcggactcaccgcccggaaccggatcgcgatggcacccatgacccggcagttctccccggacggcgttcccggacaggacgtggcggactactacacccggcgggccgccggtgacgtcggactggtcatcaccgagggcacctacgtcgaccacgcatccgcgggaaccagcgaccgggtcccgcgcttccacggcgaggcggcgctcgcgggctggggccacgtggccgactccgtgcaccgcgcgggcggcgcgatcatcccgcagctgtggcacgtgggtgtcacccgcaccgaaggcgccgggcccgtaccggacgccgagccggtcggcccctcgggcctgtccctgagcggcgagcccaaggggcgcgccatgacgcagcaggacctcgacgacgtcatcgccgccttcgccgacgcggcggcggcggccgaacgcctcggcttcgacggcgccgaactgcacggcgcccacggctacctgatcgaccagttcctgtggtccggcagcaaccggcgtaccgacgcctacggtggcgacctggtctcccggacccgtttcgccgccgagatcgtggcggcctgccgcgccgccgtctccgacgccttccccctcttcttccggatgtcccagtggaagtcggacgcctacgacgcgaagctcgcccggacccctcaggaactcgacgacctgctcacgccgctcgccgaagccggtgtcgacgtcttccacgcgtccacccgccgctactggctgccggagttcgagggctccgacctgaacctggccggatgggtgaagaagatcagcggcaggccgaccctcacggtcggctcggtcggcctggacgacgacttcttcagcgccttccagggcaacgactccaaggtcaccggcatcgagcagctgctggaccggctggagcgcgacgaattcgacatggtcgccgtcggacgggcgctgatctccgaccccgagtgggcggcgaagaccctgcgcggccgcaccgcagacatcatcccgttcaccgcggacatgctgacgaccctgcactgacaggcgagtccctcggcactgtgcgctgagcactgggcactgggcgctgagcaccgggtactgggcgctgagcactggttcccgtgccctgcgtcccgtgccctcgtccttctccctatgccctatgccctgttcgccgccgcccacgaggtcagccgcgccctgatcaccgcgatccgcgcgggtctcccggcggcggcgaacagggcat

SEQ ID NO: 3096 - DNA, 5248 bp, Unknown
  Kingdom: Bacteria, Phylum: Actinobacteria, Class: Actinobacteria, Order: Streptomycetales, Family: Streptomycetaceae, Genus: Streptomyces
cgcgccgagagcgccgcggcggcggaggggctgtcggtcaacgcctggctcgtgcgggccgtgtccgtgtccctcgacggcggggggcgcgcgagcgcaccgggccggggcaaggactcgggcggtcgcggcttcaccggctgggtccgctgagtccgctgagcccgctcggtctgtagcgggctccacttcaccggcggatcgccgatccggccgacgtcactgatcaccgatcgctcatcactcaccgagccaagaggacgggacagccatgccttctttcgatactcccgagccgatctccgccgtcgtcgagctggacgccggcaccgcccgcatcaccgccggcaagcgcaccgacacggtcgtcgaggtgctgccgggcaacggatccgacgaggacgacgtacgcgccgtgcagcagacccaggtctcctgctcgggtggtcgtctcaccgtcaggacccccaagaagcgctccctgttcggcaagccgggcgccgtcgtggtgagcatcgaactgcccgccgggtccgatgtgcgcggcacctccgcgctgggcggcttcttctgcgaggggccgctcggcgaggtgcagctcaagacctcgctcggcgacctccaggtggacgaggcggcccgcgccgagctcaggaccgaccacggcgacatccggctcgtccgctccaccggggacgccgaggtcatcggctcgggccgggtcgaggtcggcgccgtcgccggggcggcagtcgtcaagaacggcaacggcgcgaccgggatcgacgaggccggcggtgagctgaaggtcaacgcggccaacggcgacatctccgtgggcgtcgcgcacggcagcgtcgtcgccaagtccgccaacgggcggatcgagatcggcgtcgctcactccggggtcgacgcgacctcgtccaacggccgcatccgcgtcggcgacgtgacccgcggcagggtcactctgcgcacctccgtcggcgacctcgaagtgggcatccacgagggcaccgccgcctggctcgacctgaaccccaagttcggcaccgtacgcaactcgctcggcgccgccgccgggcccgaggactccgacgagaccgtcgaggtgcacgcccggagcggggccggcgacatcatcgtccgccgcgcctgacctacccgccacgcccgacttggccgcggccgtgcctgaccaggccgcgcctcgcttcgtcgtgcccgcctctcgtcccgtccacgcccgactcgccgctcgcgagagcggaaccagcatgaagggaaccagcatgactgtcacccgggtctccgcaccgcttgccgcccaggccgcggcgcaggcgatcaccgccaccggactgcgcaagtcctacggagacaaggccgtcctggacggcatcgatctggccgtcccggccggcacggtcttcgccctgctcggccccaacggcgcgggcaagaccaccgtcgtcaagattctctccaccctcatctcccccggcgccggctccggcgagatccgcgtcggcggccacgacctcgccaccgacccgcaggcgatccgcgccgggatcggcgtcaccggacagttctccgccgtcgacggcctgatcaccggagaggagaacatgctcctcatggcggacctccaccacctgtcccggcgcgagggacggcgcgtcgccgccgaactcctggaacggttcgacctggtggacgccgcgaagaagcccgcgtccacctactccggcggcatgaagcgccgcctcgacatcgcgatgacgctggtcggctccccccggatcatcttcctcgacgaaccgaccaccggcctcgacccccgctcccgccacaccatgtggggcatcatccgcaacctggtctccgacggcgtcaccgtcttcctcaccacccagtacctggaagaggccgacgaactcgccgaccgcatcgccgtgttgaacaacgggaagatcgccgccgaaggaagcgccgaggaactcaagcgactgatccccggcggccacgtcaagctccgcttcaccgaccccgacacctaccggagcgccgccgacgcactgcgggaagtcacccgcgacgacgagaccctgtcgctgtccatccccagcgacggcagccagcgcgaactgcgctccatcctcgactggctggactcggccggtatcgaggccgacgagctgaccgtgcacacccccgacctcgacgacgtgttcttcgccctgaccggatccggcacgcccgcccggaacaaccagccgaaggaggctgtccgatgagttccctctccctcgccgtgcgcgactcgaacaccatgctgcgccgcaacctcctgcacgcccggcgctacccctccctcaccctgaacctgctcctcacgcctgtcatgctcctgctgcttttcgtctacatcttcggcgacgtgatgagcgcgggcatcggtggcggagagggcggccgttccgcgtacatcgcctacatcgtcccgggcatcctgttgctgaccgtcggctccaccgtggtcggtaccgcggtgtccgtctccacggacatgaccgagggcatcatcgcccgcttccgcaccatggcgatccaccgcggctccgtgatcatcgggcacgtcgtcggcagtgtgctgcagagtgtgctgagtgtggtcctggtcggcgcggtcgccgtggccatcggcttccgctccacggacgccacgctcgtggagtggctggccgcgttcgggctgctcgtgctcttctccgccgccctgacctgggtcgccgtgggcatgggcctcatcagcccgaacgccgaggcggccagcaacaacgccctgccgatggtgctgctcccgatgctgtccagcgccttcatcccggtggagacgatgccgggctggttccggccgatcgccgagtaccagcccttcacccccgtcatcgagaccctgcgcggcctgctgctcggcaccgagatcggccacaacggctggctcgccgtcggctggagcgtcgggctcgtggtgctggggtacttctgggcgacctcgaagttcggccaggacccccggtgagtacccgggttccccgaccccgaccggctcgacatccgccgccgggccaccggggatctctccttcggccacggggggagtggtctcccggccgatggcccgggggaggaacagcgccgaacttccctccgtgcaaggagatgcggtgagcgtccgtaccgatttctaccggggggtaggcgacccgggatccttgttataccttgcgtctaacaaggatcccgggccggccggtgtccggccccgcgcgggccgtcgtccccggccccggtgatcccgtacagcacgacccgaccccgtacacagcgcgagccgattccgtacagcgcgagtcgattccgtacgcggaggccggctgacgtacgcacctcaccacgaacgaggatcaccgcactcgacccaaggagccgcagcatggccggcagcaccgttccgtcgaaggtccaggaaagccccgagggcgacgacgtcgcgcggcggctgctcgactcggccgcgcagctcgcgtacgacccggccgcggaggtggactgggagacgccgctggacaaggagttccacggcgcgagcccggagtggagcagcctctacgggaccgcctactggggcgagttgaccgaggcgcagcgcaaggagctcacccggcaggaggcggcgtcggtcgccagcacggggatctggttcgagatgatcctccagcagatggtgctgcgcgacatctacatgaagaacccggcgggcgcggagttccagtgggcgctcaccgagatagccgaggagtgccgtcactcgatcatgttcgcgcgcggcgcgcagaagctcggggctccccactaccggccccgccgcgcggtgatggagctgggcagggccttcaagacgctggcgttcggcgaggcggcgtacgcggcgatcctggtcgccgaggaagtgctcgacgtgatgcagcgggactggatgcgcgacgagcgggtcgtgccgttcgtccgcaccatcaacaacatccatgtggtggaggagtcccggcacatgaagttcgcccgggacgagaccctcaagcgcctggagggcgccggttgggcgcggcggcagatcaacgcgttcgtcgtcgccgtcgcctcgtacttcatcgtgaccagcatggtgaacccggaggtctaccggaaggccgggctggacaagaagcgggcgctggccgccgcccggcgcaacgagcaccacaagtcgatgatgcggtccagctgttcggggctgatggacttcctggcctccgcccgtctgctcaccaagcccgccctcgcgttctacaagcgcgcgaacctgatctgagccggggccatgacctacgccatcacccagacctgctgcaacgacgccacgtgcgtggccgtctgcccggtcaactgcatccacccgacgccggaggaacgcgccttcggctccacggagatgctccacatcgacccccgggcgtgcatcgactgcggggcctgcgcggacgcctgcccggtggacgcgatcttcccggtggactcgctgtccgccgcgcagcgggagtacgccgacatcaacgccgcctattacgagggcggggagccggcccccgggacgacggaggggccgaacttccacgcgtggggcgagccggtcttcgggcgcagcctgccgtccgacttcggccccctgcgggtggccgtcgtcggtaccgggcccgccgggatgtacgcggcgcaggatcttctgctgcacaccgccgccgaggtgacgctgatcgaccggctgccggtggccggcggtctcgtccggtacggcgtggcgcccgaccaccccgcgacgaagaaggtcggcgacaccttctcccgcttccactcgcacccccgggtccggatgcacctgggcatcgaggtgggccgggacgtcaccgcggaggagctggccgcccaccacgacgcggtgatctacgcggtcggcgcctccacggaccggcggctcggcatccccggcgaggacggtcccgggtgtctgtcggcgacctcgttcgtcgcctggtacaacgcccacccggaggccgtcgcgcagggcgtcgacctgtccgccgagcgggtcgtcgtggtgggcaacggcaacgtggcgctcgacgtcgcccggatctccacc

SEQ ID NO: 3097 - DNA, 7544 bp, Unknown
  Kingdom: Bacteria, Phylum: Actinobacteria, Class: Actinobacteria, Order: Streptomycetales, Family: Streptomycetaceae, Genus: Streptomyces
caggagggcctgggcgtcccggccgcgacgtggacggacgccgcggccgatgcggcggcggtgcggcaggcggcgggcagctacctgaaggacgcgatcccgcacgaggcgagtgcggccgagcgcaaggcgtggtgggccggcctgacggacgaacagcgcgaggagtacctcgcggtgtacccggatcggatcggcaacctcgacgggatcccggcgctcgtgcgggacgcggcgaaccgggacaaccttcagctgctgatgggaaagctggaggggcgggacgacgaggattcagcgaccaagctcgcggcgctgcgggagatcgaccggcagttgagggcggtgccgggggcgggggagccgccgatgtacctgctcgggatcggggatcagggaaatggccgtgcgatcgtctcgtacgggaatcccgatactgcgcggaatgtggcggcctatgttcctgggctgaatacttcgttggatgaggagtttgccggtggcgatttgaagcgggcgcgtgatacggcttccgcagcacgagaaatcgaccaatcgagtgcggtgatcacctggctgggatatgacgccccgcagagcccggatggtttgagcagcctttccgttgctggaactgcgcgagcggaggagggtggtcgcgctttcaacaggttcatggccgggctggcggcatcgaatgatcacgctgatccgcaccttacggcgatcgggcactcttacggttcacgaacagtcggcgcggcgacacagcaggaaggtggactccccggtgtgactgacattgttctcgtgggcagtcctggtgtgggcgtggaccgggctgacgacctgggagtaggcagtgaacatgtatacgtgggcgcagccgagaacgacgtggtgaccaagctcccggcgagcgggcatggagtgatcacggggatcgggcacgctcttggcccagccggttcgctggcagtggatttggcgaacagaggcgatgccgagctgtggttcgggagggatccggcgagcgaagagttcggcggtcggcgttttggcgtggacgatgggccgcctctgattggcccggagggaatgtcttccgatgcgcattcacagtattttgatccagagttggactcctcctctgccggtagtattgccctgattgctgcagggcgcggacatatggtgaatcaggagcaggcgcggtgaagctgtatctgcgaatgctgttggcagttctcgttgccggcatcgtatcgactggatgtgtcaatcaggaggggggcggtgtggatatgcaagctgccgcggagcgttctgacgaaatgcttgacgcggtttttcaggcgattcgacccgaggttcgatggactcacggtttcacctcggtgggaagatgtgaggtgacgcgtaggcgtgtcgtcatgactgatatctccgaagagcggagaggtaattttctgggcgtggtcgagcggttctggcgtaagagtggataccgcatgaccgcagtgaacaataatgcagagtttcccgcaatttatgcacgcaccagtgatggattccgtgtgagtctgcgtatcggcggcaaagggcaagcattttttcaggtggatacgccttgtgcccaggagtcggaagtagcagattccaccagtcgggcaacggcccccctgtacgacggtgtggagttcatcccccgccccaacatccactccgacttctggtcggcaggcgcccccggggtggcggcaagcaggtcgtgatcggggcatgttggctgaactgagccggtgggtacgggctttgagcccggtattgggtcctggggcccatgtcgtgtcccctgcccgtgtggtcgcatacgcggagtgactgatctgtcgcccgttccgcccacacacgaggtaggggactgctcttgtccggcatacgaagaagcgcggttcctgtcggcgtcgatgtaagcgctgccgttgcgggtccggggcggttgatgccccggccgttgcaggcggtgctgattcttcttcacgttctcttcgtggccaccctggtgggcgcgatcagggccctgtcgacggcgtcctcggtggacgcggtcgacgggtatctcctcgggttgttgctctacgcgtcgttgcccggcatcggcgccttcgtgctgtcgctgtacgtccgtaagggcggtgtccgggtctggtacgggctcctcgccgttcaggcgtggatcgttctcggcgctctcgcggagttgagcggcggggccggagcgggaggtgtcgcccggctggtgataccggtggccgccattacgctgctgtgccggccggggagccgtcagtggttccggagcggtctggagcaacgggccgagcaacggctgttcagctttgcccggatgatgaagctccgccgcgacggcgggcagaccgcgctggagtacctgggcctcgtcctcgtggtcgtcgcgctcgtcggcgggctgatggccaccggaaccggcaggcagctcaccgcggagattcgtagcgcgatctgcgaactgaccggcggatcgtgcccggcaccggggcatgacgtcgtggccggtggcggaagcaccgacggcagcggaagcgccggcggtgacactgcgggtggtgcggacggcggttctggtgccgacggtggcgcggacggcggtgctggtgccgacggcggcggcgagtccagcctcaccggtggtactggcagcaccggtaccagcggtgacaccggcagcaccggagggaccacgaccaccggaagcacgggcggtggcacaggcggaaacagcggcagcaccgccgggaccggcagcaatggctccggtgacagcgccggctcccagggcaacgggtcgtcctcccaaggcggcgaagccttccccccgggcgacgtcatcgtgccggttgacgcgggtagacccgcgggtcccgagggcggcgggttcctcgacgggttcctcggggacgggctgggcggcgacgtccaaggggtcgtcgacgcggtcctgcggccgggtgagagcggccagcgcatcgtcgaccagtgggggcgcgacacccagggcgcgggcgagaagtgggaccggggtgactacgtcggcgccgcctgggactggaacaaggcggtcggcggcgccggagccgggctggcgatacccggctccggggcgcgggtcgacgccgaggtgcgggacgccgagcgcgcgcacctgagcgagcggattccgcagaacgccacgcccgccgggaacaaggcctggtgggacgggctctcgccggaggagcgggatcggtacatcgagctggtgccggagcggatcggcaatctcaacggcatcccggtcctcgcgcgtgacgccgccaaccgcaagaatctccccgcgctgatcgacaagctggaaggcgtcgacaccgacaaggcccgtgaccagctggccgggctgcgggagatcgaccagcagctcaaggagaacgggaagccgccgatgtatctcatcgggatcggggacgagggcaacgggcgggccatcgtctcgttcggcaaccccgacgcctcccagcacgtgtcggcgtacgtaccggggctcaacacctcgctcgacgaggagttcgccaagaacgacctcgggcgggcccgggacaccgccatcggggcgcagggatacgacgactccacggcgtccatcgtctggctcgggtacgacgcaccgcagctgccggacaaggacggtgcggcgggctacctcgccgtcatgggtacggggcgagccgagaagggcggggcggcctaccgagacttcatgggcgggatctccgtgaccaaccagaacaaggacccgcacatgacggccattgggcactcctacgggtcccggaccgtgggtgccgcggcggcccggcccggcgggattcccggggtggacgacatcatcctggtcggcagtccgggggtcggcgtcgaccacgccgtggacctcggcgtcggcagcgagcatgtcttcgtgggcgccgccgccaatgacccggtgaccaagctgccctcgaagacccaggtggtggtgggcggcatcgggctcgccctgggcggtcccggcggggcctatctggccggcgatctggccgatccgggtgacgacgacctgtggttcgggaaggatccggcgagcaaggcgttcggggcgcggcgcttcccggtggcggacggtccgccgctggtcagcgggagcggcatcagtctggactcgcactcgaactacttcagcccggaacgcgacgcggtgtccgcggacagcatcgccctgatcgtgtcgggcaacgccggccggctcaagatggaggaaccgaagtgaggcgagcgaagcgggtcctgcccctcgtcgcggtggtcctggccctgggggttccgctgtccgggtgcgggagtgaggacgggagcgcgcgcgaaggcggcgtgagcaccggaaaggagcgcgggatggacatgcaggaggccgccgagcagtccgacgcgatgctcgacgcggtcctgaagggcatcgaccccgatgtgcagtgggcgcacgggccgaccaccacccgggcctgcggggtgacccgtcggcgggccgtcatgaccgtcgtctcccccgaacgccgtcagacgttcctcgaccgggcggagacgttctggcggaagaacgactaccggatcaaggcggtcaacaaggacgagaagttcccggcggtctacgcggtcacgaagagcggattcggtgtcagcgtctccttccgggggaagggacaggccttcctggaggccgacagcccgtgcgtgaaggagtcaaaggtcgccgctcccaccgccgagccgaacggtccggcgtacaaggacgtctatccgctgccccggcccaacgtccgctccgacttctggtcggggacaggcggctgaggtctcgtcaagccgggacgtcccgtcgttccgtggtccgtcgttctgtggtctgtggtctgtggtccatagtccgtagttctgtgagtggtgggccagttctgtgtgagtggtgagccgtcggcgcccccgtgtgcttcgggtgcgccggtggtgtgccgcggatgactcgtacacaccgtcgaaaacacctctgaagcgcgctccgatgggggatggttgaggggtgcggaaattctgggtgttcggtggcatcggcgtcggcatggtcctgtgcttcctggcgctgctcgtcgtcggtacgtactcggccgccgccgggctcgccgggtcggggggcggcggtgccgtcgcgctggccaagggggcggtcccggcgcggttccagccgctggtgcagaagtggggcaacctctgtcccgccatcaacccggccttgctggccgcgcagttgtaccaggagagcggctggaacccgagtgcgcagagccacgccgccgcgcagggcatcgcccagttcatccccggtacgtgggccacccacgggatcgacggcaatggtgacggcaagcgggacgtgtgggaccccgccgacgcgatcccctccgccgcctcgtacgactgcgagctcgccggatacgtgaagaaggtgccgggcgacccgacgagcaacatgctcgccgcgtacaacgccggcgcctacgcggtgatcaagtacggcggcgtcccgccgtacaaggagacgcagaactacgtcaagatcatccgctcgctggagaagagcttcgcccggcccgtcggccgcgtcgcgccctcccggcaggccgccggggccatctacttcgcacagaagaagctcggcacgccgtatctgtggggtggcaacgggacgccggagcagcagggccggttcgactgttcggggctgacccaggcggcgtaccggaccgtcggcatcgaactgccgcgcgtcgccaatgaccagtacaacgcgggtccgcatccctcgcgggacgagctgctcccgggagacctggtgttcttctccgacgacctcaccaactcgcgtgcgatccggcacgtcgggctgtacgtcgggggcggctatatgatcaacgcgccgttcaccgggtcggtcatccggttcgacaagatcgatacgccggactacttcggtgcgacacgggtcacgaaggacggtgccgccgcccttccgacggatctgcccacagggtgacggatgtctcccggacagcggctcccggcggctcccggcggctcccggcgtctgccggcgtctccaggacatcacccggcgtcccggcgtttcccgtacggggtccagtacgcgtccagtacgggggtcccgtcccgggcatccggagcggcgaagggtgctgacgggcagtcggacatggccggaactctccgtgaagcctgggccctgagctgcgatgacgagtcactcttcgataacgtcatggtgatcattcggtggagagcggaacgcacgcaccggccgggccgttccctggacgggggacgggaacggcatgtgcactgaccatgcgtcgcggtgacgcggtattgcggtaccgcggcagtgccgcggtgatgcagtacagcgatgctgtgcagtgcggtagcggacagcaccggacacgggggtacgaccacggcggcgtgcaaggacgcgcgtcgcagcagaagaagcagacaaggcaaggggccgcagcagatggctggactcgaactcgacgggtcgaacccggacgtcagtctgctctacgacatcaacggcctcgcgaaggccgctccgacctggttcgaccgggtcatggagttcgtcggcgagtacgggatcatgttcggcctggttctggtgggcctgtggtgctggtggagcatgcgcaagcgcgggacggccgaggactcggtcacggctgccgccgccatcgtctgggcgccgctcgccgccgccatcgcgatcctcgtcaacatcccgatccgcggcttcgtcgaacggccgcgtccgttcaacgaccacgaaggccttgaggtcctgatccacggcaagacggacttctcattcgtcagcgaccactccaccctggcgatgggcatcgccgtcggcatcttcgtggcgaaccggaagttcggcttcgtcgcgatcggcctcgcgctcttcgccggtttcagccggatctacatgggcgtccactacccgaccgacgtgatcggcgggttcgctctcggtacggccgtcgccctgctgctggccccgctcgccatggcgctgctgaccccgctgatggcggcggtcgcccgttcgccgcacgtgggctggttcgtccggtcgaagagcgcggccgtcgcggacgagcacggcgaggcgatgggcatccccgagccgcggcccggttccgggcggggtgacccgggggagaaggacctggccgcctgacggtctccgtccttcctcttccggcctctgtccgctcttcttcctccgccctccccctgccctccagctgatctcccgattccccgggcgcctccgagcgcccggggaatcg

SEQ ID NO: 3098 - DNA, 2580 bp, Unknown
  Kingdom: Bacteria, Phylum: Actinobacteria, Class: Actinobacteria, Order: Streptomycetales, Family: Streptomycetaceae, Genus: Streptomyces
ggcggctgcgccggctcaccgggtccatcggcacctggttccgcccctcgcccaccgcgtacgcctccccgctcctccagcgcctcgcccagcgggccggctacccccacgtcctcggctgcgacgtggagtcgctcgaccacgcggccacccgcgtcgccgccgtcacccggaaggtcgcgggggagctgcgcaacggatcgctggtggagctgagtctcggccgcccggtcaccgtcgacgcgctgccgctgcttctcgccgagatcggccgccgcgggctgcacgcggtgacggccacggagctgctgggccgaccggccgccggagccacccggacggcccgataatctgacccctgacattcggcatcacgaaggggcggaacagtggcggacatcgagtcggcgcggacggcattcgagcggttcgacagagacggcgacgggctcatcacggccaacgagtacaagagcgcgatggcccagctgggcgaccccttcgtcaccgagacggtggcgcaggcgatcatcaacgcccacgacgccaacggtgacggcctgctcaccttcgacgagttctgggcctcgcagaacaaggcctgatccgcctcggcggccggtcccgcgccgtcggggcccggccgccgccgggtgacgtccggaggaaccccttacggtgccttccggccgtcccgcccgccgtgcgcgggttgctgtgtctatgtccaccggcgaggatcgggccgtgatgttctccggaccccccgccgacccggccgcgccgaccgggcccggcctgcccgcagccgccgtaccggctccgacgggtgacgcgccgtgcgccggcgagatacccgggggagcgcccgggccgcaggccggacgctcctggaccactcccctcctgctctgcgccgcgggcgtcctcgcgctcctcgtggcgctgctcggccccggcctcgtggcacgcggcaccggggagctccggatacccggcgcgggacccaccaccgtgctccgcgccgtcctgttcgccgcgctcgccctccacctcggcgaactcctcgccccgcagctcgtccggcccgtccggggccgtccccgtaccgccgtgcggagctgggcggtgtacgcctcgctcgccggggctaccgccgcggccgggcagatcgtccggctggccgcggtcagcgatctcgggatcaccgagacctacggcacccgtgagggcggtctcctccttctcatcgccaacggcctggtcctcgccgccttctgcgccgcgagcaggcgcccggccctcgcgctcgctccgctcgccctcgtcatcggcgcggaggccctgcgtgcgcatccggaggcgtacagcccggagttcggcgccgccctcaccgtcgtccatctgaccgccgcgtcgctgtggaccggcggtctgctgtacgtcctgcgcaccatgtggctctggcgcgactcacccgtcgcggcccgcgcactgctcggccggtacgcgcgcctggcgatctggctgtacgtcgccctcgccgccaccggcaccgcctcgaccctgcgcaggctgccgctggacgtggtgttcacctccgcctacgggcgcaccctgctggtcaagctggcgctcatggccgtggtcagcgtgctggcggtggcggcccggcggcggatgctccgggacgccgacccgtcggccgcccacgggctggcccgccgcgaacaggtcgtgctgggactggtggtggtggtctcggcgatcctcaccgtggtccccgacccgcactggatctccctacggccttagggtctcccgtgtggaaaggccctggttccggtacggcttccagccgcgcaactcgtcgtcgcgcggggccaggaccagttccggagcgcccggtccgaagaccgtcacggggcgccgcgcgtcccaggacggccaccccgggtccccgcccttcgcgaagtccacccacgcccggtgcatcgcgtccgccagctcctgcggggcgtccgggccggtcagggccatcgtgtcggggtgggcgagcgtgtcgaagacgaagcccagctccagcgcgtggcaggcgccgagccgctgtacgggggtgggccagccgaactcgtacacgtacgtggcacccggcgcgtgcgtccgggcgtcggccagccggttgagcgggacccgcagcagcaggtccgtcgcgagcgcgccgaggatctcaccgggggtggcgtccggacggttggcgcggtaggcgcgggcggtggcgttcggcaccctgaacttcagcagggcgagacggagccgcagctcgctgatcttctcggtgaggccgccgggcacgaaccagagccggtactcctcggtgttcgcccccagcagcaggtcgatcccggcggacgcgccggcgtgcagcgcctccaccgggtcgtggggcagcagttcgccgtccacgaccagctggaaggagttgcggccggtcagcgggttcccgccgctggtcaccgcggtctgcgcggtcagcagcgcctccggggccaccgcggccagcgcggcggccgtcgcggg

SEQ ID NO: 3099 - DNA, 2027 bp, Unknown
  Kingdom: Bacteria, Phylum: Actinobacteria, Class: Actinobacteria, Order: Streptomycetales, Family: Streptomycetaceae, Genus: Streptomyces
  misc_feature (531)..(532): n is a, c, g, or t
ggccagcgccccgtagtacgtctgcccgaactcgcccggccgcttgatgtgcggagccgtgcgcacgtacggcaccgacatcaggctccgcgccccggccggcatgacggcgggctcccggaccgtcaccatcagggtcgtgcgcgtcgcgccgggcggcagataggcgtacacccgcaccgaggcgtcccggagtcccgcgccgtccagggcgtgccggatcagctcccgcacccggtcaccgtccaccggcaggtcgaacagctcccggttcgcggcgtccagccgggcgagatgcaggccgaggccccgcaccctgccgtcccgcacctgcatggcggtgaagtggccgtagccgtacagcgcggggatccgcagatcctcctcggtggccgggtggccgtcgaactcgatgtgcgggaggggcgtgttcggccggtgcgtcgtcatgcggccaccgtaagcgggccgtacagacccggatcgggcaggttccggacaggtgcgcttgacctcaaccatggttgaggnngtgcccgtcaccgagcccacacccctcaaggtggccctcattctcggcagtaaccgcgacggccgcttcggccccgtcgtcgccgactggttcctggcccgcgcggcgagccaccccggcgtcgagaccgacctggtcgacgtcgccgaggccggcctccccaccgcgatcaccttcagccccgggcccgaggaggcggcacggctcgacgcggtctccgcccgcctcgcggcggccgacgccttcgtcgtcctcacgcccgagtacaaccactcgttccccgcaccgctgaaaacgctcatcgactggcacagcgcggaatggcaggccaagcccatcgccttcgtcagttacggcggcgtctccggcgggctgcgggccgtcgagcagctccggcaggtcttcgccgaactgcacaccgtcaccgtccgcgacaccgtgtccttccacaacgccggtgccctcttcgacgacgagggacgccatctggacccggaacccgccgacgcggcggccaagacgctgctggaccagctggtgtggtggggtaccaccctgcgcgacgcccggaatctccgtccgtacggcgcctgacccgccgtgggccgacaatcgcatcgaaggcccacgggcaaggagcccgccgtactccgaggagaccgacgatgacagcgccgccggcatggctgaccgtactgaccacgaccgacagcgaggacaaggccggcgccctggcccggtcggcggtggaggccaggctggcggcctgcgcgcagatctccgcccccgtcacctccgtctaccggtggcaggacgccatcgagacggccgaggagtggcaggtgctcttcaagacgacggcggaacgctacgacgaactggaagaacaccttcagcgggagcacgattacgagacgccggagatcatcgccctgccggtggtccggggcagtgcccgctacctcggctgggtgacggcggagacggcgcccccggcagccctgtgacggcggccgtgaccacgaccgaccccggcggccacgtcgccgccgagctgcccttcttcgtgtacgggacgctgctgccgggcgaacccaaccacgacctgttcctccggggccgcacggcggaggagcggccggccgtgctgccccgggccctgctctacgacggccccggctacccgtacgcgatcgagggccacggccgcgtccacggcacgctgctcgtcgcggcgcccggggtctacggggaactgctcggactgctggaccacctggaggagttcctcggccccggccacccgcgcaacctgtacgagcgcgtcgtccgcgaggtcgagctgccggcgcggggggtgccggacgccggggagtccgtgcgggcctgggtctacctcgccgcggccgccgtcacccgctcgctgcggaccggcggcgttctcatccccgagggccggtggaccaccgggcgtgcgccgggcggctcctaggag

SEQ ID NO: 3100 - DNA, 1603 bp, Unknown
  Kingdom: Bacteria, Phylum: Actinobacteria, Class: Actinobacteria, Order: Streptomycetales, Family: Streptomycetaceae, Genus: Streptomyces
gcccgccggcgggcccgaccgggggaccgctctggacctgcggctcgcgggccgcccggccgaggtggtcgtgcgggtggacaccgcgtggagcggcggcgcacacgacgcggactccgggaacgacgtgcacacggtgctggcaccctcgaccggggacgcgtacgccttctgagccgtacgcgtcaggggtcgccattccccggaccggaaggccttgaggacccgagggccaggatccgaaagcctcaagagccgaaagcctcaggagccgcgcgccttcgagtagcggtgccctgaaggcgggacagcccttaggccgacgcgcccccgaattcggccactgcctcggacacgatcgtttccaggtggccgtgatgggcgccgcgccagtacacccgggagcactccgtgcactgggcgaacacgtcgtacgcctgctgggtgccgtgttcgagcagtccgctcacggagtccttcgcggccccggccagcgtgccgttgcacgcggtgcagcgggtccacggggccagggccggagcgaagcggccgaggacgtcgcggagctgttccttggggcggtcgctgtagacgtacgcccccgcccagatctcgcggcggcgcagcagcccgcggtcccgggagagcaggacgcgccgctcccgtgccgagagggtggccagggcggggtcgccgatgtcctcgctctcgtacgccgcgtcgacgcccaggagccgcaaccgacgggccagtgtgccgagatggacgtcgaggaggaaccgcaggggcgcgccggggacccgctgggggcgttccacggcgcgtacgtcgacgtgttcgccgggaccgggcacatgcgagcgggccaccggcccgccgttcaccagcagcgttccggcctcggtgagcgggacgccgagggactcgatgacatggccgagggtcgaggagccgtccgtgacgagggacgtgggcccgccgcggcggtggtgcgggacgaagagccgcagctcaggggctacttcgagggtgatctcgggtccgttcacccggtcaggatgccaccggggcgggagagactgccagggatgtggcggggcgcgcgggggtgcgcccggtcgccgtcaacgcggggcgaacgccgtcgggggcacgcccaccgtcgcggtgaagtcccgcaccagatgagcctggtcgctgtagcccaggtccgccgcgagccgcgaccagtcgacggccgggtcggatccggcatgttccagcgcctcgtggatgcggtagcggaggatgacccacttggggccgacgccgacgtacgcggagaagagccgttgcagggagcgggcggagagcccggcgtcccgggcgagccggtcgacccggagcaccgtgcggtccgtgcgcacccggtcgacgacggtcatcgccagcgtcgcctgcggatcgggccggggctccagggccagcaggaaggcgtccagcgccgcgacccgcgcgtcctcgtcgaccgggtccaggacggcttggacgggcggcggcagccgcagcgtcccggcggcgtcggaacgcagtccggtccgcgcggacaccggacgcccgggtg

SEQ ID NO: 3101 - DNA, 9341 bp, Unknown
  Kingdom: Bacteria, Phylum: Actinobacteria, Class: Actinobacteria, Order: Streptomycetales, Family: Streptomycetaceae, Genus: Streptomyces
gcggtggcgagcgtcgacccggacgcgtcggccgcggggatcgaggtgctgcgcaagggcggcaacgcggtggacgcggccgtggccacggccgccgcgctcggcgtgaccgagccgtactcggcgggcatcggcggcggtggctacttcgtccactacgacgcgaagaagcgcaccgtgcggacgatcgacggccgcgagaccgcaccgcgcaccgcggacgcctccctcttcctggagaacggcaagccgatccccttcgaggagggggtgaccagcggcctcggcgtcggcacacccggcaccccggccacctgggagcgggccctggacgcgtggggcagcaagtccctgcgtacgctgctgaaaccggccgaacgcctggcccgggacggcttcgtcgtggacggcaccttccgctcgcagacggcctcgaaccaagcccggttcgccgacttcccggcctccgccgagctgttcctgccgggcggtgaactccccgccgtcggctccgtgttcaagaaccccgacctggcccgtacgtacgagaagctcggccgcaagggcgtcggggagctgtaccggggggagttggccgacgacatcgtccgtacggtgcgcaatccgcccgtggacccggacgccacccgggtggtgcggcccggcgatctgacccgcgaggacctcgccgcctaccggaccctgcgcaaggatccgacgaaggtgaactaccggggcctggacgtctacggcatggccccctcctcgtccggcggcaccagcgtcggcgaggccctcaacatcctggagtccaccgacctttcgcgcgccgaccggacgcggtatctgcaccgcctgatcgaggcgagccggatcgcgttcgccgaccggggacgctgggtcggcgaccccgcgttcgaggacgtccccacgcgggaactgctgagccagcggttcgccgacgcgcgggagtgcctgatccgggacgacaaggcgctgaccagtccgctggcgccgggcgacccccgcgaccccgagcggtgcggcggtggcggcacggccgcgcccaccacgttcgagggcgagaacaccacgcacctgacgacggccgaccagtggggcaacgtcgtcgcctacaccctgaccatcgagtccaccggcggcagcgccatcaccgtgccgggtcgtggcttcctgctcaacaacgaactgaccgacttctccttcgcgcccgccaatccggcggtgcacgacccgaacctcccggggcccggcaagcggccgcgctcgtcgatctccccgaccatcgtgctgaagcacggcaagccggtgctcgccctcggttcgccgggcggggccacgatcatcacgaccgtgctccagtcgctcaccggacacctggaccggggactcccgctggtcgacgcgatcgccgcgccgcgcgccagccagcgcaacgcgccgacgacggagatcgagccggacctgtggaacagcccggtccgcgcggagctggagaagctgggccacgccttcaggcagaacccggagatcggggccgccaccggggtgcagcggctgcccgacggccgctggctggcggcggcggaaaaggtgcgcaggggcggcggctcggccatggtggtgcatccgggcggcggtcactgagccgcccggacgaagcaggggtccggggccggtatcacgcgagacagcgcgcggtgccggccccgcggccttggcgcgcgcccgcccggcgaagcccggacaggcggggaggggtgcgccgtccaggggacccgtacggggtcccccgtccacgggaagggtccccccgcacgatgcgcacccgcatgctcgccctgacatccgccgcctgcggcgcagccctgctcgctgcggcggcgctgcccgcgtccgccaccgggcccggccaggagccggaaacggccgaagtggaggccgacggaagggacgcgaccggggcgaccgccgccgaactgctgaccgaggtccgcgcctgcacccggatctcgaaaggcgcgtaccgcacggacagcggcagccgcaaggcgacggtgcccgtctgcgacaccacggacgccgtcttctggaaagcggacatggacatcgactgcgacggccgcaggaccagggcctgcaatcggaggaccgatccgtacttcctgccggagaccgcgttccagagctcccgcggcgaacccctggactcggccgtgctcccccatgtggtcgtaccgggcccgggcaaggtgtgggactaccggaagtcgggattgaccggcggcagcgtcgtggcggtcgtgtaccgggaccgggtgcggtacggagtggtcggcgacaccggccccacgggcatcatcggggaggcgtcgtacgccatggcgaaggccctgggcatcgatcccgacccgtcgaccggaggagccgagtccggcgtcacctacatcgccttcaagaactcccgtatctccccgatcgagagccgcgagcgggcgcggagccggggagcggaactggcccgggagttcgtcgggcgctgattccgccgggccggatcctccgcggagcgtggcccggcacaatgacggcatgatcggcatgcgcaccacccaccgcacggcggacggcgtccgcataccaggcacttggcgtcacgccttcatcaacaacggggggacgtactacctcaccgacctgttcatctacgcggacgggctcatcgactgctggggcctggccaccgtcgaggagttcgagcggaaactccgctccggctgggtggccaccagcttccaggaaggagccgaggcgtccgcgcacggcctggcgtcgtggaagttcggtgagacatggacttggctcacccccgagctgctgctcgccgagatccgggacaccctcgacgagctgaacggccgtcccgactccatcggccgatgcctggccgccgtcgacgcgttcctggccgaccggtccgaggcgaaccgggccgtcgtccgcgccgcctacctcgccatcccggagacccgccgccactacgcgctgggggacatggaccgcaaggaccagccgctgcgcgcactggtggccgggccgggcggcacgctggaaggcagccccgacggagtcatcacccccaagacccacgaagaggccatcgcctacttcgaggagcgcgcacggctgatcgcggaactgccttcccggagtccctcggacggcccggcgacctcgcacacgcccgcggtccacctgccgcactcctacccgaggcagcgcgccgagagtcccggcaaggtgggactgcgcaacgactatcccgcgcccatcgatgtcgacggcaccgtctacccgtccgtcgcccacgcctactgggccctgtcggtcgccgatcccgccgagcgagccgccgtcgcggcggcggacaccgcctgcgccgcgagcgaatcggccgccgccgccgtacggcgcgacggctgggaactcgcccgcggcgccgtcatgaccgcactcctccgcgccaagttcacccagcacccggacctcgcggagatccttctcgccaccgacgacgccaccctcgtctacgacgacgcgggctcgccgttctggggcgacaacgccggacggggacgcaactgggccgggcggcttctcgaactcgtccgttccgaactgagcgcccggcgcgccgggatcatctgacgggcggctcgctcacagagcggtcaggatgcgcgggccgtcgttcgtgatcgccacggtgtgctcggcgtgcgaggcccggctgccgtccgtcgtccgcagcgtccagccgtcctcgtcgtgccggaactcgtcgccgccaccggcgatcagcatgggctcgatcgccaggaccatgccgtgccgcagcgccatgccgcgccccggccgtccctcgttcggcacggacgggtcctcgtgcatggacctgccgatcccgtggccgccgtagccctccaggatgccgtagcccgccttccggcagaccgtgccgatcgcgtgcgcgatgtcgccgatccggttgccgaccacggccgcgccgatcccggccgccagggcctcgttcgcggtgtcgatgagtcgggtgtcggcggggcgggcctggcccacggtgaagctgatcgccgagtcaccggcccagccgtccaggagggcccccgcgtccacgctgaccaggtccccgtcgcgcagcggctcggccgacgggatgccgtgcacgatcgcgtcgttgaccgagacgcagatgacggccgggaacggggtgggcgcgaagtgcggcttgtagttcaggaacggcgaggaggccccggacctgctcagcacctcgcgtgccgcctcgtccagttggcgtggggtcacgccgaccgccgccgcctcccgcgcgcgggtcaggatctgcgcgacgacccggccggcctcgcgcatcgcttcgatggatgtgtccgtcttgatgtgcaccatgcccattactataccggtcgaagcggtatagtaatgacggtatagaaatggcgttccgtagtaggatgggctcatggtccgcacccctctgacacccgaagaacgcctgcgcggcgaacggctcggcatgctgctccgtgcggcgcgcggagaacgcagcatggccgccgtcgccgcgagcgccggaatctccgcggagaccctccggaagatcgagaccggccgcgcacccactcccgccttcttcacggtggccgccctcgccggtgcgctgggcctctccatggacgagatcctcggccgctgcgcacccgagccggccgccaccccgctgatcgcgtagcgccgttcggacgagccctgcccggcgcgtcccccctcggagcgcgtagggtcgcgccgtgactctccaggacttcgcgcgcagcgagtacgtcagcctgaccacgtaccggaagaacggcacccctgtcgcgacgcccgtctgggccgccgccgagggtgaggtgctgtacgtctggacccgctccgactcgtggaaggtcaagcggctgcgcagcaacggcaaggtcctcgtcaccgtctgcgacgtacgcggcagagtcgccgaaggagccccccgcgcggagggcgacgcgaggcttctcgacgaggacggcacccgcgcggcgcgcaagctgctggcccgcaagtacacctggaagttctggctcgtcgactggcccgcgacggttgcccggctcggcaagcgtccgcacaccggaatcgccatcaccttctgagcccggccgccgtcgccggagcgcgaaggggtgcgcggccgggctcagaacccggccgcgtacgtccagaagtcccgcatcacctgcggtgcggcgggcccggacagctccatctgggtgagcaggacggcgacggcgcccgtggacgggacgacgtgcgccgtggtgccggtgccgccgacccagccgtagcggccgaggacgttccagggggccgcgatctcgatgtccaccgcaccgccgaatccccagccctggccctccgtgaacagcccgctcgcggcgcgctggtccggggtgaggtggtcggtgatcatctggcggaccgactcggcggccagcacccggtgcccgtcgtcgttcaggcccccggcgagcagcatccggccgaaggcggcccagtcgtcgacggtcgagaccaggccgcccgcgccggaagggaaggcgggcgggctgctccactgcccgtccggggcgtccaccagcaccggatcgtcgccgctgtccgccccggcccggtagtagctcgtgaaccggtccagcgcggcgggctccacggcaaagccggtgtccgtcatgccgaggggctcgaacagccgctccgccagatacgcgggcagcggccggtcggcgacccgggcgacgaggacgccgaggatgtcggagcacgtgttgtagagccagccgtcgcccggctggtgcagcaacgggatacgggacagcgcggccatccaggcgtccggcgcgaggacggcctgcggctgcggcgggccctgtttcagctcggcgaacagcggtgcgacggccgggagcgagaagtcggacgggaagccgtatccggcccggaaggtcagcaggtccagcagggtgatcgggcggaccgccgacaccacgtcgtcgaccgggctccgcggggtccgtacgaccagcggcgcggccagctcgggcagccacgccgcgaccgggtcggcgggggcgaccagaccgtcctcgacgagcgtcatggcggccgccgccacgatcggcttggtgatcgaggcgatacggaagatcgagtcccgtcgcatcggcgcggacccggcgaggccggccgtcccggccgacgccacctcggtccgtccgccccgggagaccagggccacggcgcccggcatcgacccctcggcgacgtgggcgtccagcagttcgtgcagaggggtggtggtcatgggtcgtccttcgtccggtaccgcgtgtgctgtcggaggcctgcccccgggaggtgtcccgcagcgtccgaccgcgggtggtgggccggcgcgcggcctcggacaggaggacgcgcgccggccgtaaaaggaagcattcgggccgaaaatggagactcccggaccgtcccggactcatcggtcccgtcccgcactcatcggcccggcaccggactcctcggcccggcacccgtgggtgggattatcgtcccttccctccccgtaccagcaggtccgccaccaccggccggtggtcggaggcgacggtctccggcacccacgccctccgcaccctgatcccggcgcccggcccgtccttcgagaccgccacgaagtcgatccgcttcaccgggtcctgcgccggaaaggtgggcgcacccgggtcggcgtccgccagctcccgccacagcggggccagttcgggggcgtcgggctccgcgttgaagtcgccgagcaggattcgcggtccccggtcctcggccatgatccgccgggtgtcggcgacctgggcgacgcggacggcggggtcggggcggtagtcgaggtgggtcacgtacacgtgtacgggcaggccccgcacccgtacgacgacctcgccgaaccccggggcgggggccgggaccgggtcggggtcctgggtggagaggcgggtgatctcgtggttctcggcgcccacgatccggtgccgcgacaggacggccaccccgtactccgcccgcgggtcgcccggttgggccgggtccaggctgtagatcggcgcgaaggagacgtgcatgcgcagccgccgcgccagctctccggcgagatcccgccacccgctgcggtcaccccagtgccggtcgacctcctgaaggccgatcacatcggcgtcgagcgaacggagttcggcggtctggcggtccaggtcgaagacgccgtccacccccgccccggcgtggatgttgtacgtggcgacccgcagcggcaggtccccgccggaagggggccgggccgtcgtggcggtggcgggcggcgcgacgagggcacccaagagggccgcggcgaacaggatttgagggatacgaaaggtacggcgacgcagcgacatggctctccaaccggccgaaaatcgcgcactttgtcaggtcagcgtcgagaaccgtaccgcccggccgccgcgcgctcccaccggcgcggcgggtccggcggcacataattcgacttgtacgttgtacagggaccgtcttacgctgtaagtcaacgaagccttccacgccgtacagcaccgaatgccgtacggccctccggagcgagctgtcaccgcaccggaccccccggagcccaaggagtccgcatgacggcgcccgccgcacagcgaccagacctcgccccccaggggcatccgcagcgctggctgatcctcggcgtcatctgcctggcccagctcaccgtgctgctcgacaacaccgtcctcaacgtcgcgatcccctccctcaccgcggagctggacgcctccacctccgacgtgcagtggatgatcaacgcctactcactcgtgcaggcgggcctgctgctcaccgcgggcagctccgccgaccgttacgggcgcaagaagatgctgatcgtgggcctcgccctgttcggcgtcggctcgctcgtggccgggctctcccagtcctcgggccagctcatcgcggcccgtgccgggatgggagtcggcggcgcgctgctgctcaccaccacgctcgccgtcgtggtccagatcttcgacgagaccgagcgggtcaaggcgatcggcatctggtcgaccgtcgcctccctcggcttcgcggcgggaccgctgttcggcgggttcgtcctcgaccacttctggtggggcgcgatcttcctgatcaacatcccggtcgccctgatcggcctggtcgccgtcgcccggctcgtgccggagtcgaagaacggccagggggaacgacccgacctgctgggggcgctgctctccacgatcggcatgaccgccgtcgtcttcgcgatcatctccgggcccgagcacggctgggcgtccggccaggtgctgctgacggcgttggccggagtcgcggtactggccggattcgtgctgtgggagctgcgcattccgtacccgatgctcgacatgcacttcttccggaaccagaagttcgtcggcgcggtggcgggggccatcctggtcgccttcgggatgaccggctcgctcttcctgctcacccagcatcttcagttcgtcctcggttacgggccgttggaggcgggtctgcggacggcgccgatggcgctcaccgtggtcgtcctcaatctcagcggcatgggcgcacgtctcgtccggaagctggggacgcccgtggtcatcgccgcggggatgagctgcctggccgccggtctcgccgccatcgcggtgctcggcggcggcggcgggtacggcggaatgctgttcggcctggtcgtcatgggcgtggggatcgccatggcgatgcccgcgatggccaacgccatcatgagcgcgatcccgccggagaaggccggagtgggagcgggggtcaacggcatgctcgcggagttcggcaacgggctgggggtcgcggtgctcggcgccgtgctgaacgcccgcttcgccgccctggtgccggccgccgtcggcgccgcctcgctgcccgcggccctggccgccgccgacggtcccgccggccgggaggagatcaaggaggccttcgcatcgggcctggaggtcagccaactggcgggcgcggtcgcggtgctggcgggcggactgctcgccgcgttcctgctg

SEQ ID NO: 3102 - DNA, 13824 bp, Unknown
  Kingdom: Bacteria, Phylum: Actinobacteria, Class: Actinobacteria, Order: Streptomycetales, Family: Streptomycetaceae, Genus: Streptomyces
ggccccgctgatcgtttcactccacccgcaggaccgctccagcacgccgtacggcacggcgacccgctccccgggggcgccgtgccgcgctcccccctgccctccagcaccaccggagtccccatgctgctcgccgccaccccaccgccggtcgaggcgccaccgcacaccggtggcctgctcctcctgatcgacggcaccgccggtctgctgaccgtcgccgccctcggcatcgccctcctgctcttcctgatcatcaaggtcaggctccagccgttcgtcgccctgctcgcggtctccatagccgtcggcctcggcgccgggctctcggtcaccgaactcttcggcaccgtgcagaagtccgccgccgtctcggtcatcgagtccggcatgggcggcatcctcggccatgtcgcgatcatcatcggcctcggcaccatgctcggcgcgatcctcgaagtgtccggtggggccgaggtgttgagcgcccgcctgctgaacgccttcggcgagaagcgcgccccgctcgcgatgggcatgacgggcctcgtcttcggcatcccggtcttcttcgacgtcggcatcttcgtcctcgcgccgatcgtgtacgccgccgccaaacgctccggcaaatcgatcctgctctacgcgatgccgctgctggcgggcctgtcgatgacccacgcgttcctgccgccgcacccgggaccggtggccgccgccggactcttcaacgtctcgctcggctgggtcatcctgatgggcgtcgtcgtcggcgtcccgtcggtcatcgccgcctgggcgtacgccgcctggatcggcaagcggatcttcgtcgacgtcccgcaggacatggtggaggccgccgaggaggccaaggccgccgtcgccgccgaacagcgcgccgccggggtcaccccgcacgagaagccggtcccgctcggcacggtcctcgcgatcatcggcaccccgctgatcctgatcctcgccgcgacgttctcctccatcgctctggacccctccacgctccgctcggtcgtcgagttcttcggcaacccgttcgtcgccctgacgatcgccctgttcctcgcgtactacctgctgggcatccggcgcggctggtcccgcaagtccctggaatcggtctccacgtcctcgctcaagcccgtcggcaacatcctgctggtggtcggcgcgggcggcatcttcggcgccgtcctcaagggcagcggcatcgcggacgcgctggccgacaccttcaacgacgtcggcctgccggtcatcctgctcgcctggctgatctccgtcgtcctgcgcgtcgcccagggctcggccaccgtcgcgatcgtcacgacggccgggatcgtggtcccgctggtcgagggccaggacctgtcccaggcccacctcgcgctgatcatcatggcgatctcggcgggctcgatcttcgcctcgcacgtgaacgacggcggcttctggatggtgtcgaagtacttcggcatcagcgagcgcgacaccctgaagtcctggacggtcctggagacggtgctctcggtcgcgggattcgtcgtcgcggcactgctcagcctggtcatctagcgaaccggcacacacggggacgttccccgtccccgtgcggaccgtttccgtgcgcaccccttgtgctgtcccgccgattacgcttccttgatcggcatggcggagacaagcgcaaccacagggacaggggagccggcctcccgaccacgtcagtccagctggaagtacatcggccccggcatcgtcgtcgcggcgaccggggtcggggcgggcgacctggtcgcgacgctgatcgcgggcagcaagttcggatacaccctgatgtgggcggcggtgatcggctgcgtcgtcaagatctcgctcgccgaggcggccggccgctggcatctggcgaccggccgcacgctcttcgacggctggcgcagcctgggcccctggaccacggtgtacttcgcggtctacgtcgtgctctggggcttcatctacggggcgacggccatgtcctccagcgccctgccgatcgtggcgctgttccccgacggtcccggtctgaagttctgggcgatcgtcaccgggctgatcgggctggccttcgtctggttcaaccggtacgccgtcttcgagaaggtcatgacggtcctgatcggcatcatgttcgtggtggtcgtgtacgtggccgcccgcgtcgtgccggacgtgggggcctcgttcgccgggctgctgcccgtgcttccggacggctcgctcctctacaccctcggactgatcggcggcgtcggcggcacgatcaccatggccgcgtacgggtactgggtcaacgccaagggctggagcaactcctcctggatgaaggtgatgcggctcgacaaccgggtcgcctacatcaccaccggggtcttcgtcgtggcgatgctcgtcgtcggcgccgagctgctgcacgcctcccaggtcgccctcaccaccggcgaccggggtctgatcgacctgggcaaggtgctggaggaccgcttcggcgcgggtaccgccaagctcttcctggtgggcttcttcgccacgtcgttctcgtcgctgatcggcgtctggcacggggtcagcctgatgttcgccgacttcgtggagcggttccgggctccggcggcgggagcggcgaagaccgaggagcacgaggggccggacgccgccgagcgccggcagcggtcgctgccgttccgcgcgtacctcctgtggctgaccttcccgcccatgaccctgctctggctggaccagcccttcggcctggtcatcgcctacggggtgctcggcgcgttcttcatgccgttcctcgccctgaccctgctctggctgctcaactcctcccgtacacccggggagtggcgcaacggatggctcagcaacgggatgctctccctggccgggctgctgttcgtcgtgctgtgcgtccagcaggtgcgcgaactgccctggtgaaccggtcgtcgtcggcgtaacgccgcagcgccgccgggggagcggcggcgctgcgggttccgggttgtgcggtgtcgttacggcaggctgcggacgtgcgggccgaccgccttcgaccaggcgaacccggccgtcgcgtcccagttcgtcgaccaggtcatcgcgccgcgcagcgacggataggtcctggacggcttgaacgagccgcagttggtgcccttggcgaggcagtccagcgccgcgttcacgatggacggggagacgtagccgctgcccgcgccgcgggtggaggccgggacgccgatgccgacctgggacgggtcgaggccgccctccagctggatgcaggcgagcgcggtgaggaagtccaccgagccctgcgagtagaccttgccgtcgcagccgagcatcgaaccgctgttgtagtactgcatgttgacgacggtcaggatgtccttgacgttgagcgccgtcttgaagtactcgcccgacgtcgactgcatgtcgatggtctgcggggccatcgtgatgaccagtccgctgcccgccttcgccgacagctggcgcagcgccttcgtcatgtaggtggagttgaggccgttctccaggtcgatgtcgaccccgttgaagccgtagtcccgcatcagcgcgtacaccgagtcggcgaacgcggtggcggaggcgtcgctgtcgacgcggaccgtgcccagctcgccgccgatcgagatgatgacgttcttgccggccgcctgcttggccttgatgtccgagcggaactgggcgtcggtgtagccgttcagcccggcggtgtccaggttgaaggtgaccgcgccctgggtcgccgtggcgtccgcgaaggagaccgcgatgatgtcgtagtcggccgggacgtcgctgagcttctggacggccgcgccgttgttgaagttctgccagtagccggtcaccgcgtgcttgggcacggtggtcaccgggccggtgccgttcttggccgtacgggcgctgacggcggccgacttgaccgactcgccggccgcgttggtggcgctcaccgagaactggtaggcggtgtccgcggtgaggcccgtgacggtcgccgaggttccggtggaggtggtggccttcgtgccgtcccggtacacggtgtatccggtggcgccggagaccgcgttccaggagagggagacggaggacgtggtggtggcgcccgccgcgagacctccgggagccgccgggacgaccgggcctggctcctcgccgccaccgccgtcgggaccggtcacctcgaagtcgtcggcgaggtaggcggcctgcccgtaccagccgtgggtgtagacggtcaccgaggtggtgttcgcgccggtcttgaagctggtggagagcttggtccaggtggcggagcccggcgtccaggtggacacgtcggtggttccggtgccgctcacgccgaggtaggcgtagccgccctgcacccaggagctgagcgcgtacgtcgagttgggcttcaccttgacggcctgcgaacacttggcgttgtcctggccggccggggtggccttcagcgcggacgtgccgccgtgcacgggggaggagacgatggcgccgctgttcccggagcaggtccagttggcgaggcccgactcgaagcccgcgttcctggcgttgttgacgtcggcggcctgcgcggtgctgacgagtcccgtgacggtcagggccgcggccgcgacgacggccatggtgccgccgagcacgggacgggtgcgacgccttctgcgactgctgcctgcggagcgttccactggttcctccgtgggggagttggtggtcctggcgggggtcgtgcaggagggccggacggacgacggaccggggctgcacgggtgggccgggaggagcggggatccgtgacgatgaatcacggtgaagcacgatgaatcggggtcggccgggggtgtcgtacggcggtggtgcagggggtgctggaccggggacatggaacacggggtgtcccgccgggagcggtggccaccgcttggcgcataaaactggtccagaccaatcaagttgtcaagacctctggcagtgaaaagccttccgcggaggtgggcgcgaggtcgcgccgagggtctggccgcggggtgtccgaggggccgcggagggtgccggaccggggttttttttccgccgggagcggctccgcgaccgcacatcgcaccccgcacgggtgatcttgtgggagatcttcggacggtcacggaaacgcccttacgaaaaggagggcggcaccctggaatccagtctgacgtgcgcgaatggatacctgatcgaaagccggacgccggcttcggtaacgctccgcagtgagagccgagttgggcggaatcgatttcgtcccgtttagcacccgggccccgtaggaacggtgttcgcatgatgccgtactggtctccgataactgttctctgcctggtgagacgtggctaaagtgctgggtcaggagcacggagcaggagcgtttgcggccgacgtccccacgtcgaccggagccgaaacggggaagagcgtgccgaccgcaatagcagtgacgagcgcagacctggtgctgccgcccaccgaccagcagacaccgaccgccgctctgctccaggcccccgaggcccaggtgctggagctggcgatcggcgacatgcacctgctgctggaacagcacgggtatgtgatcgccctctatccctcgggcatccgtcccgagcacgagcgtcgcctccactccatccgctcggtgctggagagcgaccggatcgccctggtcaaggtggacctccctcccctcggcctcgccgtactggtgcgccagctccggcagttgtccgtctgcgacttcagtcccggggtggtcgcctccgccgcccggctgctctcgcactacatctacgcgggcgccctcctcaactccgtcgcccgcctcgaccgggtcccggtcagcctcaagagccacgccaagtcctgggtccccggatcccagttcgcggtgctcgccggacccgagtcgcagctggtgaaggtgggcccgaccgtcgaaccgccgacgggaccggatttcggtacgcatcttctggtcgcgaaagggaatctgcagtcggactgggtacaggagaccctcgcgcccgcctggaaggtccaggccattcacgacgccacggtcccgtccgactcaccgcgctggtggggaacgggaaagctggtggagttcgccgcgcatctcccggacctctccgtgctctaccagctggtctcttccgtgcgtcgggagaagtgccactggtgcgccatggaactcatcggtgaccgctgcgcattctgttccgctcctctcgcggtttcggagaaccgcatgctccccacaggtgtccttcaccacggggccggcgaatcgccgggcccctagcgagaccgctcctccccgcagggcccgctcctcccggtccctgcgtgtcccccgtactccccgaactccccgcactcccgtacgagaccttccccggtccggccggccccgcagcagcgcgccgccgcagatgtaagcgcgtaaccgcaccgcacagatgtaagcgcgtaaccgcaccaccgcaccgctctctctgtccgcagtccgtcccacgcatccgattcgaacgaggttgtccggaccatgaactcccgccagcgccgcggcgtgatactcctgctcctgtcggtcctgtgtgccttcgcggccttcgccggcgtgctctcggtgatcagcgacgtcaactcgaaggtcggacccgaggtgacggcgtaccagctgaagaccaacgtggctccgtacacagcactgaacagcggccagttcgagaagatcaagatgcccaaacgctggctctcggagaacgccgtgaccgacctgcaggaggtcgagtcgaagatcgcggtcaccgagctccgcgaaggctcgctgctccagtcggacatgatggtccgcaagcccgaactccgcgccggtgagcaggagatcgccatcatgatcgacgcctccaccggcgtcgccggcaagatcacaccgggcgccacggtcaacatctacgccacgttcgccggtgagcagcagggtgccgctgcccagtccaaggtcatcgtctccaacgccaaggtgctggacgtcggcgagctgaccgcgctggaccccagcgcggacgaccggggcacccgggcgaccgaggccgtaccgatcaccttcgccctgaacacgctggacacccagcgtgtcgcctatgccgagtccttcgcggagcacgtgcgtctcgcgctcgtcgccccgggcagcgacggcaccatccgcccgggggaccgcacctacacgctcgaaaaggacaagtgaggatgggatgaccaccagaatcctccccgccgtcggtgacctcgacgcggcccgctccgtcaccaccctgctcagccagctgcccgacgccgaacccgccaccccggtcggcgactccacccagctcatcgacaccctggcccgcctcgcgggtgaggcgctcgacgagctgcccgaggtggtgctggtccacgaacggatcggcccggtgccggccctggagctgatccgggaggtgtcgatgaggttcccgtccgtcggtgtcgtcatgatcaccgcggacgccagcccgaacctcttcgccgacgcgatggactccggcgcacgcggcctggtcaccctgccgctgagctacgaggaactggccaaccgcgtccaggcggccgcccagtggtccgccggcgtacgccgtcacctcacctccgggaacgaggtcttcaccggccccggcggcacggtggtcacggtcaccggcgccaagggcggcgtcggcgcgaccgtcaccgccatccagctcgccctggccgcgcaggcgtccggcaacacggtggcgctggtggacatggatctccagaccggggacatcgcctcgttcctcgacgtccagttccgccgctccctggtcgacctcgccctgatcaccgacatctcaccccgggtgctgtcggacgcggtgttctcccactccaccggcctcgccctgctcctcgcccccggggagggggaacgcggcgaggaggtcagcgaccgctcggcccgccagatcgtcagcgcactgcgcacccgctacgagatcgtcgtcatcgactgcggcggccagatgaacggggccaacgcggcggccatcgagatggcggacgtggccctgctggtcacgaccccggacgtggtcgcggtgcgcggcgcgaaacgcatcgtacggatgtgggaacggctccagatccgcaaggccgaggagacggtcaccctcgtcaaccgcttcacccgcaataccgagatccagccgccgttgatccagaagatcaccggcacccgggtcgcctcggcggcgatccccgcgaacttcaaggagctccaggcgtccgtcgactccggacgtctgcacgagctggacgccaagagcacggtcaagcaggcgctctggggcctggccggagagctgggcatcgtcaaggagagcgcgacggcgaagaagagcggcagcgccctggtcaagaagaacagcggcgccttcaagaacgaccggggctcgatcggacgcccgcgccgccggcgcgacggctccggccgcgggtccggagactccgaggggacacgttgagcgatgaccaccacaaggacggcacgaagcggcatacgggggcggatcaccgccctacgtgaccgccgggaccgggaccgcggacagaccgcggtcgagttcctgggtatgacccccttcatcatcctgatcatgctcgtgctctgggagtgcgccctgatcggttacaccttcagcctcgcggggaacgccgcggacgtgggcgcgcgcaagggcagcggagcggagtacggggcgggcgcggcctgccgggcgggcgcggtgaaggacctccccgacgcctggcaggacggagcccgggtccgctgcaacggcggcagccgcctgtacgaggcgacggtgaagctgaaggttccggtgctggtgccgggcctgttcgacctcgacaccgagatcaccggccgagcgggatcgccgagggaggaccagtgatgacgacgcatccgtacctggacggactccgggacctcgaccagcgccacgaccggagccaggaccagcgccaggtgaaggcaccggacggggaccggggtcaggtcgccatggagtacctcggcttcctccccctgctgctcctcgtcgcgatggcggccatccagctcggcctggccgcgtacgccgccagccaggcgggcaccgcgtcccgcgccggagcccgtacggcagccagcctggacgcccggggcagcggtcagaccaacgcccgagacgccgtgagcgactgggtggaggagggcgggttccgctaccgccagcgcggcgggcaggacatcacggtcacggtccgggtcaaggtgccctccgtcgtgccgggactggacgactggtgggccgagcggagcacgaccatgcccaacgagaagtcccggatcggtttctgaccggtttctgacccccacccccaccctccggccccggtcctgacccgggccggaccggacctgccggaccagcaccgtccgcgaacaccgaggagagctacgccgatgagcctgcgggcacgcatgaccgctcctgaggaacagggcgggggacgggaggacggccacatggtggccacctaccgggccaagctgctggaggagatcgacctcgcggagatgtcctcgctggccgccgccgaccgccgggcccggctggagcgcgtcctcggccacatcatcagccgcgagggcccggtcctctccaccgtggaacgctcgcagctgatccgccgcgtcgtcgacgaggcgctcggactcggcatcctggaaccgctcctggaggacgcctccatcaccgagatcatggtcaacgggcccgaccagatcttcgtcgagcgcaacggcagggtcgaacagctcccgatgcgcttcggctcccacgaacagctgatgcagaccatcgagcggatcgtgtcgaccgtcaaccgccgcgtcgacgagtccaacccgatggtcgacgcccgcctgcccagcggtgaacgtgtcaacgtgatcatcccgccgctctcgctgaccggcgcgacgctcaccatccggcggttcccgcgctccttcacgctccaggagatgatcggcttcggttcgctggacgaacagatgctggtcctgctcgccggactggtgcaggccaagctcaacatcatcgtctcgggggccacgggcaccggcaagacgaccctcctcaacgcgctgtccggactgatcccgaacaccgagcgcatcgtcaccatcgaggactccgccgaactccagctccagcagagccacgtgatccggctggagacccgtccggcgaacgtcgagggcaagggccagatcaccatccgcgacctggtccgcaactcgctgcgtatgcgccccgaccgcatcgtcgtcggtgaggtccgaggcggcgagtccctcgacatgctccaggcgatgtccaccggtcacgacggttcgctggccaccgtccacgccaacagcgccgaggacgcgctgatgcgtctgcagaccctcgcctcgatgtcggaggtcgagatccccttcgaggcgctgcacgaccagatcaacagcgccgtcgacgtgatcgtccagctcacccggcacgccgacggcaccaggaagatcaccgagatcgccgtcctggactcgcacggccgcgacccgtaccgcatcgtcacggtcgcgcggttcaacgcacagccgatggcccccgacggccgcatctacggcgacttccagtacctcccgctgccccggaagctcgccgagcgcctctacctggccagtcagcccatcccgcaggcgttcggcgtcgcccagtccgccgaacagctcgccacccgagaggccaactaggtaccgagccatggacaacgtcaacctccccctggtcaccgtcggcgtcacgctgctgtgctgcgtgctcggcgtgatgggcctgtacgcctactccggcggcaaggccgaccgcgacgccctggtcgaccggctctcccacgtcgggcagatccccgagacgggccgccgccggcgcttcaaggtcctcgaccgcaggctgcgcgccaccgcgctcggccggaagctggaactgaagctcgcggcgaccggcatggacctcacgccgggcgagttcctcgtctacgcgctcgtcgcgatggcggggctctggatgatcgcctcctccctgctcgccgccttcttcggtccggtcgccgccctgatcggcctctggggtaccaacgccttcctcaactggcagcgggtcaagcgcaccgagcgcttcatcaaccagctccccgagctctcccggatcctcgccaacgccacccaggcgggtctggccctgcgcacctcgctgtcgatggccgccgaggaactggaggacccggccggcgaggagctggcccgggtcgccaggcggctggccgtcggcgagcccctggaggacgcgctcagcgagctgaccgaccggctgccctcgcgcgaactcgtcgtcctcgtcaccacgctggtcctctccaaccgggccggcggtacggtcgtcagctcgctgcgcaacctcaccgagaccctggaggagcgcaaggagacccgccgcgaggtcaagacccagctctcccaggtcaccgtgaccgcctacgcggtacccctcttcggcatcggcgcgatgctgctgatgaacgcggtcatgcccggcgcgctggaccggatgacgggggcgttccccggccaggtggcggtggtcgtctccatcgtcctctacgccatcggcttcgtcgtcatccgccgcttctcccgtatcgacgtctgagaccaggaaccaggaaggaacgggacggacatggacctgctgctagccctggtcgtcggcctcgccgtctacggggccatccacggcatccggatgtaccgggccgacgccaaactccccggggacctggccgtggccctggagtccggggcctcccgcaccagcgcggtcggctccggcatcgaccgcctcggcatccgctgggcacccgcggtgctgcggatgatgggccccaaggccgtcaacaagaagcgccgccagatcgacctggcgggcaaccccggcggcctcaccctcgaccgttacgcggcccgccgtgcggtctacggcgcgctgggcgtcctcggcgccttctcgatgctcctgcgcggccagctgttcctggccctggtgatggtcgccttcggcctgttctgggtggaggccgggatctggtcggcgatccgggtgcgccgcgagcacatcgagcggaccctgccggacttcctcgacgtcctggccgtcgtcgtctcggccggactcggcttccggcaggcgctggaccgggtggcggagaagtacgagggtccctggtccgacgaactgcgcatcaccctgcggcagatggacatgggcgtcagccgccgccaggccttcgaggagctgcgcagacgcaacgactccgaacaggtcgccatgttcgtcaccacgctccagcagggcgaggagctgggtgcgccgatcgtcgagacgctcatccagatcgccaacgacatgcgccgcaccgacgcccagaacgcccgccgcaaggcggccagggcggtcccgaaggccacgttcgcggtgaccacgttcctcctcccgggcacgctcgtcctcctcaccgtcggtttcgtgtacggagccgacgtcgacctctcgtccatcacgggcggatgacatgaacgacagtcgggacgacatgaacgacgggccggatggggacggaactcctccgttccggaacgcctgctgaagcggttgcccgaaggagcggccgcggggagcaccagccgtagggagcacagccgtacggagcggcagccccagggaacacgagcgttacggggaaggagacggaggtgacaggctcatggcattccagctcagtggcgcccagccaggactgaccgcggaactgacccgcgcccacaccggcaccccggcccgcccggccttcgccatccaggtcaacgccctccaggcgatgtgccgccaggtcttcggcttccgcctggcgatgatcgcgatagcgaccccgtacgccatcagccacaccgcccccggcctgcccacctggttcatcggctcggcgatcctggtcaccttcatgggctcgtacctgctgttccgcgactgggagcgcttcggcccggtgctcctgcggcacccctggctcctgggcgtcgacgtgttcttcggcgcgctgctgctgatcacggcgacccccgagtcgaccctcgcgtacgtcaccgtctgcaccccgatgctggcgggcctgatccagggctggcgcggcgcggcgatcttcgccgcgctccaggtggtcatcgtcttcggcgtgtacgcgagcgtcccgaagctggagccgggcggtgcgccggccctgctcctgcccggcttctgcgtgatcgccggggcggtcggggtcaccctgcgcaatctcctcctgcgcttcgggacggccacccaggcgctcaccgagacccgggcgcggctggcggtgaacgaggcggtggagggcgagcgcacccgcctggcccgggagatgcacgactcggtcgccaagacgctgcacggt

SEQ ID NO: 3103 - DNA, 4312 bp, Unknown
  Kingdom: Bacteria, Phylum: Actinobacteria, Class: Actinobacteria, Order: Streptomycetales, Family: Streptomycetaceae, Genus: Streptomyces
ttttttttttcaagcagaagacggcatacgagatctagtacggtctcgtgggctcggggacctccagctcgggcggcgcgggggcctcggcgaccggggcctcctccacgggcgcggtggcgtccgggaggccgacttcgtcgatggtgcgccgcgcttcgtcgcgcggcgtctcggcctcctcgccgacctgcggttcggcgggaggagtgatggtcggcgcgctcggcggcgggggaggcagcttcttcttgcggctgccgaccacgagcccgccgaccaggccgacagcgaccagggcgatgactacagcgaggatgacgatttcgacgagttccataacccgtccagtatcggccacggtcgtgccgcgggcgcggccccggctgacccccggcgatccatcgaggccatttgcaccttttggcggtaattcgaccgccgacccctacacttctgacgccacgtcagctacggtgccgccgcccgcctgatgtccgcctgcctctctgcccgcccgcacgcacgcctgcctgtctgcctgtctgtctgtctgccgcctgtctgccgcctcggcgaagggacgcctccgatggccttcacagtggtccggttcaatctcgtcgatcccgaagccgaccccgtatcgctctcggcccgctaccgcgccgccctggagatggcggcgtacgcggacgagcacggcgtcgacacggtgcagaccgaggagcaccacggggtggcgaactcctggctgccctccccgttcaccttcgccggggcggtcttcggcgccacccgccggatcgcggtgaccgtctcggcgatcatcgggccgctgcacgacccgctgcgtctcgcggaggacatcgcggtgctggacctgctgagcgccggccggctggtgacggtcgcggggatcggctaccgccccgaggagtacgagcgggccggggtcgagtggagccggcgcggcaggctccaggacgagctgctggagacgctgctggcggcgtggaccggggagccgttcccgtaccggggccgtacggtacgcgtcaccccacgcccgtacacgcgcccgcacccgatgctgctggtcggcgggagttcgcgggcggcggcgcggcgggcggcccggctggggctgccgctgttccccagcgcgtatctgccggagctcgaggcgtactaccacgagcggcgcgcggagcacgggacggagggtttctgcatgatgcccgcggagcgcacaccgctgctgcatgtctccgaggacccggagcggacgtgggcgctgtacggcgagcacctgctgcacgaggcgcgcacgtacgcctcctggcagtccgaggacatccgctccgcggtgcgctcggcggcgacgacggttacggaactgcgcgaggagggggtgtaccggatcgtcacgccggacgagctgaaggccctggaggcggagagcctggtgctgcacccgctgtgcggggggatgccgatggaggaagggtggcgcagcctgcggctgttctgcgaagcgactgcctgacaccacctcgccccgctcaccgggccggagcgctggaaaggccgacggtcccggctcggtgagccgggaccgcgcggttcgaagagaggggcagcgggggatttagcccatctcttccaacgccttgcccttggtctccttcacgaatttcagcacgaaggggatcgagagcacggcgaagcaggcgtagatgatgtacgtccccgagaggttccagtccgagaggctcgggaagctggcggtgatcgcccagttggccatccactgcgcgaacacggcgacgccgagggccgccgcgcgcaggcggttcgggaacatctcacccaggaagacccagacgacgacaccccacgacagggcgaagaacagcacgaagacgtgggcggcgatcagggcgaccgtgccctgggtggtcggcagcttgccgtcgaccaggtccgcggagaacgcccaggcctcgacggcgagagcgacggccatgccgaccgagccgacgagggcgagcggcctgcggcccacccggtccaccagcaccatcgcgatcaccgtgccgatgatgttgatgatcgaggtggtgaacgagtagaagaacgagtcggtcgggtcgatgccgacggactgccacagcgtcgccgagtagtagaacgccacgttgatgccgacgagctgctggaacatcgacaggccgatgccgacccagacgatgggcaggaagaagaagcggttgccgagcagatccttgaaggaggacttgtgctcgcggtgcatagcggtctcgatctcggccacgcgggcgtcgaggtcgacgttcttgccctcgacctcttccaggatcttgcgggcttcgaccttcttgccgaccgagatgaggaagcgcggggactcggggatggcgaaggagagcagtccgtacaggatggccgggacgaccatcacgccgagcatccactgccaggcctccaggcccaggatctcgccgcgctggtcgccgtcggcgatctggaggacggcgtagttcaccagctgggagatggcgatgccgatgacgatcgcggcctgctggaaggagccgagccggccgcgataggcgggcggggagacctcggcgatgtaggccggaccgatcacggaggccatgccgatggcgaagcctccgatgatgcgccacatcgccaggtcccagagtgcgaacggcagcgcggagccgatcgcgctggcggtgaagagcaccgaggcgatctgcatgcagcggatgcggccgatccggtccgcgatccggccggcggtagcggcgccgatcgcacagccgatcagcgcgatggcgatgacctgggcgagcgtgccggatccgatgtcgtaccggtcgcggatcgcctcgacggccccgttgatgacggagctgtcgtagccgaagaggaagccgcccatcgccgcggccgcggtgatgaagatgacatggccgaggtggtccggatgggccgctcgggccccggactcgggtccgttcgctgtgctggtcacgtgaactcctgatgcctggccgcaagtcagacgtggggggtgagccttcccagtggggcacaacatccggcccgccaccacttgaaggcgaaatcaactttgcagaggttatgcgttcaagaagcgaagtcaaacaacgggtcgaacctcgcgtacccaggagtgcacaaaaggtgcgttgaacttctggtgattcggtaaaaagtcagcgcagtcgctggctgatgaccttcgagaccccgtcgccctgcatggacacgccgtacagcgcgtcggcgacctccatcgtccgcttctggtgggtgatcacgatcagctgggagctctcctggagctcctccatgatccggatcagccgctgcaggttggtgtcgtcgagagcggcctcgacctcgtccatcacatagaacggactgggccgcgccttgaagatcgagaccagcaacgccaccgccgtcagggagcgctcaccgcccgacagcagggagagccgcttcaccttcttgcccggcggacgcgcctcgacgtccaccccggtggcgagcatgttgtccgggtcggtcaggatgagccgcccctcgccgccggggaagagccgcgagaagaccccctcgaactcgcgggcggtgtcccggtaggcctccgtgaagacccgctcgacccgctcgtcgacctccttgatcacctggagcagatcggcccgggtcttcttcaggtcttcaagctgctcggacaggaacttgtgccgttcctccagcgccgagaactcctccagggcgagcggattcaccttcccgagttgctggtacgcccgttcggccgaccgcagccgcttctcctgctcggcccgcagatacgccttcggccggttacggggatgctccgggtcctccggaagttcctcgccctcggcggcgggggacggcggcacgagctggtccggcccgtactcggagaccagccccgcgggctccacgcccagctcctccagggccttggtctccagctgttcgatccgcagccgcttctccgcgcccagcacctctccccggtggaccgagtcggtgagcttgtccagctcgcccttcagcccacggccccggtcacgctcgacggccagctcgcgctcccgctcgcccttcgccgcctcggccgccgtccgctcctggtcggcacgtacgagggacacctcgacgtgcgccaacagctgacgggcccccgatgccaccgccgaggcgacct

SEQ ID NO: 3104 - DNA, 10532 bp, Unknown
  Kingdom: Bacteria, Phylum: Actinobacteria, Class: Actinobacteria, Order: Streptomycetales, Family: Streptomycetaceae, Genus: Streptomyces
cggcgatggcggcgacggcgagagcgccggatccgccgagcgccgcccagaggctgggcgaggcgtcgacggctccggcgcggacggtgaagatgacggccgcggcgccgctgagcacggcggcgacggccgggagcagcgcggtccgcagcagctggggccgtatgcgggcgtcgggggtgggccctgcggcgcgcggcctgctcgtggccgagtgggcgcgcgtgccggggcggccgtgccgcccgccttcacggcggtccggtcgcgcgtcgggtgcgcgaagttgagacatcagcgtcctcggtacagggggcaccggggatcggcggtcgtgccggcgtccatgcggtggcccctacggtggtcggtcaggcgcgggtcatcggtcgggcaggcccgaacgttatgagcccaccgttgatcaccgggcacacacggtagtcgtcaatgacgtatgcgcgacgggcagttgtcgaacttgcccgccatccgtcccactctggtatgacctctcgcacgcacgcccgattgcgtcaccttggacccgaatcgccccgggatgccgaaaagctgcccacatgctggacacttcgagcccgccgcgaccgcgccggcggcgtcgtcgcggggtttacccgcaggcaggggccactcgagggagcggcaatgcggccggttaccatatgagcgccgcctagctcgaaagataaacttgtgactgtcaatgacgactcgttcaccaactggatgcaccgcgaggagatcgcggagtcgatgatcccgatcatcgggaagctgcaccgcgagcaggacgtcaatgtcctgctgcacagccgctccctggtgaacaagtcggtggtcagcatcctcaagacccaccgcttcgcccggcagatcgcgggtgaggaactctcggtcaccgagacgatgccgttcctgcgggccctgacgacgctcgacctcggcccctcccagatcgacataggcatgctggccgcgacgtaccgggccgacggacgcgggctctccgtcgaggagttcaccgccgaggccgtcgccggggcgacgggcgacaacaagatcgagcgtcgcgcatcgcgtgacgtggtgctctacggtttcggccgcatcggccggctcctggcccgcctgctcatcgagaaggcaggctcgggcaacggactgcgcctgcgggccatcgtcgtccgcaagggttccgggcaggacatcgtcaagcgcgcctcgctgctgcggcgcgactcgatccacggccagttccagggcacgatcaccgtcgacgaggcgaacagcaagatcatcgccaacggcaacgagatccaggtgatctactccgacgacccgacaacggtcgactacacggcgcacggcatcaaggacgccatcctgatcgacaacaccggccggtggcgcgaccgcgagggcctctccaagcacctccaggccgggatcgccaaggtcgtgctcaccgcaccgggcaagggcgacgtccccaacatcgtgcacggcgtcaaccacgacacgatcaagccggacgagcagatcctgtcctgcgcgtcctgcacgaccaacgcgatcgtcccgccgctgaaggcgatggcggacgagtacggcgttctgcgcgggcacgtggagaccgtccactcgtacaccaacgaccagaacctgctggacaattaccacagctccgaccgtcgtggccgttcggcggcgctcaacatggtcatcaccgagaccggtgccgcctcggccgtggcgaaggcgctgcccgacctccacgccccgatcaccggcagttccatccgcgtcccggtgccggacgtctcgatcgcgatcctcagcctgcggctggagcgcgagaccacccgtgaagaggtcctcgactacctccgcaacgtgtcgctggcctcgccgctcaagcgccagatcgacttcatcagcgcgcccgacgcggtctccagcgacttcatcggctcgcgccacgcctcgatcgtcgacgcgggcgccaccaaggtcgacggcgacaacgcgatcctctacctctggtacgacaacgagttcggctactcgtgccaggtcatccgggtcgtccagcacgtctccggcgtggagtacccgacctacccggccccggcggcctgaccccaggcaccgttcggtccgtcacgaggtgcccggtgcccggcaggtcttcctgccgggcaccgggcgttcgtcacgccgggcggcaccgtccctcacgcctcgcgcgggagtcctccggacccagccgttcggtgggtcgtccaaagacggaacgtggcccgcgccgcgaggagccaccggccgtcggccttacggaacgtgtcctcgtagtgcccgacctgcccgggaagtcgcggcggcaccatgccgccggaccccgccgcgcgggccgcgcggccgtggctcagacctgaccgaggtccgagctgacccagcgctcggggcgcagggtgatcactacctgctcgccgtggttctcccaggcgaaatccacgtaaccggcgactttctcggccggaaggtagcgcgccgacacctcctccaggtccgcccgcgtggcggggcgggtgtcgacgacgggtccctcgacggagacgtaacggatggtcggctccagccggtcgaccaagagggtgaaccggcccgccgagtcgatcagttcggccttgcgcgaggtgcggccggtgaggatgcgcacgtcgccgccgggtgcgtactggtaccagatgggaacgctgagcggggcccggtcgctgccccgcgacgcgacggccagtgcggcgacatgaggctcggcgaggaactgttcgcgctctgcacgggtgagtgccacggcgcgctccttcgtacgggattcgggggctgcaccagtgtgccccgcacgccgggcgagtctcccgtcaccgacgccggagtgtgcggcgtgtcgcgcgaggtgcctcccggcccgccgcgcgacatctcgcggtccgccgcacccgggctccagctcatgtccggcgggtactgaccgggttcgcgacgcctggcatggtccgaacgaaaggccctaggcgaccccggaagcgtcctgggaccgtcgcacgacggccgccccgcgcagtgcgacggcgcaccagacggccaccaggagcagtgcggccgcggccaggcccgcgacttcgatgggctccggccgccagcccagggacagccgggtgccgatcatgacggtgccgaggaggacctccgacggggagtagaccggcaccttggccgccacgaaccgcaggacggcgccgagcaccaggccgatcacggcccaggcgagcagatagggccagagcgctcccggagcggcgggcggcaggccgtactcctccgggccgatgcggaacagggcgcccagccatcccagcgtcactccggcggcggtgacgatcgccgcccacagcgcatggcgccacagcgggccggaccgcactcgctcgtcctcgtgctcgtgctcgtcctgggtgtcgacggggttcgtggtctcaggaagatccatcacgcccgctaggacgctcaccggccgccggccgttgcgtcgcgaccggtgtcaggaacacgccgaacagctgcacggccctcggggcgggccgaacgagaggccttaggctcccgcacatgagcaaggaccgcgacgacgagccgatattcgtccgctcgaactggggaacaagtcgctatgtctacaacccgaacaatccgatcggcgtggccctcatcatcggatccctcctgttcgccgccgggggcatgtactacctcttttcgagttcctcgtggagcgagggcgagttgcgcgacgccgtgcacacggccgtccaggacctggagtcggagcggcacaccttcagctcctggaccggtggttacgaccgtctgatccgcgacgcgctggaggagagtggcgaaggcccctcgaccggcgggatggtgtacgtcgatgacgcgaacgatccctacgacgaggacgcggagccgtccgtcgaccggttcgaggtatcggcgaaggacgtcgacgcagcgttctgtctgagcgtgtcgccgccggagcccgagtcggcgctggacaacatcacggtcagcctctccatcaccgtggaggagggccgatgctgagccaggccgtcaagcccggtgagcccggcttacgaccggcgcggatccggggcttgaagttgccgctgcggcagcttctacggtcgtgaccagggccggaggaaccggccccgtgaggcgctcgtgagggagtgaggacgtggcgatggactggccgatctccgaggtcgcccggatgtcgggggtgaccgcccggacgctgcggcactacgacgagatcggcttgctgccgccggcccggatcggttccaacggccaccgttactacgaggagcaccagcttctgctgctgcaacagatcctcgtgctgcgggccctggacgtcgggctgccggagatcggcagggtcctcgccgaccaggtcgacacggtggatgccctgcgcggacaccaccgacggctgctcgcggagcgggaccggctggacgccctggccacgaccgtctcccgcacgatcgccgagctcatgcagtccagaagggacggtaggcccatgaccgccatcaaccgaccggagaacctgttcgagggcatccagccctctcagtacgaggggaatctgcgcgactttcccgggctcgcggaggaggccggccgacgggcggccgtcatgaccccggccgagaccgaggccggacagcgcgagcgcacggcgctgatgatccggctggccgagcacatggccgccggcgtcccggccgacgccgagcccgtgcaggccgagatcgacgcgcagtacacggcgctcacggccctgcatgccgtgtccgccgacgagtaccgcgcgatcgggcgctcctgcgtggacaacgagcagtggcgcgccgcgtacgaggccatcgccccgggcctggccgcgtatcagcgggacgccatcgaggcgtacgccgcttcccggctcgcctgaccgtggcggggccgccgcaggacgacccggcggcggccctcagccgtcagcggcgcgggcgaaggcgtacgcaccgcgcgtggtcagcgctccccgggctccgcccaggcgtgcggcgccagcgtccgcaacgcttcaccatccccccacctgcacaactattggttgtatctgacgggtgcggggttgtttgaatgtgtgctccgcgcggtgatgggatcggcacatgtctactcgcactgagcaggttatgtatgtccagacgcctgatttcacacgtcacgcggaacggatcgtggaggtgaccgatgcgacgtctcgactgaacgtgcttccgttcagcgacagcgaacgtcgcgcggaactactttctgttgtgttcggtgggccgctgccggaatcggtgacgatctacccaccgttctttaccgagcacggactgaacacgacgttcggggagaacgtcttcgtcaaccagggatgcaccttcatggacaagggaggcatccgtatcgggaacggcgtcatgatcgcgccgaaggtcagcctcatcaccggaggccatccactgcccctggccgagcgacgcgagtacctctccttcgccccgatcgtcatcgaggacgacgtctggatcgggacggctgccgtgatcacgcagggggtgaccatcggtgccggtgcggtggtcgccgccggtgcggtggtcacgcgtgatgttcctgccggtgccgtggtcgcgggggtgcccgcccgggtgatcaggaagatcgactgaacccggccgggctgctggaccgggtgcgcggcacccgcgcggcctgacgctggtgcctccccaggcccggccggccggcggtgggaccgcgtgctcggcgtcttgctcgcccgcgcggacgacgacgggcggatcaggtggctgatggcgtggtctccaccatcgcccgcacccgggcccaccagcacgcccccaccacccgcgaccccgagaagtgccggtccgcggccaagggccctgtccggtggatcggcgtcgcggttccggccgcttccacggacagtcctgctcacccttgacggccggcatccggtggtagatgcggaaggcgacccgggatttgtcgggctcggtccggacatcacctgttccagcgggagcttggcgggaggggtgtcgcctcggtactcgtgccggccgacgtcgagccccagcagcatgtcggggccgatcggactctgacgccgccggcgccgctcatgaatccccggaggaagctagacgccggtctgcccgtcgacgagttcacgcacgacatcgaggtgaccattgtggcgggaaatctcttcgatgaggtggagaaccacccagcgcaggtccacgtgacggccgtcgccgataggacgtacggccgttgcgttcaggtcgcggtcggccaccagccggcgataacgggtgctctgttcctcgtactcggcgagaagccggggcagcgggatctcgaccgctgtccgcatctcggggtcggggtcgtcgtcggtcgcccccgtgagcggcccctcgggctcctcgccgagaaacatcacctggacccagtggtgttcgacccatcgcaggtgactgatcagcccgcacatcgtcatcaacggcgagttcgggagcggcgccttgcgggcgtcctcctcggacacgccctcacacttggctcgcgccgtgtcacgggcgtagtccaggaaggtggccagctgcgtacgttcgtcccacgtggggggtgtatcggttcgttgtgtcatcgcgggtgaggttcccacagctcagaggcggtgtcatgtgatttggaagctgcgggaagccggcgtgcgactaccgccgtgcgtcggcacgtcgtgcgagatccgccggacagccccagcggctcggcgacgaggaggcgcggtcggtcggtccggttcgaggacggtcatcgccccggatcatgtcagcaacagtggtcgggagttgctgaatgcgtcccggtctgccgccggcacaggtagaacagctcggggtcgccctcatcgaggccgtggagaaggccgaccgggctccatccgtttcgttggagcagccgctgcatcggctggttggatacgttggtcgaggtgaacagcttcggggtggtgcatgaggctgccgcggcgttcagcaaccgatggccaacgcctctgccgcgggcggcaggcgccaccatcagcatcgtcacgaagccctgttcgaagaacgtgtactccaccacgcaatagccgagcgggccggacgcgtcctccgccacgaccgccaggccctgtcggcaccaccttcggatgctcgcctgccgttcgccgttaccttcgaccgcaatcgcgtcgagcccgatcagcgtgtccgcctccgactcactcgcgcggcgtacaccgaactcgcccagctccactgcactcatgtggtcatgttgtcagctagcggggttccgccctgcatcgcgttcgcccgcctctctgatggagcacggagaagtagatcggtggggtggtgcgggggaatctgccacgatcaccggatgggtgcatggaacgcggtggcaggcagggataccggctggaccagccacgatcgtgtctttggcatctgtgtgccagtcgacggtgtcacccggtcagcgagccatgggcaagacgctcgcggccgactccaacgccccctcctgagcccagttcacggcccggtgcggcggatgtcaggagacgggcagacagatctgacggacctgtggcagcagcgttggcccgattgccctccggtcgggtacaagctgtgcgacccgtatcgggatgtctgggttcgttctcacagcctgccggagtcgaagcggcatccggaggacgcgagcgagtacaccgtccgagcatccggaccgtctctccgggctcgtccgcgacccgccgtcaccgctcccccgcgaggtccatatcgcccctgctcgtctcggccacgctctccgcgctccgcggacgccgccacgggtgcgcgatcggctgggacaccgcgcgccaccatgcctcggccggcagcttccccgccggttcgaacggttcgcccggccgggggaacgccaccgcctgcccggcctcctcgccggcgtccttcgtccactccgcgggctccgcccaggcgtgcggtgccagattgaaagtgccccagtggatcggcagcagcacaccgtgcgggcggccgccctggaggtccaggtgggcgcgcatgccttcggcgggggtcatgtggatgtccggccagtactccgagtacgcgccgatctggatcatggtggcgtcgaagggcccgtgctcggccccgatgtcccggaagccggggaaatagccggtgtccccgctgtggtagatccggtgctccgggcccgtgacggcccacgacgcccagagggtgtgctgctggttgcgcagcccgcgaccgcagaagtggcgtgcgggggtggcggtgaggctgattccggcgacggtcgcggtctcgttccagtcgagctcgtgcatccggctcgtggggactccccagcgctccagatgggctccgacgccgagcggcacggcgaagaccgtgtcggtgccggccagggcgcggatcgtcggcaggtcgaggtggtcgtagtggtcgtgggagatcacgaccacgtcgacgggtccgagcgctgcgagcgacagcggagtggggtgcagacgcttgggaccggcgaacgggaacggggaacagcgctcgccccagaccgggtcgaacaggatccgccgtccgtcgatctccgccagaacgctggaatggcccatccaggtcagccggagcccggtggcggggggcgcggccaggtcggcgagggtcgtggcgtggacgggcacggtgcccgtcggcgacctgcgggcccgctgctccttctggaagtagatcttggcgaattcgacggtggacccggaggggcgggtccgggcccccaccgggttctggaacaccccgtcgacgaaatggggcgagcggcggatgcgctccatccgcgctccggccggatcggccccgaaggactcggtgcgcatcgagcgcagtttcgtgcggaacggaagcaagtagtcagcgccggtcacaacatctcctgagggagtcggtgtcgtctcattatggtcggcatgtacgacagggcgagcagaagatgctgaacggggcaaccggcccggccggcggcgtcagccacgcgattgcccgtagacgtggtcgatgcgcagggtgagcagcaccctgcggtcctggaccatggcccgccggtagtcgtcccagtcgggatgctcgcccttgacgtcccggtagagcgtgatcagcgcctccaccgtggcgtcgtccggcgcctcggcgggcggggtcagttcggctgttccgtcggcgacggtccaggcccagcggtcgtcgctggtgacgtggtaactcgcccgggggtcgcgccgcaggttacgggtcttggcccggccctcggtgatcgagacgcggaccacctgctcctccggatagaaggcgtgattgacgttggacagctgagggcgtccgtcctgcttcagagtgaccagaacgccgccgtcgtgctcaccgaagagacggagcagtgcttcctgtgccggttcgattcgcgtcatgcaggtgcaacgtccgggcgctccggaggattccggtgcgccgcgtccgccgtcgtctccgtcggccaccgtcccaccctcgctgacctggcgcattggtcagggtgggccggtggccagcgtcccggcttctctgccccgcccagctcctcgggtcaggtctgacgcaccggtgcgtaggccgccccctccaggccgaacgtccaggcgacgccgtccttcgcggtccgggtggcgggcggcacgcgcagccagtacgtgcggtaggtgccgtccggctcgggggtggagttgaccacctcgaccatcaccacgtcctcgtcgccgtcgagcgcgatgcgccagaggatgcccgtctcgtcgcggtggacgggctcggcgcccgactcggtgagataccggtcgtagccgtagtactccagcatcacgcggcgcagctccgcgttctcctcggcgcggatccgctcgggcgtgagggagggcagttcggccaggaacgcggcgggaacgggcatgccgcgccaggcgtggagagcgaagccgtccccgtaggcgagggccggaccctcgccgtggtcgagcctgcccgcctcgtcgcggtggaggacctcgggccgctcactgatgaccacggcgtgctcgtagggccaccaccagccggcgttgcgggccacctccgcgaggcccgtcagccggtcgccccgcccgtcgaaggcggcgagccaggcggcgt

SEQ ID NO: 3105 - DNA, 13108 bp, Unknown
  Kingdom: Bacteria, Phylum: Actinobacteria, Class: Actinobacteria, Order: Streptomycetales, Family: Streptomycetaceae, Genus: Streptomyces
ctgctgggcgacaccggcgacctgcggaccaccgtccgggccgtgcaccgcaccgacgcagacccgaccgtgacccgcctgctccaggtgatcgcgggcctgcgccccgggcacgcgtaggtcgtgtgcggcgatcacgtcggaccgctcggcgccatggggctggatcgcaggcaggttgcctgcgctctgtagctgatgagcaggggcatcgcatcgcgggcatgggcatgggcatgcgacaggacatcgaagagctggtgaaggaagccgaatggcaaatccgcgagcacgaatgggtcctgtcagccaacggccgtaccgtcgcggcgagggccgccgcgggcctgcgcgccgtcgtgggcactcctcagtctcagcaggagctgcccgagtcacccggctggaacgcctgcgggaagcacgtgctgctgtggccattgccctcgtccacgtacacgaaagccgaagaagcgatccgtcggctcccaagcgctctcacctgtgtcgccaccgcctgcccccgtctgcctccgtcggggagcgtcatggtcgcccggacaggacctagtgcgggaccaccaccgacccgcacggtgcacgacacgctcggcgaccgggaagccactgaaccggcctcgtgacggacaacgaccggacggtctgccaggtgcgcgatgggcatccaaaccacgacccgccgtcgcgccccgcggtgccgttgagactgccgctgcgcttctccggacggccggtcagaaacgtgtctgcggtgtcaccgagccgtcttagagtggccttccaccgacgttcaaagaggatcgatcatggggatagcggacacttccgtcgccgctcagagccgggcccgcacctggacgagactgcatcagcacttggggtccgtccctggcccgctcacctatgacatggtcagccgggccgcagcggatcacctcggtgagtccgacgacctcgactggaagagagaccttccccttcctcccatgcacggtcagtggaacgagttcgccaaggacatcagcgcgatggccaacacccgtggcggactgctcatctacggcgtcgccgacaaccacgagatcatcggcatcgactgggagaaggccgacctccggcagtacgcgcagtgggtccgcaaccacgtccacccctacctgccagacctggtcatgtacccgttgaccgacggcgcgacgactctcctggtcgtggatgtccctgccagcgaaatggcgccgcacctcgtccacggcaggtcggacaaggacaaagaacaacaggcgttcacggtgccgtaccgcgaccgggaccacaccgcctggatggcggagcaccagatcgaacgcgcctaccgcgaccgcttcacccgcgccgacagagcggaggaagcactgcgccggcactccgacttcctcaccaagaccatcaccgcgcatgccaccaggccctcagcctggctcgtcgccgtcgcacgtcccgcccggccctaccctcacggtgcgccaccgctgaatcgggacgaagctcgctaccttcttcacgtcgccgaggaacgaggaaggaagctgccgacgcgacggaattccggaccgatgacggggatgggttacgcactcgacaacccccgcccgggcctgaggcgctgggtctgcagcacgatggagatcgacgacaaccggaactccatgatcgagatgcaccatgacggcaccgtgaccctggccaccaacgtgtcatggcggccctactccgaggagcagcgcagcctcgccgaagagggcgtcgatgaagccctacctgtttctcagcgcgtggtcgcagcagcctgcggtgacttcgtgaccgtcgtccaggagctgcaacggaaactgcgcctggacagtactcagcagatcaccgcgacgatctacgcatcagacggtccgggtgccctcgaagcccgcactgcggaattcggaggtggccgcgaggtcacgcccccatatacccgccgtcctcattacattcagcccgtacacacgctgctcccgccgatcgcggacgacgaggaaacggcacgtgtctccgaggaactcagtaccgacctgatgagtcagttcggcctctgaggacgcttctcgacaccacgcacaccggctgatgtcgacgttgtccggtcttcggtcacggctccagtcggtcccgtgctgccgtaagtggctgcgggccattcttcgaggcgtcaggctgggtcgatgtctgctctgtggagttcgctgttagcccctgccggagcggtcgtggccaccctcatcggtgtggtggcggggagtgtgatcagcaggagaacgcaggaccggcaatgggtgcgggatcaggtcgcggcagcctgcgcgcgcgtactgcgggaatcctcgggtgtactcatagatctcaatgaatggaatccgggcggcccaaacggctccgcaaggtgtggtcgttcccaccaccacccccgaggaagactggattgccctgcgctcggccgtcgtgtccgcgcagaacgacttcatcgtcgtcgcacggggccacctctcactggcgggagacccgctccagcggttctttcgaaggcgtctgcgaagatctctcttccgactcctctggtcgcgatgagggtgtggtcgatgtcccacagcacgagcttcaacgtcgcctcccggaccacggacagcacatagtcagggccacggtgtcacgccttggggtgaggccggacagctcagggcccggaccgttccacgctgagtgaacggcctgatcatggaggcgtcttgacggacctgaccccgatcccgaggggggctcgtccgcgcggcgcgtcggcgcgatggtcacccgcaggccgccatcgcgggactgtgcggcatcagcaccgactacctgtcgcagatcgaacgggggccggagagccctcggggcgtgtcgccgggctcaaggccctcacgggccatggcgacgatgccggccttggccgcggcgtagttggtctggccgaagttgccgcgctgtcccgcgggcgaggagatcaggatcagccggccgccctcgccctgctcccgcatgcggatcgcggcggcgcgagcgcaggtgaaagtgccgcggaggtggacgcggacgacgtcgtcgaagtcgtcgtcggtcatcttccacagcacgcggtcgcgcaggacgccggcgttggtgacgagtacgtccaggcggccgaactcccgtaccgcggtgtcgaccagttcctgggccgcgcggctgtcgcccaccacggcgacgacgccggcggccgtgccgccctcggggacgtgatcgaggtgacggcggcttccaccgcgtcccggtccacgtcgttgacgacgacggcggcgccggccgcggcgagggcgcgggcgtatccgaggccgcgtccgctgccggtgacgacggctactttcccgtgcaggttcatggggggtgcctctcgtgagggtggggtggcatgccgaggtgccggcacacacagcggccgggatcgacaggaatcctgatgaacgaagtctgatcaatcaacaggattcctgtcaatgctctaggctgtccccgtcatccatcccggcgccggcacaggaggacgaacatgagcacctcgctgctctacctggtcaagaggacggagctggcggtgcgtgcccgcctggaggaggtggtcaggccgtcgggcgtcaccgccctgcagtacaccgctctcaccgtgctggagcggcaggacgggatctccgccgcccaactggcccgcgactccttcgtcaccgcccagaccatggccgacatggtccgcgccctggagggccgtggactgatccgccgcgagcccaacccggcgaaccgccgggagcgcctgatcctcctgaccggcgagggcaggcgactgctcgccgcgtacgcggaacccgcccgccggctggaggagcgcatggtcgccgagctgagcccggcggaggccgaggcgttccggcaggctctgcaccaggcctggcgggcgctgacctgagcgccgcgaccaccagggggggccgacgggtgccccgcccttccgccaccgggcgcccgcggcgtgaccggccccggccacccgccgtggttcagacgtccgcgaccgccggactccagccgcgccggggcacggagtccagcagcagccgcgtgtaggggtgttccggcgcgtcgagcacccgccgcaccggcccgtactccatcaccgcgcccgacttgagcacgagtacctcgtccgcgatgtgccggacgaccgccaggtcatgggtcacgaacagatagccgattcccgcctcgcgccggatctcacgcatcaggtcgaggatctgcgcctggatcgacacgtcgagcgcggcgaccgcctcgtccaggaccaggacccgcggccgcaccgcgatggcccgtgcgatcgccacccgctgacgctgcccgccggacagcgcacgcggcagctccaccgcctcgcgggccccgaggccgacctggtcgaggagctcggcggcccgggcccgccgtcccgccgcgtccagtccggagtgcaggcgcagcaccgcctccaggcagccgctcaccgtcacccgagggtcgagggagagataggggtcctggaagaccatctgcatctcgcgggcgcgggcgagccgttcggccctcccccggccacgggccgaacggtcgcggccgtcgagccgtaccgtaccgccgtcggagcgttccaggccgaccagcatccgcacggtcgtcgtcttgccgctgccggactcccccacgatcgccagcgaaccgcccggcgggagcgtgaacgacacgccgtcgacggccgtatggcccccgtaccgcttgcacaacccctcgaccaccagtccctgcgtcacagtgtgattccttcctcggcgcggtggcacgcggcgaacccctcgccgtgcggcgcccatgggggtttctcccgcgtgcagcgcgttacggcatgggcgcagcggggggcgaaggcgcagccgggtggagcctccgcgagagagaccggccggccggggacgggccggggcggctgcgcacccgcgtcgatgcgcggggtacaggcgaggagtcctgcggtgtaagggtgccggggccggtcgaagagctcctttgtggaacgggcctcgacgatccggcccgcgtacatcacgtacaccctgtcgcagacggccgcggcgagctccaggtcgtgggtgacgaacagcatgccggtgccgcgttcggcgcgcagccgggccaggatcgctaggacctcggcctgagtggtgacgtcaagggcggtggtcggctcgtccgcgacgagcagggccggttcggcggcgagcgcggcagcggtgacgacgcgctggagcatgcctccggagaactggtgcgggtagcgcctcagagctccgcgcgggtcacggatgccgaccgcgtcgaggagttcctcggcgcgggcgagggccttgccggcgggcgtgccggcggcgcgcagcccttcggtgaggaagtcgcccacgcggcgcatcggattgacggaggcgcgcgggtcctggaagaccatggcgacctcacgggcccgcagcgcggccagctcggcgcgccgcatggtcagtacgtcccggccggacacacggacggcgccactgacacgggcgccggcggggagcagtccgaggacgctgcggcaggcgacggatttgccggagccggactcgccgacgagtccgacggactctcccggccatacggtcaggctcaccccgtccaggaccgggcgggcggcccggccgtcgggcagccgcacccccagcccgtcgatctccagtacgggcagggtcgatgcctgtgtcatgccgttcaccgttcccgcttcgcgatccggtcggcgaggccctcgccgacgatgccgaacgccaccacggcgagcacgatgcacgcggagggcgcgagggccggcaacatcgcgccctggagcacggccgactgaccctcgttgatcatggcgccccagtcggcggccggcggctgcgccccgaagccgaggaaggacagcgccgccaggtccatcagggcgtagccgaagttcatcgcggactgggcgagcacggtcggcgcgatgttcggcagcaggtggcgcacgcagacggtccagccggaccagccctgcacgacgtgcgcctcgatatagggccgcgtcttctcctgccgggcgatgccgcgcacgagccggcccacgtacggggtgtaggcgacggccatcgcgatcaccggtgcgctcaggccggtgccgaggacggacaccagcaggatcgcgagcatcaggccgggtatcgcgaagacgaggtccatcgagcgggacagcaccgcgtccgcccagcctccgcgccaggcggcgaccacgccgagcagggtgccgagcagcgtggagacggcgacgacgagcagcggtccgagcagtccggtacgggctccgtggatcagccgggacaggacgtcccgcccggactggtcggtaccgaggaggtggtcgccggtggtgccgacgaggctcgcggacaggtcgagcgcctcggggtcgtacggcgcgatgaggggtgcgaacagggccacgaggacgagtaccgcgagcaccgcgacggaggccgtgaacagcggtccctggccgaacggccgcagtccgcgcaggcccggccgccggctgtacggcgccgtggtgagcgtagtggtcatgacacaccctccgcgggcgagagacgggggtcgatcagcggggcgagcaggtcgaccgcgaggttgacgaggacgaaggccgccacactgagcagggtgaccgcctggaccacggcgaagtcctgggcggtgaccgactggacgagcagcgagccgaggccgggcacgtcgaaggcggtctccacgatcgcggtgctgatgagcaggccggcaagcatggtcccgccgacggtgacgaccgggccgacggcgttgcgcaggacgtgccgacggaccacggcagcctcggcgacgccccgggcgcgggccacctccacgtgctcgcggccgagttcgtcgagcatcgccgtgcgggtgacccgggcgaggagtcccgcgaaggtgagcgcgagggcgagggccggcagcgtcagctggtggatccgggggccgaggccctcggcggctccgccaccgggtccggggaaccagccgagccgcaccgagaagagcgagacgagcacgatcgcggtgacgaaggacggggtggcggtggccacgccggtcccgatgagcacggcgcgatcgagtagaccgggacgcagggcggcgagcacgcccgcgcccactccgagcacggcgacgagcagggccgcgtagccgacgagaagggccgtgccgggcagcctggagccgaggagggcgctgacatcctggtggtactgggcggagcgcccgaggtcgccgcggaggaggtcgccgagccatgtgccgtactgcacgacgagcgggtcgtcgagatggtgctcggcgcgcagcgcggcgacgatctcgggggtagcgggccggccgtggagcagaaaggtgacggggtcgccgggggccaggtggaccgtgccgaagacgacgaccgaggtcacgaacagcacggccaccaggccgaggagccggccgacgagatgacgtgtcatttctgcgcggccccgatcgtcgcggcccaggggtagtagagctgggcgatgccggtgggtgcaccggtgatccgcttgccgaggaagagcgagtacggcgcctcgtacaccgggatgaccgggagttcggcgagggcgagacgctggagctccgcggtgaggccggcgcgcttgccgctgtccggttcggcgttggcgcggtcgaaggcggcatcgaacgtcgcgttcgaccagttgccgtagttcccgaagtctccggtgcgcaggtactggtagaactccagcgggtcgggcgtgttgtcgtagccgttggtgatgaccagatcgaggcccttgcgggcgttcgggtcgacgaagaggttgctgtacgcgtcgggtgagacggactcgagtttcacgtcgagcccgatctgtcggccggcggcctgcaccgcgttggcgacgacgttgatctcgggggcgatggagctggtcgccagggtgaccgtgcgaccggccgcgccggcctcctcgacgagcttcttcgcccgcgtgatgtcgtacgccggttccggcagcgtgtcgtacagggcggcggtcttctccggggcgagtgcccaggcgccgcgtgcggcgggcgccttggcgggtacgccgaccccgcccgccgcggccttgacgatgttcttccggtcgagcgccagggacagggccttgcggactctgaggtcgccgagcgtgccctggaagtcgaggaccgagaggagggacgccgccgtgttggggccgaagaagacggtgcccttgccgctgccgcgcagctgggtgagggaggaggacgccaccatgtaaccgccgtcggcagcgccggacaggaaggcgttggagcgcgctgccacgtcctcgatgaaggtgaacttcacggacttcgaccgggggaggagcttctcgtcccagtacccggggtatttccgcagggtgatgctgtccccttgggcccacttctccagggcgaaggggccggtgcagttcagagctcccttgggggtgccgtagtccttgccctccttcgcgagggaggcggcgctgacgacggttccgggggatgcggcgaggagttcgtggaagaggacgtcgggcctgtcgagcttgatcgtcacctccagcggtccggtcttctcgatggtgtcgacgttcttgaagaccgagccccacggggacccggtggcggggtccatctgccgccggagggaggccacgacgtcgtcggcggtcatcgtggagccgtcgtggaaggtcactccggagcggagggtgtacacgagggtccgggggtccggtcgctcccacttcctcgcgagaccgggctcgatcctcagatcgggggtgacccgcagcagttgctcgcagacgttggcgaggacggtgttgggcgggtagtcgtacgcgagggcgtagtcgagggtgtacggctccgcgtacaaggaccaggtgaaggagtccagggaacccttcgccgcgggcgaggccggcacgacggcggtggtggaggcgccggcctggggcttggtggcgccggagcaggcgctgagggagaccgcgagcacggcgacgcaggcaccaacgccgaatctaggtataggcatgcagacccacccctttgcgggtgttgtggcggtacggggggatggagcgagtattgatgcgggaacgttcccgcacaaggcttcgcggagttttgcgggaacggttctgcgcaggtcacggaggtggcagcatcgtctcccatgaccgcttcagagcaggacggagcgccctccgtacggaccgtcggcgcatccgcgcgccgcgggcggtcctcaccgcccgcccctcgggtgcgcctcgtcgacgtggcccgcgaggcgggcctgtccaagaccaccgtctcggccgccctcaacggcaccggccggctctcccccgaggtacgggagagggcccgtgagacggcccgccgcatgggctaccggcccaacgccaccgctcgccagctgcgcgccgggcgggcgcggctgatcggctatgtggtcggcgaactggccgacaccccctgggccttcctggggtcgccctacttcgcccggctcaccggcgccaccgccgccgcctcgctcgcccgcggctacgcgctggtgctgctgcccgtcggctgcctgcaggacgaatggggcgcactgcccctcgacgcggtgatcgtcgccgatcccgtcgccgacgaccggatcgtccaggacgtactggccgcccgcatcccgctcttcagcgaccggtccgtggagggccgggcaggggcgcactgggtggacgtcgacgcggccgccgtcgtccggctggctctggaccacttcctggaccagggcgcccggcggcccgcgctcgtcgtacccgagagcaccacccgcttccaccgcgaggtgtccggcgcgcaccgggcgtggtgcgcggcacatggactgcccgagctggccgcacgcgtccccggacccgggaacgggccggtgatccgagcggtcgagaccgctctgagggccggaccggagcggcccgacgccctgctggtggtcgccgaggccagcccgcccctcgtcctggaagcggcccggcgtcacggctaccacgtccccggcgacctgctcctggtctgcgtcagcgaggacggaaccgctgtgcacaccgatccgccggtgtcgaccctgagtctgcgcccggacgcggtcgccggggccgggatcgacctgctggtggccgtgctcgaacacgggcggcaggagaccgacggggtgctggtaccagtccgcctccacgcccgcgcctcgtcccggcggccggtgtagcaggcgctcaggcatggtggacgagtgagccgcccacataggtgcgctccacgcgggcctcggctatctcctccggcggcgcggcgaggatgtcgcggtccagcaccaccagatcggccaggtgacccacgcgcaggctgccggcctcgtcgtgaccgttgacgtgcgccgcgcccgcggtgtaggcggccagggcgctcggcaggtcgagtcgctggtcgggcaggaagacccgctcgtccccggaccccggctcccggcggttcaccgcgacgtgcaggccggcgagcgggtcggggctggagaccggccagtcgctgccggcggcgagggtcgcccctgcgcgcagcagaccgccgaacgggtactgccaggcggcgcgctcggcccccaggaaggggatggtcagctcgtccatctgcggttcgtgcgccgcccacagcggctggatgttcgcgatggcgccgagggccgcgaagcgcggcaggtcgtcggggtggaccacctggagatgggccaggtggtggcggttcccgcgccgcccgtttgcctccacggccgcctcgatcgcgtccagggcctcgcgtacggcccggtctccgagggcgtggaagtggatctggaagtcgtgcgcgtcgagttcggtgacatggccgcgcagcgcgtccggatcgacgaagctgaggccggagttggccgtggcacagccacaggcgtcgaggtacggggtggtcatcgcggcggtgaagttctcggcgatcccgtcctgcatgatcttgaccgaggtggctcggaaccttccggaactcaactcgtcgcgcagtgaaacgagttcgggtatctgttcggctccccgctcacggtcccaccacagggcgccggtcacccgggcggtgagcgaaccgtccctcgccgccgccagataggcgtcggaggggtcgggcatgccgttgaacgagccgatcagcgcgtcctgccagccggtgatgcccagcgagtgcagcaaccgctgcgcccgcagcaggccggcgagccggtcctcccgcgtactcggaggcacgaggcaggagaccaggccggtcgcgccttcctgcagcatgccgctcggggtgccgtcggcctctcgctcgatgcgcccgtcggcggggtccggggtggcggcggtgagcccggcgagttccagggcccgggtgttcgcccaggcgccgtggtgatcgcggttcgacagcagcaccgggcggtcgggacagaccgtgtcgagcagccggcgggtcggcagtccgcccgcgaagctctccatcgaccagccgccgccggtgatccactcacggtccgggtgcgcctcggcgtacgcgctgatccgcgtcaggtactccgcggcgtcaacgctctcggtgaggtcgcactcggccagctcactgccgccgcccaccgcgtggatgtgggcgtcctggaaaccggggagcagcagcttgccggtcaggtccaccacctcggtgccggggccgatcagctcacggacctcgtcgtggccgacggccctgatccgctcccccgtgaccgcgatcgaactcgcccgggtccgggcggggtccatggtgaggacgggcccccgggtgaagaccaggtctgcgtggggcatacggcagctcccttgcgtgcggcgcaccggacaggcgcgggacggacggacagggcgccatggaagcccggctgccgtttacacgtcaatggtgttgacgtaaggtcccggccatgtccgatcgcgtggttcccgaaggcagccggcgccgtcgcaggccgaccaggcagggcgcggtgctctccgagcggctcatcgtcgacaccgcgctgcggctggtcgcggagcacggcggtgacgccctgtccgtacggaggctcggtgccgccctcggcgccgaccccagcgccctgtaccgctacttccgcaacaccgacgccctcctcctcgccctggcggacgagatgatcggccgcgcgcaggagggctgggaagccgtcggcgactggcgggaggacctgcgagcgatgggactgcgcgtccacgcctcgtacctcgcccagccccaggcggcgctgctcgccgcgcaccgcaccaccggccgcccgcacgagacgcgggcggtcgagagaatcctcggcatcctccgtgacggcggtttccccgaccccctggccgtacggatctaccacgcgttcatcgaccaggccctggccttcgccgcccaggacgccgcggcggcggccctgccccgggcggcggcggacgcggacgcggaggtgtggcacgccgcctacggccgccttcacgcggcgacccacccgaacatcgtggccacgtacccgctgctggccgccgagatgcggcacagcggctatccgatcgcactggaactgacactcacggcggcagcggctctgcacccggacgcggcaggacggcggacgggtgggcgccgggccggcgagggctgacac

SEQ ID NO: 3106 - DNA, 4634 bp, Unknown
  Kingdom: Bacteria, Phylum: Actinobacteria, Class: Actinobacteria, Order: Streptomycetales, Family: Streptomycetaceae, Genus: Streptomyces
cttcttcctcggttacgcggcggccgtcggcgtcctggccccgcgcgcgctgctccgcggcggctggccccagcggtcaccactgctggcggtcgccatgtggttcgcgctggcggcgtccttctccgtctgcgtcgccctggccgccctgcacctcgccaccccgggcgcacacctgcacggaatcctctactcctgccgctccgccctgggcctcggtccgtccggcggcggccttccgccgggcctgggactcgccgccgtcaccgtcctggtcgccgcccacctcatcggcttcgccgagcacaccgggcgggcgtacgccgctcgcgcccggcaccgcgagatcctggacaaggtcggccgccggtcggcctgttcgcgggccaccgtgctggagcacgtggagcccgccgcctactgcctgcccggccgccacccgaggatcgtcatcagcagcggggccgtcggcctcctgtccggcggcgagatcgacgccgtcgtcgaacacgagcgggcccacatccgcggccgccaccacctcgtcctggcggcggcccatgccttcacccgggtcttccccggcgtgccgctcgcccgccatctccggcagcagattcccctgctgctggagatggccggcgggcgaggcgccgaacggggcccttgcggcgggcggccggacggtactggtccgcctccggcgcgtgctggcaccggcgcaccgcgcgcatcccgccctgcgctgcgcggtcgggacgggcgccctgatcacgcccgtgctccccgtactgctgacctgccacgccggactcgggtgacacccgtcggccgcgaaccggccgacggcctcagacccgtacaccccacatgaagggcatcccgctgcgggccatcgactcgtaccgcacgtgggcgccgggcttcggcgcgtggagtatctggccgttgcaggcgtagaagcccacatggctcaggtcggtgcgcatgatgacgagatcgccgggcttgagcgcaccgatcgaatcgatccgggtgccgacgccggcctgggcctgcgacgtacggggcagcgagacatcggcctgccggaacgcccaggaggtcagaccggagcagtcgaaggaccccggcccggtggcgccccacacgtacggcatgccgaccctgctcttcgccgcgtcgaacaccgcggccgcacgtccggacgcactggcctcgttgcccagctcgacccgatcgctcgcccggtcggcccgctcctccctggcggcccgctcggcccgctcctcggccgtgagggtgttgaggagccgctgcgcctccgccagcttgccctggatctccttcttcttgctccccagctccttgcgggtgtcctggaggctgtcgagcttctccgcggcctgagcgcgctgctgttgcagggcgcgctgctgcgcgaggaaccgctggagcgtgtccgactgccgtgcgccgagccggtcgaggcccgacgccttgtccagataggcgtcggggtcggccgagagcagcagctgaactgcgggatcgaggccaccgctgcggtactgggccgtggccgccgaaccgagctgctgccgcagctcgttgagcgccgcctgcttgcggacgacctcctcgtggaggtggtcggcctccttctgcagttccccggccgattccttcgccccgttgtacttctcggtggcctgggtggcctgctcgtacagccggtcgatctgcgcctgcacacccttcttgttcgggtccggcagcggatcggccgaggccgactgcgccgacagggcgaccgtcaccgccgcggtcgcggtgagcacggacgtgtatccgtggctgggctgcttgggacgacggtgggacgccactgaggcgagctcctcttcctcggccgctgtccgacggtccacggaccgtcaagtaccgctgcgggaacgcggcttcagcgacacctccaccggtggcccgggcgggccaccggccgtgcggaggccgagccacgcatactaatcaacttagtgactcacatccaagcgcggtccggcaagcgctcgctccttccgagcctcccgtgacctgctcagtcgccgaggatccgctcccacagcagcccgtcccgccagctcccgtcgagaaagatcgccgcgtgcgcgacgccgtacggggtgaacccgttgcgacgcagcacccgttgcgacggcaggttctccaggttggtggacgcctcggcgcggtgcaggccgagatcgtccgtcatcacccggagggcgagcccgacggcgttcccggcgtgccctcggttctgggcgacggaggcgatccagtagccgacggagccgcggcgcagatgcggctgcggcaggatgcctcccaccgtgacctgcccgatcacctggtcgtcggcgagcaccacgcccggccagaccgtgccggcccggtatccggccagcaggccctcgatccgctccgcctggccttccggggtgaagtagtcggccggctgggccggttcccacggccggaaggcctcgacgtcccgcccccgatgcgcggcgatcgctgcggcgtcggtgggctctatcaggcggatcctggtgctgctgctcatgggccggtcctcgtcgcggtgcgtcgaatgggacggccaacctatgcgagggcgtccgggccgcgatccggcggagggggatcgacggtggtcaggggaccttcacccagtcgagggtgcgctccaccgccctcttccagcccgcgtagccgtccgcgcgctgctcctcggaccactggggcgaccagcgcttcgactcgtgccactgggtgcgcagctcgtcggtgttctgccagaagccggtggcgagacccgccgcgtacgcggcgccgagagcggtcgtctcggcgacgacgggacggctcaccgggacgccgaggatgtcggactggatctgcatgcagaggtcgttggcggtgaccccgccgtcgaccttgagcacgtcgagatggaccccggagtcctgctccatggcctcgaccacatcgcggctctggtagcagatcgcctccagcgtggcccgtgccaggtgggcgttgtcgttgtacctggccagaccgacgatcgcgccgcgggcgtcggaccgccagtacggcgcgaacaggccggagaacgcgggcacgaagtacatgccgccgttgtcctcgacgcttcttgccagctcctcgctctcgggcgccgacttgatgatcttcagctggtcgcgcagccactgcaccgccgatccggtgacggcgatggagccctccagcgcgtagaccgccgggctgtcgccgaactggtaggccaccgtggtgagaaggccgtgctgcgaacggaccagctcggtgccggtgttgagcagcaggaagttgccggtcccgtaggtgttcttggcttcgcccggagcgaagcagacctggccgacggtggccgcctgctggtcgcccaggacgccgccgatggggatggcggcgctcagcggccgggaggtgcgggtcgagccgtaggcctccggatgcgacgaggggttgatcttcgggagcatcgcctgggggataccgaagaagcccaggagttcctcgtcccagtcgagggtctccaggttcatcagcatggtgcggctcgcgttggtcacgtcggtggcgtggataccgccgttcgggccgccggtcaggttccacaggacccaggcgtccgtgttgccgaagagcgcgtggccggcctccgccgcttcccgtacgccgtcgacgttctccaggatccactggatcttgccgccggagaagtacgtcgccggcggcagcccggccttgcggcggatgacctcgccctgccccgagcgttcgaggttcgccgcgatggcgtcggtacgggtgtcctgccacacgatggcgttgtagtagggccgcccgttgcgcgggtcccagaccaccgtggtctcgcgctggttggtgatcccgatggccttgaggtccgtcggcgagagaccgccgtgccgcagggcgttctggatcaccgagttggtgcgttcccagatctccaccgggtcgtgctccacccacccggagcggggcaggatctgctcgtgctccagctggtgcttggcgacctcgttgccgccgtgatcgaagatcatgaaccgggtgctggtggtcccctggtccaccgcgccgatgaagtccgccatgatgtgtgtcgcctctccggccggtgtggtcagtccttggaggccgccgggacgcgacccggcggttcgggttcggcggacggcaggaagcgtccgatgaaggccttgtagagaccggcgccgagcaggccgccgatcagcgggccgaggatgggcacccagaagtagagattcccgtactggtcccgccacgcgccgccgtagccggtgaggaagctcgccagccggggcccgaagtcacgggccgggttgatcgcgtaaccggcgttggttccccacgccatgccgatcgcgacgacgaccagaccgatgatgaacgggcccatgttcgagccgggtggggtgttcagcaggtccgtgatggccatgatcaggaggagcaggatcgcggtgccg

SEQ ID NO: 3107 - DNA, 568 bp, Unknown
  Kingdom: Bacteria, Phylum: Actinobacteria, Class: Actinobacteria, Order: Streptomycetales, Family: Streptomycetaceae, Genus: Streptomyces
ctggaggcgagccgccgggccgcccgtgagggccgttcggtggaggacatgcggctgcggctgctgctggacaccgtgctggacgcggcctcggggttgcggcgggagctggcgcttccgccggcgacgacgcatcccgccgacaccgtggacgcggtggagcccggccggatgtcacccaaggacattgccgccagagccctttcggagaccgatccggcgttgctcgaccagctgctggcgctgccgcaggcccacctcatcgtggacggctacaacgtcaccaagaccggctacccccagatgccgctggagaagcagcggttgcggctgctgggcgggctctcggtgctcgcggcgcagaccggcgccgagatgacctgtgtcttcgacggggccgagctggccgccccggtgctgctggccccgccgcggggcgtacgggtgctgttcagcaaggccggggtcacggcggacgagctgatccgtcaactggcccgcgcggaaccgccggggcggcccgtggtggtcgtctccaccgaccgggaggtggcggacggtgtggcca

SEQ ID NO: 3108 - DNA, 1656 bp, Unknown
  Kingdom: Bacteria, Phylum: Actinobacteria, Class: Actinobacteria, Order: Streptomycetales, Family: Streptomycetaceae, Genus: Streptomyces
ggccgagccgtccccgggcacgcccgtcgggccgtatgtcgcgaccggaccgtacggccccttcgggtcgacctccgggggtgtccggctcgccctgttcgacacccgggccacggcgctggcactgccggtcccccgggtcgacgcgatggatccgaacgccggcttcctcgccggtctcatggcctccgccccggccgagctgatcacggccctgcacacggtgccggctccctcgctggagacccggctgcgggaactgcgggcccggctggagatgcgggagctggactcggccgcccgtgcgctgaccactctggagggtgaacacgcggacgactggcgggtcgtctggtatcgcggcgtcacctcgctggtgaccggtgaccacgagacggcggcgctctccttcgacgcggtctacgacgcgttccccggggagatggcgcccaagctggcgctcgggatctgtgcggaggtgctgggccagctggacaacgccgccgagtactaccgcctggtgtgggcgaccgacccggggttcgtcagcgccgcgttcggcctggcccgggtgcagatcgccgccggtgagcggaccggggcggtgagcactctgaagtcggtgccggaggcctcgatccactacacggcggcgcgggtcgccgccgtccgggcgcggctgcgcgagcgctcgcaccgggagccgctactggtcgacctgacggccgccggcatccaggtggcggcgctggccgccttcggtctggacccggtgcgtcacgagcagttgtcgaccgaggtactgggcaaggccctcgactgggtactctccggtagtcccggtgtcccggggccgggcggaccggccgccggttcgccgggtgcacgcaagctgctcggcgccgaactgaacgaacgggggctgcggttcgggctggaacgctcgtaccggatgctcgcccggctcgcgcagcggggcgacgagaggatcgaactggtggagcgggccaaccgtttccgcccccggacgtgggtgtgaagatgtcacagagccaccagcagcccgccctgtcgaagtgccccggctgcgaggagccgccggccgcgggcgacctgttctgcggggcgtgcggctacgacctctcggccgttccggcgcgccccgacgaccggcccacgatggccatcaccgtgcctccggccgccccggcggccgaagcggtgcggtggcccaccgccgaggagaccgacggttcggacgtgcccgcgcccgtggtccgtccggcggatgtgccggggaccgattcgggcggcaggccgctgaccgagccggacacgcagcacccccgcgcaccccgagccgtccgccagccggcgcaccgtgcggaccagcagcggggccgccgcgtgccagtcgtccagcaccaggacgaccgggcggacccgggcggtccgctccaggaccgcagtcagggccgcacacatgtcctcgaagggcgcgttcggcgtgccgtcgcgcagcaggcccccggacagcagggccatcgcgtcgtcgaccgcgagaccgccggccgcgtccttcgcgtcgtccgcattcccggacgcattcccggacgcagttccggacgcattcccggacgcaggcctggacccggg

SEQ ID NO: 3109 - DNA, 16757 bp, Unknown
  Kingdom: Bacteria, Phylum: Actinobacteria, Class: Actinobacteria, Order: Streptomycetales, Family: Streptomycetaceae, Genus: Streptomyces
aaccaccgcacccgaagaaccccccaccgcacgccaacagcgccccaccaccccctggcaccaggccaccgacgcactcgacaccctccaccagggcatgaccgacgacacccacgcccaggcccacatcacggcgctcggcgaactcatcgaggccaccgcacagaaggcacctgaccactcccgagccgaactgcgaaccgcagcacagatattcgcccgcgcccagcgctcccagatccgcgctgagaaccaggccgcccataccctgcgccgcgcgacccgcgacatcgcccacaccgccaccggccccgacggcagcgccttcgccgccctgctcgccgcccttgtctgggccacgatcgtcgccgcccgctggcacgaggcgaagaaccacgcccaccaggctgaagccgcccgtcaggccctgcaccaactacacaccgccgctgaccacgccctcgtcccggtcatcgacaccctcgccgctcgtcagccgagcgaccaggcccgccgaaccctggcccatgacgtccgggccgccgtccccgaccacgccgaccgcatcctcaccgaccccgcctggccagccctcgccaccgtcctcgccgacgccgaagcaggcggccacaaaccccaccaactcctcaaggaagccgccgcccagcgcgaactgacgagcgcccggcagcccgcccgcgtcctgatcacgcgcatccagcacaccagccgaaaccctgtgcccaaccgtcgggcagcggctgctcgccgacgctcgaccatgacgtcttcggtgtcggatcacctgaatccacaacctgcagcggcacccacggcacccgccgaacggcatgtcggacggcgccgatagtcccagttggtctgaccgacggcgacacgaacagccagcccttcagtcacccagctcctcctccatcgccacggcgacggctggccaaggtgccttcagctcgccgaacagtcgccagtagcggtacgacgcgcgaaccagggaactgacgcccaacctcgccgcaccaggatcgatcgttgcgatcactcgacgagtgattccgcctgctcctcgcgaggcgggacggatgccgtgcgcgaggaggagagtggcggtgcggacggcatccagggtcggtggtggggccagggatgcgaacctgccgaatacgagatccctccaccccgaccgagtccgtgcccaggccagtcgctcaagagcggtaccgaggtccacggccagacgggcagggttgtcggcgttccacaggaggacgatgtcaccgacaggcaggtccaagtgcttgaagcgaagtgtgatgccctcgacttggcggcgcttccaagtggtcagtgtgccgtggacgctgatgtggcgtgcgtggaaaccgagtcgtgacagcacgctgaaccagccgtccaagattcctccgtactcgtccatgtgctggatcggctggacacgggagacgttgacgaacgaggtcaggaaccctggccgaagatcacccgatgcgtcgcgctgcccggtgaagcggacaacaggctgaggcaggaagccgctgcggtaggtcaccggacgcccgtccttgagatagggatcgagggcttggactgccgagatcgtaagctcggtctcgcggccccaccgaagcggcaggcaggtgtcctgcgggacgcctagcgccgcgaaacccgtcgtgagccccgccagtagttcctcccacgacggcgcctgacgaggcggacggtatggggatcctctgtgtgcgtgctcgatcttgactcgtttatcggagacggtgaactcccagtgggccccgaggatgcgctgaaggacctcaggtatgaggacgcctgaaggacgtgatgccacgaacgggcgttctctgggatgactcgtcatcacggccgactcgccatcgccctgaagtggcgggccggatcgaagcggtccattccgatctcctggacctccgcgtacttcaggtcctcagccgcctcgatcgcccgcgcgaggagttccgctgccgactcgtcgtccacggcagggtcggccaccgtcaccacaccggtctgatcgcacaaagcggcttgggcgcatgtgccctcgcgccaggtgagcgcggccattggggtgccggcgcggagagactcgccgaagaccgcggcgccagcctccacgtatgcacgggcgtaggtgtagacgaagacggaggcgtcgcggatagcagccgtcttggcggggccgccgagttcaccgacccacttcacgtggtccgcgctgaagaggcattcgtggcggcgcacgtacgcctcgtcgaagacagggccgacgatctgtatccggcggccgaggatctgggcggctcggacagcgatgtgcggcaccttctcctcgtctattcggccgagccatacgaggtcgctaccggcgacagccggtggcacctcctcgtccaggccaaggtggacggcgagttcggggatcggctggtgagctgcgtaccgctcgatcatctcgggcgagtagcagtagagccgtgaccgcttgccgtcgaaggccatgtccgcgtgctggaagacaggcgagtgctggaacgtggcgacggcgcagtccagctcgttccaggtgcgcgtccaggccggcagcgacgggtattcgtgcccgacgaccaggaggtcatatccggtgctgcggagcttgcgctcggcgagcgatccggcggtggtgttttccaggcggaacggccgacggacccagtcgttctccaggtccgtgagccagcccggcccgaggaggtgtacgtcggcgcctgcggctcgggcgcctacggcgaccgcccacagccatcgttcgatcccgccgtacccggcggggggaaaggcgtagctaccagggaagtcgcagacgccgacgagcacgttatgcctccggtgttccgtccgccgagatacggcggaagccgagatacgggaagagggattcgggcaggacgatcgagccgtcctcctgctggcactgctcaaggagcgcggccagggtgcgaccgacgggcaggccggagccattgagcgtggcggcgagcttgggcttgccgtccttgccacgggtccggatgttggcccggcgggcctggaaggtgccgaagttggataccgaggagatctcgcggtacgtgttctggctcgggatccagacctcgaggtcgtacgtgagctgggcggagaagcccgtgtcgccggcgggcagcttgatgacccggtaggcgaggccaagctccttgaggcacgcctcggcgtggccaaccatcgtctccagctcggcgtccgccgtctccgggtcgacgatcttgaccatctcgaccttggcaaactggtgctggcggatcagaccgcgggtgtcccggccatacgagccggcctcggagcggaagcacggggtgtgggcggtcatggccagcggcagctcggccggcgggatgatctcgtcggcgtagaggttggtcagcgggacctcggccgtcgggatgaggaagagctcgtggtcggcgacgccggtcttgaacagatcttcctcgaacttcggcagctggccggtaccggtcatggtcttgcgggtgaccaggtaggggaccgcgtactcggtgtacccgtgacggcgggtgtggatgtcgaggaagagcgtggccagggcacgctcaagggcggcgccggcgccgcgggagaccacgaagcgcgggcctgacagcttcgtcgcccgagcgaaatcgagaatcccggttgcctcgccgaggtcgacgtggtccttcggctcgaacgggaaggccggcggagtaccgacccggcgaacctcgaccgcgaagtcctcggagtcaccgtcgggggctgagtcgtctggcaggttcgggatgctgaggaggaggtcgcgaagctgttcctcgacctgttcctgggcagcgtcgatgtcccggatctggtccttcagctcgcgggcccgttccttcagcttggagatgtcgccgccctgcttggccgtctgctggacttcgctcgccacccgcttggactccgcccgcagctcgtcggccgagcggatgttctggttgcggcgggactggagggactccagcccggacaggtccagggagtaaccgcgacgagcgagccgacgaaccgcttcggcacccatttcgatcagggcgcgggcatcatgcatgaggaagatccttctgatccggcgggtgggatacggaatcgacggtagcaaccgccagcccttctccgatccgcaataccgatgcctcaccgcagtcggtggcttcgcgcagcatgcccgaatcaagatcgtccaagagggccgtcatcaggagagggagctcgtcgtctgagatggcgatcggctccaggtgcggggcctcggggaggaacagcggcagagcctctgtcgcggcgcgattctggtaccacacgaggacggacacgagcagtccgtggctgacgaggacacgggggccgggacactcaagcgcgccgagcacacccgtgaccattctgcgtatgccctcgcgttgggactccgtggcaccgggcggacgctcgcgggagccgtgcccgtcgagccagaccgcgtactccaggaatggtttgccctcgaaatccccgtagtcgagctcgttcagtctggcgtcggtcacgtgggcgggggaggggactcccatcaggagggaggcggtctggcgggcccgcggaaagtcgctggtcaaccaggtggccacggagtgcagggggagcctgctccaggcgtcactcagcgctgcccggccttcctcgttcagttggacgggcttggtcgggtcgccgttgacgaggtaccgcctgctgtagtccgtctggccgtgtcggaggatgtacgtggtcatgttccgctccgaggggtcgaggccgagagttgggtgagcacttctgccatcaggggcgcccgcggatcgccggactccacgtagaagaggaggccgtcgacggccaacatgcggcaccagggcgcgaggacggggacgggtatccgcgagacacgcgaggcggcggccagacgtgcctcggtgctgcggcccaggtcgtagtagaccgtccagaacgcccagtcgaacgccgggtcacccaccatgggaaggggatcgatcagccgagggtgtcccagccagtcgaacaggacgttctcgcgatacaggtcggcatgcagcaccgtcgctctccgggagcccgcctccaaatcggcgatgacgggaaggccggtttcgaccaaggagtgccagccgccgaggttgatcttgtgcattcgccgttcaagtcggggctcgacttcttgcgcgagatagtcagcgaggcgcggaagacgatccggtctgcgcctgcgctgcccgaaggtgtgcagaccatggagggctgcggccaccatctgcatctcccgcctgggccggtccgcgccaccgggctgccctccgacgagttcgagggctgccacggccagctcgtcagcggcttccacgacaccgatggtcggtccgccggcccagagccgcagcgcgtccacctcacggtggtagcgggcggggtcgagccatgctttgaggaggagcggacgcccgtcatcgcaggtagccgtcgcgatcaccgaggcgtgtccggcgtcgtggtaggccccgagggtcagcttccagcgcttcgccgcctgcgtcagccgccccggggcggcgtcgagccaccgctgggcggagggcccgtagtgcgcaagcaatcgctgccggcacccggcggggatctctccgagcgtccgcttcgtcatcagctcagcacgatcccgtcggataccagctcgtcggtcagcgcggggaacttgcccagcgtctccgcgacgagggcctgcaccttgtcgacctcggcgtcatgggcggagagacgcaccaggatgcgccacggctgatcgagacgctgaccggtggtgctgaccaggtgcacttccgcgtgcccgttcgtggcctcgtgcagtcgctcggccaggcgctgggcggcgatgttgtagagcttgccgacgtggtagacgggattcttgccgttggcgccctccaggttcatcggccgcagtggcgtgatcagcccgttgacccggttgccgcgcccgaccacgccctcgtcccccgactcgatcgagcttccggtgtacgtcaggtacagctcgtcccgctccggcacgtcgcgggcgttgagccggaagcgtgcctgagcgccgggtatccgcaggttggccacccggtggcactcggccaggacggtctccgcgttgcggacgtactcggcccggctggcgacgtggcgcgacttctgcgggacgcacagcaccacgtcggcctggtcaccgtcccagtagcccatgagcttgacgtcggagccgcaccatgcgcgggcgcgggtgaagtcgctgtccccggagaagtggttgaccagctcgcggacgaaagactcgaatgcgttctccggagcccagccggttcccagcgaggtgtcgttcgacaacctcacccgccgctcgcggaggtcgtctacagagcgcggattgaaccagcgcgtacggtccgggaccctgtcgtccgtcagaacggcacccgggctggagttgctggttatgttgaagacgatgtcaaggtggtccgccacctcgggaagccgctccgcgaagaaggccctgacctcggcctcgactatctcctcgaccgggatcgtctcacccccgcacacgggtgctgcccgcccgttcaccaggacgcgtacaggagccgtcatcctgccggccccgtaccgaacctcgctggccccaccgaggagggcgagcttgtcgaagttgtggtgcaacactgcgccgaagcgcgcgacggtgtggtggctgtaggcgcgggacagccgctcggcgaggtggtctgccagggtgtccgggtgcccgagacccttccgctcgacgatggtcgtcgtgtccggtctggccatggcggtgtcgatgacgaggtggctgttgtcgatgatcgtgctcgtacgaggcatcacgaactccctttcaggggtggtcggaagagaaagcgcaggcgtcgacacgcttggacaagcggtgcagtgaggggttcagcggggaacgtcggcggcacggaggtactcgaccatctgggcaagtgacctgtatgcgggggtagcctgttcctcggcggcgagttggtggatgtcgtgggtggagacgagatcgatgtcctgggtcctacggcgatcgagccagaggagcaggcgccaggcgaggaccgggccgctgaacggcagcctggtcagcaggtcgatcggtacgtgtccggccggcacgccctcgtacagcaggtcgcgcacaaggtggaaggccacgtcggtgtagtcgagcacggccgggccgcaggcactcgcctcccagtcgacgacgtgcagacgcttcccgtcgacgaggaggtgctccggcttgagatcaccatgcaggtgtacgacccggtgcgtgttgatcggccggagggcttcggccagcaccttccaccagggcagccagcggcagcgggcggagaactgatccagcaggaactgacgtgacgaggtagggctggttcgcggtgttccccagccggagcccggggtgatagcagtcgtgggccggtggagcctgccgctcaccgccatgacgtgctcgatgtactccaccgccgcctcgggcgtgtccgtcgagcactgcttgcccgccaccgtgcggaacaccgtccatgacctgccctcaccgtttcccgtggcaagaatcgcggggacggagataccccggagtgcggcgcgctcgatcgtcgtggcctcgcgcaggcgtcggccctcgggctcaatgcccacgtagaccttcagcaaggcaccgccgtccgtggcgaaccgcatcctggagtgcggcttgagcactgccggtccgaatgggccgaactccggttcgatccccgactgcgtcagcttcgtgctgtacacctccacacctccaatcagcgggacgtgtcctactcgcgtccgagaagcaggactgatcatcaaagccagccggttgagacagagttggcggctttgcccggcggcgttctcgctctactgcgacagtaggtacggcgccccgcagcaccctggaaaaactttccggggtcctttccggccacgaggtgatgttcaggacatgcgagggatgacggagaacctgaccatcggcgagcgcgtcgcctggtaccgacgtcggcgtggcctttcccaggaggtcctggccggccttgtcggacgtaccacggactggctgagcaaagcggagaacaaccggatcgagctcgaccgcctctcggtgatcacctcactcgccgaggcgctcgacgtttccctcggagacctgctatccgagccgactctcatggagtggtcgaacgacagcgggcgccgtacggtccccgccctgcgcgaagccctcatggactacaaacagctcacacccttgctcgggcccccacccgacgatgaaccgccgacactggaggatctccgagccaacgtgaaagaagccctcgacgcctaccaggtgtcgcgctacgggttcgccactcggcggcttccgctcgttctggccgatgcacttaccgcgtcccgcgtgtactcgggggacgaaggccggaaggcgtatgcccaactcgccttggcctaccacggtgcggccatggtgctaggcaaggtgggagagtcggaactggcgtggatcgccgccgaccgcggcctcgccgccgcacagcagagcggccagagcacggtgacgggctcgctcctccgggcggtcacacactgcctgatgagtactggccgattcaccgccgcgatccagctggtgaacgacgcggcggacaccatgcagcctggcctgggcgcggcggacgacgaatacctctcggtctacggcacgctcttcctcgccggcgcgatggcggcagccagagcagaggatcgggcgacgacgcagaccttcctccgtgaggccggtgaggccgcacagcgactgggcaccgacgcgaaccatctgtggacggccttcggacctaccaatgtgtccatccactgtgtcgccaccgcaggagagctcggggaccttcagatagccgcggacctcgggcaacgcattgacaccagcggcttgccgacagaacgacgcgtgcggcacagcctggaagtggcccgagcactcagcgcctggaaccggaccgacgaggccctggccactctgctcgacgctgagcagatcgcgccggaacaagtacgccaccactacctgagccgggagctggtcatcggctgggtccgcggcaccaggggccgcccgtcccagtcagtggcagacctggctcgcaggctcggcgtggtcggcggttagagtccgttctgtgaccgagaacgagcacgaagcgaagatggcccacccgcgcatggcggccggcgcgctgttcttcgatgacgccgaccgggttctgctcgtcgagccctcctacaaggactaccgcgatatcccaggggggtacgtcgagcatggggagtcccccatgcaagcctgcgtgcgcgaggtccatgaggagctgggcatcaggcccgccatcaggcgcctgctcgtcgtggactgggcaccgaacccgggagagggcgacaaggtcctctaccttttcgacgggggccgcatcagcgccgacgaatgccagcacatcgtgctacaggacaacgagctccgcagctacgccttccacgatgtcagagagctgccgggactcaccatcccccgcctcgtacgtcgcatcaccgcaggtatcgaagcccacgccagcggtgtgaccgcctatctggagcatggaacggctccggaagcagtaggcggtacaggaccggggaagtaagagagagacgtacacccccaagactgaacggggctgtggctggcaccaacctggtccccttggagggccagcaacatcggtgccagcatgacgtatgattgggacaccgacgcggggtggagcagctcggtagctcgctgggctcataacccagaggtcgcaggttcaaatcctgtccccgctacgagtgcgatgtctcaagggcatccaggacggccgaccctgcaagttgcggggtcggccgtctgttgtttcagcggatgaggccggggggtgccccccccgatagctcacctgtgccccgcatcgaccacctcagaaggccccccgccagacacgatcccgcgcaggcccccggtgcctcgggtgtgctcgtggttggcaccagcaattcgcgacgagcggctaaggttgtgttgtgacggactctacgtttactcccagtggccccgagcatcagaaggtgcgggtgccggtgcttaagagcctcctggaggcaggttgggattcgggtcagctgcagtggaagcctgaatggcgagtaccgcagtcacctcacgacgccgcgaagcgggaggacgggaaagccttcgctgggtggcctgtcgaccttgccatctttgacgatgtgcggaacgcaggtgattgggaacaccttctagtcatctgcgagttcaagcagccgacgatcgatgcaggtatctcgcagcttgagatctatctcacccgcgagccgcgggcgcggatgggttattggaccaacggctccgacaacgtcagagtctataagctggccgacggtaattttcagcatgttcgaaatcacggcctgccgcagccgggtgaaggcttcactcggccctccgaaaagccgctgacgttcagtgacttggttacgcccaagagtgggcagctgcggtcaatctttggccgcctactggatgtagtggttgcgagagacagtcgatcgactcgttcggaagcgcaactaaacgaactgtgcaacctcttgctgcttaagctggagtcagattcaaacgcttcatatgatcacgacaagccagtcgctttccagctctcgcaggctggtgaaccagccacagctaaggcgatgcgggcacagttcgaggctcttaagaacttccgtccagaagtatttgctgaccatcgagaaggcgccctcgagttggatgatcacaccattcaggaggcggtgtacgagctttccagcttgaacctgaatgatgtggggcctgaggcgatctcgtctgccttccaggtattccgtagggcgaacctgaaagctggtgaagggcagtacttcactccgcagcgtgtaatcgctgctgccgttagaatgatggatatccgcctggaagacagaattatcgacccggcatgtggaactggcggattcctcaccgaagcctttctttcgctggtcgatcgaatctctgccggcgactctgccgccgcagcgagaacttgggcacatcggaatgtctatggagtggacaaggactccatcaacgtcaagctcactcgggcgatcatggtaggtattggcgacgggtccgtcaatgtgcacatcggtgactcgataaggggtgataggtgggcaaaggattatccgcaacttgagcggcctctcagcgacgggtcgttcacggttgtgattacaaacccgcctttcggtaagaacctaaaggtcagcaaggttgatgcgcgccgcaacggttacagcattgccgctgcggcaaaccggaagccgggagagtacgcggatctcgaaattggcctcgtctttcttgagcgctcgtacagactcctaatgaagggaggtaggcttgggatcattctgcccgaaacttacttcttttcgcctacatataaatggctgccggaatggttgagtgaccggttcgctttgcgaggcgtcctcaatatccccatggaagctttccaggggttctgtcgagcaaagaccaatttctacgtctttgagaagaagtgatttccgtggtgcataggccagcttggttccgcgagggtcaggttttcgtttcatacgccccgaccgtgggtatcaataaggatggcgaggatctattcgtcgttgctgctgatactggaactcgaacagatgtaatcgacgaccagatcgctgcagatgtcgctactctggtggacgagtttggcacgacggatacaagccgctgggtggacgagagtgagttcactgggcagctaactgccgttccgaactatttcgacgagcgttcagttcgtgacttcttcgcgctcatggacacccccgagatgaggaatttcacgagcgcttccatcggggaactgattgacgacggagtcctggactcgatgcatgggcacgggagtccgtcggcagactttcgaactgggcacgtcccatacatcaaagtctccgatattcgcgccggacaggttaatattaatccgacaaatcgcgttcccgatgtggtcgccgagcgtttctggaaggggagcgaatctggactcgaagagtacgacctgatcactccgatccggaccagcaagaacatcggtgactttgcggtaatcatgcctgggcaagagagggtcgtgctaactaaggaggtgctggtgcttcgtgcttcggagtccgcccccttcgataacttttatctcttgtgggccatgacgctgaaagccgtgcgtcggcagtgggatcgcgtcgttttcatgcagaccaaccgcgaagacgtcggtcggaggtatcgggaaattcgtatccctgttcctcggagtcgcgaggcggccgacgatgtctcgaaagcatttagggattactacctggggacgcagcggctgcgagagaacctggtgggttacctggcgaacgacgacaagcatcacatcttcatgtcgagcgcggctgcagtcgtggaagaccttgatggagaggctgacgaggtcgagtaacggctcggcggttcatgtctgctgcggtgacggcgctgatctgcgtgagcgatgcgtgagcggacggtccggtatccgttggactgggtgtcagggcgccgaacccggccagccttctgaccaggcaaaatcggatcggctgagagcacagaccagtacccggcacgatcgtgcaggctctcgtaatgcgtaggtctcgggttcgaatcccgaaggcggctcattcgaagcccagctcagatgtctctgagctgggcttccgtggttgtcgggatgattccggccgaggtcactcctccaggccgtggccccagatccatgcggcgatgccgacccgattgcggacgctcagcttgcgctggatgttggcgacgtgcgtcttggccgtgccggccgagatgaacaactcggctccgatctccgcgttggtcattcccttggcgaccaggcgggcgatctgtgtctccctgcccgtcagcgcgtccttcggctgcacgggcctgggcctgccggcgtcgcggtggtgctgcagcagggccacggtgagggaggggctgatcagcgtgtcgcccgccatcgcggcgcgcaccgcctccaccagcagcgtcgggccggagcgcttcaggaggaagccgcaggcgccgttgcgcagtgcggtgtggacgtactcgtcgagtccgaaggtcgtcaccaccaccacgcgcatcggatgctcggcgtcgggtccggcgagccggcgggtgacctccaggccgtccaggcgcggcatgcggatgtcggccagcacgacgtccgggttcagctgcgcggcgagctcgacggcccgcagtccgtcggatgcctcgccgatcacctccatgtcgggctgggaatccaggatgaggcggaatccgacgcgtacggattcctggtcgtcggcgaggagtatgcgaactgtcacggtcggcacgctagttcgacttcgtcccgttcggtcaacggaaccgtacgcgcgtcatgccggccacacggtgtttgccgtccggcacatccgtcgtccggcaggcgggccgcgtacgcggcggtcgccgtccccctgttgtacgccaccacccggtgggcctgggccctgggcattccgctcgtcatctccgaggagctccgcaagcgctgcacccgcggctgagccgagcggagacggatcggtacggcgatgccatgtcctcagtccagtggcaggaccgcggtgacccgccagccgtgctccgcgtgaacaccgaactccagggtccccccgagcgcgcgggcgcgttcggcgagccctttcaggccgctggtcccgtgttgttcccggtcgccgagtcgcgcgtcgtccgtctcgccaccggcgggagggccgttggtcacggtcacggtgagcaccggctccgggcgctcgggtccgggggtcacggacacggtcacccacggtgcggtggcggcgtgccgccgtatgttggtcaaggcctccaccaccacgcggtgggccgtgctcgccgcttcgcgggggatccggccgatccgctcgggcgaccggtccatgtccaggcgcacttcggcccggccggccgtgcggaaccggtccactacctccacgatgtcctccaggctgtacgccaccggcggtgtcgcgtccgtcgcgctccggccggccggggtcgttccctcggaggacctgagcatgtggaccgtacggtccatggagccgagggcctggaggccggaggcctcgatctgccggaggagtggcagaacctcctccggccggtccgcgccgatcacctgtgcggcctgcgccagcacgacgatgcccgatacgtcatgggccacgaagtcgtgaagatcgcccgccagttggaggcgctggctgcggcgggcctcgtgcaccgcccggatccttcgggtctccagggtgcgcagaccgccgccggcggcggcagcggcgatggcgccgagcgcgaagaacgagctctgcgcggcggcttccatcacggtcggggggagttggagccgcaggagtgccgtcgacgccaggactccgagcacggtgcagagcacgaaggcctgccgggtaccggcgtaccgggctacgaggcagatgagcagcagaagcccggtgatctccaccagggtggcgacgccggtcgccgtctccagggtcggggggtccccgagcagggtgccgagggcggagctcacggccaccacggcggcggccgccgggatgatccggtccctggtgtgcagggaggccacggtgagcgcgcccagcaccgcgaccgtcatgggcagggccgcgcgccagccggctgacgggcccgccagcagaccggccggcaccacgcagaatgccaggaccgcgcagaccgggccgacggcacgctcccggaggcggcctcgggcgcggttccccgtgttcgtccccacccccggattctacgtaacccgtcaggttctcctcctttctgtcggctcggtggagccggaacccccaactgctggtgcagggcgcgatattcttcgagctagcaggcctcgaacgatcggtggccccggccgcggaggacctcgtggcgacgaccctgccgcggatacacccgtcatccggatccccatcactccaactccccgtcgagcggctccctatcgcccggagccgcgcggcccgaaggatgaccggatgaacgtcggagcccaccgcgccggaccgtcggccaacgtcgtggcggacggatggctgcgccgctaccccgcgacggcgggcgtacgccgcaggctgctggtcctgccgcacgcgggcggctcggccggcttcttccactcctggggcaccgcgttcgacggcggtacggagcttcttgtcgcgcgctaccccggacgccaggaccggctgggcgacccctgcatcacggtgatggacgagctggccgaccgggtgaccgaagcggtcctccccttccacgacgtaccgctgtcgctcttcggccacagcatgggggcctcgctcgcctacgaggtggcgctgcgcctggggcaccggcacgggaggagcccggcggcgctgcatgtgtcgagccgcaggccgccgcaccgcctgaccccgcgggccctgcacgaacagggcgacgaagcactgatcgaggaggtgcgtcggctcggcggcaccgacgagtcggtcctccgcgacccggacctccgggagatcatcctgcccgccatccgcggcgacttcacgatcgtcgggacctatggtccgcgccccgccgatccggtcggctgccccgtgtacgcgtacatcggggacgaggacccgggcacctcggcggaggacatgtcggcgtgggccgacgtcgcgtccggcggcttccggctggacgtcctgcccggaggtcacttctacctggtcgagcagcgcgagccgctgctccggtcggtcctcgcccgcctgcaccccgccgacgacggcccccgccttccctgaccctgtctccggccggatccgcatgaagcgccggtccccggggctcctatccttggcgggcgcgcacgtctccggccgggcgcgaacgaccgcaggggacaaggccatcgggggatcgggtcagcatgggcgagggcacgggcaaggacagcgggcggtacacggcgatggagggcatacgtccgcttacggccggtgacccggcccggatcgggccgtatcccctgctcggccggctcggtgcgggcgggatgggc

SEQ ID NO: 3110 - DNA, 3836 bp, Unknown
  Kingdom: Bacteria, Phylum: Actinobacteria, Class: Actinobacteria, Order: Streptomycetales, Family: Streptomycetaceae, Genus: Streptomyces
gcgcaggagcgggaccgcggtcaggcgcgtgcacgcgtacggaaccgggccggccgctggctggtctgccacgcctcctgcctgcgggaggcgggcggcgggctcggcgcgtccgcggtggtgatcgagcccgcgaagacctcggagatcgtcccgctgatcgtggacgcgtacgaactcaccgaccgggagacggaggtgacccagtacatcgcacgcggcctcccgaccggcgagatcgccgatcggctgcacctctccccgcacacggtccgggaccacatcaaggcggtcttcgagaaggtcggggtctccagccgcggcgaactggtgggcaaactgttcaccgagtactacgcgccgcccgcggagaagaagatgacgcgggtccacaccggctgaacgacggacgacgcaccgacgcagcgacaccactcccccattcgccccgggtcgcgcgtgcggggcactcctgagaacggtgcacgccttcggtatgttctccggccacgacggcagggaaccggaccatcggaataggcgcgtagtcgccccctccgcccggcccggccacgccgaagaagccgccagcacaccggaaggcaccacaactcgccgtgtccgaacgggaaacgacccccaccgccgacatcccgccaaggccgccgcacccggacggaggattttcggtcgtcggccgggggcggcacttcacccacttcgtccgaatgtcggcgagggccctcccgccgagccggtcccgtcagtccacgacccgtgctccggcccgggcgcgggcggcgcggacgcccggcaggccgagcggaaccggaccgtcttcgtgactcggcgtggtccgccggccgcgcggatggccttccccggctccgtcaggcccaggggtcgaaggggatcccggcgggcttggagttgtcgagcagatgacggaagcggtcgtccttgtcggtgaccttgatggtcgcggacccgaagtcggcgttcatgagcttgtcgcgcaactccgtgctggggaagccgttccagtcgacgaccggggggtagcgccagttgccgtagtggttctcgggcggctcgtcgttgccgttggcgaggcggaagaagtgcgtactcggaccgtccttgtggtagacggccttggggtgcgagccgtcgaaccgcacctgcgagcgcggataggtcttcaccgtgctgtgctgcgtcgtcgagacgtaatccacctggccggagccctggttgacccaggagatcacatgctcgaagtcgtggcggtgcccgccgagcccgctgccgtggacggcctggtccttctcgaagtagctcgcgtagacgatgccgcaccagccgttgttgcacttcgagcgtgcgtacgtctgggagttgtccaggtcccactggtcgcggcaactgccgttgatcgcgccggtcgtcttcaggccgggcgcgagggtgccgtccgggccgatggcgggggtggcgtagcagccgtccccgtcgtagtcgaaggcgggcgagaacgcctgctcgtaaccgcccgcgttctgggggaggttgcccggcggatcggcgtgggccgtggaggccggaatcaggacgaacagggccgtggcggcgaggaccgctccgacgcgggtggacagggccctggcgcgggcgaccggcccgggggcggcggggccggatggggacggattgcgcatgctgcctctctccttgctgaatgtcgctggatgtcgccggatgtcgtggaggcggtggccccgcttccgcgtggggcacctgtcgcagtctgatggaagatcccggcagttgtccgtacacggtcactacttttcatgacgcggcggcgacatcgcggcccttgacctggaacgcactcgaagtcctacagtgcgggaggtccggcccagctcaccgcacacccaccagggagctcgaccatgctctaccgcacactcggcggcaccggcatcgaggtcagcgcgcactgtctcggcacgatgatgttcggctcggtcggcaatcccgaccacgacgactccgtacgcgtcatccatgccgccctcgacgcgggcatcaacttcgtcgacaccgcggacatgtactccgccggggagtccgagacgatcgtcggcaaggcgctgaagggacggcgcgacgacgtcgttctcgccaccaaggtccacttccccatgggcgaaggacccaaccggggtggaaactcacggcgttggatcgtccaggaggtcgaggagagcctgcgccgcctcggcaccgaccgcatcgacctctaccaggtccaccgccccgaccacaccacggacgtcgaggagaccctctcggcgctgaccgacctcgtgcgcgcgggcaagatccgcgccttcggctgctcgacgttcccggccgaggagatcgtggagtcgcacgtcgtggccgaacggcgcggcctcgggcggttccggaccgagcagccgccgtactcgatcctcgcccgcggcatcgagcggtccgtcctgccggtctgcgggcgctacggaatgggcgtgctgacctggagcccgctcgcctccggcttcctgaccgggaagtaccgcaagggcggaaccatcgacctgtccacgggacgggcggcgctcaccccgcaccggttcgacccggaggccccgcggaccgccgccaagctggaggtcgtcgagcagctcgtcgccgtggccgacagcatcgggaccaccttgcccgagctggcggtcgccttccccctggcgcacccggcggtgacctcggtgatcatcggcccgcgcacgatggagcagttggagggtctggtgaagggagcctcgctcacgctggacgacgagacgctcgaccgcatcgacgcgatcgtcgcgcccgggaccgacgtctatccgccggacggcgcgtggaccccgccctccctgaccgacgtcgcccggcgcaggcgaccggtgggcgagcgcgcggcggcgtaggggacgggagcggactccccccgcggcacggcgcggggggacggggacggagggccccgccgtgcagcgcgtcaggagtggccgatcacgcctgcgcagcggcgtccggcttgtgggccaggaagccggcgaccggccgcttcgcgcctgctgccggctcctgcagcgtccgtcccgtgaccacgaaccccgctcgctccagcagctcggcgatccgctccgccggcagccggtagctgtcgaaggagacggcggggcccccgtagccgtgtgtcagacgccggtgcccgtcgtcgccgacccgggtgacgatcagcaggtacccaccggccgccagcgtccggtggaactcggcgaacaccccgggcagcgcctccgccggcagatgatgcgtggagtagaacgccaggacgccgccgagttcgccgtcgccggtctccagcgcggtcatcgaaccgacgtcgaagcgcagttccggataggccgcgcgggccagcccgaccatcctcggcgacagatcgaccccgaaggcggagacccccagcccggtcagatacgcggtcaccttgcccggtccgcagcccacgtcctccgtcggcccgcggtccgccgacgtgacgagctcggcgaacgcggccagcacggcgcgcgacaacgggtccagctcgctcggatccttgacggtccgggcgtagtcggcggcgacggcgtcgtacgactgccggatcgcgtccgggtacgggggttccatcccgcccacgctatgtccccggcggcctcgaaggccatgggcccgttgagcggcgcagggcgaggcgagccggggac

SEQ ID NO: 3111 - DNA, 3899 bp, Unknown
  Kingdom: Bacteria, Phylum: Actinobacteria, Class: Actinobacteria, Order: Streptomycetales, Family: Streptomycetaceae, Genus: Streptomyces
ttctgcgttccaggaccgatcggaactgaggagaatccggagaaccgatctgctccagctggggtctcctcggcccccgggccgacagacagcggatcctgtctcgctggaaccggcagggcagctgccgagccataactctccggcagattcctcagagacggcctgcggccttcagcgccaagtaggtgtcggcaagcgtgggagcgagattccccggagtggcgtccaccacgacgacgccatggcggcggagcctgtcggccgtgcggcgacggtcggcctgggcctgaccggctgctgccgcgtcgtacaccgattcgacggttccccgggccttggccatttcctcgatccgagggtcggagaccgctgccagcaggacggtatggcgctgggtgagttgaggcagcaccgggagcagcccctcctcgatgggggcggcctccaacgtcgtgaggaggacgatcagtgaaccgcggggcgcgtcggtgagggcggcattactcaggccgcgggcatccgtctcgatgagctcgggttccagcgtggccagggtgttgatgacggtggccagaacgttgcccgtggccgtccggccttgtacgcgggctcggacctggcggtcgtaggcgaggaggctaacgcggtcgcccgcccgggaggctagcgcggtgagaagaagtgtggcgtccatcgaggcgtccagacgggggacgtcacccacccggcccgctgacgtgcgcccggtgtcgaggacgatcaggatgtgccggtcacgctcggggcgccacgtccggaccgctacggcggactggcgtgcggtggcccgccagtcgatggagcgggtgtcgtccccgggcacgtaggcccgcagactgtcgaactccgtgccttcaccgcgtgtcaggacgctggtgcggccgtcgagttcccggagccgggcgagccgggaaggcagatgcttgcggctggtgaacggtggcaggacacgtacggtccacggcgcccggtgctgcccttggcgggcagcgaggcccagcgggccgtacgagcggatcgtgatgcgttccgcctgccgttcgccgcgtcgggtcgggcgcagaacggtgaccagacgtcgtcgttctccggcggggatcgtcagtgtgtggcgggaagcgcggcgttcggagcccgaggtccagctgctggggggccaggcatcccgcagctgggcgcgcagacgtcgacgcgaggtgttggtcactgtcagttccacttcggccgcgtcaccgagtcgaacagatgtatcgccggatcgagtgaatcgaagcgtgcgcactggcgcggccagggcatagtcacacagaattgccagtgagagcggtgcgttgaccgcaagcatcccggtccagctgggagcgaggatgcctacggggagtgaccccagggcggccagcagcgcggtacgtccggtgagggccatggtcaccgcctcatcggggtacggggacatgggcgagcactgaggcgatgacggagtccggggtgactccttccatttccgcctcgggccgcaggtggatgcgatgacggagcgtggggagcgccagggccttcacgtcgtccgggatgacatagtcccggccggtcagccaggcccaggcgcgggcggtcgacagcagtgcggtggtgcctcggggggagacgccgagggcgagcgagggggaatcgcgcgtggcacggcagatatccactacatagccggcgatctcgggggagacggtcgtcttcgcgacggcttcgcgtgctgcttccagatcagcgggtccggcgacgggccgtatccccgcggccttcaggtcgcgcgggttgaagccgtcggcgtgacgggtgaggacgtggatctcgtcctgccgcgaaggaagcggaaccgtcagtttgagcaggaagcggtccagctgggcttcaggaaggggataggtgccttcgtactcgacggggttctgggtcgcggcgacgaggaaggggtcgggcagtggccgtggtgttccgtccacggtgacctgcctttcctccatcgcttcgagaagggaggactgggtcttgggaggggtgcggttgatctcgtcggcgatcagcaggttggtgaagacggggccgggctggaaggagaactcggcggtgcgcgcgtcgtagaccagtgaacccgtgacgtcgctgggcatcaggtcgggggtgaactggacgcgcttcgtgtcgagttcgagtgatgcggcaagcgcgcgaaccagcagggtcttggccacgccgggtacgccttcgaggagtacgtgtccccggcagagcagcgcgacgacgagtccggtgacggcggggtcctggccgacgacggccttggcgatctcggagcgcagggcttccaaggatgcgcgggcgctgtcggacggctccgcttccgcgggcctcacggtggccgctgcgggtgccgtgggctcggccggctcgggggtcggggtgctcatgaagtgcgtacctctctttcgagggcgtcgagttgatcggcgaggaggaccagagaggtgtcggtggagggggccgcgccgaagagcagggtgctgacgtcgtggtccggggtggtgatgcgtgcggacacggcggcgaggaggacatcgggagtgtgcgcatcacgagcgggcactccggcaaggggggcgatgcgtgtgcgggtggcggctcggagggcgtcggcggctcggtcgcgagcgttggccttgcggtagaggagggagcggccttcggccgattcggatgcccggatggctaccggcagccgttctgtcaccagggggccgagtcggcgggcccgccagacggcggcgaggactgcggcgatggtgagttgcagagttccccacagccagccggaggggacgaggtcgaggaagctgctctcgtcggccgcatcgtccctcgctccgccctccggctgttcctcgttctcgctgcccggcgagtcgtcatcgattgttgcggatggatccgtgagcgaggggaggtaccagacgagatggggacgggagccgaggagttgcagggcgagcgaggcgttgccctgcttgtcgagacgctcgttgtggaggaagtcgggggcgccgaggatgacggtgtcgcctcccgccccggtcgggaggacgaccagactggggcggcccgcagccgggtagcaggtgacggcggcgggggcctgcgtcgtgtagcggatgccgcccatgtccgctgcgccggccagacgggcggcggggagctcgcaggacggggcgagagcactgacggcgtggtgcggctcggcgcggacgccgggggcgagccgggtggtggctgccgggcccggggctatcagcagggtgcgtcctgcggaggcggaggccgtctcgtccagtcggagctgctgcgaccgtgtcaggagattgggaccggcgaccaggagtgtggcgtcggagccggtcgcggcggtggcctcgtcgagagtggtggcgacggtgacggatatgccgtgtgccttgaggagttcggccacggcgcggctgcccttggggtccgcggagcgggggtcgagctgtccgtggttcgttccggaatgtacgacggcgaacgtgatgccggcgacgacgaggatgaggacgacggccaggacgcctcgggcgcgggtccagacctggccgggcgtgggcgccgtcgaggtgggggaggcggtggtcgccgcggtcatccggtggctcctcgggaggttccgggcagcagcggctttgcctcgtccagttcgaggtcgagggtgcgcagggacaggtatgtcggctggtccgcggtgcggcccccgtatgtcacgtcgtcgaagctccgggcggcggcgcgca

SEQ ID NO: 3112 - DNA, 9377 bp, Unknown
  Kingdom: Bacteria, Phylum: Actinobacteria, Class: Actinobacteria, Order: Streptomycetales, Family: Streptomycetaceae, Genus: Streptomyces
gccgaagaaccggccggtgaggggagcgtgggtcggccgccacaacgttcgtcgaagcccaccccgcgcaacccgcccacctcgcaggcctcgaaggcgtcgcccgaggaccgccggggcgcggcgcgcgacaccctcgcgcactgccgcgtccaccttgcggcgatcgaggggcggggcaagccgtccggtgacgcggcgacaagcctgctcgcggacgcggcgggcggcccggaggccgtaccgggctactgcgaacggctgttggcgggagagccgcaggagaagacggggaccaacgggacggagaagagcccggaacgttccgcgaagccagggccgaaggatcggccggtaccgcccggcccaggcgcggcacgagaccccaaggagcagcggtgacacagctttcgcccactgatggtcagggccgctacggcttgatgttctggttcacatggaacaggttgccggggtcgtacgcccgcttgacctcgacgaggcgttcgtagttgccccggtagttggccctgatccggtcctggtcgtcctcggccatgaagttgatgtacccgccttcctccgagtgcggagcggtggcctcgtagtagtcgcgcacccaggcggcgttggcctcgttgtcggcggggtccggccacattccggcgatgacggtggcgaacgtggcatcccggtaggcgaaggctgtgtcctcctgcgccacgcggtggcaggcaccgttgatcgggtagatgtgcaccgtcgaattcacggcgggcagccgaggcgcgtgaccgaggtgtgccgtgatcgccgcgtcactcagctctgttacgaaattggctttccagtagtgctgaaggccgggcggaaccagcgcgtcgaaagcgctgttgagcgcggaatacggcatcggaccgacgtgctcggccaccaccggtgcgatgtcgcggaaccgctggacggcccgctctccctcatccatgggaccggcccagcacgccacgatcaggatgaaggtgtcgccgtgccggttctccggtatgaacggcagtggcggggcgatctggaaggcggggaacccgccgagttcctccggggcctcggcgatgagttcgcggaacgcacgcagaaccgtgccggcgtcctccaactcgtagaggatgggcccgccatagatgtccttgaccggactgagccggaattcgaacgatgtcaccgcgccgaagttgccgccgccgccgcggatggcccagaaaaggtcgtcgtgttcgtgctcgctcgcgacgagcagcctgccgtccgcggtcaccacatcggccgagatcaggttgtcgcaggtcaggcccaggctgcgggcgaggtacccgatgccgccaccgagggtgagtcccccgacgccggtggtggagatgatcccacccgtggtcgccagaccgaaggcgcccgtcgccgcgtcgaagtcgccccaggtcgcgccgccgtccacccgcgcggtccgtcgtccgggatcgacgcggacgccccgcatgccggacagatcggccaccacaccgtcgtcgcaggtcccgaaaccgggcacactgtgcccaccaccacgcaccgcgaggtccagcccgttgtcacgcgcgaagtcgaccgcggccatgacatcgcccgcatgggcacaccgcaccacggccgccgggaaccggtcgatcatgccgttgtgaaccttgcgcgcttcgtcgtagccctcgctgtcaggagcgaccaccggcccccgtacgcggtcccgcaacccttcgatcgatgagttgttcaccaacctcactccttgcgcgtcattgccgcgaattccggagttccccagccttcgacgccggtcgccccatgcacaccggccactccgtgacctggctgcccccgacccaggcgtttccacgctacgccgatgagccggatgctcaactcgacagcctcgggcacgtccacacggccggccgtcaagagaaaccggtaccggtaagggaaaccggtaccggtaagggaagggggctgccggcgggccgtccggtcatacctgcatggccatgggcaagggaatccggccgctgctgcgcggggcctgggggagacaacgggccctcatgaccaggccgagcagccctcaaagtcctccaacgagatttccgcgacggccgcgtccgttacagcctccaggtcagggatgtaggggcggacgtcgggaagcggcgtgcagaaggtgacgttggaggtgaggagggactcctcggtatcggcgaaggagagggagacgtacgccttcacccgggtgtcaccgaactcctcctgcgctttccgaaggcaggcgcatacatacgccaggcacctccggacgagaaggggtgtgcgttcgtgcggtgcggccgggaggtcgtagtcggtcatcccccttccgttgaccgccgtctcctccgcaagccggtcgacgtgggtgccgggcgcctccggacggaggccggtcagcacgcgcccaccggcggcagtgagagaccacccgcgctccatgacctcaaggaacatgcggggaatgtcctgatcgctcagttcggtgacgtctgtcgtccgcaggatctcccgcatccgaggattgcttcgcatgcctgtccctcgccgagtgcgacgagacccaaaaaaagtttgtgtccggtgacgcgatctgttggtccgtaggaaccgggcgcaggaattgcccacgcggcccggggcagcgtaggcaggagcctggctcagcgcgaggcgttccgctccgccgaccacacggcggattttcgaaccgcggggccgtcgacgtggaccgcgcccgccacgtaagcggcccagagcagatcctggcacccgaagaaggactccccccaactgtccacccagacatggatgcgggacggcccgaccggtgtggcgtcccaccactcccagccgcgggagtcctcgtcgggatcgaagcggtacagccagtcctgcagttcccacgggcggccgcccccggtgtgctccgcataccggtcgcacccgtcccgtgcgaactgcggtgcctgctccgggtcctgggaacccaccgcggcgaaccagtccggaacatcatcgaccgggaggctgtcctgctcgaagtccgccgtgccgcccagccgcacggcgggtgagatcaccgatcgcaggcgccgtgcgtactccgcggcatccccttgagcgtcgatgacgaagagggagaggacagggggcgcggcatcggcactcggtcgatcccggagccgctggagttcggcggccaagctgtcgatggtgtgcatcatttgaggagaatcacccttcttggaccacgcgtcccgatccggggacaatagcatccctcaacccgtcgagcagtttgtcgggaattccgtacaggtgcggccccttggtcgggtcagagatttctggatattccttcaagagagctttccattcctgtcgggtgaatgcgtcaccgtcggggtggtccgccttgttctgcggaagtgcgttctcgtgaatggaatcgcgatacgacttggggacttcgtaggacacgatctgcccgccgtccgaacggaattcgacggtgtgcttcatgtccccactcatattgaggtacagcttgccgtgcccggtgatcgtcacttcgccgttgtcgccgatatggacgcgctggctcagcggatggtccgtctgtttgcggtagaccgtcaccgtctcgtccgggcacccgacaggtgcgagtccgagtgggtcggccgaggtgtgcgggttgttgacgtaggtcgcggggttcggggcgggcacgagcccgagcgggtccggcgtcaggtaccgggcggtctccgggtcgtagtggcggaagtagttgtagtgcagaccggtttccggatcgaagtactgaccggggaagcgcaacggggtgtatgcggtggagttgcgcgcccacgtggtcgtaccccacaacgtggtgcgtgagcgccaggcgatgtcgccggactcgtcgacgagttcggtgggtgtgccgacgaggtcggtgacgatggcgaagaagcgccggtccacttcttcctgggaagcgtcggccgtggtgatgcgttcggtctgggccagcggacgcatgccggagtggtcccaggtcaggacgaccgggtggggcaggccggtggaggaggtggtctgttcgcagagggtgttgccgtcccaggtgaaggtggtctgctcggcgacggtgacgccgtcaggagccagacgctgcttcgccgtccggcggccgagcggatcgtagaggtagcgccaccgggtgccgtccggggtgacgacgccggtgaggcggtcctcggcgtcccaggtgtagcgccaggtgtcggctttgcgtgacagccgggtcttccggcgcaggacgatgcggccggcggcgtcgtgctcgtaacggacgtcaccggcgcgggtgatgcgggtcccggtatacgtgcgcgggccggtcgcctcctgcccgggcatggacgcgggccatgaggccgcggtctggttccccgcctcgtcgtaggcgtacgtctcgctccagccgtccgcgtggaccgcggtgacgcggccggtcgggtcgaggtcgaagcgccggggtcctgagagctcgtcatcgatcccgaccagcatcccgtcggcacggtagtcgtacgtacggtggttgaggctgcgccctccggacgaggtctcctgcccggcgacgcgtcccgccgcgtcccactcggtcgtgaacgtgagcatctctccgaaccggcgcgacagttcgcggccggcggagtcacggtcgaagttcacctcgtgaccgccgctggtctgccggacgagctgcccggccgcgtcgtacgtgtaggtggtgacctgcccgctgggggtcacccggcgggtgcggcggcccagcgcgtcgtaggcgtgcgtggtgacccggccgtcggccagctccgtcttgacccggccgctgcggtcgtactggtagctgaggtccccgtccgggccggaggcgtggagcagttggccgccgggggcgtacgcgtaactggtggtccggccgtccacgctcttgcgggtcacccgtccggcgaggtcgcgctcgtagtggatcgtctcgcccatgggcgtggtgcgacggaccacctggccgagaggatccaggtcgtagcggagttcgcgcccgtcgaagtccgtctcggcgatcacccggcccgcggcgtcgtacgcgtaactccactccagtccctgggggttggtcacccgggtcaggcggagctccgcgtcgtggtcgaacgtgtggcggtagccgtccgggccggttcgagcagtgaggaggtcgaagtggccgtactcgtagcgggtggtgcggcccagggggtcggtgtgggtgaggcagttgccctcgccgtcccaggtccacgactcgacggcgccgtcgggcgcggtacggcgggagagcaggccgtcggcgttccactcgaagcgggtggccgctcccgaagcgtcgacggactccaggaggcggccgaagacgtcgcgccggtagcgggtcgtggagctgagcgggccggtcacctccagcggcaggcccgcacggtcgcagcgtacggtcgtgacctcccccgcggcgtcgacgacggtgacggggcgcccgcaagcgtcgtaggtgtagcgcgtggtccggccggcggggtcggtgaccgaaatcctgttgccccggtcgtcgaactcctgccgccagcggacaccgccgggtgcggtgatcccggtcgcatggcccgaagagtcccgctcggcgtggatcgtgctgccgtcggggcgggtgagcgaggagagcaggccctcctcgtcgtaggcgtagacggtggtccgcccgagcgggtccgtccggctgatccggttgccgtgcgtgtcgtaggtgaagcgggtggtgtggcccagcgggtcggtggtcgcgaggacacggtttcccgcgccgatgaggtggcgcgtggtgtggccctcggcggtggtcagggtggtggtgcggtgccctgtcgcgggatcgggccggccgtagtcgagcgtgacgtggaagtggcccgcctcgccgccctcggaggtcacccggtgctgatcgtcgtacgtgtaggcgtagcggcggccgttggagtcggcccagcccgtgaccctgccgtggtcgtcgtacgcgaaggtgagggtggcgccggagggctgggtgacctcggtgaggttgccgtccgtgtagccgtaggccatgacgggcctgcccggcccgtcgcccgttccggtcagcgcgagcgcggtgacgcggctgtcgacggtcgtcagggacaggtggtagccggccgagtggacgagtgccaggggcgtgccgtcgtcggtgcggtcgatgctgatggtgttgctgttgcggtcgctggtctggacgagccaggcggtgccgtcgtcccccggttccaccccgggagggcctgcgaagtgcctggtcagcccggtgtccgggtcggtgagcgtgtagtcgccggcgtcgtcgcggctcagggggctccgggaggtcccggattccggatacgtcggcaaccccggtaccgggtgcgggtaggtgatgagcagtccgtcgtcggtgacgtggatgacgccgttggcgtcgatctccaggcgtccgtcgacggtggaggaccaggagggcccgaagaaccggcccgcggtgtagccggattccacccggcgggtgaaggccaggggcagcaccccggggagcaccacatcggtctgcggcaggtacatgcgcccggaggcgaggtcgaccgggtcggtgcccccgctcgtacgttcaccgtcgggccggttatgggtgccttcgggagcggcgttctccagtttgcgggcgtcggaggcgaggtcggcggcctccttcaccacccgggctcccttgacacccgcccccgcgccgccggtggcgacggtgagcgccaggtcgggcaggagccgcccgaacccttcggcggggtccttcatgaacccgtcgatcatctgcttgccggtgccccaggggtcgttggcgacccggacgagcccggcggcggtgttgttgagcgcgagcgcgtactccgcggggtgcgtgatgttgtacgggtccgtggggttgacgctgcgcgcgaagttcacgatgccggccgcacccttgacgacgccgcccgcgatgtgggtctggatcacctggtactcggcgagcccgtccatggcctgctcggagtaccgcggcttctccggcgcggagtcccgcgccgccgtcaccgccttgcgggcgatgtcggcggcggtgttgcgctgcttgcgcgcctccgcgagcagcgactgggcctcctccatccgccctgttcccgggtcgctgaaggtgccgggcttgggcggcagcgaggaaggatcacgctggtcggagggcttggcgttgtaggcgtcgacggccttgttgtacgtggtcgtcttctcgttgtacgcgtccctggcgtcctcggacgccttggtcccggccttccacttgtcgatcgcggtctgcgcctgtccctgcgcccactccacggtccccgcgaacgagtcgagcgcaccggcggccttctcgaaggcgtcggcggccttgaaccacttcggcggctcgatcgacacggagtcccggaacgcgtcggcggcctgccccttcagggcagacgagtcgacccccttgagcccgccgccgaccttgtcgaacgagccctgcaacttacgcaggtgagtggcggtggaccggatctcggacgggctgccgtagatcagcttggtcttgtcctcggtctgcccgaggtccatctcgtcgacctcggcgcccatccggttcgcgacggaccgggacttctcccggacccagtccgccccggactcccagccggcgtcgtcgagccggtcaccggcccagttcccggcgtcctcgacccggtccccggcccactcgacaccgtcctcgacggcgtcctcgacgacatcgggcgtgatgtcactgacgaaatccccgaaccccatgacctagttccccccgccgccctgctcctgctgctgccgtgcccgctcctcgggcgagggcccgaacatgtcgtccacggaccggtcgaacgccccttgatccacgccgaacatctcgttgagctggtccgcctgacgcccgccgttcccctcggtgacgagcgcccgcccggtgtccttccaggtctgcccggcctcctccgccgtccgctcgaacgactcccggctgtagtccgggctcagatagtccggggtgaagacatcgccccagtcctgcttgacgatctcgtcctcggacgcgtgcggattcccgacgcccgcgttcacggcgatcttcagcgtgccctgaacgtactggtcctcctcccacacgatccccgccgcgagcccgagcttcgccgcgatcgcgttggcgtcctggaccagcgcccggactccccactcccaccgctcgcagaagtcctcgaagtccaccgacagcccgtgatgcccggcctccatgccggtcatcgacaggtccgagagccccttgccgagcaccgcccccgtaccgttcccgatctccttcaactccgccacggcttcccgcagcccggtggtgatcagctgaacactgaccggatcgacgttgaggtcctccgcccccgtaccgctcacaggtcatgccccctgtccacttcgtccgcgtcgacggcgacggcatccggaacgatccccaccaccggcggaaacagcatcgacccgtccggatcggcgacgttcaccgcgaccccggccggcacccccatcgccggaatgacctcgtccagcaaccgagccccccggaacgtggcgtactcccagccccgcgaggcggccccggcgccctccaccacagcccgctcctcggcgaaccgggccaacgccccctcatcggtgaacccgcacacccaccgaatgccaccgaactcagcggtccacaacccgccaccgtcgtacggcacgagcaccaaggaccgccgcagctcacccacgagagcacgcggatccccgacccctgcccgccgctcggcaatccgatccgccaacgccatcccgtcacccactggaagttccccccgtacgcgagtcgtcactcttaacttccgcacacgctaggacaccacgtccacccgcaaccacgtggttccccccggcccccacagcctccacaccgcgggccgtcgccgaacacaaaaaggccccggtcaccgaccagggccttcatcaaagagcgggtgacgagaatc

SEQ ID NO: 3113 - DNA, 5327 bp, Unknown
  Kingdom: Bacteria, Phylum: Actinobacteria, Class: Actinobacteria, Order: Streptomycetales, Family: Streptomycetaceae, Genus: Streptomyces
cgaccacgccgaacggttcgcgggcacgccggtacgggtgagcagcccgcagggcaagttctccgacagcgcggccctgctcgacgggcggaccctcaccgccaccgacgcccacggcaagcacctcttcctcggcttcggcgacaccggctgggtccacatccacctcggcctcttcggcaagctcggcttcggcgccgccccgcccccaccgcccaccgacacggtccgcctccggctggtcaacgccggccaccacgcggatctgcgcggacccaccacctgcgccctgatcaccgagcccgagaagcgcgcgatacacgagcgcctgggcccggacccgctgcgccgcgacgaggacggcgagcgcgcctggcagcggatctctcgcagccggaccaccgtcgccgccctgctgatggaccagaaggtcatcgcgggcgtcggcaacgtgtaccgcgccgaggtcctcttccgccacggcatcgacccgtaccgcgcgggcagggacctcacccgcgccgagtgggacacggtctgggcggacctgggggagctgatgcgcgaaggcgtgcggaacaaccggatcgacaccgtccgcccggaacacctccccgacgccatgggccgcccgccccgcaaggacgaccacggcggcgaggtctacgtctaccgccgcgcgcatcttccctgccatatctgccgtacggagatccgcaccgcggacctggtctcccgcaacctcttctggtgcccccggtgccagcctccgggaccctccggcgactgagcctccgggccggcctccgacgcccctcccgacctggcgtcgagcggtcctcacgcaccccccgcccccgcgaatccgtgtcatatgccacgcgaaatcggctcccgccgcgtggacgacccccatttcgagcgcattgtcaccggggtccccctgcaccggaggcgttcgggtggataaagtcccggcaatggcccgtagcggaggagtagacgacttcggggcccggtggcgcaagaacctgcaccgggcccgcatcggcctgcgcaaatccggggtcgactacttccgcggcgacggctccgactggatcgccctggccggtctgctgctgacgatcccggccatcaccttcgccaccgtcgtcagcccggtctggatcgacccggcagccctcgccctgcccatcgtggcgggcggcctcctgctgcgccccgccagcctgctgggcctctacgcgacggccgccggcgcactgatcgtcgaggcgctcaccctcggcccgtacctggacggccccgcccgggtcacgccgggcaccgtgctcgtggtcgccgcctgcggattcttcgggctgatcctggcccagttccgggcccgggtcggcgtgccctggcggcgcggcggcacgatgctcttcgacctgcgcgaacgcatccgggtccagagctccctgccccggctgccccagggctggcaccgcgagatggccctgcgcccggccggcggccagtcgttctccggggacttcgtcgtcgcggcccgcacccacgggggccgcaccctggaggccgtcctcaccgacgtctccggcaagggcatggacgcgggctcccgggccctgctgctgtccggcgccttcggcgggctgctcggctcgctgcctccgcacgccttcctgaccgccgccaacggctatctgctgcgccaggactgggacgagggcttcgccacctcgatccacctggtgctggacctggaatcgggcgactacgagatcttctccgcaggccatccccccgcccttcaactgcacgcgggcagtgggcagtgggaggagaagtccggggaaggccctctgctcggcgtctacgacggggccgagttcgacgcggtgaagggatcgctcgcgcccggcgacgtactgatgctgttcaccgacggtctggtggaggcctccgaccgggacatggccgagggcatcgaccggctgacgggcgaggccgaccgctacgtctccaccggcttcgagggcgcggcctggcatctgatcgaggcctgcgccaaggacgtcaacgacgaccgggccctgctgctgctctcccgccgggcctgagcggccttcggcccggactcgggacggcgaacgctccggacggcgaacggcggagaggcacccgtcacccggagaccgggtgacgggtgcctctccgccgttcggtgctgctcagaccgacaccggtacctgttcctggtcgccgtccttcttgcggccacccggcaggatgcgggtcagccagtgggagtgtccggcggccagcggcgcgaggacggcgagcaggaggacgtagccggcgatgaacggcgagagccgctcgtccagtccggcggccgccgccatcgtggccaggatgagcgcgaactcaccgcgcgcgacgagggtggtggcgatgttggacgtggcctgcgcgccgaaggagtacaccttcgccgccgcgagaccggccgcgatgttcatggcgagcgtcagcaccacggcggccagcaccggccacagcacgctcgggaggtcgcccgggtcgatggagaggccgaaggcgaagaagaagatcgcgccgaacgcgtcgcggagcgggtggaccagcttgaggatgcggtcggcggaggaggtggagccgagcatcaggccgaccatgaacgcgccgatcgcgtcggcgacgccgaacatctcggagacgccggcgacgaagacggcgacgcccaggaaggagatgacgagcagctcgtcgtccttggtgttcatgagcttgccgatgagcttcgtgccgaaccgggccgccagggcgagcagcaggaggaagccgaaggccttgccgccgtcgatcagcgcggccgagaggctgtccgcaccggacaggatcggctggagcgcggcgaggtacagggcgaggaagatgtcctcgacgacgatgatgccgaggatcggccgggtctccggattcccgatgcgcccgaggtccaccaggatcttggtgacgatcgcggacgaggagatgccgaggacaccggcgaggaccagcgcctccgccgtaccccagcccagcgcgaagccgaaggcgagaccggcgccgacgttcagggcgagataggtcccgcccgcgatggccatcttccggccgcccgtcttgaggtcgtccatgtggaactcgagccccaggtagaagagcaggaggacgagtcccagtgcggagagcatctccaggtcgtgcgggttcttcaggagcgtgtagccgggggtgtgcggtcccaggaggatcccggccaggatgaagagggggatcgtcggcagaccgatgcggccaccgaggcgggcgaggacggcagcggccaggaaggcgccgcccatggcgaggagggtgtctgcgtgtccgatgagcctgatccttcggggtcggtcaagagctggtcaagggggcatcaagaatccatcagtaattagtttaccgaacgattgacactgcaactatggctccgtcagattgcctgcttttgtctacttgattccgctatggaggtggacgaacacgtgacctcaacagccgcatgggccaagcgagttcggcttcggtcccggatgcgtccccggccgcgatcccggatgcggccgtagggtcggcccatgactggacatctgagcgtctccgaggtggaggccatcgcccgcgaggcccatgcgcggcagaccgacaaggcgggccgcccgtacgtggaacacctggcggcggtggccgaaggggtacgggtgcgcggcggcgacgacggtcagatcgcggcggcctggctccacgacgcgatcgaggacgcggcgctcccggccgagtggctggccgccgccgccctgccgcaggaagtgaaggacatggtcctggcggtgaccaagcggccgggcgaggagctgtccgcgtacaccgctcggatcctggccaccccgggcgcgctgctcgtcaaggaggcggacctcgcccacaacgcggatcccgcccgcctcgcggtcctggacgcggcgacgcgtacccgactgacggcgaagtatgcgcaggtacgcgagctgttggggctgaccggcagcgaatcacccccggaccgaaagaatccggccaacccggagacgcactgatccacccgcggccgggccggcgggtggatcaggggaagtcgggagaaaggggcgaccgccgtccgcggacagccggtccgccagggggttcagcgccccgcggagtccttccggaacgcccacttcatgtccggctcggtggcccacttcagggcgcgccccaccagcggggtgcacatgagtgtcacggccaccgccgccgtgagcgagacgacgaccagcccgaccgggtcggagagccaggtgtggcggtcgaacaggcccgcgtattcggctcccttgatcaggaagccgtgcagcagatagccgcagatcgttccggctccgagcgccgtgaaccaccgggccctgccgggcacccaggccaggaagccgatcgtcagcgccagggcgcagccgaacatcgcgagcgtcatcaccgcgcccgaccaccacggcgcgtccatctcctgcgcgctgttggcgcggtagagccagccgagctgcatgcgcggagcgatccagtacgcgaagagcagcgcgccggcgaacagtggcagggacagcagtcgtacctcgcgccgcctgaccagctggaagtgctcgggcttcatcagcaggccgagcacgaagaacggcaggaactgcagcacccgctggaggtcgaggtcgtcgccgatgtcgggggagatggaggcgagcatggcgatggcgagcgccaccggcagcggatggcgcagcgtgcgccagatcggcgtggtcacccgccagacgaacagggcgatcaggaaccaggtcaggaagaacgggtcgatcaggctgatcgccatgtcgggcgcatcgtccgcgtaccgcttgaagagcgaataggccgtctcgaacagcacgtacggcaccgcgaccgaggtgatcagccgcttcaccttggacggcgtcatgtcgaacgagcgggagaaatagccggagatgaggatgaaggccggcatgtggaacgtgtacacgatcatgtacagcgcccgggtggcgcggctgccgtccatcacgggttcccaggcgtgcgccaccgcgacgagaacgatggccagatacttcacattgtcgaagtagggatcgcgtttcttcgccgccgccgacgcgggagcggcggcggcgaagaaacgc

SEQ ID NO: 3114 - DNA, 2160 bp, Unknown
  Kingdom: Bacteria, Phylum: Actinobacteria, Class: Actinobacteria, Order: Streptomycetales, Family: Streptomycetaceae, Genus: Streptomyces
gcctcgctcagcgcgggtcccggcacgaactcggtggccagccacggggccggcgcctcggtgtcggcgtcgaccaccggaaccgcccaccggttgcgtacctgccgggcgatggccacctcccgccggaagcgggcgcggaaggcggtgtcgtcggcgtactccgcgcggatcagtttgatcgccaccagcgcgccgccgggcgaccggcccagcagcaccacgcccatgcccccggcgccgagccggccgaggacgcggtacccggcgatccgtgccgggtcggtggaacggagcggttccatcaggggtcagtgcctttcgtccggtcccgcgcggtcacttcagttccagctcgacgcggtagagcaccttggcgccgccctcggcggcgatccgcagcaggtcgctgttcctgtagcccttcgcgcccttgaccgacacggccgtggtcaccggaccgatccgggacttggtccacacgtagtcctgggtcccgcccgattccgggccggagtacttccccgcctcgaacagcgaggcgtccgcgttgcgtacgtccttctggtcgaaccggagggacatcagaccgctgaggttctgcccgccgcccagctcctgccgcgggcagcggaagctctcctggacggtgtcctcgatctccttctcggcgcccgccacgctccggtgcacggtcacggtcaccgacccctggacgcggcccctgccgtcccgcgccggtacgtcgagccgccgggtgaagctgtccagcaccccgtcgggcagtgcggagcggctccagacgcaggagtccgccagcacgggccaggtgccgccgctctcgtacggtgtgtgccggaccatccccgcggcccagtcggtctccacgagtgcggcgctacgggtcagctcccgcgcccggtccgcgtccttcggcacccgcgccgggttcggcgtgaacgcgtaggcgctgggcagcgcccccggcagcgtggactccttcgcgtccggcttccccgtcgcctccgtcttcttgccgtcggccgcccggccgccctgcttcgccgatccgctcggcttcgggtccggcccgtccccgttcttcgacgccgacccgccgcacccggccagcagtacccccgccgccgcgaccgccatcgcgcgtgtccccaccagcatcagcttcatcatcggacccccctggtcccccgctccgcaccccggccgaacagcccgggcgtcggtagcgaggcgattctagaagcggacagcgtcccggcgacgggaagccggtactcaaccggtcggcgcaacggctcagccgacagcggggtttcgcctctggcggcccggcgcgcgggatggtaggcgccggacatgaaggacgaccggggttggccggaactccaccgtcgacgccagcgggaagccggttccggcgcggcggcgggggaggttcgcccgccgcgcgaccgctctcgggggcctcgcgatcggcggaagattggtctggaccacacggggtgcgccggtgactggctcattccggactccgcgccttcgggccgggtccgcccagcttgtgagcctgtccttccgagaacgtacgagcgccagggaacacctgagcgtggcggcgaacgcgcgagggcccggatgccggggagcatccgggccctcgccctgttacgcgtatccgccgctacggcagctgtgccgcccgcgcctcgcgccggttgtcacggaacgtgttcacccgtcgcgccgtggcgaacagcgggatcaccgcgccgagcaccacctggagcgcacagcccgtctggagcagcagctgaccgccgggcgcgtcgaacgcccacgcggcgagcagccccatcgcggccacgatccagccgagcatcgccaccgcgaggatgccccgcggcttggggtactccacccggctcaccatgagccacgccacaccgacgatcgccagcagggtgggcgggaagggcagctccaggagcacgatcgagacgaccgtcagcgctccgaaggggctcggcatgccctggaacatgccgtccttcagcgtcacgcaggagaatctggcaagcctgagcaccaccgccagcaacacgacgatcgccgccagcgccgacacacgctgatgggcgt

SEQ ID NO: 3115 - DNA, 15484 bp, Unknown
  Kingdom: Bacteria, Phylum: Actinobacteria, Class: Actinobacteria, Order: Streptomycetales, Family: Streptomycetaceae, Genus: Streptomyces
  misc_feature (309)..(310): n is a, c, g, or t
cgccgacgcgctgaccgcctccggggcgacggtcgccgttctgtgctcgtcggacgcgctgtacgccgagcaggcggagcaggtggccggtgcgctgaagtcggcgggagcggcgcgggtgtacctcgcgggacgtcccggcgcgtacgccgatgtcgacgcctatgtcttcgctggctgcgacgcggtcgccgttctcacctccgtactcgaccgcatgggagtggcgtgatgccgacatcgcccacggatcggaagccctccgttcccgacttctccgacgtgccgctcacggcgtccacgccgccnncctggagggcctggacgcgctgcactcgtatccggggatcgccccgtatctgcgcgggccctacccgacgatgtacgtcaaccagccctggacgatccgtcagtacgccgggttctccacggccgaggagtccaacgccttctaccggcgcaacctggcggccggacagaagggcctttccgtcgccttcgacctgccgacccaccgggggtacgacagcgaccacccccgggtgaccggcgacgtcggcatggccggggtggcgatcgactcgatctacgacatgcgccagctcttcgacggcattccgctggaccggatgtcggtgtcgatgacgatgaacggcgcggtgcttccggtgctggcgctgtacatcgtggccgccgaggaacagggcgtaccgcccgagaagctggccgggaccattcagaacgacattctgaaggagttcatggtccgcaacacctacatctatccgccgtcgccctcgatgcggatcatctccgacatcttcgcgttcacctcacggaagatgccgcgctacaactccatctcgatctccggatatcacatccaggaggccggggcgacggccgatctggagctggcgtacacgctggccgacggggtggagtatctgcgcgccggtcgtgaagccgggctggacgtcgacgcgttcgcaccgcggctgtcgttcttctgggcgatcggcatgaacttcttcatggaggtcgcgaagctgcgggcggcccgcctcctgtgggcgcgactggtgaagcagttcgacccgaagaaccccaagtctctgtccctgcgcacccattcgcagacgtccggctggtcgctgaccgcgcaggacgtgttcaacaatgtgacgcgtacatgcgtggaggcgatggccgcgacgcaggggcacacccagtcgctgcacaccaacgcgctggacgaggcgttggcgctgcccaccgacttctcggcgcggatcgcccgtaacacgcagctcctgctccagcaggagtccggcacctgccgggtcatcgacccgtggggcggcagcgcgtacgtggagaagctgacgcgggacctggcggaccgggcctggcagcacatcgaggaggtcgaggcggccggcgggatggcgaaggccatcgacgcgggcatccccaagctccgggtggaggaggcagccgcgcgcacgcaggcgcggatcgactccgggcggcagccggtgatcggggtgaacaagtaccgggtggagaccgacgagaagatcgacgtcctcaaggtcgacaactcctcggtgcgcacccagcagatcgagaagctgcgccggctgcgcgaggagcgcgacgaggtggcgtgccaggaggcgctgcgcgcgctgacggccgcagccgagcgcgacccggggccgggcctggagggcaatctcctggcgctggcggtcgacgcggcgcgggccatggccacggtcggggagatctcggacgcgctggagaaggtgtacgggcggcacgccgggcagatccgtacgatctccggtgtgtaccgcaaagaggcaggagagtccccttcggtggaccgcacccgcgcactggtcgaggccttcgaggaggcggagggccgtcgtccgcgcatcctggtcgccaagatggggcaggacgggcacgaccggggccagaaggtgatcgccacggccttcgccgacctgggcttcgacgtggacgtcggcccgctgttccagacgcccggcgaggtggcgcggcaggccgtcgaggccgatgtgcacatcgtgggcgtctcctcgctggcggcggggcacctgaccctggtgcccgcgctgcgtgaggagttggccgccgagggacgcgaggacatcatgatcgtggtgggcggggtgattccgccgcaggacatcgaggcgctgcacgaggcgggcgcggcctcggtcttcccgccggggacggtgatcccggacgcggcgcacgacctcgtgacgcggctcgccgtcgcgctcggccacgagctgtgagccgctgaccggatggctgcgaagatcgacatcgacggttatgtgcggggagttctcgacggcaggcgggcgttcgtggcgcgcgcgatcacgctcgtcgagtcgacccgggccgaacaccgcgtgctggcccagcagttgttgagccggctgctgccgcacgcgggggcggcccggcggatcgggatcagcggggtgccgggcgtgggcaagtccacgttcatcgacgcgctcggcacgatgctcacggggctcggacaccgggtggcggtgctggcggtcgacccgtcctccagccgtacgggcggctccatcctgggcgacaagacccggatggaacgcctcgcggtggacccggccgccttcgtccgcccctcccccacggcgggcacgctgggaggggtcgccaaggcgacccgggagtccatcgtggtgatggaggcggcggggtacgacgtggtgctggtggagacggtgggcgtcgggcagtcggagacggcggtggccaacatggtcgacacgttcctgctgctgacgctggcccgtaccggcgatcagctgcagggcatcaagaagggcgtcctggagctggcggacgccatcgcggtgaacaaggccgacggaccgcacgaacgtgacgcccgttcggccgcgcgcgaactggcgggcgcgctacggctgatgcatccggtggacgcggcgtggacacccccggtgctcacgtgcagcgcacgtgaggcgaccggtctcgacaccctgtgggagcggctggaacagcaccgggcgctcctggagtcgaccggccggctggcggccaagcgtcgcgaccagcaggtggactggacgtggacgatggtccgcgacgatctgctggacagtctgcacagccacccggcggtgcggaagctcgcgccggagctcgaacagcgggtccgggaaggcacgttgacggcgacgctggccgccgaggagatcctcggggtgttccgcgggagcgcgtcccgtgagggtggtgcgggaacgtccggctgaacgcgtacgccggcacggcagcagggacatggaccgaggggcccccggacggaggggcccctcggcgttttcgggcatctgtgggggacgcggatgcggagcatcggatggctacggccggtacgcctacggccgggacgacgacggatgccccgccggaggtcgcggcgaggatttccgcctccgtgccctagatctcctggacccgcgcggtgtgcgctcgaacagctccgtgccgaggtcgccgacctcgccgagaagcccgcgtcctggcccgcttccgggtgtggccggccgactccgcggccctgccgctgccactgggggtggcggggacccggacgtcgggttccatcaccctcgacgcttgtcaggcgcttgcgcgacgccgacggatgttccgacgggtcttccgacggatgttccgacgcactcccggcacatagtggtacagtgcgatcaacacatgtgcatgccccttctcatcgggcaccggtgctgattcctctccaccgctgttgcgcccgtccttccgaccggcgatccagctttcttcccagcgtcttcgctgtctctccggcccagggcttccgtgcccgcggtgcgtggcgtgattcccgccgcccctccgtacgccggtcccctcattcgcctgtccgcgaaaggacctctcccatgaccaccacactcgaacgccccgtgacaggggagcggcgccccgtccgggtcgtcggcctcctcgacaccgccgacgacggacacggcatgctccgcgtccacggcggccacccctcccccgacgacgtccaggtgtcgtccgccctgatccgccggctcggactgcgcaagggcgacgccgtcgagggcggctgcgaccggccgcgcgtcctgtcctcggtcgaccgtgtgaacggactcgccccgcaggacctgcggggccgtgcccgcttccgcgacctgacgccggtgcacccccgcgagcggctgcgtctggagacgccgcagggcgggcccgcaccgcgcatcgtcgatctcgtctcccccgtcggcaagggccagcgcggcctcgtcgtcgcaccgccccggacggggaagacggtgctgttgcagcagttggccgcctccgtcgccaccaaccatcccgaggcgcacctgatggtggtgctgctcgacgagcggcccgaggaggtcacggacatgcgccgctccgtacgcggcgaggtgtacgcgtcgaccttcgaccggccggcgcgggagcacatcgccctggccgaactcgccgtcgagcgcggccggcgcctcgtcgagcagggccgggacgtggtgatcctgctggactccctcacccggctgtgccgggcccacaacaacgcggcccgcgccggcgggcggaccctgagcggcggcgtcgacgcggcggccctgaccggccccaagaagctgttcggcgcggcccgttgtgccgaggagggcggttcgctgaccatcctggcgacggccctagtggagacgggctcacgggccgacgacttcttcttcgaggagctgaagggcaccggcaacatggagctgcgcctggaccgctccgccgccgaagcgcggatcttccccgcggtcgacatcgcccgctccggcacccgccgcgaggaactcctcttcggacctggcgagttggcggccgtccgggccctgcgtcgcgccctgaacacacgggacggccagggcgcccttcaggtgctgctcgacagggtccggcgcaccccggacaacgcggtcttcctgcggcaggtgcagccgacggtgccggacgcctgagcgccggcaccggtcggcgtgccggatcctgacgagagggctcaggcgtcgcccagcgcctcggagaccagtgcccgggcctcctcctggacctgggcgagatgaccgggtccctggaagctctccgcgtacaccttgtagacgtcctcggtgcccgaggggcgggcggcgaaccaggcgctgtcggtgcagaccttgaggccgccgatcgccgctccgttgccgggggcctcggtgagcacggcggtgacgggttctccggccagggtgtcggccttgacctgctgcggggagagccgggccaggacggccttctcctcgcgagtggcgggtgcgtcgacgcgggcgtacgccgggtcgccgaagcggccggtgagccgcgcgtagtgctgggagggcgtggatccggtgacggcggtgatctcggaggcgaggagggccagcaggatgccgtccttgtccgtggtccagacccggccgtcgcggcgcaggaacgaggctcctgcggactcctcgccgccgaatcccaggctcccgtcgaagaggccgtcgacgaaccatttgaagccgaccgggacctccaccagggtgcggccgaggtcgtgggcgacccggtcgatcatggacgaggagaccagggtcttgccgatgccggtgccggcggcccagccgtcgcggtgggtgcagagatactcgatggcgacggccaggtagtggttggggttcatcaggccgccgtcgggggtgacgatgccgtgccggtcggcgtcggcgtcgttcccggtggcgatggcgtacgcgtcgcgctgggcgatcagcgaggccatggcgtgcggggacgagcagtccatgcggatcttgccgtcccagtccagcgtcatgaaccgccaggtggggtcggcgagcgggttgacgacggtgaggtcgatccggtggcgttccgcgatccgtccccagtaggcgacggacgcaccgccgagcgggtcggcgccgatgcggatcccggcgtcccgtacggcgtcgaggtcgaggacggagggcaggtcgtcgacgtacgcggtgaggaagtcgtaccggcggatggtgtcggcggccagggcctgggcgtacggcatccggcggaccactccgagtccggcctcgatcagggcgttggcccggtcctggatccaggaggtggcgtcggaggcggcaggacccccgttcggcgggttgtacttgaagccgccgtcggcgggcgggttgtgcgaaggggtgaccacgatgccgtcggccaggtgctcggtgcggccccggttgtacgtgaggatggcgtgcgagacggcgggggtcggggtgtagccgtcgtcgctgtcgatgagggcggtgaccccgttggcggcgagcacctccagggcggtgacccgggcgggttcggacagcgcgtgggtgtccgcgccgaggaacaggggtccgtcggtgccctggcgggtgcggtagtcgcagatcgcctgggtggtggcggcgatgtggtcctcgttgaacgcggcggcgaacgcggagccgcggtggccggaggtcccgaaggccacccgctgggtgggctcggccggatcggggtggagggcgtaataggccgtcaccagccgtgccacgtcgaccaggtctgcgggctgcgccgggcgaccggcccgttcgtgcaccatcggttctcctcgtacgtcttcgtcgtcggccggcccgcggggagacgggcccggcgcaccgggaaacgatcaccccggtccgtacccgattctgctctcccggccgccccggtgcgcgaccggttcacgccttcctcgtgtcgctccccggccggagcggcgccgcgcccccggtccggagcgggccaggggcgcggcaagcgtacggatgaggggctcaacggccctggagggacctcacgttgtcgccgaaggtccagcccctggagccgtcccagttcagggaccacgtcatcagccccttgagggagccgttgtagtggttccaggcctgcgagacgagtccggtggacatgtggccgccgccggcgccgggctgggccgggaggccggggacctgcttggcgtagggcaccttgatggtggtgccctggatgacgagccccttgtcgaggcagtcggtctgggcggtgaagcccgcgacggtgccggcggagtaggagtcgccggagcagccgtacatgctgccgttgtagtactgcatgttcagccaccacagacggccgttgtcggcgtacttcttgatgatgggcaggtacgagccccagatcgagccgtaggccacactgccgccggtgacgtacgccgtctcgggggccatggtgagaccgaagttcgccggcatcgcggcgaggacgccgtcgatgatgcggatgaggttggcctgcgacgcggacagctggttgatgttgccgctgccgacgaggccggtctcgatgtcgatgtcgatgccgtcgaagttgtacctcttcaggatcgggacgatcgtctcgacgaaccggtcggccaccctgctggagctgaggtcgatccccgccgcggctccgccgatcgacatgagggtggtgaggccggaggccttggcctggcacatctcggcgggagtggcgaccttgacggtgctgtccatgccgtcctcccagaggacggtgccgtcggagcggatgacggggaaggccgcgttgatgacgttgtagccgtgctgggtgatgcgggagtcggtgatcgggatccagccgagcggcggatgcacgccgttggccgcgccgtcccagttctcccagtacccctggagcaccttgcccgtgggcttcgacttgaccgcacaggtctcggcggccgcgctgtccgtctccgcggccctaggcggcgcggctccgaccagcatcggtacaacgagcgccgcggccagaccgaggcccagcagccgtgaggtacgacccatgatccgtacgtccttccagcccgggtccgccgccgacggtgcgaaaggttcgccccgccccgccctatgtcgtgaccctgccaaaccgtagaatggtccagaccttcggtcaagaggtctggaccaggccatcgtgacggcggcgggcgctccgcgtccccgtggacgccgctgcctgccgagggtcccgggacccgtcgccgggacccgggaccgtcacctggcgccgggttcctgccggggtaccgtgcgcacgccgtcgtggatcgaatgggccatgatcacgggtccgttataggtgccgtcgttgatcgtgttgtggttgaccgacacggtggtaccggcgggctgccggggcgccagctcgtcgagcaaccctcgcagctcctccgcggcctcggggttgtcgcgcagggcccggcgaagcctgatccgccactcggccgtgacgtccgcggcaccgtcctcgtcgccgttgcggcgtgccgcgatcagctcctcacgggactcctccagctccgcgtcgatcgcgtcgacgtcctctccccgcgccaggaaccgggccacccgcccgcgcgcctgcgtccagccctccgtcaccatcaggcccacgaaggccgtcgcccccgatgccgccagtgccgtcaactcggcttccaccgaaccccctccgcctcacctgtcgtgcccatacgggcgcaccacccgtcgctggtgcaaccgtagagagcgaaccacccccgcggaagcggaatcaggggcgcggcgcagagcagttccggccaagtcggccgagcgtgcgggggtgcctgtgcgctgcgccggcggtcggggccgttcgggccgtttccactcgggaccggcggtcgcgcaaccatggacgcgccggatgcgtgatgatggatgaggggccgcagcacgacggcgttgcgccgacgccgccggccggcgacccggaagggcggtcgccatgtccgcagccggaatcaggtcctcggccgcagtgctcctcaccgcgctcgtgctgctcgtcgccgccgcgtgcacgggcggggacggttcgtcgccctccccccgcagcagctctccttccggcgcggtccgggccgccgacgtactcgccgtgaagatcgacaatgtggcgcccgcacgcccccacaccggtctggagcgggccgacgtcgtctacgtcgagcaggtggaggccggcctgagccggatcctcgccgtgtactcctccactctgccgccggtcatcgggccggtgcgcagtgcgcgggagaccgatctggagctgctgcggcagttcgaccggccgacgctggccttctcgggggcccagagcaggctgctgccggtcatcgaccgtgcgccgctggacgccgtgccgccctcgaaggcgccgggggcgtacttccggggtccggaccggcccgcgccgcacaatctctatctgcgtccggagcggatcccgttcgacgcctccggtgtgaacgccgtcgaggagctggggctcaaggccggctcgccgcctcccggcgggcagccggagggcagccgcacggttcgctatccgtccgcgtccgtgaccttcgcctggtccgccgaacgcgagcggtggctcgtctccctggacggctcccccgcacgcaccgccgagggcgggcggctcggagccggtacggtcgtcgtccaggacgtgaccgtacggccgtcggacttccgcgaccggtccgggaacaccagcccgttcaccgagaccgtggggtcgggaagcgcggtggtcctgcgggacggccgggcgtacgaggcccgctgggcacggagcgcggccgacgcggacacggtgtacaccacccccgacggagagcgcgtcgatctcgccgaagggccgctgtggatcctgtacgcgccgcgcggtggtgcctgagcgacggctcgccgcagcgtcggacaggcgtccgggcggtggtacgggcgatcgttcggccccaccgcccggacgcccggggtgcgcggcttcctactgccagaccttgatgtagtcgacgctcatcttctgcgggaagcgcgtggtggcgtcgggcgggccgggccagtcaccgccgaccgcgttgttgaggatgaggaagaagtcgtggtcgaacacccagggtccgcgggtgcgctccagctcctccttgtcgaccgtgtgcgtgacctggccgtccacccggaacgtcatgcccttgctgttccagtccacggcgaaggtgtggaagtcgtcggcgaagtccgcgcccccgggcagtgagtagggggctccgtagccggccgcaccgttgtacgcgggagcgtgcagcgtcgagtacgtggtgtccggctccttgccgacgtgctccatgatgtcgatctcaccggtgtagggccacggacgcccctggtcgaagtagtccgcgcccagcatccagaacgcgggccacagcccctgcgtaccggagaccttgatgcgcgcctcgacccggccgtaggtgaactggaacttcccgtaggtgttgagccgcgccgaggtgtactggcatgtggtgctgccgctcagcgggtcgggcgggcaggccgagccgggtgtcggctcgcgtcgggcctccaggacgaggttgccgttgccgtcctgggcggcgttcttgttctcggtgtagtactccagctcgttgttggggccggagcccgtctccgggacccacttcgcggggtcgggcgtcgcgcccgcgggaccgttgaactcgtcgccgaagaccagccggtcgtacgtgggctccgcgggcagcggcggtgcggggatcggcgctccgccggtgccccagacctggaactcccagagcgaatagccgtattcaccgctgcgctgggtggcgtacaggcgtacgtgtcggccggtgccgctgacgtcgagcgtctccttgaagcccgcgcccgacgtggtctcgtggatcgtcgtccagtcggtcccgttgtcggagacctcgatccggtaggccctggcgtgggccgggtcccactggaggacgacccggtcgatctcggcccgggcgccgaggtcgaccgcgatccagcccgggtcggaccagccgccctcggggctggtggcccagcggctggcggggtcgcggtcgaacgccttgtccggggagcactcccaacaggttccgtcgtgctgggaggtcgaggcggatccggtcctgccgtaggagagcaggacgtcgtcaccgggggcggtgccgccggtggtggagtagacctggaactcgtggagggaatagccccaggcggtggcgcgctgggtgccgtgcatccggatgtagcggccggttccggagaccgtcagcgtctcgaccccgccggcgccggtcgtggtggagtggatcgtggtccactgctgtccgtcgccggagacttcgaggcgatagcccttggcgtaggcggcctcccagtcgaggacgacctgcccgatcgaggtgctcgcgcccaggtcgatgcggagccactcgtcgtcgccgaaggcgctggaccagcgggtggcggtgtcaccgtccacggcggccgccgcggcgaaggggccttcggtgctggaggcggtggccggctttccctgggatacgagaacggcagcggcgacggcacgttccggggcgatgcccaccgagagggtgaagaggagggccacgacggccatgaccgcgagggcgccgcgcgaccgcggtgttccacgggcttccatgcgaactccttgactgtgaggggatgaggccgagagagcgctcccccgcagtggggagactgacgggcccccggtgaaccgtcaagacttccggcggggttgagtcaagcccccgggggccgagcgtccgacttgccgccctgatgcccgatcaactgcccctgtgctttcaggagatgaaacatcgcgcggcccggccggcccggaaccgcattcctgtgcacaactcttgacgtgacggaaacacgggagaatcattcggctaccgagagagcgctctctccctgtgagagcacgcccgcacctgttaccacccccgctcaatcgacctctcaggagacccggacatgtccgttgccctcgtcagaccctcgcggcccccgacagccgcatcccaccgatggcgcactctggccctcgtcctggtcaccacgctggtcgcggcgctgctcgcgtccgtgcaggcggctccggcccaggccgctcccgtcctgctgtcccagggcggcgcggtcaccgcgtcgagccaggagaacggcggcaccgccgcgggcaacgccgtcgacggggacggcggaacgcgctggtccagcaccttctccgacccccagtggatacgggtcgacctaggctccccggccgtcctcagccgggtcgaactcgcctgggaggccgcgcacgcgaagagctaccgcatcgaactctcggccgacggcaacgcctggacgaccgcctacagcaccaccgcctccgcgggcggcaacgagaccctcaccgtctccggcgaagcccgctacatacgtctgaccggcaccgagcgggccaccggatacggctactcgctctgggagttcaaggtcttcggcacccgtgacggcggcggaccggagatccccggcggcggcgacctcggtcccaacgtccatgtcttcgacccgtccacgccgaacatccagggcaaggtcgacgagatcttcaagaagcaggagtccgcgcagttcggctccgaccgctacgcgctgatgttcaagccgggcacgtacgacggcatcaacgcgcagatcgggttctacacgcagatcgcgggtctcgggctgaacccgaacgacaccacgttcaacggtgatgtgaccgtggacgcgggctggttcgacggcaacgccacgcagaacttctggcgttcggcggagaacctgaccctgaacccggtctccggcaccaaccgctgggcggtctcccaggcggcaccgttccgccggatgcacgtcaagggcggactcaacctcgcccccgacggctacggctgggccagcggcggctacatcgccgacagcaagatcgacggccaggtgggaccgtactcccagcagcagtggtacacccgcgacagctcggtgggcggctggaccaacgcggtctggaacatgaccttctccggagtgcagggcgcgcccgcgtccagctacccgaacccgccgtacaccacgctggacaccaccccgatctcgcgcgagaagccgttcctgtacctcgacggcaacgagtacaaggtcttcgtccccgccaagcgcgtcaacgctcgcggtgtctcatgggacggcggcgcccagcagggcgagtccattccgctgaaccgcttctacgtcgtcaagcagggcgccacggccgcgacgatcaacgccgcgctcgcacaggggctgaacctgctgttcacgcccggcgtttaccacatcgaccggaccatcaacgtgaaccgggcggacacggtcgtgctcggcctcgggctggccacgatcatcccggacaacggggtgaccgcgatcaaggtcgccgacgtcgacggtgtgaagctcgcgggcttcctcatcgacgccggcccggtcaactcctcgaccctgctggaggtcgggccgcagggcgcgtccgccgatcactcggcgaacccgacctcgctccaggacgtgttcgtgcggatcggcggcgcgggtcccggaaaggcgaccaccagcatcgtcgtcaacagcgacgacacgatcatcgaccacacctgggtgtggcgtgccgaccacggcgagggctggggctgggagaccaaccgggccgactacggcgtccgcgtcaacggcgacgacgtcctggccaccggcctgttcgtcgagcacttcaacaagtacgacgtggagtggtacggcgaacgcggccgcacgatcttcttccagaacgagaaggcctacgacgccccgaaccaggccgccatccagaacggcgacacgaagggctacgccgcctaccgcgtcgacgactcggtcgaacagcacgagggctggggcatgggcagctactgctactacaacgtcgacccgaccatcgtccagggccacggcttcaaggcaccggtgaaacccggcgtgaggttccacagcctgctcgtcgtctcgctcggcggcaacggccagtacgagcacgtcatcaacgacgtcggatcccccacctcgggaacatcgacggtcccttcgaccgtcgtcaacttcccctgaccccgggcctctcggcccgggaccgggggctcgggagcgggtccccggccgacgcccggccgcccgttccgcgcggaagggaccgtgccgggattccccccgtccggctagcgggagcgggacagcagcgccccgcccgcgtactgcgccgactcccccaactcctcctcgatccggatcagctggttgtacttggccgtgcggtcggagcgggacagggatccggtcttgatctgaccgcagcccgtcgcgaccgccaggtccgcgatcgtggtgtcctccgtctcgccggaccggtgggacatcacggcgctccagcccgcacgacgcgcggtggcgaccgtggcgagggcttcggtcagggtcccgatctggttgaccttcaccaggaccgagttgccgacgccggtacggatcccctcgcgcacctgcgcctcgtcggtgcagaacacgtcgtcgccggtgagctggcagcgttgaccgacgcgggcggtcagctcgcgccacccgtccatgtcgtcctcggccatcgggtcctcgatggagacgaccgggtacgagtcgatcagcttgaccaggtagtcgacctgttcggagggtgtgcggcgcacaccctcgcccgcgtacacgtacgtaccgtcgcggaagaactccgacgaggccgggtccatgatcaggccgatgtcctcgccgggacggtacccggtgcgttcgacggcgctcatgacgaagtcgagcgcctcctcggccgtgcgcagcgccggcgcgaaccctccctcgtcgccgacgccggtggcgtgcccggcggcgagcaggtcacgtcgcagggtgtggaagatctcggagcccatgcggacggcttccgcgaaggtcttcgcacccaccggcgcgatcatgaactcctggaagtccaacggattgtcggcgtgtgcgccgccgttgatgatgttcatcatcggcagcgggagaaggcgggcgtcggcgccgccgagatagcggtagagcggctggcggtgggccgccgcggcggc

SEQ ID NO: 3116 - DNA, 5262 bp, Unknown
  Kingdom: Bacteria, Phylum: Actinobacteria, Class: Actinobacteria, Order: Streptomycetales, Family: Streptomycetaceae, Genus: Streptomyces
gcgttgccgatcagctccttggtggcggcgaggagttcgctgtcgtcggcgagctgcacgatccgcagggcgggggcgtgcaggacggcggccccgcggcgcttgaggagggtggcgagctcctcggcgcgacgggcggcggtcaccccgacggtgaagcccgcgagggggccgtgcgttgtgtcgtcgtcctgcatggcgtgttcccggctcctgtggttcccgctggtacgcgatgtgcggaggcccgagcctgccaacgatgcgtgacaggctcggttcccccgtatttcccggccgttacgtcgcatgacgccgggatgtcgtcccgtgccctcctggggcgtgtcgccctagacctccgcgtagccgagctgggcgcgtgtgggcacaggcgcggggcggcgaaggtataccgcccaggtgagggtgaaacacactccgtagaaggcgaggaaggaccagaaggccgcggtcccggtgccggtttcctggaaggactggcggaaggcgaggttgatggccaggccgccgagcgcgccgacggcgccgatgaggcccatggccgcgccggagagccgccgtccgcgggcggcggccgcctccccgccgagtccccgggcgagggccttggcgtggaagatgccggggatcatcttgtacgtcgatccgttgccgaggcccgtcaggacgaacagggcggtgaagccggtgaggaagacgggcagcgaggcgttccccgaggcctggatgacgacgccggtggcggcggccatcgcggcgaaggtggccagggtgatgcgcgcaccgccgtaccggtcggcgagccggcctccgacgggccggatcagggagcccagcagcgggccgatgaaggtgagcgatgcggcctggagcggggtccggccgaactgggtctggagcaccaggccgaaggcgaagctgtagccgatgaacgagccgaaggtgccgatgtagaggaccgacatgatccaggtgtgcgggtcccggacggcttccagcgcggccccggtgtcgttcttcacgggccggaggttgtccatgtacagggcggcgcacacggcggccaggacgatcagcgggatgtacaccccgaggacgatccgagggtgcgaggcccccagcgtgccgatgacgagcaggccgacgagctggacgacggggacgccgatgttgccgccgcccgcgttcaggccgagcgcccagcccttcttgcgcagcgggaagaaggcgttgatgttggtcatcgaggaggcgaagttgccgccgccgatcccggtgagcgccgcgaccgcgacgaaggtggcgtacgaggtcccgggttccatcacccagaacgcggccagcgtcgggacgagcaggctcaccgcgctgaagatcgtccagttgcgtccgccgaaccgggcgacggcgaaggtgtacggcacccgcaccagcgcgccgacgagggtggcggtcgagatgaggaagaacttcccggccgggtcgatgccgtactccggtcccatgaacaggaccatcaccgaccacagggtccagatggagaatccgatgtgctcggagagcacggagaaccacaggttgcggcgggcgacccgttcgcccttctcccgccagaacgtctcgtcctccggctcccaggtctcgatccaacggcctgccatcacgcgcctccacagggggtcggggtgttgtccccgacgctagggaacccgcgtttcggcgtggtgccgcgaggtgaccggtgcgcaaccttgctctcaccgggcggctcccggcccggtgagatgcggtgtccgctaccgcctgccgtccggccacagctgcggccgccgccgggcggcgacgtcctcggcccagccgaaggcgaggacgcagagcgcgatgagggtccacgtgatcaacagcacgggcacccagctctccagcagccggggcacgttctcgctgagggcgtcgacggaccagagccggtcgtagagcgtggcggcggccaggatgcagacgttgtgccagaggtagaccgtcaccgcccgcgagttgagcagggtgacgggccggtcgaaggcgcgcagccgcttcggccactcggtccaggtggggctgaggtgcagcaggagcaggacgcagccgaaggaccacagggcctgggcgagcgggatggagtccaggtcgaagccgctgcggaagccctcgtggctcgcccaccacagtcccgcgcccgcgaagagcggagcgatcgacggcacgacgtaggcgggcagccgtttcaggacgccttcctggtgggccatgccgaggacccagcaggcgccgaaggtggagaagtcggtgatcgcggagtcgaggcggtcgccggtggagaacagttccagacgcatgacgacggcgaggacgagcggcgcgagcagcgtcggccagggcagcctgcgcaggccgcgcaggatcagcggggagaacaggacgaaccacaggtaggcccggatgtaccagagcggcccggccagctcctcgggccagctcccgccgaggaatccgtcgatgcccgccacgtcgtccgcgtacggcggatcgctgagcggcagcacccagtacaggaggtgctgccaccaccagccggggtggccctcggcgtccgggccccagccctgggcgagcatgccggtgacgccgatcgcgccgagcagccacagcggcggcaggaggcggcggacgcggccccggatcacctggacggcgggccgctccagcgagcgcgccatcagcgtcccggccagggcgaacatgacacccatcgacgggaagacgatcggcagccaggcccagccggtcaggtggtagaggacgacccggaagagggcgacggcccgcagcaggtcgaagtaccggtcgcggacgggcttcacgggtgccggctgcggcaccctgacgtccgggacagcggtccccggcagaggcggggcggtcatacgaagggcctccggtccgggctgtcaccgccgacgggtccggccgcggcctcccgcgggcgccggccggacgtgccgccgggagcctccaccgcgcccgtgcgccgcagtttctgccagcgcagccggccgccggtgagcgcggtgatccaggactggagcagcacgacgtacatgagctggcggtacaggatctgctggagcggcagcgagatcaggtgcgtcatacgctccttgtccagccggaacgcgtacgcggcgcacaccgcctggacgaacaggacgccgaaccacgcggcgacggtcctgccggtggggccgaagaccagcccgtacagcaggaacacgtcgatcaggggcgcgaggagcggggcgacgaccatgaagagggagacgaacggcagcccgacccgtccgaagcggcccgagggtccgcgttcgatcaccgcgcggcggtgcttccagatggcctgcatggtgccgtacgaccaccggtagcgctgcgaccacagctgctgcacggactcgggggcctcggtccaggcgcgggcgttctccgcgtagacgacgcgccagccgtcccggtgcagggccatggtgacgtcggtgtcctcggcgagggtgtcctcgctcatcccgccgacccggtccagtgcctcgcggcggaacgcgccgacggccccggggatggtgggcatgcagccgagcacgtcgtacatccggcggtccaggttgaagcccatcacgtactcgatgtgctgccaggcgccgatgagggagtcgcggttgccgaccttggcgttgcccgcgacggctccgacccgggggtccccgaagggctggaccagctcgcggaccgtggccggttcgaagacggtgtcgccgtccatcatcacgacgatgtcgtaacgggcgtgccggatgccgttgttgagggcggcgggtttgcccgcgttccgctggcgcacgacccgtacgcggggcagccgcatcgcctcgacgaggtcggcggtgccgtccgtggagccgtcgtcgatgacgatgatctcgatggggtgctcactggcggccagggagcgcacggtcgcctcgatgcacgcgcgttcgttgtacgccgggaccaggacggagaccgggcgggtgacgggcgggccccagacgaagttcctgcggcggaccttgcgggcgtgcaggaaggagagcagcagcatcagtccgaagcgggcgaggaccaggacgccgatgacggcgaggccgacgaccaggacaccggtgatccgctcggacacggcgacggcggagacgaacgccttgcccttccacagcgcgaacccggtgaccggggtgtgcgcactgggggagtcgagggcggtggtgagacgggtgaaggtgtagccccgctccttgaggtccggcagcagggtgccgagcgcggccacggtctgcgagcggtcgccgccggagtcgtgcatcaggatgatcgcgcccttgccgtccttcggtgttgcccgctcgacgatggcgcggaccccggggcgcttccagtcctcgctgtcggtgtcgttgacgacggtgaggtagccgcggctgccgatgtactccgtgaccggccaggacgtgttgtccatggcgtacgagaaggaggagtacggcggccggaagatcgaggtgcggatgccggccgcgcccgccagcgccagctggttctgcgaaagctcccagtcgatgcgcccggtggactggtaggagaggtcggggtggttgaaggtgtgcaggccgatctcgtgcccctcggccaccatccgctcgaccagcccggggtaacgggcggccatgttgccggtgacgaagaagacgccgtgtgcgtcgtgctccttcagcttgtcgagcaccttcggcgtccacaccgggtccgggccgtcgtcgaaggtcaggacgatccggcggtcgggtatgcgcagggtctcggcgtcaccggaacgggcgtcgatgacgggaccgccggagaggacgtccttcggcacctgggtggtgcggtcggcgccgcggacgcggtggtcggcgaggatctcgctgtgcacgtatccgcgcagcatcagcatcgcgagcagggcgacgaggaacgtcgtcggcaggaggtagcgcatggggagcctgaaccggctccggccgcgtggcgctttcctcgatctgccgttcctgccccgcgtggcgggggagttcatctacggggcgctctcttcctgcaccggcgggtcgggtgtctcggcgg

SEQ ID NO: 3117 - DNA, 1840 bp, Unknown
  Kingdom: Bacteria, Phylum: Actinobacteria, Class: Actinobacteria, Order: Streptomycetales, Family: Streptomycetaceae, Genus: Streptomyces
gcgctgcccccgggcccccgcgcctcaagcgccgacggggctgaacacgctcgcctcaaccgtcggcggggctgggacggtgtggctccagcagggccgttttgacccgtgcgggggctccccggtaggctctcggtttgttatacgtattggcttcgtcgttctcacgcgaagggccttacgtaggttccctggagcagttaccagtggttcgcatacgggcagcgtccccggcattgtgaaccccagctgcatatcgcttcagaggtgccgtgtgtctggatcccatccactgaagaagcgaaggctgcgaagtgcgtacgtacagccccaagcccggcgatgtcacgcgccagtggcacatcattgacgctcaggacatcgtcctgggccgtctggccaccacggctgcgaacctcctccgaggcaagcacaaggcgatctacgccccccacatggacatgggcgacttcgtcatcatcatcaacgccgacaaggttcacctgtccggcaacaagaagacccagaagatggcgtaccgccactccggcttcccgggcggtctccgttcggtgcgctacgacgagctgctctcgaagaaccccgagaaggccgtcgagaaggccatcaagggcatgatccccaagaacaccctgggccgtcagatgctctcgaagctcaaggtctacgcgggcgaccagcacccgcacgctgctcagcagccggtcccgttcgagatcacccaggtcgcgcagtagttccggccaccccctaagacatacagaaagatctgaggagaatcgtggccgagaccactgttgagacccccgtcgagggcaccgagggcgaggagaccttcgccgaggtgaccaccttcgagtccgaggtccccgtcgagggtgagtacacctccgagtcgctcgcgggccgcttcggcgacccgcagcccgcggccggccttggccgtcgcaagaacgccatcgcccgcgtccggatcatcccgggcaccggcaagtggaagatcaacggtcgcacccttgaggactacttccccaacaaggtgcaccagcaggaagtcaacgagcccttcaaggttctcgagctcgacggtcgctacgacgtcgtggcccgcatctcgggtggcggtgtctccggtcaggccggcgccctgcgcctcggtgtggcccgctcgctgaacgaggcggacgtggacaacaaccgcgccatcctgaagaagaacggcttcctctcccgcgacgaccgtgcggtcgagcgcaagaaggccggtctcaagaaggcccgtaaggccccgcagtacagcaagcgctaaacatcgcctgctcgactgtcacgttcgccccggcggcacactccgtgctgctggggcgttcgtttatcggcgctcgcgggcgtataacggcataagacgttcatcggctcgcgcgggaccgtggcccggtgagcgccgtcgagcatcccgcacgtcgtcgcgccatgccgtctgacgtgcttttttgcttcttttcgttgctttcgttgtttggttgctcagttcgattgctgtgcagtggtttgtggtttcggagcacttcggaggacaccagtgggacgactcttcggtacggacggagtacgcggtgtcgccaacgccgatctgacggccgagctcgcgctcggcctctcggtcgcggcggcgcacgtactcgccgaggcgggcaccttcgcgggccatcgcccgaccgccgtggtcggacgtgatccgcgggcctccggagagttcctggaggccgccgtcgtggcgggtctggccagcgcgggtgtggacgtgctgcgcgtcggc

SEQ ID NO: 3118 - DNA, 2154 bp, Unknown
  Kingdom: Bacteria, Phylum: Actinobacteria, Class: Actinobacteria, Order: Streptomycetales, Family: Streptomycetaceae, Genus: Streptomyces
gggtgtgatgggcgggagttgggggcgtagcgtgggtggtcggagtgccgcgtggagcggcgtcccgttcatcccctaatgtggctttctcgtccatatgtggttggggaagggacttgatggagtcgatggagcgcaccgtcgtccgttgtgccgaagggcatgttttcgctacctcgtcgttcccgatgcagcagctcggggccggccggatcgggcccgggcggttgatccggtgtccccggtgtgcgcggctgcggcaggccgtgccggtggcgttcgagaagcggtagcaagcggacgcgggaaagacgagcggacgcgggaaagagatgtagcggggtggaggtgttccgcaggcgcgcgggtggtccggttggggcgggctcgcgcgttctgcgtatcctcgggacgtgcttctctcagacaaggacatccgggccgagatcgacgccggccgagtccgtattgatccgtacgacccttcgatggtgcagccgtcgagcatcgacgtgcggctggaccgctacttccgggtgttcgagaaccaccggtacccgcacatcgatccggccgtcgaacagcccgatctgacccgtacggtcgagccggagggcgacgaggcgttcatcctgcatcccggggagttcgtgctggcgtccacgtacgaggtgatctcgctgcccgacgatctggcctcgcggctggagggcaagagttcgctcgggcggctcgggctggtgacgcattcgacggccgggttcatcgaccccgggttctccgggcacgtgaccctggagctgtcgaacctcgcgaccctgccgataaagctctggccgggcatgaagatcgggcagctgtgcctgttcaagctgacctcgtcctccgagttcccgtacggctccgagcggtacgagtcgcggtaccaggggcagcggggcccgacggcctcgcggtcgttccagaacttccatcggacccaggtgtgatcaatcatggcgagtgacgagcgggaaaacctgacgtacgagggcttcgggcgggccgtgcgcgagctggcgcaggccgtcgccgacgacgggtacgagcccgatgtcgtcctcagcatcgctcggggtggtgtcttcgtcgccggtgggctcgcctacgcgctcgactgcaagaacatccatctcgtcaatgtggagttctacaccggggtcgggacgaccctggagatgcccgtcatgctggcgcccgtgcccaatgcgatcgacttctcggagaagaaggttctgatcgcggacgatgtcgctgatacgggcaaaacgctcaagctcgtccacgacttctgcgtcgaccatgtcgccgaggtgcgcagcgccgtcatctacgagaagtcccactccctcgtgaagtgcgagtacgtgtggaagaagaccgaccagtggatcaacttcccgtggagtgtggagaagcccgtcgtgcggcgggacgggcaggttctcgactcctgaccccacccacctatgtggcagtacgtgagaagcccccggagcgtgttctgtgctccgggggccttctcacatacggcgcggtttctcagatcgtgcccagcttgatgatcgacagcagcgcgatcagctggatcgccgatgctcccagcgccttcggccacggcaggtcgtgcgacttgctgaccattgacgtgaacagcgccccggccgccagccaggtcatccagcccacgatctggaccagggagttctcgccgcccaggaagacggcgaagagcaggcgcggagcgtcggtcatcgacatgatcagcatcgacaggcccaccgtcggctgccacgagcccgtgccgccgagctggcgggccagggagtgggtcaccgcgccgaggaccaggccgccgatgacgaagccgacgccggtgaacagcacgtacgggatggccgtcgagatcgtcgcgttgatggcttcttcgcgcgcctggtcgaagccgaacagcgcgagcaggccgtagaggaacgtgacgaccagcgccgggccccagaccgggtagtcccgcatctgccagaacgtcggccccgggcgcgtcacgatgccggtcagcagttccttccagcgcagacgcgggcccgcccggctgggcgggcccgcgtctgcgct

SEQ ID NO: 3119 - DNA, 5905 bp, Unknown
  Kingdom: Bacteria, Phylum: Actinobacteria, Class: Actinobacteria, Order: Streptomycetales, Family: Streptomycetaceae, Genus: Streptomyces
ccttcggggaggcgttccgctcgtccggtgctgaggtcgtcgaggacgacgaggcgctcctcgcccgccatctgcgcgacgacgtgggatccgatgtagccggccccgccggtgatcagccaggtcatcgtcagccgccgatgacgacgcggcgcacgcccgcccagttcgccgggtccgtggtgcgccggccgtcgaccaggacgcggacgtccgggaggtcggcggcggacagctcgcggtactcggcgtggtcggcctggaggatcgcggcggtgacggcctggtggctgtcgtgcgggacgaggccgagggcggtcagctcctcgggggtgtacatcgggtccgagacgaagggcaccgcaccccgcgccttgagtgcctcgacgacaccgaagacaccggagaacgcggtctccttgacgccgccgcggtaggccgcgcccagcaccaggacgccgacgccgtccaggtcgccgtaggcggcggccagcaggtcgacggcgtacgcgggcatcgcggcgttggcctcgcgggccgagcgcacgacggtcgcctccgggtcgttccacaggtacatccgcgggtagatcgggatgcagtggccgccgacggcgatgccgggctggtggatgtggctgtagggctggctgttgcaggcctcgatgaccttcttgacgtcgatgtcgttctggtcggcgaaccgggcgaactggttggccaggccgatgttgacgtcgcggtaggtggtctcggcgagcttcgccagttcggaggcctccgccgtgccgagatcccagacgccgttggggcggggcaggtcctcgcgctcgtcgaagtcgaggacggcctcgtagaaggcgacgccgcgctcggacgacgcctcgtcgatgccgccgacgagcttggggtagcggcgcaggtcggcgaagacccggccggtgagcacccgctccggggagaagaccaggtgaaagtcctcgccgggggtcagacccgagccctcggccagcatcggcgcccagcgggtacgggtggtgccgaccggcagcgtggtctcgtagctgaccagggtgccgggcttcaggcccgcggcgatggccttggtggccgagtccatccagccgaagtcgggggtgccctcggcgtccacgaagagcgggacgacgaccacgacggcgtcggaagcggcgaccgctgccgtggtgtccgtcgtggcggagagcaggccggcgccgacggtctccttgagcaggcggtcgaggtcgtgctcaccggggaacggctcggtggccgcgttgacgagttcgacgaccttctcgttgacgtccgcgccgatgaccttgtggcccttggcggcgaactgcacggcgagcggaagtccgatcttgccgagcgcgactacacagatattcatcgggttacttcctcttcgacctggacagcgtgcggcgcagccgtgcgcccacggtgggcttcggttcccgcaggggggccgtcgtgatcacgagccggcccttggtgttggtgttcgccgccacgcggtgggggtcgttggtcccccagcggcgggccagcggcatcggctgcccttcggtgcggaccgggatctcgtacggggagcccgccacgtccacgtagaggcggacgcccctcttggtgctcgtgagcgccagcgggatacgtgcggtcagcagggtgccgccgtcctccgccgcttcggcggtgagcgtgccgctgcccttcggacgcggagtgtccgcgggcagcctgcgcgcgccggacttgtccgcgctctgcggcatggcgccctgggcgagggcgacgacggccgaggaggtatcgccggtgatgccggcgcgcagccgcacgacgcaggagaggttcgtgccctcctgctcccagtcggccgccaccaggcgcgtaccggcggagaggcggcccgccaccgactcgccgagcacctcgtagtaccggtcgtcgaggccgatggccgcgttacggaaaccggggtaggcggcgaaggcgcggccgccctccagcaggaagggcggtgctccgtgctcggtctcctccgcgatggcgcgggtcagctcgtcgacggcgccgctccgggcgaggccgaagcgcacccggcgcttgactccggtgccgtcgcgcaggccgtcggtgaagtaggcgtccaccagtgcgccgacgccttcgcccacctggcggcgggtgtcggcgtcgagcgcggggaagtccttctgcaggagcttggtgagctcccagtcgaagtggcgcttgaacacggcgtcgcgtcgcgggccggcggggatcagggcggccgtgtgctccatgatccgctggatgcagcggagccgggccaggtggtccgcccggtaggtgatgttgctcgcgtcgccgcgcttgaccgcgtagtagcaggtgtagtcggagatcacggagatcttgcgggcccggacgcacgcctcgatggtgaacggctggtcgctgccgaccggcatgtcctcggggaagcggagcccgtgcttctcgaccagttcccggcggaagagcttggtgttggccagggtgtagggcagctcggagtcgtcgagggtgacgtcgcggttgccggtgtacagcttctggtggacgtaacgcccgttggtgccgaccatcttgccgacgaccacgtcggactcgttggcgtccgcgcaggcgaccatccgctccagggcctcttcgccgaggtggtcgtccgagccgatgaagtacacgaagcgaccggtcgccaggtcgagggcgcggttactcggagcggccgggccgcccgagttgggctggtggacgacggtgaagacgtccgggtaccgctgcgcgaagcggtcgagttccttgccgctgtcgtcggtcgaaccgtcgtcgaccgccacgacctgaagccgcgcgtgaccgatgctctggcccaccagcgattcgaggcactcggtgaggtacggcatcgtgttgtagacggctacgacgaccgtgacatcgggtgtggtcaccttctgggctcctgcttctggtcccggtccgcgggaatcagcaccgtggtgccggtggtggcggattccagtacggaggcggccacctcgaccgtacgcagcccctggcgcagggtgcagatgtcggcgggctcaccctgcacggcgtcacggaacagctcgtgctcgacgagcagcggctcgcgcttggggatggcgtagcggatcatgtcgccctcggagacgccgcggaaggcgcgcagcgcttcccactcggtggtgaccgcggcgttggagtggaaggtgaggtcggcggtgagggtgtcggcgatgaagcagccgcgctcgccggtgaccgaggtgaagcgttccttgagcgggctcagccagttgaccaggtggttgaccatcgtgccgtcggacagctggcccacggcggagaccatgtcctcgtgcgggcggccggacttggagacggtgtgggccgcgatcgaggtgtacgtccggccggtgacccagcccgtcaggtcgatgtcgtgggtggccaggtccttgaccacgccgacgtcggcgatccggtgcgggaaggggccctggcggcgggtgacgacctggtagacgtcgcccagctcgccggcctccagacgggcgcggagcgagaggagggccgggttgcagcgttcgatgtggccgacgccggccaccaggccgcgcgactcgaacgcgtcgacgaggcggcgggcgccctcgacggtgtcggcgagcggcttctcgatcagggcgctgacaccggcgtcggcgagctggaggccgacctcctcgtgcagcgcggtcgggcaggcaacgacggcgtagtcgatgccgagggcgatgagctcctcgacggtggcgaggacgggagcgccctgggcccagccgttcttgtcacccatcgggtcgacgacgcctaccagttcgacgccttccaggctcgcgaggacgcgggcgtggtggcggcccatggagccgaggccgacgagtccggccttcagtacggcgctcacaggttctcccccagggagttcaccgcggcggcgatccgctccaggtcgccctcggtgagcgaggggtggacgggcagcgagacgacctcggcggcggcccgctcggtctcgggcagctcccaggtgcggccggccttctggtccggctcccagtagggcttgagccggtggatcggcgtcgggtagtagaccgcgttgccgatgcccgcctcggtgagcttcgccatggcggcgtcccggtcgccgctgatccgcacggtgtactggtggtagacgtgccgggcgccctcggccaccggcggtgtggtgacggccggggaggtgatgcgggcgtcgaggtacgcggcgttggcgcggcgctgttcggtccacgcctccaccttgccgagctgtacgcggccgacggcggcggacacgtcggtcatccgcatgttggcgccgacgatctcgttggcgtaccgctgttccatgccctggttgcgcagcaggcgcagggtgcgggccagttccgcgtcggccgtcgtgaccatgccgccctcgagggagtgcatgttcttggtcgggtagaagctgaaggtgccacccgcgccgaacgcgccgacgggggtgccgttcagcgccgcggcgtgggcctggcaggcgtcctcgacgacggcgagcttgtgcttgtcggcgatgggcatgagcctgtccatcgccgcggggtggccgtagaggtgcaccggcatgatcgcggcggtgcgcggcgtgatcgcggcttcgaccgccgccgggtcgaggccgaagctgcccggctcgatgtcggcgaacaccacgtcggcgccgacgaggcggaccgcgttcgcggaggcggcgaaggagaaggaggggacgatcacctcgtcgcccgggccgatgcccagcgccagcagcagcaggtggagggctgaggtccccgagttgacggcgacgcagtgccggtcgtcgaccaggcgggagaagccttcttcgaaggccgcgacttccgggccctgcacgacgcgaccgctgcgcagcacgcgtaccgcggcctcgatctcgtcttccccgatgaccgggcgggcagcaggaatcggctgctcgttgatgctcgtcatgaacgtcctccttgaacaccgcaagagctcgtaaccaggcagagctccgaggtgcgggacgtcttaccgaggtcgcgcgtaaccccaccggcgcgatgccgacgccctgccgaggaatccggcccgatcggtatcttcgccgggccttgtcaccaaccgtagtttcgtgatgaacgctcatacgcatggcaaccgtcgtcacattatcagggatttcttggcccatttcgggctcgttaaccggcccctgcatcagttctgaaacaaagcaggtgtcccgccccgatgcgctcggaacgggacacctgaagatgaacaaccggttacggattcatcagccggccgacgactcgcccgcctcagaaggcgcggaagccgttacggacggcgacgactgctcggcggcgacggtcttcttcgtcgtcttcttcgccgccgtcttggccgtcgtcttcttggcggcggccttcttcgcgacggtcttcttggcggcggccttcttcgccggggccttcttggccgctgccttgcgagccgtcttcttcgccggggccgcctccatggattcggattccgacgttccggattccgccgctccctcggcgccctgtccgtcggattccggggccttcgccccgggcgccgaagcgaccacgacgacctccgcgtcgtccgaaccggtgggcgagcccgccggagcggtgaccttgcgggtcacccggcgccgggtgac

SEQ ID NO: 3120 - DNA, 2660 bp, Unknown
  Kingdom: Bacteria, Phylum: Actinobacteria, Class: Actinobacteria, Order: Streptomycetales, Family: Streptomycetaceae, Genus: Streptomyces
ctcggtcgtcggcttcgacgactcgcagctcatcgcgttcaccgacccgccgctgaccacggtgcgtcagcccgtgcaggcgatggcggcggcggccgtcggcgcgctgctggaggagatcggcgggagcccggtgcagcgcaccgagtacgtcttccagccggagctggtggtacggggctcgacggcggcgctgcgcaacggctgaaccgcgaagcggcagcgggtccgcaggggaacgggcacgtacaggagaggcaccaggagtcggcccaggaagggccggcggggagttgcagcgactccgggtgcctctcttgtcgtgaccggcccggccggccgggcgcgtggggttccgacgacgtgatgcggcgccggaacccccggccgaccggaccggagtcgggatgaaacgtaacaggcccgcaatatcttgcgaaagaccttgcagcaagaaatcgggaggaagccgggaagaaatctctgctgttacgcggatgtgagcgggggatgtccaaagggttgaccggtgacgggagggctcgtacggtctgctccgcggcaaggtttgcattcttgcagcaagaaccttcacgagccttgagggcacggcgcgttgtcgactgaggctgcaccgtcatccccgcttcccccacccgcaggaggaaagacatggcacgcagacccctgtctgccgcgctcgccctcgtggccggcgccgccgccctcgtcatccccaccggattcggcgccgccggcaccgcacaggccgccgctccgggcgacaaggacgtcaccgccgtgatgttcgagtggaagttcgcctccatagccaaggcctgcacggacaccctcggtccggcgggctacggctacgtccaggtctcaccgccccaggagcacatccagggcggccagtggtggacgtcctaccagcccgtcagctataagatcgcaggccggctcggcgaccgggccgccttctccgccatggtgaacacgtgtcactcggccggggtcaaggtcatcgccgactcggtcatcaaccacatgtcggcgggcagcggcaccggcaccggaggctccgcgtacaccaagtacgactaccccggcctttactccggcagcgacctcgacgactgccgggcccagatcagcaactacaacgaccgcggcaacgtccagaactgcgaactggtcggcctcgccgacctggacaccggcgaggactacgtacgcgggaagatcgccggctatctcaacgacctcctctcgctcggcgtcgacggcttccggatcgacgccgccaagcacatgcccgccggtgacctcgccaacatcaagtcccggctgagcaacccgaacgtctactggaagcacgaggcgatcttcggggccggtgaggccgtctcgccctccgagtacctgggcagcggggacgtccaggagttccggtacgggcggagcctcaagcaggtcttcctcaacgagaacctcgcccacctgaagagcttcggcgagggctggggtttcatggagtccgggaagtccgccgtcttcgtcgacaaccacgacaccgagcgcggcggcgacaccctcaactacaagaacggctccgcctacaccctggccggcgtcttcatgctggcctacccctacggctccccggacgtccactccggctacgagttcagcgaccacgacgccggaccgccgaacggcggccaggtgaacgcctgctacagcgacggctggaagtgccagcacgcctggcgagagatctcctccatggtcggcttccgcaacaccgcccgcggccagggagtcaccaactggtgggacaacggcggcgaccagatcgccttcggccgggggaacaaggcgtacgtcgccatcaaccacgagggctccgcactgaaccggaccttccagacctcgctgcccgccggcgactactgcgacgtccagtccggcaagggcgtcagcgtcaacggctccggccagttcaccgccaccgtcccggccggcaccgccgtcgctctgcacgccggcgcccggacgtgcggcggtggcggcacgaaccccggcccgggccccggcgacggcgcctccggcgcctccttcggcgtcaacgccaccactcagcccggccagaacatccacgtcaccggcgaccaggccgccctcggcaactggaacccggcgaacgcgccgaagctcgacccggcggcgtaccccgtctggaagctggacgtgaacctgcccgccgggaccacgttcgcctacaagtacgtccgcaaggacggatccggcaacgtcacctgggagagcggcgcgaaccgcaccgccaccgtcccggccaccggcaaggtcacgctgaccgccgacgtctggcggagctgaaccctggggcctgtcgtcgaactcccgcctgccgcgctccgggcgacgacgggagtctgacggcaggccccgacccccagcgggcctgtggcatcgcctccggcccgcctccccgctgatcgacccaccgctcgaccgaccgatcaagccccaaggagcaccctccgtgtcccgaaccatcctcggacgatggacggtggccgcccgggacgacggcgcagcagcgccgtcgcacacggcggccaccgtccatcgtc

SEQ ID NO: 3121 - DNA, 820 bp, Unknown
  Kingdom: Bacteria, Phylum: Actinobacteria, Class: Actinobacteria, Order: Streptomycetales, Family: Streptomycetaceae, Genus: Streptomyces
  misc_feature (332)..(363): n is a, c, g, or t
agctccgcccccgcgacggcgttgtggaagccgaccatgccggtgaccgcctgctgtgcgtgcgtgcaggtccacgcgccggagccgcagtcggccgcaccgccgttcggcgggccggcgtccttgtcggtccaggtgtagccggagaagacgttcggggagccgtagggcgaggccagcatgaagacgttggccagggtgtaggccgcgccgtccttgtgggtgagggtggagccgttgcgctcggtgtcccagttgtcgacgaacgtacgggcggagacgccggccagcttgccgtcggcgaccgacttcaggccgggcaggccgccgcnnnnnnnnnnnnnnnnnnnnnnnnnnnnnnnnggtgccggagccggcggccatgtggttgatcacggcgtcggccacgacctggaccccggccgcgtggcagctctccaccatcgcggcgaaggagtcccggtcaccgagacggcccgcgatccggtagctgaccggctggtacgaggtccaccactggtcgccctggatgtgctcggcggcgggcgagacctcgacgtagccgtagcctgccgggcccagggtgtcggtgcaggcggtggccaccgcgtcgtacttccactcgaagagggtggcggtgacggtcttcccgcccggtggggtcgcctgggagggccagggggcgaggaccgtgaggcctccggcggcgagcaggcccgccagggttgcgcgtgcggcgcgggaactcaattgcggctccttcggtcgcgggttcggagcgttcgcccgtacccggcgtgggcagccacgcgcctggctg

SEQ ID NO: 3122 - DNA, 944 bp, Unknown
  Kingdom: Bacteria, Phylum: Actinobacteria, Class: Actinobacteria, Order: Streptomycetales, Family: Streptomycetaceae, Genus: Streptomyces
gagcgcgacggcgacgtgccacacctcccgtcccgcgcccaccccgagcagggcgagcaggaccaggggctgggaccaccgcaggacggcaccgggccgcacccgcgcgaccaccttctcggtggccacgctgccggcccccgccaggatcgggacagcggcgaggaagacgggcagcagcccgtcggatatcccgtactggtcctgaacggcggggatacgcgtcaccagaagggcgaaggccaccccttgaacgccgaagctcaaccccagggaggccctgccgtgccgcaagcccgcatcagtcatggccgcgagcgtagagccaggttctacccaggggtagatggatcaggcgagcagttcgggaagctgagccatgtcggagaagtgcccggtcactccgacgagccggtcggcgggcatcatcgacgtgaacccgtacacgtccatccccgcggcacgggccgcctcgaccccgagcggactgtcctcgatgacgacgcaccgctccggcgcgacgcccatccgctcggcggcgtacaggaacaggtccggtgccggctttccccgcccgacgtcctccgagctgaagatccactcctcctcgaaccactggtcgatccccgtcttgcggtgcccgacccggatccgctcgtggctcccggaggaggcgacgcagtagtccaccccgtccgcgacgagcttcccgagcagttcctcgaccccgtccacgaccacgagctcccgctggaaagcggcgaacgtacgggtgttgagcgtggagtcgaagtcctcgggcagcttctgcccggtcctctcctcgacgagatcgtggacccggtgcacggcggaccccatgtagtcacggagcgattcgtcgtacgaggtggggtgaccgagttcggtcaggtagccggagaggacggtgttggcgagcggct

SEQ ID NO: 3123 - DNA, 6015 bp, Unknown
  Kingdom: Bacteria, Phylum: Actinobacteria, Class: Actinobacteria, Order: Streptomycetales, Family: Streptomycetaceae, Genus: Streptomyces
ggagaacatctggctgcggaccaagcgctacgacgcgggcggcaaggtcagaagcggtacgggcggggtgtgttacgtctactggccgacccggacgacaccgggtcagcagcgcgtgctgcggtcgctcggactgctgtgagcggtcgggtgcggccgcgcggtcctcccgctcatggtcggccgggcgccgccacgccccagcgcctcggcaaccgcgccggtcggtccggattcatccttgtccaccggacgagaccttagcgggatccttcccggcgggcggggggagcacgacgcatgtccatccgctggtccaaagtgtcctcgcgccaagggagttgccggaggtgagcgctatgttgaacgcgtgaacgacatcgaatcgcgcatcgacgcatcccgaccgcacaccgcccggatatggaactactggaccggcggcaaggacaactatccggtcgatcgggcggccggtgacgagatccgggggctgcacccggggatcggcgcatacgcgaaggcggaccggttgttcctgggacgggcggtgcgacacctggccgagcaggtgggcatcacgcagttcctggacatcggaacggggctgcccagtgccgacaacacccacgaggtcgctcagcgcgtgacccccgacgcccgtgtcgtgtacgtggacaacgatccgctggtgctggcgcacgcccaggcactgctggtcgggacgcccgagggccgcaccgactacctggacgccgacctgcgggacgtcgacacgatcctggccgcggcggcgaagaccatcgacttctcggagccggtggcgctgatgctgctcggagtcgtcatcttcgtcgaggacgacgaggagtcgtacgcgatcgtccgccggctcatggacgcgctggcccccggcagccacctcgtcctgtcccacacggtcacgcaccccgacatgcccgacgtggacgcagcggtggcgttctggaacgagcacggtacgcccaagctcacgcagcggaccccggccgcggtcgcgcgctacttcgagggactggagctgctggagcccggggtggtgtcgtgctccgcgtggcgggccgcgacgccgacgcccgacgtcgcgatgtacgcgggcgtcggccgcaagtgagggcggatgctccggacgcgggcccggcaccgaggtccgccgctggcgtacaggccccgctgtggccctgggcgcggtgtggcgtcgcccactgcgcgtgcccgcccgcgtcgccggcccggcgtgcttttccctgccgcaccgggggagtggggcacccccgggtgcccggtccgtgaccgggatctcctttcccgtggcccggtgtcctgacactctggtcgggtcacggggagacccagccgaagccgtacgaagagcgagacgccatgaccgcgaccaccgccgcaggaaacgcccaccacgcccgccgcgcgcgcaccggcgggcccgaggacggctccaagctgatggagcacatcgccggctgggccttcgtggtcgtgttcgcgatgctcgtcacccagctcggtctgctgtgacggcccgactccctactcccgggacagggcagggtgcgtgaaagggcggggcgcccgcccggcaccccgcccgtcgacccttgaacgctagcggatcgccctgatcagctcaccgttcccggtgtcaccgctcagctcccagaagaacgtgcctcccaggccctgttcgttcttgtagttcatcttggtgccgatggtctccggggtgtcgtagctccaccagtcggtgccgcagtgcgcgtatgccgtaccggccaccttgcccgtggcggggcagctgttcttgaggaccttgtagtcctcgatgcccgcttcgtacgtccccgccgccgcaccggtcgcgctgccgcccggctcggaccgggtgacaccggtccagccgcggccgtagaagccgatgcccagcagcagcttctccggcgggatgccgagggacttcagcttggagatcgcggcgtcggagttgaagccctccgtcgggatgcccgggtaggaggtcagcggggagtgcggggccgtcgggccctgcgccgcgaacgcgccgaagaagtcgtacgtcatcggcaggtaccagtcgaggtgcttcgccgcgcccgcgtagtcgaccgcgtcgatcttgccgccgtcggagccgtccgccgtgatcgccgaggtgatcaggttgccggtcccgaaggacttgcgcagctcgcccagcagactgccgtacgcgtcgcggccgctggtgtcacaggtgagaccacaggcgttggggtactcccagtcgatgtcgatgccgtcgaagacatcggcccagcgggggtcctccaccaggtcgtagcaggatttcgcgaacgcggccgggtttcgcgccgcctcgccgaagccgccggaccagctccagccgccgaaggaccagaggatcttgaggtcggggtggagcttcttcagcttgcgcagctggttgaagttgccgcgcagcggctggtcccatgtgtcggcgaccccgtcgacggactggtcggccgtgtacgccctctcgtggtcggcgtaggagtcgccgatcgtgcacttgccgccggtcacgttgccgaaggcgtagttgatgtgggtgagcttgtccgcggaacccgacgtctcgatgttcttgacgtggtaattgcggtcgtacgtaccccagttggtgaagtatccgatcaccttgtcgcccgccgccgtgggggcggcctcggccgcggcggaggccgcggccggctgtgcggcgggggtggcgccggccggggacattcccgcgacgccgagcagggtggcgccgagggccgccgtacaggcggccgcggcgagcgcccggagccgggcgcggggacggtgcggttcgagcatcgtggctcctcgtgggggagggctggtgcgtggggggtgctggtcgaacggcgggcgagagtgcccgatttgacatgaacgcgatgcgcgttcggtggaaccgtagaaggactagaccagttgggtcaatggttcgaaccaattcgccgggggtccgcggtccctccccgccgtccggcctgcgcgttgacccccgtgacgggaggcacccgatcgggcatactcaacccgccacagccgatgaccgtgccacccgtgacccggaagggcaggatcggcgggacagtctgttcttttcccgggtcacttccgggagatcacccggcggcgcctctcccaccccgagcgcgcgaccgccgcaacgcccgacagggaggagagcgccgtcatgtccgaccgtgccccgcagccggtggaacgccgtctgcccaccgaggagtcccggcagctcgtcgcgctcgtccgcgacatcgcgtcgaaggagatcgctccccgggcggccgaggaggaggaagccggagtcttcccgcgtgaggttttcaccctcctgtccgaggccggactcctgggactcccgtacgactccgcccacggtggcggtgaccagccctacgaggtctacctccaggtcctggaagaactggccgccgcccggctcaccgtcggtctcggcgtcagcgtccactccctcgcctgccacgccctggccggatacggcaccgacgagcagcgcgccgcacacctgccggccatgctctccggcggcctgctgggtgcctactgcctctccgaacccgcatccggctccgacgccgcctccctgcgcaccaaggccgtgcgtgacggggacgagtgggtcatcaccggcaccaaggcgtggatcacccatggcggcgtcgccgacttctgcaccgtgctcgcccgcaccggtgtcgacggcccccgcggcatcacggctttcctcgttcccggcgacgccgagggggtgaacgccgctctccccgagaagaagatggggatgaagggctcgccgacggcccagctccacttcgacggcgtacgggtcggcgacgaccggcgcatcggcgaggagggccagggcttcgccatcgccctgtccgcgctcgactccgggcgtctgggcatcgccgcctgcgccgtcggggtcgcccaggcggccctggacgaggccgtccggtacgccacggaccggcggcagttcggccgccccatcgcggacttccagggactgcggttcatgctcgccgacatggccacccagatcgaggccggccgcgcgctgtatctggaggcggcgcggctgcgggacgcgggggagcccttctcccggcaggccgccatggcgaagctgttctgcacggacgcggccatgcgggtgaccaccgacgccgtacaggtgctcggcggatacggctacacgctcgacttcccggtcgaacggctgatgcgcgaggcaaaggtgctccagatcgtggagggcaccaatcagatccagcgcatggtcatcgcgcgccatctcgcgggtcccgagacgcgctgaaccgcagcggcgcctcgggccagggaggcagtgccgcggcctggttccactccgggtcgcggcggcccggcagcgtgcggccgtcgctctcccactgcctgagcagcgcgctgtagatcggcgggtccacgggtgcacccatgggtgagctccccgtggagcggggcagtggctgtgcgggcgctcccggctgcggaaccgattcttcgggggcgggtgcggcgagacggcggcgacccggaccgactgttgaatgcagcgtggtcatacggggccaacgccgcagggcgggccggggtcactgccacgccgattcgagcgctcgttcgcgggtgcccgcacccggtcgccggcgaccggggggtacgccctgcccagcaccacggcggccggggccgtcgtggtgctgggcagggcgtacggcgtacgggtcaggcggcctcgtgccgcatccgcggtacacgcagcgggcgggagccgggtccgccggcgtgcgagaagggctgcatccgccagtcgagtccctgggggagcgtcaacagcagccccgcctcctgctcctggagctccagcgtctcgtccgcggggcgggcgtcgctcacgccgcggccggtcccggcgcagacggtgaggacgaaggggttccacggcgtggggcaccgggcgtgctccggcaggacgtcctcgtcggccagcagcgcgatgggctgggcgcagtccgggcagatcacccggaccatctcgaacatgtcgtacgcgtcggcgctaccgtcgtcgtccggatcgacaggctccggttcggtacgttcggtgagcttcaggctctgcatggaagttcccccctcgggtgggccgacaaggcgccacggcctcgaccacagcaagcacttcccgccgcgcatcgccggtaatcgcgaggcggcccgccaccgccccgtgggcctgtggcgttcgtcacatgccgcccgcaggtgccgttccgtgacccgcgcgactgtgccgagcggtgcccggggccataggttgatccacatggaggagctggaccgtcagatcgttgagttgctcgtcaaggacgggcggatgagctacaccgacctgggcaaggccacgggcctgtccacttcggcggttcatcagcgcgtccgccgactggagcagcgcggggtgatccgcggctacgccgcggtcgtcgaccccgaggccgtcgggctgcccctcaccgcgttcatctcggtgaagccgttcgacccgagcgcacccgacgacatcgccgaacggctcgccggggtgcccgaactggaggcctgccacagcgtcgccggggacgagaactacatcctgaaggtgcgcgtggcgaccccgttggagctggaacacctgctcacccggatccgcacactcgccggcgtgtccacccggaccaccgtcgtcctgtccaccccgtacgaggcccggccccccgcgtatctgaacggcgggccgtccgctccgcgagggggccgggcctcgtacgg

SEQ ID NO: 3124 - DNA, 1638 bp, Unknown
  Kingdom: Bacteria, Phylum: Actinobacteria, Class: Actinobacteria, Order: Streptomycetales, Family: Streptomycetaceae, Genus: Streptomyces
atcccggccgggatcctcggctggacccacaccgcgcccagcggctggtcggtcgtgaactccgcgatgggcaccgggggcgtcgccgagtggcgcggctggtccttcgccaccgacgagttctggagccgcagccagcgcgaccagtcccgtgagctgaacgtccgctcgcgcgggatcttcgcggtcgccgactccgacgagtgggacgacaaggcgtcctccggaccgtacgactccacgctcgtcaccccggcgtacgcggtcggcggcaggtccagggtgacgctcggcttcaccaccctctaccggcaggagggcagccagagcgcccgcgtcctcgcctcctggaacggcggcacacccgtcgaggtgaagcgctacacgtccgacgtgatctcccagccccaggcgctcaccctggacgtcccgtccggggccgccaacgtgagcttccggttccactacaccggaagcaacaactggtactgggtgatcgacggggtcaaggtcaccgcgagctaattatgctgggggtgccgggacggcgtggtccgggcacccccagcacgcagtgcgtacggcaggagtcccgacacatggcagagcgcaagccgatctcatcctggctcaccgacatggacggcgtcctcatccacgagggcacccccatccccggtgccgatgccttcatcaagcggctgcgggattccgggctgcccttcctcgtcctcaccaacaactccatctacaccgcgcgcgacctgcacgcccggctgaagcgcatgggcctggacgtgcccgtggagaacatctggacctccgcgctcgccaccgcccagttcctggacgaccagcgtcccggcggcacggcgtacgtcatcggcgaggccggtctcaccacggccctccacgacatcgggtacgtcctcaccgaccacgacccggactacgtggtgctcggcgagacccggacgtacagcttcgaggcgctcaccaaggcgatccggctgatcaacgcgggcgcccggttcatctgcaccaaccccgacgagaccggcccctccgccgagggcccgctgcccgccaccggttcggtcgccgccctcatcaccaaggccaccggcaaggccccgtacttcgcgggcaagccgaaccccctgatgatgcggaccggtctcaacgccatcggcgcgcactccgagaccagcgccatgatcggcgaccggatggacaccgatgtcctggcgggcctggaagcgggcatgcagaccttcctggtcctcaccggactgacgtccgtcgccgacatcgaccgctacccgtacgggccgtcgcacgtcgtcgagtccatcgccgacctggtcgacctcatcgacctgcccgaccaggtggaccaggggaagcagaccggccagacggacagtcgctgacctgcgcggaccgcatccgcagtcgtccgggcatcgctcgaatggaggactgcggatgcgggccgccgccgcagacgtgaaccttcccgtaggaggttcacgatgcgttccattcccctcacgttctgtgccgcagcggcggccgcgctcataaccgtgcccgcgcccgccgcgctggcgtccccggccgccccggccggtgacg

SEQ ID NO: 3125 - DNA, 11356 bp, Unknown
  Kingdom: Bacteria, Phylum: Actinobacteria, Class: Actinobacteria, Order: Streptomycetales, Family: Streptomycetaceae, Genus: Streptomyces
ttcggggccgacctggcgctggaccccgccgatccgctgttccgcgagaaggtgctcggggcgacggacggcgtgggcctggaggcggcgttcgacttcgccggggtccccgcggtccgcgaacaggcgctgaccacgctggccccgaaggggcggctggtgctggtggggttgaccgaccagccgctgaccgtcgcccgccccaccctgttcagctacctccagcaccggatcctgggccactacggctcggagggacaccatgtggcgcagctcgtccggctcgccgagggcggtcggctggacttctcccggtcgatcaccgatgtcctgcctctggaggacgcggcagcggccgtgcggcggatggagaccagggagggtgacccggtccggctcatcctgcggccgtgacgggctccccgccgtgggcgccggcctccggctcgggccgccgcagctccacgttgaactgggctccggccagcagcgagaggttggcgaaccagacccagatgaggaagacgacgagcccggcgagcgatccgtacagcctgctgtagctgccgacctgggtcgcgtagagagcgaacagcgccgacgcggtgagccagcagaacgcggcgaggatcccgccgggcaggccccggcgaataccgcgcgcggagcgggggccggtactgaagaggaccatgatcaggcaggccacgaggaagaccagcaccggccacttcagcgccgcccacaagctctccccctcgtgcggcaggccgacgcggcggcccagccagcgggccagtgggccggtcatgacgatggcgaaggcgctggtcatcaggaggaggagcaggccgatcgcggagacgacgatgatgtgcgcctgccgcaggggcggacgcgtgtcccggacgccgtgcatggcgtgcatcgcccggcggaagaccgcgaggtagctgcacgcggaccacacggcgctcacggacccggtggcgacgagcagccagacggcggagcgctgctcggtcgccgcctccagcggacggcggagcgcctcgccggactcggccggggcgaacgcggtgatgtcggcgatcagggcgctggtcgcgccggggttggccagcccgatcaccgagacggtgaccaggagcgccgggagcagggcgaggatggcgtagtacgtcagggcggcggcccagtcggtgatgtcgtcgttccacagcgagaccggtgtacgccgcagggcggcgccccagcggcgggacagggctgcgggggcggtgctttccgcggcggacgcggtctgggtgggcaagctggcactccggggacgtgggcgaacgcggcgggcggcgtgaccggtccgattccggacgcgccgactccgctcgatcctctcctgccacgtcgcggccgaagcacacccctcccccggccggtctcgcgcgcaggcgggacggtcgtcgacgggggcggtcagtcgtcgacgggagcggtcagtcgtcgacgggagcggtcagtcgttgacggccgtgagcaggaccacggcgtcctggagtgccagcagcccgtgccgttcctgcgggatcgggtgcaggaccccggacggcagctcggcgtccccggaggcggcggtgagacggacgctgccgcgcaggacgaggagcgaggcggcgggcggagcgttgtgctcgtcgagcgccgtcccctcggtgagggcgatcaccgtctgccgcaaggggggctgctggagcacgaggtgggcgctgcggccgtgcgcggaggcgcgggccgcggtcaggtgttcctcggcgagtacgttgaggtcgtccatgtgcccactgtgccgcagccgtgaccaggccgcgatccgcgggattcagcggggggccttcgcggtggatccccgtaccaccagctccggctcgaacagcagctcgtccggagggaccgagccgccctggatgcccgcgcagagcagttcgacggcggcccgtcccatggcctcgatgggctggcggatcgtggtgagcggggggtcggtgcagttcatgaacgccgagtcgtcgtagccgacgacggagatgtccgcaggcacccgcagaccgcgcctgcgggccgcccgcacagcgccgagcgccaggggatcgctggcgcagatgatgccggtgactccccgctccagcagccgggaggcggcggcctgtccgccctccagggagaacatcgagcgctcgacgtactcctcggccaactccccgccggtggccgccgcgacggaccgggcggccgcgagcttgcggcgggagggcacatggtcggaggggcccatcaccaccccgatgcgctcgtggccgagggaggccaggtggcgccaggcgcgctcgatcgcgacagcgtcgtcgcaggagacgcaggggaagtccagcccttctatgggggcgttgatcagcacgacggggatgcggcgttcggcgagccggtggtagtgctcatgggcctcgtcggcctgcgcgaacagaccaccggcgaagaccaccccggagacttgctgctggagcaggaggtccacgtagtccgcttcggagactccgcccttggtctgagtgcacagcacgggggtgagcccctgctgggcgagggcgccgccgatcacctcggcgaaggcggggaagatcggattctgcagttcgggcaggacgaggccgacgagccgggcgcgctcgccccgcagttgggtgggccgctcgtagccgaggacgtccagagccgtcagcacggactgccgggtggtcttggagaccccgggcttgccgttgagcacccggctcactgtggcctcgctgaccccaaccttcttggcaacctgagcaagtcgtcgcgtcatgccgcaaggctagcgtaagcaacgcaaacaattgacttatccacgcaaggattacatgcgagggggcgcttctccgtcatcgggtagcgcccccttgccactgaccgcggcctctcccctcagctacgggttgttgacgatcttgaaggtggaggtggtgttcttgacgtcctgggcgttgtcgctgagcttcaggccgttgacggtgacctcgccgacggccggaccctgcccggcctccggcatctcgttggcccacagtccgaacccggacttggcgtcgaaggcgtcaccgctcttgcgcgcacccgagacggagacgtcggtgagcacggtgtccttgatcgggaactggggctgaccgccgacgtagttcgtctggaacatgatcccgctgtaggtgggatcgacgatgtccacgtcggtgatgcggatgccctggaagaccttggacgccgagaacagccagatgccggggaaggtctgcgatccccagaagtgaccgcccgcgcgcacgatcgagacgttctcgatcgtcgtcggtccggtcccgaacccgttcatcgggtagccgaagtccagcgagctgaccgtgatcccggagtacaccagggtgtcggcgatgtggatgttgcggaaggtgttgtcgtacccgccgtagacggcgacgcccgccgcgcgccaggtgaggatcgaggtcaggttctcgtagacgttgttcttcatgtccgctcccccggcgtcgatcgccgagaagagcgcgaagctgtcgtcgccggtggcccgcgcctcgttgttggccacgaggttgtcggtggacccgttggtcatgttgacgccgtcggcgaacatgttgcggatccgggagttcttgatggtgacactgtcggtgttggcgccccagtagaggcacaccatgtgctcgttccagatgttgtcgatcacgatgtccgagacgcctgcgaagtcgaacaccttgcccggcccgtcgatccgggacgtgtagttgccgaagtacgcgaagttcgcgaacgaggaccccttggcactggcctcggcccggaagccgacgtcggtgttgtcctgggtcgacggggcgttgaagcgggtgtaccagggacccgcgccgaccaccttgacagccttgccgtagacctggaatttgctggcggtgctgtagtcacccgccgggaggtagacacccacgagggtgccggtggtgtccatacggaccttgtccagggcgttctggacgtcctggtgggtgaacccggccggcacggtgtacgtggcggggtccggattggcgaccggcgcgacctgctccaggttgacgaagtcgatcgcgtacgtgctcgtgttggcggcgtccttctggagccggatcctcgaaccggccgggacggtcctgcccagcatcgtgttcgcctcgtcgtagatgtgacgaggcgctccggagcccggggagttgccgggagcggtctcgttcccgtacagccaggcgtacttggaggtgaggtcgatcgccttgaggaggacgccgtccacgtagacgttcagcgtggagtcgatgccgtcgccgcccggggcgtcggggatggagaaccgggtgaccagggtgttggtggcggcgcgggtggtgaactcgacgtagtcgccggtctggtcgagggtgacggccttgcgtcccgaggcctcgcccgcgacgtcgccgacggtccggttcgggccgacgaccttcgccccgccgccggtcgtgccgtcctccgcctcgtacatgtcgtacggcatgttcgcgccgcgtccgacgaagagggcctgggcggaggtgttgttctcacgcctgaccgggagttcgttggcgtcggccgcgatcacggtccgtacggtgtacgagccgttggcggcggtccaggtgccgagcgggaccggcgcggtggtggctcccgccgcgatggccccggtgtggctgccggtgagggtcttcaccgtggcgcccttgctgtcgacgagcgtcagcgagatgccatgggcgccggcggccgaggccaccgtgccctggttcttgagagcgacggagaaggtgaccgtctcgccctcggacgcggccgagggtgaggtggtgaccgccgaggcgaccaggtcggagctggagaccggcttcacgaccagcggggaggcgctggtgcaggtgttgttggtctcgttctgctcgatgacctcgcccgccgggtcggcgacggcactcaggacgtaacttcccgcgttccgggtcccgatggaggtgctgacctgggtcgaggcgcccgtcgcgagtggaccgaccgaggcggtggcgaccttggtgccaccgaggcgcagctcgatcttgctcgccggggcggcgagcgcgccggcgttgcggacggtcgcggtcagggtgacctcgtccgtctcgaccggtgcggcgggtgcggcggagatgccggtgacctggaggtccggattggccgccggagcgcccaggacctggaactccgcgacctgaccggccccggagccgctgttggcggtgaacttcaactggacgtccgcgacgcgcgcggagaccgggatggtcaccgtgttgccggacgtcggactgaaggcgtaatccttcgcggcggaaagggagttgaaggacgaggagctctgctcccggccgaggacctcgatccgctgggtgcgcggaccccagctgctgtcggggttgagcttgacgacgacgttctcggtgtcggcgttggagccgagcttcacggtgagggtgttcgggtaactgccgcccgcgccctcccagtaggtggaggcgctgttgtcgttggcgttctccgcgacgaaggtgtggaccacggaggaggcggtgatcggcttgttcacggcgaggttggaggcggagccgctcttcccgttgcgggtgacggtgttgctgtcgccggagacgttgcccgccgcgtcctttgcccgcacgacgtagctgaccgtggtggacgtcggctgggcgtcggtgtaggtcagcacgtcgccggcgacgctgccgcgcagcacgttgttggcgtagacgtcgtagccggtcacgcccttgttgtcggtggacgctccccacgtcaacttcaccgagccgctggacggttcggtgtacgccagcgcggagggagcggtgggcgcctgggtgtcaccggtgtcgccgatgcgggtcacggtgttgctgttggccgagacgttgcccgccgcgtccttggcgcggacgaagtagctgacgtcctgcccggccggccgggtgtcggtgtaggtggtgacgtcgccggcgacgctggtcagcagggtgttgttcgcgtagacgtcgtagccggtgacgcccttgtcgtccgtggagggcttccactccagccggatctgtccggtggcgggctcggtgaacgccaggccggccggtgcggtcggggcccgggtgtcgccggtgccggggccgtagatctccagttcggccaactgcgctgcctgcgcgccgctgttggcggtgaccaggacgcggacgtaccgggtggtcgtggcgtcgaaggtgatcgtcgccgactgcccgcccgccgcgtcgaagcggtaggccctggacgcggtgaggtcggtgaagtccgtgccgtcggcgctgccctggagcttcagggtctggctgcgcgcggcccatccgccgggcaggcgcaggaccacccggtccacgccgagcgacgctcccaggtccgcctggatccactgcgggaactggtcgtcgcggctcgcccagtagctgtcccggttgccgtcgttggcgtcggccggggttcgggaaccgttgctgctgctggcggtgagggtcttgccggccgcgaggtcggccgaggactccccggcgccccggacctccagctcggagagctgggccgcggaccagccggtgttggcggtgatgtcgacccgcacgaagcgggccagggtggccgggaacgcgatggtgacctcgctcgccgcccccggggcgaaggtgtacgtcgcggagttcttcagggtcgcgaagccggtgccgtccgcgctgccctggagggacagcgtctgggtgcgggtctcccagcccgccgggagcgtcagcctcacctcgtcgacccgggccccctcccccaggtcggtctggacccactggggcagtccgcctgccgcgctctcccagtacgtggaccggttgccgtcggtgatgttggacgcgccgtactcggcatgggcgctgctcgcggcagcggcccggcccgaggcgaggttggggccgtcggccgccgaggcggtgagcgacggccggacgatcatcagaagactggtcgcgaccaaggcggatatcgcccgccatctccagcgttgggctctcatagctccccgatcttcggcctcggcgcagggcgcgacgagggcgcggctccgtgaccgcagccagggaacacgaatttctgcgtacgctgcggcctgttttgcgttgtgccgtcagagagttgcagagaaatgagagaccgtccaccgttccggcaacagccgggcgaccgggacggggagcggattccgtcgcgcggtcaccgctccccctcccgtggacgagccgccggtccgaccgtccgacgggtcgtcagatgccgccggtgtacagcagcaggtcgggcgagccctggccgagaccggagagcacgtccggggtggccgtgcccgtcagccatcgcgagacggcggcgggagaggccgaggggttcttctccttgtagagcgcggcgacgcccgcgacgtgcgggctggccatggaggtgccgttcagcgagacggtgccgccgccgagccgggcggagacgatgtcggcgccgggggcgtacagcgagaggcaggagccccagttgctgaacgaggtctcccggtcctgccggtcgctcgccccgacggtgaacacgccgtccgcggcggccggggagacgtcacaggcgtcccggtcgtcgttgcccgcggccacgacgggcagcacacccgcgtcggcgaccgcctcgaccgcggcgtcgaccgaggtggagcgctcgccgccgagcgaggcgttcagcacggcgggggcgccgctgcgctcggcgtccttcgcgacccagtcgaacccggcgaggatgccggcccaggtgccccggccctcgcagttcaggacgcgtacgttgaccagtgaggcgtccttcgccatgccggacgtcgcgccgccgaccgtgcccgccacgtgcgtgccgtgtccgttgcagtccatgcccccgcggccgtccccgacggcgtcgtacccgttcacgacccggccgccgaattcgctgtgcgccgcgtcgatcccggtgtcgacgacgtacgccttcactcccttgccggtggccgtggtggtgaaggtgtcgtccagcggcagggtgcgctggtcgatgcggtcggcgccccagccggccgccggggcccgcagcagattcgcggcggcgggcgcggggacggtcacctcggcgttctcctcgacggcgaggacgccgggcacggcccgtaccgcttgaagttcggtggcggtgagctcggcggcgaagccgtgcagagcatttccgtacgtgaacaacgggctgagcccgaactcccgcaggaaggtgtccggcgagagttcgggctccagggtgacgatgtactgcccgggaacggcccgggtggactgctccaccagaaccccttccggtccgctgtcggccgaggccgtggcgggtgcgccgaccagcggtgcgatcagcagcagggcggccgtggcccatcgggcgggcaggcgcatgcattctcctcggggtggggatccagtcgcggagcgagtgcatccgcgaagcgcgaacacccgttccttcgtccccgtccgtcggccgccttagcgggttcagccggacagcgcaacgccggcggtcagctccagctcgtcgaggtcgtgtccgacttccgcccggaggtcttcgttcgcccagctgcccacggccacctcggcggtgatgccgggtccgaagccggcgatgagcccttgcgcggactcggcggccccgccgtcgtcgaagagccgcgccagtgcgtcgaatacgacggagctggcgatgttgccgcgttcggtgagggtggcccggctgtagcggaacatctcgggcggcaggtccaggaagtggcagaggtcgtccaggatgcgcggtccgcccgcgtggacgatgaagaagtccatgttcgggacggaccagccgtgcaggtcgaccaggtcgagaagcaccggggcgagcatctccatggtgcccgggacccgcttgtccagctggaagtggaacccggtgtcgcggacggcgtaggagatccagtcctcggtgtcgggcaccaggtgggagccgttgcgctccaggcgcatgccggtgccgccctgccctcgcacgacggcagccgagatggcatcgccgaagagtccgttggagagcagcgagccgaccccgatgtcggtgggctggtagcagagcgagcagaactcgcaggacacgatgaggacgttggactcggggtaggccaggcagaagtcgtgcgcgcggttgatcgccgcgccgcccgccgcgcagccgagctgggcgatgggcagttggcgggtctcgggtctgaagcccatggtgttgatgatccacgcggtcagcgagggcatcatgaagcccgtgcaggagacgtagacgatcagatcgatctcggacgggtcggtctcggcgtgggcgagtgcctgccggacgacttcggggacccgggtcttggcctccgcctcgtacacctggttgcgcacctcgaatccggggtgcttcagggtcttctcgatgggctgcacgaggtgccgggtctggacgccggtgttctggatgagcctcaggacgaggtcgcgctgcggatgcccggcgtgggtctcccgggccaggtccagggtctgctgcatcgtgatgacgtgctcgggcacagcgatggccggtcggcacagagtcgccatgggttctcctcgttctctggagcgaaggctctcgtcaccatgtgacgggcagggcgagcgggtaacgccagatggacgtcgtgttccacgagacgtccgcgggcggcacgtccagacgcagggccgggaagcgggtcagcagcgtggagaaggccacttccagttccatggtggccagcggtgcgcccaggcagtggtgggcgccccagccgaacgtcatgtgggggatggtcggccggtcgggatccagctcgtcgggacggtcgaacttggcggagtcccggttggccgtcagataggacacgtgcaccacgtcacccgccttgatgaggactccggagagctccacgtcctccagggcgacgcgcgggatgccgacgcccttgcggaaggggatgtggcgcagcagctcctccagggtgcggggcagccgctgcggttcggcccggagcgacagcatgaggtccgggcgggtgagaagggtgtaggcgatgttgccgagctgataggtcgtggtgtcctggccggtgatgagcaggaccatcgccatgacggccagctcgtcgtcgtccagcagttcgtcgccgtccctggcggtggccagggtgctgatgaggtcctcgcccggggagcggcgtcggtcggcggtcagctcctggaagtagccgcgcaactccgccttggcgcgtaccgcgtcctgcttgcccgcggccccgacgttcatcatggtcatggcgtgggcgcggagccaggggcggtcggcctcggggatgtcgagggcctcgcagatggtgatcagcggcagtggcgcggagacccgggcgacgaagtccgccggtgagccctcctcctccatctcgtccagcagccggtccaccacgcgctgggttccgccgcgcatctgctcgacgcgacgcggggtgaagctcttggcgaccagaccccgcagccggctgctggcgggcgggtccatgaggttgatggactcggcctgcacgatcggttccggcgtcatccgggggaagtcacggccgaggacggcactgcggctgaaccgccggtcggtggtgaccgtccggacgtcctcgtagcgggtgaccagccaggcctcgccctctccgtacgccatacggatgcgggacaccggctcctcggtcagcaattgcctcagctgggggtcgaactccagctgctgggcgtagtcgaaaggacagttccggacggtttccttgttctgcaccgaggtgttctccaccgaggttctcccaatgaccgcttcgaggaaaagggcgtgtgccggaccggggcccggcgcccgacctaccctctgtgccccgtgactcttcgaaacatgtcagtgacacgccgcagtcagccgatcagggggcgtacgcccc

SEQ ID NO: 3126 - DNA, 1049 bp, Unknown
  Kingdom: Bacteria, Phylum: Actinobacteria, Class: Actinobacteria, Order: Streptomycetales, Family: Streptomycetaceae, Genus: Streptomyces
cgatgtacgcgctcatcgaggcgctgcaccggggcgggatcccgtcggcgcggcggcacgagctgacgccggtgctgttcgcgacggccgcgggcggggatccggtggccctcgcactggtggagcggctggccgatgaggtggtggcgatggcctcggtcgcgctgagacggctcggtctgctggaggaggagactccggtgctgctgggcggcagtgtgctggccgcgtgccatccgcagctgaacgaccggatcaccggactcctggcggcacgcgccccgaaggccgaggtgcgcgtcgtgtccgagccgccggtgctgggcgcggcgctgctgggcctggaccggacgggcgcggcgcctgaggtccaccggaggctgcgcgcgcagtacgtctgagaaccgagcacgtcgtacgtcacgggacgtcccctcacgcggttcgcgtggggggacgttcctcgtacgggtgaacgcctggcacgtgagagacctgagggaaccgatcgggctcctggaacgtgtacctgatggggagtccgttcgcttatggggatgtatccgggcacgttgctccgctcgccttgatcggccgcgtccgccctgatcgaatgcggggactgatgcggggaccgatgtgggggcagctgcgggaaacaggcgttcccggtgtggatgtccgtccccgcggccatacttctggccgggcgcgcgtccctgggccggggacgggggcccgccgtcagtgaccgagggggaggccgagtgacacacccgccgagcggcggcacgcaaacgctgcgcgcgcccggacagaagtatggccgcggggacggacatccacaccgggaacgcctgtttcccgcagctgcccccacatcggtccccgcatcagtccccgcattcgatcagggcggacgcggccgatcaaggcgagcggagcaacgtgcccggatacatccccataagcgaacggactccccatcaggtacacgttccaggagcccgatcggttccctcaggtctctcacgtgccaggcgttcacc

SEQ ID NO: 3127 - DNA, 12829 bp, Unknown
  Kingdom: Bacteria, Phylum: Actinobacteria, Class: Actinobacteria, Order: Streptomycetales, Family: Streptomycetaceae, Genus: Streptomyces
  misc_feature (8321)..(8344): n is a, c, g, or t
gtcaggtcaggtcaggtcagctgggactggatctgtgaggagatcagttccagatggtccaggtcgtccaggtcgaggacctggaggtagatcctcgacgagccgatcgcctcgaagctgccgatcttgtcgaccacctcggcgggcgatcccgccagcccgttagccttgagctcctccacgtcccggccgatggcggccgcgcgtcgggcgacctcggcgtcgtccttgcccgtgcagacgatcagcgcgttggagtacacgaggtcgtccggcgagcgcccgtgcgcctgcgcggcggcccggacccggccgaactgcttctcgctgtcctccagcgaggcgaacgggatgttgaactcgtccgcgtactgcgcggcgagccgcggggtgcgctgcgcaccgtgtccgccgatcaggacgggcaccttggcctgggcgggcttgggcagcgcgggcgagtcggtgagttggtagtaggtcccgtcgtaactgaaggtcttgccgacctccgtctcccacaggcccgtgatgatcgcgagctgctcctccaaacggccgaacttctccttcgggaacggaatgccgtaggccttgtgctcctcctcgaaccagcctgctcccagacccagttcgacccgaccgcccgacatctggtcgacctgggccacctggatggccagcacgcccggcaatcggaacgtaccggcggtcatcagcgtgccgagccggatcctgcgggtctcgcgcgccaggccggccagggtgatccaggcgtccgtcggtccgggcagtccgtcgccggagcccatgcggagatagtgatcggagcggtagaaggcgttgaagcccaggtcctcggcggccttggcaacggtgagcaaggtgtcgtagtcggccccctgctggggctcggtgaagatgcgaagatccatgccctccatcctgcccctccggcgcccggtcccgcccaccagcccggccggacctctcccgcatctccccctgccgtcgtcccgcctcgccctcacgacgtcgcctccccctcaggacgtcggctctcagaacgcgtcgtcccctctcggcacctcgccgcgttcccctcagggacccgccgccgacgccgcggggccgcgtatgccgccgtagggaccgtcgcgctccctctcccgctccgccagccgcctcagcatcccgtgcacgcgttccagcgattcgtcggccgcgtccatggcctcgatgcactgccagtacagattgtcctcccccgtgtcgcatgccaccccgaccagggcgatcccggcctcaccgagcagcagcgcgagcccggccagcgccggccgcacatcggcgatcccggacaactgggccgccctggctccgccggagagcaccgtcggatggtccagcgccgagcatcccgcgccgatctcccccagcgcccgcgcctcgctccgtaattccatcgggccgtacagcgccagccgactgccgatcgcccgcgccagcgcctgtgcctgccaggcctccgccatgacatccagcgcgccccggctgctcgccagagcccgccgtcccgcctcgatgactcgctccgcttccatgtgtctcccccgtccgtacgaaaacccgctcacctcattcattacccacagtgaggtagacagcaccgtaaggccagaggaaatcggaaatctgtggacaggaagtcgactgtggatatctcgctcactccgaagagtgacgatcgtggggttccggagcgctcggcagggggaagcgcttctcgttccgctccaacttggccaccagcgccgccgtcggatcgatgcccaataccgcgcagaactgcaggagataggcgagcacgtccgccacctcgtcggcgacccggtgggccgattcggggttctccatgatccccgccgactgttcgggcgtcagccactggaagatctccagcagttcggaggcctcgacgctgagcgcggccgccaggttcttcggggtgtggtactgctcccagtcgcgcgccgccgcgaacgcggccagccgccgctggagttccgccacatcgatgtctgtcacggcaccaggtctatcaccggccaccgacagtgcctcctcgcgcgccacccggcacgggggagggggccgccggcgcggaggacggggacggcgcggccgggggcggcggtccgatccggctgccgccccgactgccgcttcctcctactgggcgaggcccgcgggcgtgaccccctcgacctccatgccgaccggcgcgagcaggaagacattgcggtcgacgcggtgcatgccgctgccgagaccgaagaccacaccactgctgaagtcgagaatccgcttcgccacgtccgtctccgcagccgtcaggtcgagcagcaccggaacctgggcgaccaggtactcggcgacctcgcgtgcgtccgcgaagacctgcacccgcagcacgacgaggcgccgctgttcggccgcgcgctcgtccgggacggtgcggtggtcgatccgggacggccactcgtcgcggccgcgcaacggcacgacctgtgcgagcccctcccactgttcgtcggtggcgtcgtatctgtcatacctgtcgtacctgctcacagggccaccccgtcgtcgagccggtcgggtacccgccggctgcactcactgttcatcgggcaatcctctcgcccctcacccgttcggcgtaccaacgacacggtgaagtctccgtccgtgtcacttccggtacccgacggacatcggttcatgacgacgcgcgcccccgcacccctcggacggcgaagagccgcaccgtaccgatcggaccgtaccgatcgagccacgccgatcggaccgtaccgatcagaccgtgatgacctggacccccgcctcgccgaaccggtccttcgcctccgcgcagatgcgggagtcggtgaccagaacatcgaccagcccgaggtcgcagacccgggcgaacgcccgcttgccgatcttcgacgagtcggccgccaccaccacccgctgggcccgctccgcgagcaaccggttgacgctggcctcgccctcgtggtggacgtacgcgccgcgttcgatgtcgatggcgttcactccgaggacggcgacgtccagggtgatctcgttcatcacgccgacggcgagggggcccgtcagttcgtacgactggggcctcgcgaccccgcccgtcaccaccatcttgatctgcggccggatcgccagctcgctcgcgatgttgagggcgttggtcaccacggtcagcgtcggctgcccgcccgccaccgacgtctcacccacgatgtccgggcgcaccgccagcgccctggccacttcggtcacggtcgtcccgccggtcaggccgacgacttcgccgacggcgacgaggccggacacggcacggccgatggcctgcttctccggcgcgtgccggcccgtcttgtaacggagcgccagttcgtaggagactccgtgcgcgaccgctccgcccctggtgcgggtgagcaggtgctgttcggccagctggtccaggtcgcggcggatggtggcggccgagacgtcgagcgccgtcgccgcctcctcgacgtctaccctgccgtgcttgccgaccagttccagcagcgcgtcccaccgggcgtccctggacaagagcgtctcctcaccgtccggcgcggacaccgcgtttcgcgggaacgcggtcgccggtggccggaccgccgcaagcgtcgcacagggcactccgggagctcttcacccacctgcaccttgcttgtttttgcttgataactgcatgtaacgtgcagaattctacatgcgggttgatcagtcccgctcagcccccttcccgtggtccacctcgttcccgtggagtgcagacgtgtcgtatgccgagaccgagacagccagtcagcccgcctgctggcggcgcgccgccgccttggcgggcggccccgaggccgccgccctgcccgtcgccggcgagcggatcgcggtcgtcggctgcggtacctccttctacatggcgcaggcctacgccgggctccgcgagggttccggccagggcgagtcggacgccttcgccgcctccgagttccccttcggccgcggctacgaccgcgtcgtcgcgctgacccgctcggggaccacgaccgaggtcctggagctgctggatcggctgcgcggcaccacccgcacggtggccctcacggcggatccggagaccccggtccgggcggcggccgacgatctcgtcgtcctcgacttcgccgacgaacggtccgtcgtccagacacgcttcgccacgaccgccctcaccctgctgcgggcccacctcggtctgcactccgaggccgtggtcgcggacgcggagactgcgctgaccgagccgctgcccgacgggctgctgcggagcacccagttctccttcctcggccgggggtggacggtcgggctggcccacgaggcggcgctgaagatgaaggaggcgtcgctgtcctggacggagtcctatcccgcgatggagtaccgccacggtcccatcagcatctccaccgccggcaccgcgacctggatgttcggcgaggcccccgagggcctgcccgagcaggtgcgggcgacgggcgcccagtgggtggacggggtcctcgacccgctggccgatctcgtacgcgtccagcgcctcgccctcgcccgcgcggccgcccggggactcgacccggacctgccgcgccacctgagccgttcggtggtgctcgacgggtcctgagggaccatggacacatgcacctgaccctgtcagccgcccgggatccgctcgccgccccggagccgcagggtgggatcgccggctgggccgccgggctggtcgaggcgttcggcggtcccggcgcgggtgcggccatcgcgctcgagaacgtgttcccgccgctgcccagcgaggtcatcctgccgctgaccgggttcgccgcctcgcagggggtgctcagcatcgcctcggccctgttctggacgacgctcggctcggtcgtcggcgcggtgttcctgtacgggatcggagccgtcttcggccgggagcggatgcacgcctggtgggcgaagctgccgctggtcaaggcctccgacctggtgcggacggaggagtggttcgcccggcacggcacgaaggcgattctgctgggccgcatggtgcccgtgttccggagcctgatctcggtgcccgcgggcgtggagcgcatgccgctgccggtgttcgtcacgctgacgacggcgggcagcctggtgtggaacaccgtgctcgtgatggccggatactggctcggcgaccagtgggacgtggtcggggcgtatgtcggcgtcgtgtccaagatcgtgctggcgctggccgccgtcgccctggtcggttacgtcgcgatgcggatccggggccgcaaccgcgaacagccctgacgaggcggccgggcacgacacggcaccgcgcggcgcgagccggcacggtgcggcacagcatgaagctgctcggcacggtgcggcacgacgccggcccgcgcggcaggactcggcgccacgcgacccggcgtcgcgcggcgtggccggaaccgccgtcccgcccccggccgcatcggtgagacaccccgccggggggggtgtctcacggccgaccgttcaggactcctcgaagtaggcgtccaggacggtgtccagctcggccggccagctcttgagctcggcgcggctcgccgcctcgacctcggcgttgaaccagcggcggctggacagatggacggtgaccgtgaaccggcggccgaagcgcgccggcgtcgtctccaccgcgccgatctcgtcccagtggaactcggcctcctggtcgtcgagcttgaagaggacgccttccctggccacccggatcgaaccgcgtcggtcgctgacctcgaagacgggaccctcctccacggcctcgccctcaccctcggcctccgccgtgacgtctcccgccgccgcttccgattcctggtcggcgtcggcctccgcaaccgacgcctcgggctcgtcgtcgcgttccacctccgcctccggagcagcgtccttcggaccggcctccgattccggttcgggcttccgggtcgcgacgggcgccgccagtccgggcagggggatgaacgccgggtcggtgcctgcggcgaactcgggcttcttgttcgaatctatgctctgctccacggcgggcagtatggtcgacgaacctgtacgtgaccagtcgtcaccgccccggcgctgtccccggccaccgcccagcaggcgaaaacccttccgcggaacggccggagccctgtccggcggcaggaaattcccggccgctcagagcacgcccctgcgccattcccgtaccagcagacagccgaggtacgtgccgccgatcgccatcgtgtagatcccgaccggcaggtcgtcgaagagcgccaactgctgggagcagaggtccgcgagcaccagcaggaggccgccggtgagggcggagagcagcaggtgcggaccggagcctcccgtgaggcgtttggcgatctggggcgcggtcagggcgatgaaggcgatgggtcccgagacgctgaccgcggcggccgagagcgcgatggccaggaccacggcaagggtcttggccttcttcggctcggagccgagtccctcggcgatgtcgtcgcccatctcgccgatgtcgagccgccgcgagatcagcgcggtcagcggggcggcggcgagcaggaccagccagacggtggtggcgtcggtccaggagcgggccgtcaggctgccgttgacgtaggccgtgaggacggaggccttgtcgcgttccagggcgtagacgacgtactgggtgacggccgcgcccatcgctgcgaccccgatcccggcgatgacgagccgggcggggttgcggaagccggtgccggtggagacgtacacgagggccatcgcgaggaccgcgccgaggagcgctccgacggcgacgggaaccgtgtcggggaacatcagggcgcagatcgcggcgcccgcgccggctccggcggagagtccgatgacgtccggactgccgagcgggttgcgggtgacggactggaacagtgcgccggagaggccgagcgccgcgccgaccccgatggcgacggtgaggcgggggccgcgcagccggttgaagacgaaccggtccttgccctcggcatcgccgacgagcgcggccggcaggtcggcgaggtcgatgccgaggcgcccccaggccagcgtcgtgacggcggccgcgaggaggagggcgaagagcccgatgcccgcgaacacggaggcccggcgcatgggcagcgccacggtgcggcccactaccagatagccgcggggggccttgggagccttgcgcacgggggtggtccgttcggtgacggtcatgaggtgccccgcatcctgcgtacggcgatgagcagcgcgggtgcgccgatgaaggcggtgacgacgccgaccatgagttcggtggggcgcatgacgacccggcccaccacgtccgcgaggagcaggagggcggggccgagcagggcggagaagaggatctgggcgcggaagtcgacgccgaccagggctcgtacgacgtgcgggacggcgaggccgacgaacgcgatcgggccgacggcggcggtcgcggcggcgctgagcagcgtggcggcgagcagtccgccgccccgggtgcgtccagggtgcgagccgagggcgacggcggtggcatcgcccagggccagggcgttgaggccggggccgagagcgagggcgagcacgaaaccgacggcggcgaagggcaggacggaccagaagacgtcgaagtcccggccgccgagcgctccgacgacccagtagcggtagctgtcgaagacctgcggtttgctgagggtcaccgcctggatgaacgccatgagcacggcggtgagcacggctccggcgagcaccaggcgcaccacgctcgtccccgtaccggcggagccgatgacatggacgaggacgccggcgaccagcgctccgggcagcgcccaccacatggtgtcggtggcgccggaggccccgaaccaggcggtcgcggcgacgatgctcgcggaggcgccggcgttgatgccgaggaggcccggttcggccagcggattgcgcgagacgccctgcatgagggtccccgcgaccgcgaggcagagtccggcgaggacaccgaggaccgtgcgggggtagcggctctcgacgatgacggtgatgttggggtcggcggtgcnnnnnnnnnnnnnnnnnnnnnnnntcggcggtgcgaccgtggtggttgccatgggagtggagtgtgccttgtgggctcggcggttcgaagaccggtccggacttacttgccggcggtcttgacggccttgtcgatgatcggcaggtagcgctcgatcgtccagggcacggtcagcgggttgatgatcgaggaggcggtgacgaaggagttgtcgttgctcgcgacgacggcgcccttcttgatcgcggggatcgcgccgtacagcttctggccctcgatctccttgcggttcttctcgtccgtgtagaacgtgaagacgaggtcgctgtccttgagcttctcggcgttctccaggccgatgagggccgagtcggtgccgggggtctccttgaagccgttgacgaccgggtcgaccttcaggccgagcgaggagaccatcttgacgcgctgctcctcgggcttgaagacgccgagggtgccgggaccggagttgtagatgtaggagaaggtgacgtccttgtagttcggccgggtggccgcggcgtcggcgagctgcttctcgatcttcgtcttgagaccgttcgtgtcctcggtccggccgagcgccttgccgatgatgtcgatctgctggtcccagtcggtgctccacgcctggtcggggtaggcgaccgtgggggcgatgtccttgaggacgtcgtactgcttctgcgtgatgcccgaccagggggcgaggatgacgtccggctccagctcggtgatcgcctcgaagtcgatctcctcgccgcccgtgaactgcttggggagcttgtcgccggacttcttgaccgcctcgttgatccacgggaggtagccggacttgtcgctgccccaggggtagctctcgatgccgaccggggtctggccgagggctatcgcggtctcggcggagccctggccgagagtgacgatgcgctcgggcttcttctcgatcttcgcggttccgagcgagctcttgatcgagacggggaaggcgccgccgctcttcgccgagtccttcgccccgtccttgtcgccgtcgccgtccgaggagcagccgaccagggcgacggcgagagcgacggtggtggccgtcgcggcgagggtgtggcggcgcacgcgggtgaagccgagcatggaggttcctcaggttggccgagcgagtgaaggttaggcaagcctaagccagaggtggcgacgcctcaacaagcccccctcccgcaccgccgggcacaggggccgcgccggggggtcgtcaagcctcacgccgctcctcggcaccctgccccgaggcagggtggatccgtggactggccccggggacaaggctgttgctcaccgggaccgccggcggactctctccgcccgtacgcgctccgcccgtgtgctgatcgttatgcggacgcccgggacgacaggccacgctcagtgtccgtgctcggcggattcctcgttctccggcacgggctccccggccgcggctcccccggcgtgcacggtgaaggcggccgtacggaccttcccctcgtgccggaagtcgaggaagagacggtaggcgcccttgctcggggccgtcgcggtgaaggagacctccggtcccggcttcgtccgcccgtcgtccggttcgccgttcgggtggacgtggaggtacgccaggtccccggcgcgcagcgcgacgaggtggccgtacgcgccgaggtagggctggaggtcggtgaccggtttgccgtccttctcgacctccagcttcagctcgctgcccgcaccggggcgcagcgccccgtcgagcgtcacctcgtacccgtcgacggtcaccgtccgctcggcgtccggcagttcctcggggctcgcgtcgcccgatacggcgaggtcggcgcccagggtgacgccctcggcgttcttcacgtccggggtgaagtcggcgaagacccggtagccgccggcctcggggagctcgacgggggtggaccaggtgccgtcggcggcccgctcggggtgcaggtgccggtaggtggtgaggtcgctcgacgccacgatcaggtgcagttccttgtcgtgctcgcggcggaatgccgtcaccttgcgggaggtgtcctcgtccacgacggcgaagcgcagctcggcgggctcgcccgcctcgacgcgcggggtgctgaggtcgagggtgtagcccccctgggagatctgcaggccgccgggaagctccggggcctcccccgcgctcttctccgccgctcccttctccgtggccggtcgatccttcgcgccgtgaccgtcctggtgggacgactccttcgcggcgacggcgggatccagggcgccgcccaccgcgtacgccgacccgaaggtcgccgcgagccctgcggcgaaggccgtgatcttgagaccggtatgcatggcctactcctcgtcaaggtcgccggatcgcgaccactcaccatcaaagataccccccaggggtatgaagtcaaccggggggagaccttgtggcgggggcagggggcaaggagaatctcgctcaacggcttggccgaaacggatgggagcgggcttccatgggggcattcgtcgcactgatagcgggactgggcggggcggccgcgtggtgcgcggtggtgctggtccggcgcgggcgtcgcgggtcgaccgagaacgcggacgggttgctgatcgagcaggcggcccggctgcgggcacagcagatgaagaccgacgggcgggccttccgggcccatccccacggggtgcgcggctcagtgcagcgccgtcactgaccctcggggttcatcgccgccagggcgcgcagcaaggagtccgtctgctcgtccatcgggaagaacgactccaccgccagttccgagagggtcacgtcggcgggggctccgaaggtggcgatcgtgctgaagaacgccatgtcgccgagcggcgtgcggatgcgcaacgggacgacgatgcccgtcgggtccaccggaccggggtcggcgtcgaggtccggcggggccggataggcggacacctcctcgtacagctcccgcagatcacggtggccggtcgtgtcggcctggtgccgcagccggccgagggcatgggcgcggacctgggcgaagttcaggcaccgggaggcgaggccctccgggtggaggatcagccgcatcacattgccgcccgcctccgtcaggtgcggcggcacggtgccgagcaggagggacatcgcgtcgttgcggtcgacgatgttccagatccggtcgatcgcggcggcggggtacggctcgtggccggccagcatcgcccggaccgcggagcggaccatggccatccgctcgctgtcgagcggcgactcccggtacgcgggggcgtaaccggccgccagcagcaggccgttgcggtcgcgcagcgggacgtcgaggtgctcggcgagccggaggaccatctcccggctcggccgggcgcggcccgtctccacgcaggagaggtgccgggtcgaggaatccgcccgcagcgccagatcgagctggctgagcttgcggcggcggcgccactcccggagcaacaggcccacccggggcggctcttcggtctccatgacctcaccgtatccatggttcgccgtccccgcgtccatgacctgggaggtcatggagtgcggaccctcccgcgtggcacggtgtcaccgaccccaccggccgaaggagatccgagatgacgtacgccctcaccccgtccgcgacggtggcacccgcgcgggacgccgcccggttcctccgtctggtgctgcgcgtcgacagtgtgagcaccgccgtcatgggcgtcgtgctggtcgcggcagccgtgccgctcggctccgcgaccgggatgccggtggccttcgccgtggcgttcgggatcttccagatcggcggggcggcctgcctcgccctgatcgccggctatccggtgatcccgcccgccctggccaggaccgtcgtcgcggtgaacgccctgtgcgcggtcgggtgcgtggtgacggccttcgccggcttcgtgccgctcaacgggttcggcgtggtgttcctgctgatcggcgccctgatcgtggcggtctacaccgcgctccagtacacgggactgcggcggatgacggcgacgacggcctgaccggatgctgccgggcacactctctcactcccccgcgaattcgtccggagcggaccgggcgaggtcggcgagggtcgcgagggcccgggagagggtttcccgggtgggtgacgccaggccgaggcggatcgcctgcggaccccggtggcggcccgaggtgaacgccgcggccggggtcaccgcgatgccctgccgcgcggcggcggcgacgaaggtgtcggcgcgccagggactgggcagctcccaccagcggtaatacgagagcgggtcgctgcgcgtgcggagatccccgaggtgccggtgcgcgatctcctgccgcgctccggaggctggacacccatgcgcttccccctggaagcg

SEQ ID NO: 3128 - DNA, 4828 bp, Unknown
  Kingdom: Bacteria, Phylum: Actinobacteria, Class: Actinobacteria, Order: Streptomycetales, Family: Streptomycetaceae, Genus: Streptomyces
tccgggccgcctccgccgacgggcacgccgcactcggccgccccgacgcgggcgtgctggagccgggtgcccccgccgacctgaccaccgtcgccctggactcggtcagaacggcgggaccggtgccccgactggcagcggagaccgccgtattcgccgcctccgccgctgatgtgcggcacacggtcgtggcgggccggcacatcgtccgggacggccgtcacacgcggatcgaggatgtgccgcgggcgctcgccgaggccgtggccgccctgcaccactgaccccggaccctccggaacgcaaggagaacactctccagatgacgaccaccgccgtcacccacatcgccagcctggtcaccaatgacccctccctcggcaacgggacccccctgggcctgatccaggacgcggccgtcgtcatcgagggcgaccgcatcgtctggaccggtgaatccagcaaagcacccgccactgacaacgtcctcgacgcggccggccgcgcggtgatcccgggcttcgtcgactcccactcccacctggtcttcgcgggcgaccgcacccgggagttcaacgcccgcatgtccgggcagccctaccgcgccggcggcatccgcaccaccgtcgccgcgacccgcgccgcctccgacgaggagctctccgccaacgtcgcccgctacctcgccgaggcactgcgccagggcaccaccaccttcgagaccaagtccggctacggcctcaccgtcgaggacgaggcccgcgccctgcggatcgcgtcccgccacaccgacgaggtcacctacctcggcgcccacatcgtgtcccccgactatgccgacgaccccgccgggtacgtcgacctggtcaccggcccgatgctggaggcctgcgccccgcacgcccgctggatcgacgtgttctgcgagcagggcgccttcgacggcgaccaggcccgcgccatcctcacggccggccgcgccaagggtctgcacccccggatccacgccaaccagctgacgtacggccccggcgtccagctcgccgtcgagctcgacgccgcatcggccgaccactgcacccacctcaccgacgcggacgtcgacgcgctcggccagggcgacacggtggccacgctgctcccgggcgcggagttctccacccgtgccacctggcccgacgcccgacgcctcctcgacgcgggggccaccgtcgcgctctccacggactgcaaccccggctcgtcgttcacctcgtccgtaccgttctgcgtcgcgctggccgtgcgcgacatggggatgaccccggacgaggcgatctggtcggccaccgccggcggggccgccgccctgcgacgtaccgacatcggccggatcgcccccggcgcccgcgcggacctggtcctcctcgacgccccgagccacgtccacctcgcctaccgcccgggcgtcccgctggtcagcgcggtctggcggagcggccggcgggtggtgtaggcggggcgcaccggccaggtatgcggcggggcgcaccggccaggtgcggttggggtgcatcggtcccgcacgcggaaggacccgctcccggtatccggggcgggtccttccgcggtgctgctcgaacggcccgtggagccccgtggcgggacagcgggccgccgcggggtcactcctccagggtcagacccttgcggagcttggtcagcgtccgggagagcagccgggacacatgcatctgcgagatgttcagctcctccccgatctccgactgcgtcatgttgctgacgaagcggagcgagaggatcatccggtccctggagggcagcgcggcgatcagcggcttcagcgactcgacgtactcgatgccttcgagaccgtggtcctcgtagccgatgcggtccgcgagcgcgccctcgctgtcgtcctcctcgggcttggcgtccagtgagctcgcggtgtacgcgttgctcgccgacatgccctcgacgacctcgtcaggggtgatgcccaggcgctcggccagctccgccacggtgggtgcgcggtccagttgctgggagagttcgtcgcccgccttcgccaggtcgagccgcagctcctggagccggcgcggcacgcgcacggaccagctggtgtcacggaagaagcgcttgatctcgccgacgatcgtcggcatcgcgaaggtgggaaactccaccccgcggctcagctcgaaccggtcgatcgccttgatcaggccgatggtgccgacctggacgatgtcctccatcggctcgctgcgggagcggaaccgggaggctgcgaacttgaccagcgcgaggttgagctcgacaagggtgttgcggacgtagctgtactcgtgggtgccctcttcgagggactccagccgctcgaagagcgtcttcgacagggctctggcgtccagagcgcccacttcggcgtagggcgggatctcgggaagtccttcgagtccctcgccggccgcggcggagaagtctgaggtggggtcggcggtgctggtggtgctggtgcgcgggccgggaacggcgctcgcggcgggggagtcggaattggtcggtccctgaggacatgccgacgacgcgttgtgggtacgcgcttcgtcgagccggggtgacatgggtctcctccatcgttctcggcatatggctgccgatgcccatacgtgttcctgcggtgaagcggcgcctccaaagccggtcgtgttcgggtgtccctctacccatacccggtcctggccagcagtgacaagcgccaattactgctatatgtccggtttgttgaggtctccgactaccgcgtggcgaacggaacgcgtactgttttacgcacgtcggcggcagctacgcatacagccgcgcaggcagtgacgcgcacagtgacgaacggcgaagagggacaggcatggaccgcgggacggtcggcagtgcgaaccggggtcgacttcaggtcgaggcccggaccgaggggcgcagcgaggtcgtgacgccggtgggtgagctcgaccaccacaccgccgatctgctgcgcgagcctttggagagtgcggtcgagcaggggcgttcgcgcctggtggtcgactgttctcgcctggatttctgcgattccaccgggctgaacgtgctgctcggcgcccgtctcagggccgaggcggccggcggaggggttcacctggccggaatgctgcccgttgtggcgagggtgttcgagatcaccggcgcggaggcggtcttcaccgtccacgccacgctcgaagaggccctggccacctgacccggtatgagcgtgcgaccgcggacgtccccgatgtcggctgtgtcacgcgatcgtgtgcctcaagtgggtgttgttgcgacacggcagggcaggagacaccccggcggtgccccgcaagggctccggcacactcggtaactgatcactatttgttgaacggcgacatggcgacatggcgaatcggtgaggtgaagcgctgatgagcaccacccggcagcatccgccgggcgacctcggtcgcgagccggagggagcgggcgcggcctcgcccgatccggcggagcggcagtggcgcaccctctcgctcgcacaggccagcgggatcgttccgacggctcgtgacttcgcccggcaggcgctgcacgactggggttggctcccggcgtccaccgcggaccgcagggccgccgccgaggacgtcctgctggtcgtctccgagctggtgaccaacgcctgtctgcacgcggagggtcccgaggagctccggatcggccacacgcccaaggtgctgcgggtggaggtcgtcgaccggggcgccggtcagcccgcaccccgtacgccccaccgggccggccggcccggggggcacggcatgttcatcgtgcagcgcctctgcctcgactggggcgtcctgcgcacttcggacgcccccggcaagaccgtctgggcggagctcgccgcccccgcctagggagtgtccgcaaggtgtcgtcgtccgccctccaagcgtcgcgggccagacgaggctctgcggacacgacctagggcgccgcacccctggcccgcactccccggccgtacacctcacccggtgcgcctcaggcgtaccgctcacctgcaccgacaagagcgcgccggatcggcgcgctctttgtcttccctccatcaggccccgggcgtaccttgagcgccaaatctgatgtgccgtcagtaatgtgcgcccgtacgggtcgtggcgcgcggcggcgtccggcatgaggggaacacgaggtgtcgaaccagaagcggacaactctcgcgctggcggctgcgctggcaggctcgatcgtggtggcgggcggacccgccgcgcacgccgaggtcgtggacgtcaactatcagtgcgtgacgcccatcggacccaaaggggcggtctcgcccatcgatatcaagggcgtcaagagcggcgacggctaccagctcaccgtgtccttccagaagggcgtctcctccagcccggtcgagctgggcaaaggggccatgaacccgagcgccgtgatcgagctgggcggcgccgagcaggggaaggtccaggtcaccggaccggcgaacagcgaggcgattccggccaacacccctatcaagatcagcgacttgtcggggacgtacaccccgaagaagagcggcaaggtcaccttcaccgccggggtcctcaccatcaaggccctcggtacgaccaccacctgtacgccgaagaacaatcccggcccctccctcgaactcgacgtccagggggcgggcggttcatcggacggcggctccaccgacggcggttcc

SEQ ID NO: 3129 - DNA, 4614 bp, Unknown
  Kingdom: Bacteria, Phylum: Actinobacteria, Class: Actinobacteria, Order: Streptomycetales, Family: Streptomycetaceae, Genus: Streptomyces
ctccacccccggcggcctgcccgtacgcacgcccggccgcaccatggcggagtcggaccgggagcgcggccgccatcgcggctcgcccgcgtccgcctctccgggggacccgcgcggcaccacaccgcggacctcgccgccacgcagcgcgggacagcagttcggcgccttccggcgcggtaccaagcccggaggcaatcccggaaaccccgaagtccgggccggagagcccgaaggcagggccgaaggacccgacggcgggaccgtgccgccgaccaccgctgcgtaacccggaacgcccatccgttcggtgtccggtccaccggacgcgctcgctcgaacaccgagattggaggtacgggccgtcggccgctcccccggcgccacggtcccgtcactcatcatgcagaccacagacaacagcctcacctggctcctgcagaggctgctcgagcagacccccggcacccggcacgccctggccctgtcacgcgacgggctcaagctctgctggaccgagcacctcaccctcgaccaggccgaccaactggcggccatctgctcgggcatgcaggcgctcgcgcagggcgcttccatcgagttcggcgacagcaccggaggcgtccggcactcgatgaccgagttccacggcggtctgctcttcatcgtcgaagccggtgagggcgcgcatctggccgtcgtcgccacggaggaggccgaccccagcgtggtgggccaccagatgacggagatggtcgagcagatcggcgagcacctgcgcgccgcaccacgcggcgaggtgccgaggagcgcgtcatgaccctccgccccgtcgacaccggagctcccgaccggctctacacggtcaccggcggacgcagccgctccgcggactccttcgacctggtgaccctcgtggtcagcgagtgccggcccaccgccggaatgcagtcggaacacgcgcggatcctcgatctgtgccgccacccgaccgccgtcgtcgagatcgccgccgaactctcgcttcccgtcaccgtggtgcgcatcctgctcgacgacctccacgatatgggccgtatcaccgcccgccatccgcgcacggccgcctcacgcagcgcgctccccgactccgacctgctgaaggaggtgctccatggactccggaagctttgagctgccggaccggcgcacgccgctggccgacgccgcggaaaccggcctgaagatagtcgtcgtcggaggattcggcgtcggcaagaccacgctcgtccgctcggtgagcgagatccgtccgctgaacaccgaagaggtcatgacccaggcgggcgtcggcgtcgacgagacggacggcgtcgacgccaagacgaccaccacggtcgccttcgacttcggacgcatcagcctcaacgagcgcatcgtgctctacctgttcggcgctcctggtcaggaacgcttctggttcctgtgggaccggctgttctccggcacgctcggcgccgtggtcctcgtcgacacccgccggatggacgactcctggtacgcgatcgaccggctggaacaccacggcacacccttcgtggtggcggtcaaccgcttcgacgacgacctcgcccactccctcgacgagatccgtcaggccctggcactgcccgagcacatcccgatgatcgactgtgacgcccgggtccggcggtccagcaagaacgtactgatcacgctcgtcgaccatctgcgcacgatggccatcgcccgggagacgacaccatgagcacctccagtccctcgttcgatccccaagccctctccggctgcccggtcggtgccggtggcgacggcggcgcggtgcgcctgtccggagcctcctaccagcagacgcccacggagctctaccgttcgctgcggcgggagcacggggcggtggcgccggtactgctggacggtgacgttccggcctggctggtcctcggctacgccgaactgtcctacgtcaccacgcacgacgagctgttcgcgagggactcgcgccgctggaaccagtgggagaccattcctccggactggccgctgatgccgttcgtcgggtaccagccgtcggtgctcttcaccgagggcgacgagcaccggcgcagggccggggtcatcaccgaagccctcgaaggcatcgaccagttcgagctggcacgcgactgccggcgcatcgccgaccggctcatcgcggacttcgccggaagcggccggacggaactgatgagcagttacgtccacgcgctgccgatgcgggccgtggtccagatgtgcggcatgccggtgtcgggctccgacacccagcagttggtggacgacctgcgcatctcgctcgacgccggcgagggggacgatccggtggcggcctacggccgcgtcggcgaccggctgcgccaactggtcaaggacaagcgagccgcccccggtcccgatgtcacctcccgcatggtgacgcacggggcgggcctcacggacgaggagatcgtccaggacctgatctcggtgatcgccgcggcccagcagccgaccgcgaactggatctgcaacacgctgcggctgctcctgacggacgaacgcttcgcggtgaacgtctccggcggccgactcagcgtcggcgaggcgctcaacgaggtgctgtggctggacaccccgacgcagaacttcatcggccgctgggcggtacgggacacccagctcggcggccggcacatccgggcgggcgactgcctggtcctcggactcgccgcggccaacaccgacccggagatctggccggagagttacgtcggcgccgagaactccgcgcacctgtcgttcagcggcggcgaacaccgctgcccctatcccgcgccgctgctggccgacgtgatggcccgtacggcggtggagacgctgctcgaacagctgccggacctgatgctggccgtcgagccgacggagctctcctggcgtccttcgatctggatgcgcgggctgtcgacgctgccggtccgcttcagcccgatggcgcagtagcggtccctccgcggtgcgagcggccggagtccacggatccggccgctcggggacgacgtacccgtcagccggacaccggcgtgaagcggaccggcaggctctgcggccctcgggtgaagacaccgcgttcgaccgggtcgaagccgtcggccggccgcaggtccggcatcgcgtccagcagctggcccacaccggtctcgacttcggccttggccagcagagcaccgacgcagaagtgccggccgagtgcgaaggcgagatggtcggccgccgcggagaaggcgttcgtggcggtcaggtcctcgcggaagatgtcgaagacatcgggattccggtagcggtcctcgtcacggttggcggcgcctatcaggcaggtgacggtggagcccgccggtacggtgccgccgccgagcgccacctcggtcgccgacttgcgcatgatcatgtgcaccggcggtgtgtagcgcagcgtctcggcgaaggcccggggtatcagggtgcgatcggcgcggaccgcctccaactgctcggggtggcgcagcagattggcgaagatacccgcgatggccttgtcggtggtctcacccccggcggccagcagcagactgcagaacgccttgatgtcctcgtcgcccatccggacgccgtcgacctccgcggtgcacagcgtcgacagcagatcgtcgcccggcgcctcccgccgcttccggatgatcggcagcatgtactcggcgaactcgacgcgcgtacgctcaccggcccgcgtcacctccgggtcaccggagagattgccgagaaacgcgatgacggccgtgtaccagccgtgaaatcgctcgtagtcggacttgtcgaggccgagcatgtcggcaatgacgttgacgggaaaacgggtggcgtagtcggcgaccagatcgacggaccccgcatcgcggaacctgtcgatcaattcgcgcgaattgcgctcgatgaccggtaagaacttctcgcgcaggtcgctgccccggaaggccggtgcgaccagagctcgacgtacggcgtgctcgcgcccgctgagctggagtatcgtccgcccgtggacgggttcgatctgccagtcgtagttctccgtggtgaattcgccttctttgtccttgaagacgcgttcgacgtcctcgtaacgcgagacgatgtaactcccggtggcctcgtgccataggagaggcgcgttctgacgcatcaggcgatacgcccggtacggatctctctcgaactcgggtgacagaatgtccggagctgggaccgacatgaaaactccctgctgaacggggaacggaaacgtgtggactgaacgcttccatcacctcctgagaacacgcgttcgtcaagagttgccacccgttgcgacctgccaggacccgctcagtcctccggaccgtcgcccgtcgccacccgtcccgtcagcgccgccagcgagctgcgcacatgcgccatgtgcgcctgggcctcctcgcggccctcctcgtgctcccgcaggatccgctccgtctcccgcaccacccgctcctcgcggacccgggcctcggccagcagctcggc

SEQ ID NO: 3130 - DNA, 7140 bp, Unknown
  Kingdom: Bacteria, Phylum: Actinobacteria, Class: Actinobacteria, Order: Streptomycetales, Family: Streptomycetaceae, Genus: Streptomyces
ggccggggtttccacggcggccgcggtcccggccggggatggcccggcgcctgcggtgccgggccggggatcacccggcggcttgcacggacacctggcacccgtctgcttgatattgcttgaaaggcttgcctaatatgcagcttcgagcatcgatcgccgggaacagggagcacagatgacgcacgtggctcaggagctggccagtcagcccgactgctggcaggtggccgccggcatggcggacgggctcgcccaccggcttccggcggccggcgagcgcatcgccgtggtcggctgcggtacgtcgtacttcatggcccaggcctacgcggcgcttcgggagggcagcggccagggcgagaccgacgccttcgccgcttcggagttcccggcggaccgctcctacgaccgggtcgtggcgctgagccgctccggcaccacgacggaggtgctcggactcctcgggaggatcggtgacacgacccgccgcacggtggtcatcggcgaccccgacaccccgatggcggtgatggccgacgacacgatcgtgctcgagttcgccgacgagaagtcggtcgtgcagacccgcttcgccacctcggcgctgaccctgctccgagcccatctgggtctgcacaccgacgcggtcgtcgaggacgcccaggtcgcgctcgccgagccgctgcccaccggtcttgtggagtgcagccagttcaccttcctcgggcaggggtggagcgtgggactcgccaacgaggccgcgctgaagatgcgcgaggccgcgctcgcctggaccgaggcgtacccggcgatggagtaccggcacggcccgatcagcatctccacccgctccaccgcgacctggatgctcggcgaagccccgtccggactgatggacgaggtgcacgcgaccggtgcccggtgggtggccggcggcctcgacccgctggcggagctggtccgggtgcagcgtctggcactggccatcgcgaacgcccgcggtctcgacccggaccggccgcgccacctcacccgctcggtcatcctcagcagcacggcctgacggcccggccacccctcccgcccgacggtccctcactccggagtcgccatgtccatcgccgcaaccggcgatctgatcgccgaggccgccgcacagcaccgtgcggtcgccgcgttcaacgtcatcaccctggaacacgcggaagccgtcgccgagggcgcggaggcggccggggcgccggtgatcctccagatcagcgagaacgccgtcgcctaccaccggggccggccgcgcccgctcgcgcgcgccgcggcggaggtggccgagcaggcagccgtccccgtctccctgcacctcgatcatgtgcagtcgaccgagctgctgcaccgcgccgcggactgcggcttcagttcggcgatgttcgacgccgcccggctgccgtacccggagaacctggcggccacccgcgccgccgtcctctgggcacacgagcggggcctgtggctggaggccgagctcgggcaggtcggcgggaagaacggggagcccgcgctcgacgcccacgcgcccggggcccgtacggatcccgacgaggcacggtcgttcgtcgcggccaccggcgtcgacgcgctggccgtggcggtcggcacctcgcacgccatgacctcgcgggacgccgtcatcgaccacggtctgctgggcaggctgcgtgaggccgtgccggtcccactggtgctgcacggttcgtccggcgcctccgacgaggaactggcccgcgcggtggcgggcgggatccgcaaggtcaacatcggcaccgcgctcaacatcgcgatgaccggcgcgatacgggagcggctggcccgggacgaccggggcgtggatccgcgccgctatctggcggacggccgggacgcgatggcccgcacggtggcccggatgatctcggtcctgcccgccgggcgggcgcacgccgcgtgacgcccccgcctggggcgtcccgactgggcgtcccgggcgggcaggaccggtgtacgggcagacgtacgggtcaggcctgctggtgcagggtgcgggggtccaccgcgtgggcgaacggcaggccgtgcgcgtagcgttcgagctcgtcgaccgcggcgtccgcgagccggtggagttcgccgccctgggacccggcgatgtgcggggtgagaaggacgttcggcaggtcgtagaggggtgagtcggcaggcaggacctccggttccgtgtggtcgagcacggcgttcaggcgtccggcgaccagttccttcacgagcgcgtcggtgtccaccagggagccacgtgcggtgttgacgagggtcgcgccgtcccgcatcagggcgagccgcccggcgtcgaacaggtgccgggtcgacgggagttcgggggcgtggatgctgacgacgtcgctctgtgccgccaggtcgtcgaggcctgtgcgctccacgcccagggtccgggcgccgtcctcgtccaggtacgggtcatggaccaggacgcgcagatcatagggacgcagcagttctacgacgcggcgtccgatgcgggaggcgccgacgatgcccacggtgcggcggtagttgccgacggaggggaaccgccgcaggaggttcacccgggagcgggcctcgcggtagacgcgggcgctctccaggatctgcttgttggcgaagaggatcgcagcgaccgtgtactcggccaccgggaaggcgttggccgtcgcggcggtgctgacggcgatgcctcggtcccagacgtcctgggtgatgtggtgcttgacggagccggcggcgtggaccaccgcgcgcagccggggcatggcgctcagggccgccgggccgagcggcgggcagccccagccggtgaacaggacctcggcttcatgcagcccggagcgctgcgcggggtcgtcggccccgaagtcggtgaccaggaggccagggacgaggtcggcgacgcgggcgagccggtccagggcttcgggggccaggatcgcggcacgggtttcgccgctcatcgccaggacggtgcgggggcgggtccgctggggcgcggcggagtggctcacttgacggctcctgcggtgaggcccgagcgccagaagcgctggaggcagaggaaggcgacgatcagggggacgacggcgacgagcgagccgatgatgaccagcgggtagagctccggctgctggtagacgttctggttccacatgtacaggcccaggttgaccgggtagagccggtcgtcgttgagcatcatgagcgcgccgtagaagttgttccagctcgcggtgaaggagaacaggaagatggtcacgaagccgggcgcgagcatcggcagcgcgacctttgcgaaggtccgcacctcccccgccccgtccatccgggccgcttccaggacctcgcccggtacgtacccctcggagaagacgcgagccagatagacgccgaacgggttcaccaggctggggatcaggacggcccagtaggtgttgacgaggcccagttcggaggccatcaggtagagcgggagctggacgacggtcgaggggatgagaacgccgacgaggacgaccccgaaccacttctcccggccgcggaaggcgtacttgtcgaaggcgtagccgcaggccaccgagatgagggtggacagtccggaggcgacgacggtgtacagcaggctgttgagcagccagcggacgaagaccccgtcgttgtactccaggagggcgttgaggttggccaggaagcggaggtcgccgaggctgaacgggttggtggcgaacaggtcccgatagctcttggtggaggcgatgaggagccaggtcagcggcatcagggtgtagacggcgacgacggcgaggacgccgttcaccatgacgcgggaggtgatcccccggccgcggcggtcgggcggcggggcggagcggcgcccggcgcggcggcgcggcgtgggcggtgcgtcgggggtggctgtctgcgtgctcatgaggccttccaccggttgccgagcttggtgacgacgaaggacagcaggccggcgacgagggcgagcaggagggagctcgcggcggccaggccgtagtcgtggcccttgaaggccgcggtgtagatgaacatggtcggcgaccagtcctcgcccatggtgttggcgcgcagttggacgagcttgggagcgtcgaagagctggatggcgccgacgcaggtgaacagcagggtcaggacgacggtgggccggatcatggggatcttgacctggagggcggtgcgcagggccccggccccgtcgacggtcgccgcttccaggacctcgcggggaaccccctggagacccgcgtagaagatgatcatgttgtagccggtccactgccaggcggagatgttgacgaccgagaagatcgcctcgtcctggccgaagaagttccactgggcgccgagcgcgtcgagagcgtcggtgatcgggctgagacccggcgtgtagaggtagagccagatcagggaggcgatcagaccgggtaccgcgtgcggcaggaagtaggcgatctggaagaagcgccgggcccgggccatggtcgagtcgacgagcagggccaggatgagtgctccgccgaccatcgcgggaatgtagagcgcgcagtagagcgcgatgttcccgaacgagcggaggaacgcctcgttgcccagggcttcggtgaagttgccgaatccggcgaagacgcgctcggttccgccgaatcccaggcctgatgactcctcccggtagaggctcatccaggccgcgtagatcatcggcaggacggtgacggcggtgaagagtgcgaagaacgggatcgtgaacagggcgacggcccggcgctgtccgcgtcgggtgccggggccgcccggctttccgggtccggcggaaacggccggaccggcgggccccgtgggcggcggcgcgacctggggtgccggggtcctggccggccgggcgagtggggctgccacctgatgctccttcggctggatggggtgggcgggagaggaggcgggctgcccggcacggtgtgttccgggcagccgtacggctatttgtcgagcttcaggccgcggtcggtgaccgcggtctctcccttcgcctgaccggagctgagcatcttcgtgtggtcgctgcccgcggccatctgtgccgaggtgacctgctgctgcaccgggccccacgtccaaccgggcacgatggtgtcggcggcctcgccggccacggcgtagacgtcctggccggcgaagtaggaggtgtcgaactccttcgccgccgcggcgcgcatgccctcgttggcgggcagggcgctgctcggggccttgagggagctgaggcgggcggtcatggccgcgggatcggtggtgacccacttgatgaactcggcggccgcctcggtgtgttcactgcccttgggcacgatgtacgaggttccgccgtacatgccggtgctcggcttgccgtcccaggtgggcagaggggctatcccccacttgcctttgctgtcggggtagctgacggggaaggtcccggcactccaggcggcgccgatgacggtggcgaccttgccggtggagcgctccttggcctcgccctcgccccagagcggggtcttggaggcgaggccgtccgcgaggaggtcgtcccagtaggcggcgaccttgcgggaggccgggtcgtcgatgttcaccttccaggcgtcacccttggtgccgtaccactgggcgccggcctgccaggcgaggccggagagcagagcggggtcaccgccgccgaagttggtgatggtgacgtcggggtcggcccggtggatcttctcggcggccgtgcggtattcggcccaggtcgtcggcacctcgacgccgtgcttcttgaacaggtccttgcggtagaagagctggatgggcgtgacgtcgaacggcaccgcccaggtggagccgccgaggttgaccagcgactggagcgcctcggggaactccttcttcaccagttcgccggagctctgcgtgaggtccaccaggttgccctcgctggcgtactcgggcagggcggagtagtccatggtggccacgtcgggggcgttgccgcccttgaccgcgttggacagcttggtgacaccctcggggcccgcgggaaccaaggagaacttgatcttgatgccggtctgcgtcttgttgaacgcgtcggccgtctccttggcccccagggcggacgaccagaaggtgagggtgacgggcttgccgtcgccgggacccgaggcgtccgaacccgatgcaccaccgcaagcggtggcgagcagggcgagcgaggcggctgacgccgcgagggcgaggcgggacgtgcgggcgatacagggcatgggccggctcctacgggacctcggactgcgggagatgaggtgaacggcacacatcattttgcgcgggagtgatcgccgtcaagagcaaatgaccaattcaatcaaatcgatcacttgcggatcgggtccccctcctgacgccatcggtcccggggcatgcgaagagccgtgcccgtagggcctgttggcccgggcacggctcttcgcgcgccacttcttccgtcagggggcggcggcgaccgccccgcaggagacccggatccgcagggtgggcaggatgtccaggtgcctgcgggcggcagaaccccggcccgcctcccccgcgcccgccaccgcacccgtggccgtccccccgggttcggccacgcccagccggtccagcaggagccgggcggccgcggcccccacggcgtgcttgtccggggccaccgcggtgagcggcaggtcggcgagtccggcgacctcgtcgtcgtacgcgatcaccgcgaggtcctcgggcacccgcacgccccgggcctggagccgcgggatgaggacgatcgcgtccgcgtcgctgtgcacgatcgcggcggtcacgttgccgctcgccacggcgtcgcacagatactccagcgtccgctcgaaacgctgtgcctccgaccgcgacgcggcgtcgtccagcggggcggccgacaccggggtcagccccagcgcctccacggctccgggtcggataccgggccgccgtggaggcgctcgggct

SEQ ID NO: 3131 - DNA, 3962 bp, Unknown
  Kingdom: Bacteria, Phylum: Actinobacteria, Class: Actinobacteria, Order: Streptomycetales, Family: Streptomycetaceae, Genus: Streptomyces
cgcgtgcgggggtgaccgccagcacgcagagctctcgaacgggtgacagacgtgattcccgcacacccgctggttgcgcgccaccacggtggggtgcgtcacaaccccgtctcggaccttgacggaagcaggatgtaatgaccagtgcgccggactacagccaaggcatcaacaccgagcgcgcccttaagttcgccgtgcagcgcattcgcggggaccgtgtccagatcattgaggggatcatcgaaccggtgtcaccgacgtgggaccacgagcgcgctgccaagctcgtacgccgccaaatcgagaggcgagttgacgaactcgggtgcgtggaagggtccgggaatctggacctgcccgggtcatcaaactggtacatcccgggcatcgctgttgtgccggaggatctggccaaaggcggcaacgcccttcttcccgaccagacgctgctgatcgtagaagtgacatccgagtcgaacgcggagacggaccgggtcgtcaagcgacgtaggtacgccgagtacggggcgcccttgtacctgctcgtcgaccgcatcgatcgcagcgtcacgctcttctccgagccgcagaagctggggtacacccgcgtggacggaccctacccatttggtgccgtcgtgcggctccccctgccgttcgaactcgacatcgacacgagcgggctcgcctgaccctggcgtgagcgcgtcgaggaagtcaggtcgggggaagcggcatcggggggacaagccgcttcccccggtgagaacaggacctgccggtcgcccgccgcggtcaggggggaatcgcgcggcggtgaccccacagagaggccctgttccggccctccgggtcctgcctggtcccgttgggctcgctatccatcctgccgggcggcaggagccttgagggcgggcaaaagaccttgatggcggggccgtaggtccttaaaggccgcatcagtgatcagaaacgaccccccggatacgaccatctgtgcggatacaatcgcccgatcgcacgtgaggccgatggaggggcaggattgtggccaaggcaaagacgatcatcatctacatattggtggtcttcgtgctgtacacgatcatcatgtctccgcagcgggccgccgaactggtccaggtagggttcgagggcatttccaccgccgcgcagagcgtcggtgacttcatgtcagaactggtgaagtaggagaagcacgatgatccgccacctggtccttttcaagctgaacgagggcgtcgagcgggacgacccgcgggtcgtcgccggggaccgggccttccgggagctggagggtcaggtcccggagctggagttctgggagtgcgcctggaacatcaccgaccggccgatcgcatatgactacgccatcaactccgccgtcgccgacgaggacgcgctcaagcggtacatcgagcacccggcccaccaggcggccgcaggacagtggcgagaattcgccacttgggtgatcgccgactaccccttctgacgctcccccggcaccggctcacaccggttccagcaacccctcgccagtcaggcggggggtttccctgttccgtttaaacccttgtgacctcaacacggcactatgaggtgcttgcacacagtggacatgtcttgtgatgctatgaccgcttttgacggatgagttgaccgtagttgaccgcaaaggggtggcgtcaccgtgccggccagtacagcgcctcaagtgcctccccagaccgtccagaccgaggacatccagaccgagaccccggacccctcggccaggcccgccagagctcgcggcgccgacaccagggcgctcacccaggtcctcttcggccagctgaagaacctggagccgggcactccggagcaccgccgggtccgggccgccctcatcgaggcgaacctccccctcgtgcggtacgccgcggcgcggttccgcagccgcaacgaaccgatggaggacgtcgtccaggtcggcaccatcggcctgatcaacgccatcgaccggttcgaccccgaccgcggggtccagttccccacgttcgcgatgcccaccgtcgtcggcgagatcaagcggtacttccgcgacaacgtgcgcaccgtccacgtcccccgccggctccacgagctgtgggtccaggtcaccggcgccaccgaggacctgacgaccgcccacggacgctcgcccaccaccgccgagatcgccgagcggctgaagatctccgaggacgaggtgctggcctgcatcgaggccggacgctcgtaccacgcgacctcgctggaggccgcccaggagggcgacggactgcccggactcctcgaccggctcggttacgaggaccccgcgctcgcgggtgtcgagcaccgcgatctcgtccggcacctcctcgtccagctccccgagcgcgagcagcgcatcctccttctgcgctactacagcaacttgacccagtctcagatcagcgcggaactgggcgtctcccagatgcatgtgtcaagacttctcgccagaagtttcgcccgactgagatccgcaaacaggatcgaggcgtaaccggaacgggtagaccgtccgcagagcagttctgacggcataaaagccctacaccccctgtttccagggcggattcggcgctgacatgtcgacatgtcactacagcgtgttgccgacatgtgacattctgctcgaagcgcgtttgccgcagccccgcctccggtattcaggtggaggctgcgttcctccgatggtcgcggccaccgcgaccgtccgcgacctcaagggggtggcatgtccgaagaacagggcagctcgaaggtgctcacgctcacgaagagcgtgccggcacccgccgtgctcaccagctcaccggaagccatcgacacccgcacgctgtcccgctccctgttcctgcggcttgccgcgctcggccccgcctcgggccccgagggaacggacagtccggagcggacctatgtgcgggacacactgatcgaactgaacctcccgctggtgcggtacgccgcggcgcggttccgcagccgcaacgagccgatggaggacatcgtccaggtcggcacgatcggcctgatcaaggcgatcgaccggttcgactgcgaacggggcgtcgagttcccgacgttcgcgatgcccaccgtcgtcggcgagatcaaacgcttcttccgcgacacctcctggtccgtgcgggtcccccgccgcctccaggagctgcggctcgccctgaccaagaccagcgacgagctcgcgcagaagctcgaccgctcgccgaccgtgcccgagctggcccgcgcgctcggggtctccgaggaggacgtggtcgacggtctcgccgtcggcaacgcctacaccgcctcctccctggactccccctcccccgaggacgacggcggcgagggctccctcgccgaccgcctcgggtacgaggactcggcgctggaaggcgtcgagtaccgcgagtcgctcaagccgctgctggccaagctcgccccgcgcgagcgccagatcatcatgctgcggttcttcgcgaacatgacgcagtcgcagatcggcgaggaggtcggcatctcccagatgcacgtctcccggctgctgacccgcacactcgcgcagctcagggaagggctcatcgcggactgagggcggtcggcagagttctgctgatctctgccgaccgccatcgaccccggttgctctctgcaccggggttcagatttgacgggccgtcagccacactggcgcgatgcgacgtcagacattcggctcgaccggccgccggggctccgccatcgccgcctcggcggccgcgctgtgtctgggcggcggcctgctggccgcctgcgggagcggatcgggcgacgacggatacgtggccgtgggcgccgccgccgacggcggggaccggtcggcgggcggcgacggg

SEQ ID NO: 3132 - DNA, 11666 bp, Unknown
  Kingdom: Bacteria, Phylum: Actinobacteria, Class: Actinobacteria, Order: Streptomycetales, Family: Streptomycetaceae, Genus: Streptomyces
gcggcggcgccggacagcggtgatccgctgtccggcgccgccgcgtgggtccggagcgagggccctactggtcgtaggtgtagaactgcgtgtggtcgagcaggtccgccggcgtcttcgtgtgccagggcccgagcggggtgttgatgtcgggcacgtcctgggtcggcacggtcggcaggtagtgcggcacgtcggggtggcgcgcctgccacagggcccagcagcggtcgatcatgcagtggttgaggaagaacaccgggtcgttcggcgagccgatgtacatcatgtggccgccggtccacacgtgcgcggccccgtgcagcttgccgagcctcggctcccaggcgaacttggtgtagccctccaggtggttgcggaagctgtcgtacggcggtgtgccgccggaggtgtggttccacggcgggcagtcgtagaccgtgaggtcgagcgtctgctccagttcctgcggcgtcggcaggtccggtgtgagggtgccgaagtcccgtacgaggtagtcacggtcgtcgtgcgtgtagttgccgttcagggccgggttctccggaccctccgggatgacgctgatgttcagcttccagccgttgcggcgcgcgaaggggccggtcatcacgcggcggtcgcccggccggccgttgccgcccatgaactcctcggaccacaggggcgagttctcgccgtggtcggtggtccagtcccagtacggaagggtgacgcgcggatcgacgttccgcagggcctgttcgaacttcagcaggtactgccggtgccacggcaggaagcccgggttgacgtgaccgaggcgcttgccggtctccttgtccaggtagtcggtggagttgacctggatgtggagcttgacgaaccggtcgtagattccgcgtctcttgatctccaggaccgcgttgacgaaccggcgcttctcctcggccgtcatgttcaggtggttcttgcgtacgtggaccatcgctgggcttccttcgctgcggggccggttcaagggtgtcagaggtgcgtgacgtgggtgccgtgcgtggagggctggagtgcggcgccgcgcagttcctcgacggcgcggcgggcggcgtgcagcggggtgggggccatctcgtagtggcacatggagctgaggtaggcgtcgtcggcgaacttcatgaggtggagcggccggccgtcgatgaagacgccgccgccgtccgccggagtggcgacgcgtatggtccgcccgaggtagcgctcggtgtgctcctggcccgtggccttcgccggtgcggcggcggcctcggtggccttctcgccgtcgccgccgctcagcagggggacggcggccgcggcggcgacgagcgccgctccggtggtggccatgaccatttctcgcctgttcatgggcatgcgaactgcctttctcgcggtctcgtgcgtttcggaggcgggtcggcgggagacgctcagcgccgggccacgacgcccttgggctccaggaggaactgcgtgtagttgtcgtcgtgcgggattccgggcgtagcggtccacggcaggacccggccgcgcgtcaccttgcggacgctcggctcccggaccgcggcctccaccaggtcctcgcggtcggtgagcaggttgaggacgagtgagtcgcggagcggctccacgccgtcggcctccgtccacggggccaccacgacgaacgggaacggcagttccgttccgaccgccgggtggtcggcgcggtcggcggagaggacgaccggtcgcagcaggaacgaaccgtcgtccagctccaccacggtctcgtgctccccggcgcgcgcgctgtggtccgtgagcgaggcccggagctcggcgacctgttcgcgcagccgctcggcgcgggcccggctcaccaccaggagcgtcgccccgtcgtgggtcgcgggcagcgagggcaggtgccggatgaccgcggtctccttgcggagcagcgtcagctcctcgcgcagccgggtcgccgtgtccggggcctggagcaggcgctgcttggtggggacgtccaggaccgtggccgccgcgaccaggtaggaaatcacggacgggtcatcagggaggtcggcaccggtcgccagcgaccgttcgctcgctccggcgagccgcttctggtaggcgcggaaggcccgcaggacgccctcggcgagcgctcccgcctcgtcggcctcgtcctcgccgggcggttcctcgtccagctcctcgacctcggcggtcagatacggaccgctcgcctcgacggacagcagcctgacccgggtggtgccggtggccaggacctcgaagctgccgtcggcgcgctcgcggatcgtcgccgcgtcggcgacgcagccgacccggtggaaggtctggatcggatcgggaccgaagccctccgccggggcgcgctcggggggaggggaggccgcgacggtgtccggcatgccggtggccgtcggggcgatctcgcggccgtcgcggatcgcgaccacgacgaagcggcgaggttcgtcctcgtcgctcttcagcagctcccgcatcatggcgcgatatcgctcttcgaagacgttgagcggcagcaccaggccggggaacagcaccgcgttgagcgggaaaaggggaaggcgggcggtggtcacaacgctcaagcgtaatggccccgggggcggccgtggtcggcccggctgcgcaacggggtcagggaggccgcctggagccgtgcgccgtcccgcgcgtccaggaaccggccgagcgcgtcctcggacaccgacgaccacgggaacgacgtcgcgtgcaggccgatcaggttgaactggtgcagcgcctccgcccagcggccccgggcgagcaggacgtacgcgaggagattgcggacctcggccggccacggatcgccgggccggtaggcggcggagagcctgatcgccaggtcggccgccgcgtcgatccgctcctccagcacggaggtggtccggcccgccgcctgggtgtccaggagcagcgcgaaggccgcccggaccggcagggcctgcaccagggagtcgggcagcgcgtcctcggcggcctgctccgcgaagtcgaagcactcgcggtgcgagccgtaccaggcggcggagaggtagcgcagcgccgccacatggcagccgtagtgatgcgcggagcgccgtacggcctgttcccacagcgactcgaaggcggtgtgcgtggcatgggtgccgcgtgcgtggtccagggcgagccgccacggcacggggtcgcgggggtccgcgtcggcggcggcggtgatcagcgggccgacctcgcggagccgttccgcgcgggcgggcgactcccaggcccggtggaccgacagctccgccttgaccagcagcgcgtccggatcgcgcggggcggcggagagccagtcgacgagccagccgtcccggccgcgggcgaaggcgacgagccggccgaggtagcggtcccggttctcccagtcggcggcgtcccgggtggcggcgagcagtttggcggccggttcgtagtcccccagggcagcggcgaccagcgcgggagagagccgctcgtcgggggcgtcgagcagcaccgcgtcatccgcgggcagtccggcggtcagcggagggctgtgccggatcatgcgcgcggtactgagcagagcgcgaaggaatgccatggtgcagaccattgaaaagcgctggtgagggccgcgccagaggtgtgctgtgaagcttctgtgccgagtgaatgggttgtatcgggcggggtcaagaaagggcaaaggaaatgtccttcgctggcttgatcgcaccctcccgtgacgctcgtccgtcgctccggtcacacggtgcgggcggccggattcccggccccgaccgccctcggccgcatgcggtacgtctcggaggtcagcctctgcgcagcatccgggacgcccccgctgccacggtggtggccagaacccaccccaccaggaccagaccggccgcggcccactgccaggcgtcctccatccgccagtagccgtcctgcccgaggttgatcaccgggatcagcagatccagcgcgtacagggcgggattccactgcggatgctcctcgcccttgatggagggtggcgcgtgctgcgcgaacgccgccgtgcccgccgcccacagcaccgccatccacaccgcggcccgtcccggccggtagccgtacgccaccgtccagtcctggagataaccccacgccttcgcggccgtcggcagcgtctcgcggcggcggcgctgcttggccagcaacacctcacgcgcgtccgcgtcctcgccgcaactgcgcatcaccgtggccagccgctcgtacggctcggggacgtactccggggtcgcggcgagcacccactccagccgccgggagagcgggaagtggccgtaggggacgaggttctcgtagacgaagccgcccatcgccagaccgcccgggcccggccagctcgtcgacaggtcgatcagggtcaccaccttcgcgccgttcaggacgacgcggccctcctccgggcgctccgcgttgaaccgcagctccggcgtcacgatccggcgcagcgacagctcctcctgccgggtcatggtgaaccgggccttgtgcaggtccacggcgtccccgaaccgcccgtcgtccaggcgcaccccgccccggcactcgaagatctgcgagcgggtgccacgcgccggcgtcggtgcgtagaccacgccgtacgggggagtggtgccctggttccccgtgtcgacgctcacccacgcctcggtcatgtagagcgtgcgctccaccgtcagctgcggggcgttcagcgcgcgacggtcctccgcggcgcgcagccggctgccgcgcaggctcagcgaaccgcccaccttcgccccgcgcaggctcagctcgccgaccgtctcgatcatctcggcctggaggtcctgggcgaccgccatgccgtccccgacgacggcccgcccgtgccggtccgggccgacgctgagctggttgatcagcagatccgtgccgatctgggcgtcggtcagccggatcccccggtcgatgcggcagcgcggcagatgcaggtcgccctccgtgtggagccgagcggcctccagccggggcagcgcgcaccccacgagccgcagggtcgtgaagtggcactcggggagcaccacctcctgttcgaaacggcagccggtcagctccacgtacggagccacccggccgcccgccagatccagcttcccggtgatccgcaccccccggagcttcagcgccgccacccggcccggccgggccggcggaccgctcagcagcagccgcgccaccgtgcgcgcgccgacgctccgctcgggcccccacacctgcggggcgaacggatcgttgtgggtcgggtcgtagctgcgtaagtcgtaggtggtgccattgcggaaggactgccacatgcccagctccgctgcgctgaggccgtccgggatatcgccttcgtgcggctcggtcacggccgctccctccgtgcgcacatgctgtagtgctgttcttccctctgtgtgacgccatgaaagctagcggtcagcagtgacagccggacatggccgagacgcgtatcggccagtggtacgggcgaccgatatcagccagtgatacgggcgaccggccgctccgaccggtctgagagaattgccgtgtgatctctcgaatcgatctgcgcggtgacgtcctccccgagggtgccgccctgcgcgacctgctgccccgtgccgagttcgacgtggaagccgccctggagacggtgcggcccatctgcgaggacgtgcgccatcgtggctcagcggcagtcatcgagtggggggagaagttcgacggtgtccggatcgagtcggtccgggtgcccgccgacgccatctcccgcgccctccaggagctggacccggccgtccgggccgccctggaggagtcgatccgccgcgcccggctcgtccaccgcgagcagcgtcgcaccacgcacaccacccaggtcgtccccggcggcaccgtcaccgagaagtgggtgcccgtcgagcgcgtcgggctctacgtccccggcggccgctcggtctacccgtcctccgtcgtgatgaacgtcgtcccggcccaggaggcgggcgtcgagggcgtcgccgtcgcctccccgccgcagaaggacttcggcggactcccgcaccccacgatcctcgccgcctgcgccctgctcggcgtcgacgaggtgtacgcggccggcggctcgcaggccgtcgcgatgttcgcgtacggcaccgaggactgtcccccggtcaacctggtcaccggccccggcaacatctacgtcgccgccgccaagcgcctcctcaagggccgtatcggcatcgacgccgaggccgggcccaccgagatcgcgatcctcgccgacgccaccgccgacccggcgcacgtggccgccgacctgatcagccaggccgagcacgacccgatggccgccgccgtcctggtcaccgactccgaggaactggccgccgcgaccgaggccgagctggccccccaggtcgccgccaccaagcacatcaaggaccgcgtcgagcccgccctcgcaggccgccagtccgcgatcgtcctggtctcctccatcgaggacggcctcaaggtcgtcgacgcgtacggcgccgagcacctggagatccagaccgcggacgccgccgccgtcgccgaccgggtccgcaacgccggagcgatcttcgtcggcccctggtcgccggtctcgctcggcgactactgcgccggctccaaccacgtcctgcccaccggcggctgcgcctgccactcctcgggcctgtccgtgcagtccttcctgcgcggcatccacatcgtcgactacagccgcgacgcgctcgccgaggtcacccaccacgtcgtgaccctcgccgaggcggaggacctccccgcccacggcgcggcgttgaaggccaggttcggctggaaggttccgcagcagtgacgaacgaccccgcgcccggcaacccctgggacgagctccccatccgcgacgaactgcgcggacagtccccgtacggagcaccccagctcgacgtccccgtacgcctcaacaccaacgagaacccctacccgctccccgaagccctggtcgaccggatcgccgagcgggtccgcgaggccgcccgcggcctcaaccgctaccccgaccgggacgccgtcgagctccgcaccgagctggcccgctacctgacccgcaccgccgggcacgaggtcggcacggccaacgtgtgggccgccaacggctccaacgaggtcctccagcagctgctccagaccttcggcgggcccggccggaccgcgatcggcttcgaaccctcgtactccatgcacgccctgatctcccggggcaccggcaccggctggatctccgggccgcgcaacgacgacttcaccatcgacgtggacgccgcccgcgccgccatcgccgagcaccggcccgaggtcgtcttcatcacctcgcccaacaaccccaccggcaccgccgtcgacgcggagaccgtcctcgccctgtacgacgccgcacaggccgcccggccctcgatggtcgtcgtcgacgaggcctacggagagttcagccaccacccctcgctgctcccgctgatcgagggccgccgcaacctggtcctctcgcggaccatgtccaaggcgttcggcgcggcgggactgcgcctcggctacctcgccgccgacccggccgtggtcgacgcggtccagctggtgcggctgccgtaccacctctcctccgtcacccaggccaccgcgctcgccgccctggagcacaccgataccctgctgggatacgtcgcgcagctcaagagcgaacgcgaccggctggtggccgagctgcgcgccgccggctacgaggtcaccgactcggacgccaacttcgtccagttcggccgcttcgacgacagccacgccgtctggcagcagatcctcgaccggggcgtcctggtccgggacaacggcgtgccgggatggctgcgggtctccgcgggaaccccggcagagaacgacgcgttcctcgatgcggtacgcgaactgaagaaggagcacgacgcatgagcccccgcgtaggccgcgtggaacgcaccacgaaggaaacgtccgtgctcgtcgagatcaacctcgacggcaccggcaaggtcgatgtcgccaccggggtcggcttctacgaccacatgctcgaccagctcggccgccacggcctcttcgacctcacggtcaagaccgagggtgacctgcacatcgacagccaccacaccatcgaggacaccgcgctcgcgctcggcgccgccttcaagcaggccctcggcgacaaggtcggcatctaccgcttcggcaactgcaccgtcccgctggacgagtcgctcgcccaggtcaccgtcgacctctccggccgcccctacctcgtgcacaccgagcccgagaagatggcgccgatgatcggcgagtacgacacgacgatgacccggcacatcctggagtccttcgtcgcccaggcgcagatcgccctgcacgtccacgtgccgtacgggcgcaacgcccaccacatcgtcgagtgccagttcaaggcgctcgcccgcgccctgcggtacgccagcgagcacgacccgcgcgccgccggcatcctgccttccacgaagggcgccctgtgaccggcctcaacaccatcctgatcgtcgtcggcctcttcctggccggcggcgtctactccttcgcgaagcaggggatgcccaagggcgtcatcgtgctgctgtcgatcggctccgtgatgtgcctggtggcgggcatcctgcggatccagggactgtgggactgagaggcacgctgtgactgacaccaagaaggtcgtcgtcttcgactacggcttcggcaacgtccgttccgccgagcgggccctcgcccatgtcggcgcggacgtcgagatcacccgggactacgaccgcgcgatgaacgccgacggtctcctcgtccccggcgtcggcgcgttctccgcctgcatggacgggctcaagcgggcccgcggcgactgggtcgtcggccgcaggctctccggcggccgtcccgtcatgggcatctgcgtcgggatgcagatcctgttcgagcgcggcatcgagcacggcgtggagaccgagggcctggacgaatggcccggcacggtcggacccctgaaggccgacatcgtcccgcacatgggatggaacaccgtcgaggcccccgaggactcccagctcttcgcgggcctggacgccgacgcccggtactacttcgtgcactcctacgcggcgcacgactggtccctcgaagtgaccaacgccaagatccgtgtccccaaggtcacctgggccacgcacggcgaacggttcgtggccgccgtggagaacggcgcgctgtgggccacccagttccaccccgagaagtccggcgatgccggcgcccagctgctgaccaactggatcgagacgctgtaatgccgaagcttgaactgctccccgccgtcgacgtccgtgacggccaggccgtccgcctcgtgcacggcgagtccggctccgagacctcctacggctccccgctggaggccgccctcgcctggcagagcgccggcgccgagtggctgcacctcgtcgacctggacgccgccttcggcaccggagacaaccgcgccctgatcgccgaggtcgccggggccatggacatcaaggtcgaactgtccggcggcatccgcgacgacgcctcgctggaggccgctctcgccaccggctgccgccgggtcaacctcggcaccgccgccctggagacccccgagtgggtcgccaaggtcatcgccgagcacggcgacaagatcgccgtcggcctcgacgtccgcggcaccaccctgcgcggccggggctggacccgcgacggcggcgacctctacgagaccctcgcccgcctcgacgccgagggctgcgcccgctacgtcgtcaccgacatcgccaaggacggcaccctggaaggccccaacctgggcctgctgcgggacgtctgcgccgccaccgaccgcccggtcgtcgcctccggcggagtctcctcgctcgacgacctccgcgcgatctccctcctcgtccccgagggcgtcgagggcgcgatcgtcggcaaggcgctgtacgcgaaggcgttcacgctggaagaggcgctcaaggcggtcgccgcatgaccgaatctgccgagcccaccgccgcttcctccgtacgccggatctccaccggcgcgccctgggaggagaagttcggctactcgcgcgcggtcgagctccccaacgggctcgtcctggtcgccggctgcacctccgtggtcaacggccagatctccgcgggttccccgtacgagcaggcgatcaccgccttcggcgtcgccttcgccgcgctggagcaggcgggcctcacccgcggggacgtcgtccgcacccggatgtacctcacgcacgcccgggacgtggaggacatcggccgcgcccacaaggagctgttcgacgccgtgcgacccgccgcctccatgatcatcgtgtccggcttcgtggacccgagcctggtcgtcgaggtcgaggtcgaggcctaccggggaggcgcgaagtgagcctcgcggtacgggtcatcccctgcctggacgtcgacaacggccgggtcgtcaagggcgtcaacttccagaacctgcgcgacgcgggcgaccccgtcgagatggccaagctgtacgacgccgagggagccgacgagctgaccttcctcgacatcaccgcctccagcggcgaccgcgagacgacgtacgacgtggtccgccgcaccgccgagcaggtcttcatcccgctcaccgtcggcggcggcgtccgcaccccggacgacgtcgacaagctgctgcgcgccggagccgacaaggtcggcgtcaacaccgcggccatcgcccgccccgacctcgtccgcgagatcgccgaacgcttcggacgccaggtcctggtgctctccgtcgacgcccgccgcaccccggagggcacgttcgaggtcaccacgcacggcggccgacggggcaccggcatcgacgccgtcgagtgggcccaccgggccgccgagctgggcgcgggcgagatcctgctcaactcgatggacgccgacggcacgaaggacggctacgacaccgagatgatcgaggcggtgcggaagcacgtcaccgtccccgtcatcgcctccggcggcgcgggccggctcgccgacttcgccccggcgatcgaggcgggggccgacgcggtgctcgccgcgtccgtcttccacttcggcgacctgcggatctccgaggtcaagggtgccctgcgggaggcgggacacccggtccgctgagtacgtaacgcgcgtcggcggtgtcaccggcccacccgaggccggtgataccgccgatgcgcgtccacgggacacggcgtgagagtggcgaccgccggcgaacgacgccggcagccacgcggcgccaccccgaaggtcccggacgacggccgacggtccccgcgtggtgcggtcccgccaccaccgagaggatccccccgtgcagca

SEQ ID NO: 3133 - DNA, 1794 bp, Unknown
  Kingdom: Bacteria, Phylum: Actinobacteria, Class: Actinobacteria, Order: Streptomycetales, Family: Streptomycetaceae, Genus: Streptomyces
cacccgtccgccgccccgggtcccggggcggcggacgggtgggggacggtcatcaggagacggccttgtcccagttctcggcgagcgtggcgttggcctggtcgagctcctcggagctggggaaggcaggggtgcccgcgacctcgggcagcttggcgacgaaggtcttgtcggcggtgccgtcctcggtcatggcgggcagcagcacggggcgggcgtagcccttgagccagaggttctggccctcggcgctgtacaggtactccatccacaggcgggcggcggccgggtgcggggcctccttgttgatggcctgcgagtagaactgggcgtacacgccgtccttcggcacggagaccttccagtcgacgcccttgcccttgaactggtcggcgtacccggcgttcaggtagtcccagtcgatactgatcggcgtctcgcccttctcgacggtcgccggggtggactcgacggggatgaagttgccgctcttcttcagcttgccgaagaagtcgatgccgggctggatgtccccgaacgagcccttgttggcgagcgaagccgcgtacaccccgccgaacgcggagccggacttggtcgggttgccgttgagggcgaccttgcccttgtacgcgggcttcagcaggtcggcgaaggtctcggggcaggtcgtgatgcgggcggcgtcgcagccgatggagacgtagccgccgtagtcgttgtaccagcggccgtcggcgtccttctggctgtcggggatctgctcccaggaggcgaccttgtacggggcgaagaggttctcggccgcgccgctgcgggcgaaggcgatgccgaggtcgaggacgtcgggggcgcgcttctggcccttgcgggacttgacggcggctatctcgtcggagctggaggcgtccggggtctcgctcttgatcctgaccttgtacttggcttcgaaggccttgatgatctcgccgtagttcgcccagtccggcggcagggcgatcacgttcagctcgccctccttctcggcggcggcgaccagcttctccagcccgccgaagtcggcgaccgaggcggcctcggtggacttcacgccgttcaccccggtcgcggccttctcctcgggtgcggcgccgcacgcggtgagcacggtgagggctgcggtggagagtgcgagagcggcaacggcacggccgttggcgcggacacggggacggggtcgggctctgcgcacggtgtgttctcccggaggcgaggtgagggcaacttgttcatacaagctggcttcagttcgcccgcctcaggtgtccggggagtgaacgtcccatgtccggtgccgcaagagccatggaagaggaaagccggtcatatcggggttgtggtagcacggaaccgcgcgcggcgacggatcgacgggacgctagagtggcatgccggaccgtgacgcaatagccgacctgtacacagtccgggatccgtttccactgaccgacggggagcgcgtgggccgttcacgctacgaggagatcgccgagtcgctgcggcaggcaatccgcggcggtgcctgtccgccggggtcccggctgccgtccgagagcgacctcgccgcccgctgggaggtctcgcgcggcaccgtgcgccaggcggtggcgctcctggcgtccgagggcctgatcggctcccggcagggagcccggcgggtggtcctgcgccaggagcggcggcagagcttccagcagctcaacagcttcgcgcagtgggcgcgggcgatgggccacgaggcggccggccgcatcc

SEQ ID NO: 3134 - DNA, 7607 bp, Unknown
  Kingdom: Bacteria, Phylum: Actinobacteria, Class: Actinobacteria, Order: Streptomycetales, Family: Streptomycetaceae, Genus: Streptomyces
cgcctgcaccgggtcctccttgcgggcgcgggccgcgcccgcaaggaggacccggtgcaggcgggcgcgggcgtcgagctgcacgccaagcccggcgacaccgtcaccgagggccagcccctgatgacgctgcacacggacacccccgagaagttcgactacgcgctgaaggcgctgcccgaggcgtacgacatcgccccggccggcacgtcgtacgcaccgctgccggtggtgcgggaacgtatcgcctgacctgcggtttcctcatatgggtgaacgggatcggtggactgccaccggtcccgttcggcatgctggactcggtgacgcaccgatagaggggaccgccatgggcgcactcaccgtcgaacccgtgccgggccagggacaaggccaggactgggacgacctcgtccggatctgggaggagacggacgcacccgagggctgcaaggtggagatcatcgaggagatcgtcaccgtgtcgccgccgccgtccaaggatcacaacaccaccgctgccctgctccagcgcaggctgtacaccgtcatcccggaggactgggagatttaccagaccctcggcctctccctcccgggacggggagggatctacatccccgacctcgtggtcgtcccccgcgcggtggcctccgggccgggcaacaccgtccccgccgaggaggccctgctggtcgccgagatcacctcccgctccaacgccaaccatgaccgcgtcagcaaggtgaacggctacgccaaggcaggggtggagctgttcctgcttctcgacccctggcactccggccgtccgaccgcgacgctgtacggggagccggaaggtggtacgtaccgcgtgctggaaacggtcgagtacgggcggaagctgactcttcccgagccgttcgggctggtgctcgacaccgacgtcttcccggtcagctgacacgcggtcggcccgccgcacggggagagtccgtggggcgggccgccgtcgtgtgcggggtgaactacccgcgagcgcccgtcacttgcccaggtacgcgctgtagatcttcaccgacgaggtgttgcccttcttgtcggtgaccttggcggcgaacgagaccgccttgcccttggccgggttcttgacggtgatcttgcccttcttgacggtgaccttcttccaggtcttgccgccgttgtaactgacgtacgtcttcagcgacttcaggttcttgcccgcggccgcgccgtggaccttcaccggcaccgagacggtcctgcccgccttgacccggccgtccgcgcccacggccggggcgaaccggacggtggagacgggcagcatcgtggacgtggtcttcttggagcggaaggtccaggccgcgtccacccgggtggagagcgggctgatcttcgcgctgtgcctgaccgaggtcgtcagcctgtagtcggccgctccggccggtacccggaagacctctccgccggccagcgggtcgctgttctggccgagcttcttgccgttgcggtacaggacggtcttgaccgacgagagtgccatcccgcccgcgttgccccggccgtccgccagcagcgggaggacgccgccgatctcgttgccctcacggatgatgccgaagtccttgctcaccagcggcccgaacaccgccgtgttcaccgtcttcgcgtacgtcttgcccggcttgtacttcgcctccgtgccgatctggtagttggcctcgtacgtcggccagccgtccgcgtcggcgggaccgatctggctgaagtcgaagctccaggccaccttgtccgcggtggagaggtacagcgtgcgggtgccgggcagcttctgctcgatcgcggtggcccaaccgccgccctgcgtgggcaggttgccccaggcggtgatctcgcccttcttcttcggtgcggaggcccccatggcgatcttcaccttggccagctgtccggcggtgaacttccggctgtagccggtcgcgagctgcttgaccttgccgccgaccgcgatgtcgtactcggtcgacgcgcccttgctccaggtgcccgcccagtgctgggcgagcgaaccgtcggtgatctgcggacccacgtggagcgtgcgcatgccggccggcgactgcatcacccagccgaacgagacggcgtcggtcgccgtctccaccccgtagtccggggagaacagccggctcttcgccttggcgtccggcacggtgacgttcaccggcttggccttgcgggcgtcgaacgtcagcgtggtgttcttggtgatcgcgatcttgggccgggcgatccagtcggcgcccttggtgacgtcgtccgggtcgttgtagaccgtggagttgaccacgtacgtgcccttgggcacccggatcttcgcggtgccgccgacgacctgcgggctcaggaacgggtcgcccgccccggcgtcgaagcggtagagcgtgctgtccgcgtaggcggccggacggccgtcccgtccgaggtgctcgaccgtgacgtcgtagctctccccctcgcgctcgaccgcggcggccgtgcgcacggtctgcccgccgccggtggccaccagatacgccgagtacgtgccgtcggcggtggagccgagccgggtgtcggcggtcagcgtcgcctccgccgtgccgcccgccgggacggtgacccggtccgcgccgagcgtgaagaagccggccggagcgggcttccccgccggaccggtgcccgtcaccttcaggtcgagggtgacgtcgctcgtaccgaggttgcggtacgtgaccttctcggtggccggctcgtcgtcggtgtgcggccactgctgcaccccgaagctcaccgagaccgggtcggcgacgacggtctgggcgatggcacggtccaccgagatccggccggaaccctgctggaacgggttgtacgcgccgggcttcgtggacgcggtcagcgcgcccttcagctcgctggaggaccagtcggggtgctgctgcttgagcaacgcggccgcgcccgccacgtgcggcgtggccatcgacgtacccgagatcgtcgcgtatccggcggggttctcacccacctccttcgcgatcagcgagccggacgggatggccgccgtggtgtccacgccgggggccgtcacgtcgggcttgaccgccccgtccccgatccgcgggccgcggctggagaagtccgccagcttgtcctggtcgtcgaccgcgcccacggtcagcgcggcgttcgcgctgcccggcgagccgaccgtgcccgcgccgtcgccctcgttgcccgcggcgatggcgaacaggacacccttctcggccgacagtttgtcgaccgccgcctccagcgggtccacctccggggtgtcggtcccgccgaggctcaggttgacgatgtcggcgccctgggcgaccgcccactccattccggccaggatgccggagtcctcgccgtagccgtcgtcgtcgagcaccttgcccgcgagcagcttggcgtccggggccacacccttgaacttcccgcccgacttggcgccggtgcccgccgcgatcgaggcgacgtgcgtgccgtggccgacccggtccttggtgtccttggcggcgctgaagttcttctccgcgaggatctggcccttgagatcggggtgggtggcgtccgtcccggtgtccaggaccgcgatcttgacccccttgccggtgaatccggccttccacgcttccggggcgccgatctgcgggacgctcttgtcgaggctcgcccggcgcaccccgtccagccagacccggtcgatgccggccgcggtggtgacccgctcaccgcccgcgcgccggtcggtgagcgccttccagatggccggcgcgtcggtggccggtgtggtcaccgactcggcgttcagcgacgtcaggctccggctcacctcggtggagcccgcgtcgcggacctgcgccttcgctgtggcggcctgcttgccccggtagccgacgatcagcttcagaccgtcccgctgggcccggaggttctccgggcggctcagctcggtgacgtcgaacagccgccggtcgagcttgccggagacgatcagccggtgggcgtcggccgggacgacgagggtgtgccccttgttgctcatccgctggaccgggatgtgctcgcggcccttcgcgggccggaaggcgaccggcctgccctgggcgtcgacggtgacccggtcgccggtgacgagggtcagctgacgcaactccctgtcctgggaacggtcctgggaccgggtgccggaagccccccgcggatccggctgggcgacggcggtcgaggtcatgcccgccgccagtgccacggccacggcggtggcgaccgccggtatgcacgcgtttctcacgtgtctgcgcaactctccccctggagaactcgatggcttctcggtcccgccggtccgcagagacgcaggaacgacggctgcggcccgtcggttcatcgaactagaggtgatgccgggggagttggttcacagaaggggtgcgaggagttcaccgttgtcgcaaaacggcccctccgtggcggatgccgcgcggagggggccgatgaatttcgcccgccggtccggtctgcctggtgtggatgccgaaaatccgatcgccctgactgtgaccggccgggtcagccgtgccgtcgtacccgacctgtgcgccgagctggagcgtgctctcgccggcccccgcggagccgccctcgccccgggtgcggcggtggactgcgatgtgggcggagtgatccggccggatctgaccctggtcgaggcggtggcccggctggggctcgtcgcccgccggtccggacgcacgctgcggctgcgccgcgtgccccccgaactccggtcactgctggacctggtggggttggccgacgtggtgagcgtggaggaggggccggaggaacgggtgccggacccgcgctgatgccggacccgtaccgacgcgcgggacccgtactgacgccgggcgcgcgacgacgtgcgtacggctgtcggccgggcccggcgtcccgggtgtgacgcagggcgtcccggcccggccgacgactcctacgcgtcggccgggagccggtccggcaggccgaacagcgggaaccagcgcgggacgtccaggaagcagtgcatcccggtgatcgccccgtcctggatgtcgatgacctggaccgcccacggcacgtacccgtccccgtcctcggcgggcttgtagtgcgcgaagccgggagagccgttggccgagacgggcaccagcttggagcccgcgcacgccgcgccgatggaggtcatgaagcccgtgatgtccccggtgccgcggagccacaggtcgaacggcggcatcgtcatcaccgcgtcctcgtggagcagtgcggtcagagcggccatgtcgtaaccctcgaacgccttcacatagcgctccaggagcttttgctgctcctcgtcgaggggatccgccgcatcgcccgcccggctctccgtctcggtcagcgtggcacgggcccgctgcagggcgctgttgaccgaggcgacggaggtctccagcagctcggccacctccgcggccttccaggcgaggacctcgcgcaggatcagcacggcgcgctgcttgggcggcaggtgctggagggcggcgacaaaggccagacgcaccgactcgcgcgccacggccgcctccgccgggtcctggaccgagggcaggatccggccgtcgggcatcggctccagccagacgttctccggtcgggggctcagcgcggcctgggcgagcggtgtcgggcccgtcaggtcgaccgggcgggcccgcttgttgcccgcgttcagcatgtccaggcagacgttggtggcgatccggtagagccaggagcgcagtgaggagcggccctcgaacttgtcgaagttgcgccaggcccggaccagggtgtcctgcaccgcgtcctcggcctcgaaggcggatccgagcatccggtagcagtaccccgtcagctcgacccggtgcccttccaggcggctgtcgatcccggcggcttcggcgccccccgcggccgccgccgcttctgtggccgtcgtcgtggtcagatcgctcatcgctccacccctgtcgcgcgcagccgcgctgtggcatccgtcacccggtacgtcggaagctaccgcaggccactgacagccggggcggaaagaggacaagggggtgcccggcgatcgtggccgcggccacgatccgcccggcacccctcaggtgtcccgcctgtaccgagcgcgtcgctcaggtcccgggcttgcgcccgtacacgtacacgtcgtcgccgttcttcagcagtttccagtatgccttcgcgtcggcgggacgcatgttgacgcagccgccggagcccggcgggttgtacatggacttggtgaccgagtggaacgcctggccgccgtcgaagaactgggagtgcggcatccagaccttgtagatggtcgaccagtgcttgatgttgcgccagtagatcttcttggacccggtccgggtctcgacgccgttccggccggtccgcaccggcaccggtccgtacgtcagcttcttgccgtcctggatccagctcagctgccgggtcaggtcgacacaggcgatgcgtcccttgttggtggggcacttcttcgccttgttggggttcttcccggccgccttctgggcgagcatcgtgttcatcgtgcgccaggtcagcggaccggcgtagccgatggtgggggtgatcccgtgtttcttctggaacttctgggtcgccttgcagtcggccgtcgactgcttgccgtccacgggccgcttcaggaacttctcgacctgcttctggtgcggtcccaccgacttggtgcaggacgccgcctgggcggcggtgccggtgcccaggaccagggccggagcggccaccagtccggcgacggacagtgccacccctcgccgcagaggtcttccggatatcttcgccgtgactcccatgcgcgccaactccccttcgcccacagtgcgttgttggttacgcatggtagacgtgcggagaggggcggtggttgcgcgccggtatgtctcggttgcgtcgcggtccggcgcggtccggtcgcggccccggtccgatgagtccccgcgcaccccgtgcgacgagccgggaaaaccggtggagccgccgcccggaaggcactacggtcgccgggttcccgatccacgcgctcacaacgaggtgttttcgatgacggtccgagcaacggcggccgaaaccggcctgccggcccccgcggatgccatgacctcatcgaacgcaaggaacacgtcccgtggatcttccccgcatcttcaccctccgcgaaagcagccaccgcatccacaacccgttcaccccgggcaagctcgccgacctcggtcgggcgctgcacctggcacccggtacgcgggtgctcgacctggccagtggatcgggcgagatgctgtgcacctgggcccgtgaccacggggtcaccgggaccggcgtggacatcagcacggtgttcaccgagagggcccgcgcccgagccgccgaactcggcgtcgccgaccgggtcgccttcg

SEQ ID NO: 3135 - DNA, 1381 bp, Unknown
  Kingdom: Bacteria, Phylum: Actinobacteria, Class: Actinobacteria, Order: Streptomycetales, Family: Streptomycetaceae, Genus: Streptomyces
tccggccaggtctcagacgttgggccggttgagctcccagagctggagctcggaggtggcgctgacggaccgctcaaccccggcgatcccgtcgcgggaggccacgtactgcttgccctgccagatcggcagcaccggcacatcggtggcgacgatgtcctggagcttctcgtaggtggtggcggcggcggtgcggtcggtctcacggcgggacgccgggatgaggaccctctgcgcctcgcgcgaccggtagggcgagttgaggaagttgttctcgtccaggaagggcgcggtgtagttgtccgggtccgggaagtcggggaaccagcccatgccgtaggccgcgtagtcgccgcgcttctgctcgggtcggtacttcgaccactcctcgccccggacggagacgtcgaagaggcccgagcggttcagctgctgctggatcgccttgaactcctcggcggtggccgggccgtagtggtcgctggtgtagtgcagggtgaacttcaccggcgtcttgatcccggcgtcgcggaggatcgccgcggccttggcggtgctgggctcgccgtacttgttgaagaaggcgttggtgtggccggcgatgctggacgggatcagcgagtagagcggttcggcggtggtgccgtacaccttgtccgcgatctcgccccggtcgacgatctgcgccatggcctgccggacggacttgttgaccacggggtccttggtgttgaacccgacgtagctgatggccaggccgggcagctcggtgagctcgatgccctccttcggctccacgagcatgtcgcgggcctgctggggcgacatcgcccgggtcatcatgtggatcttctcgtcgtcgagcgccttgcccatggcctcggcgtcggggaagagatccatctcgacctggtcgttgaggaccttcagctcgcccttgtacgcggggttcctgtcgaaggcgatcttgacgacccggccgtcctcgacctgcggcttcatggtgtacgggccggagccgttcacctggaagccggcgcgtccctccttcgccgggtactgcgccttcgggacgatgccggcggcgggggtggcgagcttgtacgggaaggtcgcgtcgggcgtgttcaggtggaagatcacctggtcgtcgcccttggtctcgatcatgtcgatgttggcgagcagtccgaccggtccgctgtccgcgtcgatgtcgatgacgcgctggatggagtgcttcacgtcctcggcggtgacgggcgtcccgtcggcgaacgtgaggcccgcccgcagggtgcagcggtagctctcgttcgcggtgtcggtgaaggtgcagctgcgggcggcctcgggtaccggctcgccgccgccgcccggc

SEQ ID NO: 3136 - DNA, 13775 bp, Unknown
  Kingdom: Bacteria, Phylum: Actinobacteria, Class: Actinobacteria, Order: Streptomycetales, Family: Streptomycetaceae, Genus: Streptomyces
ctcgcccggctcgccgcgctcaccgacgacgagggacagccgttggtgcccgcggcccacccgtaccgctggtggggactggaggagccgacccgctccgccgtcccgctgcgcgaccgtgaccagcccgtcaccctctccggcagcgcgctggaccagctcgccaacacctgcgccctccagtggttcctgggccgcgaggtgaaggccgacgccccggccaccgccgcccaggggttcggcaacgtcgtccacgtactcgccgacgaggtcgcctccagccgtacgcccgccgacctcgacgtcctcatggaacgcctggactccgtgtggaacggcctcgccttcgacgctccctggaagtccgagcaggagaaggaccacgcccgtgccgccctggaacgcttcctccagtggcacgtcctggaccggggcggccgcacacccgccgcgagcgagcacgacttcgacgtgaccctggaggctggcgagtacgccgtccgcatccggggttcgatggaccgggtcgaacaggacgccgagggccgggcgtacgtcgtcgacttcaagaccggcaagggcgcgcccaccaaggacgaggtcgccgcccacccccagctcgccgtctaccagctcgccgtccgcgagggcgcggtcgacgaggtcttcgacggcaagcggcccgagccgggcggagccgagctggtccagctccgccagcccgccccccagaaggagggcggcgacgccttccccaaggtccaggcccaggagcctctggccggggaatgggtctccggcctgctcgccaccgccgccggaaaggtcctggacgaacgcttcacgcccaccaccggcacccactgcgcccactgcgccttccgcgcctcgtgcagcgcgcagccggaaggccgtcaggtggtcgattagtcgaccgggtatccggttcgtgcagtcggccggttatccggttcgtgccgggttgtcggtgggtccggttaccgttgctcgggtgtccccacgcctcaccgatcccgagcagctcaaggagctcctcgggattccgttcaccccggagcagacggcctgcatcaccgcgccgcccgccccgcaggtgatcgtggccggagccgggtcgggcaagaccacggtgatggccgcccgcgtggtctggctcgtgggcaccggacaggtcgcgccggagcaggtcctcggcctcaccttcaccaacaaggcggcgggcgagctggccgagcgcgtccgcagggcgctgatcgccgccggggtcaccgaccccgacgtgatcgacccggacaaccccccgggcgaacccaccatctccacgtaccacgccttcgccggccgcctcctcaccgagcacggcctgcgcatcggcctggagccgaccacccgcctcctcgccgacgccacccgctaccagctcgccgcgaaggtgctgcgcgaggccccgggtccctatccggcgctcacccggtccttccccaccctggtcagcgatctcctggcgctcgacggtgagctgtccgagcacctcgtacggcccggcgcgctcgatacgtacgacaccgagctgctgagcgccctggaacacgccaagctcagcaacgccgatctgcgcaagatccccgagaccgccgaggcccgccgctccctcctcggcctcaccgagcgctaccgggccgccaagcgcagccgggacctgctggacttcggcgaccagatcgccctctccgccgagctggccctgacccggcccgaggtcgggaagatcctgcgcgaggagttccgggtggtcctcctcgacgagtaccaggacacgtcggtggcccagcgactgctgctctccgcgctgttcggagccggcccggacgccgccgccaccggccacgcggtgaccgccgtgggcgacccctgccaggcgatctacggctggcgcggcgcgtccgtcgccaacctcgacgacttccccgagcacttcccgcacgccgacggcacccccgccacccgctacagcctcagtgagaaccggcgcagcggcggccgtctcctccaactcgccaacggcctcgccgaacccctgcgggcgatgcacgagggcgtcgaggcgctgcgccccgccccgggagccgagcgcgacggcatggtccgctgcgccctgctgaccacgcacaccgaggagatcgactggctcgccgactccctcgcccacctcgtgcgcaccggcaccccgccgggtgagatcgccgtcctgtgccgcaccgccggggacttccccgagatccaggcggcgctggtcgcccgggacatcccggtcgaggtcgtcggcctcgccggactgctccacctgcccgaggtggcggacctggtcgccgtctgcgaggttctccaggacccgggggccaacgcctccctggtccgcctcctcaccggaccgcgctggcgcatcggcccccgcgacctcgcgctcctgggccgccgcgcccgcctcctcgtacaccgggccggccgcacggacgacgccgacccggaccagcggctcgcggacgcggtcgagggcacggacccggccgaggtgatatcgctcgcggacgcgctggacaccttcctggtcgtgggggacacggccgacgacggtctgccgttctccgccgaggcccgcgtccgcttcgcccgcctggcccgcgagctgcgcgacctgcgccgctcgctcgcggatcccctgatggacgtcctgcaccgggtcctggccaccacaggactggaggtcgagctgtccgcgtccccgcaggcgctggccgcccgccgccgcgagaccctcgccaacttcctggacaccgcggcccggttcgcctccctggacggcgaggcgaccctgctcgccttcctcggcttcctgcgcaccgccgcacagtacgagaagggcctcgacaacgcgctgcccggcggcgagaacaccgtcaaggtgctgaccgcgcacaagtccaagggcctggagtgggatgtcgtcgccgtgcccggactggtcacgggccagttccccggcgaccgggcccgggacgcgtggaccgcccaggccaaggtgctcccgcacgccctgcgcggcgacgcggcgacgctcccggccctggacacgtacgacgccaaggggatcaagacgttcaaggcggagatgaaggagcaccagcacacggaggaactgcgcctcgggtacgtcactttcacccgcccccgctccctgctcctcggctccggccactggtggggcccgtcgcagaagaagacccgcggcccgtccgccttcctcgacgcgctgtacgagcactgcgcggcgggccacggcgagatcgaggcctgggcggaggagcccgcggaggacgaggagaacccggccctcgcggaacgggacgccgacctggcctggccgctcccgctcgacgccgacgccctggcccgccgccgcgccgcccgggacacggtgctggcccacctggagcgcctggccgtccatggggacgaggaggcaccggcgtacgggcccgggcccgatgacgaaccggcaaacgaggcactgttcgaggacgagccggtcgacgaggactgggactgggacacgctccccaccgaacgccccccgggcgcaccggagaccggacctggcacggcaccggacaccgcgcagcacacggcaccggaccccgcaccgcacccgtccccgcacatcccggccgcacgccacccgcaggaagacccggccgcacgccacccgcaggaagacccggcggaacggctcacccccgaggaggcccgcaccctcgcctcctgggaccgggacctggactccctggccggggagctgcgccgggcccgtgccaccgtgcgcgaggtcctcgtgcccgccgcgctctccgccacccagctgctgcgcctggccgaggaccccgacgccttcgcccgggagctggcccggcccatgccccgaccgccccagcccgccgcccgccggggtacccggttccacgcctgggtggagtcgcggtacgaggaactgccgctgcccatgctcggcccggacgaactgcccgggggagacgagagcgacgcggagatcgccgacgagcgggacctcgccgagctgaaggaggcgttcgagcgcaccgcgtacgcccggcgcacgccgtaccgggtggagaccccgttccagatcaccctggcgggccgggtgatccggggccgtatcgacgccgtctaccgcacgggcgaccggtacgagatcgtcgactggaagaccacccgccaccgcaccgccgacccgctccagctcgccgtctaccggctggcctgggccgagctgcacgatctgccgctcgaagaggtcaccgccaccttcctctacgtacgcagcggggagaccgtccgtccgcggggactgcccggccgggccgagctggagcggatcctgctggacgagcccgccccgcgggacggataggctcaagagcatgagcgagaccccggacagcgccgtccgtacgtacaccgaacagcaccgcgcagccttcctcgacgacctcgcggagtggctgcgcatcccgtccgtgtccgcgcagccggagcacgacggggacgtacggcgcagcgcggagtggctgagcgccaagctcggggagaccggtttcccggtcaccgagatctgggagacccccggagccccggcggtcttcgccgagtggcccagcgaggacccggacgccccgacggtcctggtctacggccaccacgacgtgcagcccgccgcccgcgaggacggctgggcgaccgacccgttcgagccggtgatccgggacggccggatgtacggacgcggcgcggccgacgacaagggccaggtgttcttccacaccctcggggtccgcgcccacctcgccgcgaccggccgcaccacccccgccgtccacctcaagctgctgatcgagggcgaggaggagtccggctccccgaacttccgcgccctggccgagaagcaggcggaccggctcgccgccgacgcggtgatcgtctcggacaccggcatgtgggacgaggacaccccgaccgtctgcaccggcatgcgcggcctcgcggagtgcgagatcgagctgtccggccccgcccaggacatccactccgggtcgttcggcggagccgtccccaacccggccaccgagatcgcccgcctcgtcgccgccctccacgacgaggacggccgggtcgcgatccccggcttctacgacggggtcaccgacctcaccgacaccgagcgggccctcttcgccgagctgcccttcgacgaggccacctggctgcgcaccgcgaagtcgggggccgcctccggagagagcgggtactccacgctggagcgcgtctgggcccgccccaccgccgaggtcaacggcatcggcggtggctaccagggcgccggcagcaagacgatcatcccctcctccgccctggtgaagatcagcttccggctggtcgacggccaggaccccgaccgcgtacagcaggccgtcaaggcctgggccgagtcccgcgtcccggcgggcgtccggcaccggatcgtcttccagcccgccacccggccctgtctgaccccgctggaccaccccgccctccaggcggtggcccgcgcgatgggccgggccttcgggaagaagatcctcttcacccgggaaggaggctcgggccccgccgccgacctcagggacgtgctcggcgcccccgtcctcttcctcggcatctccgtaccctccgacggctggcacgctcccgacgagaaggtcgagctggaccttctgctcaagggcgtggagacgaccgcccacctgtggggcgagctggccacggcactccgctgaatgcccaccactccgccgagcgcccggactccgctgaatcctctgcgcatctccacgtacctgtgcacacccgatccacccagggggagtaggaagcacctgtgagcaccttcgacaacgccaccgcagaccgcccgatcggcctcaccgcgccgagcggcatcgaccgcgcggcacaccaccgcctcgacgaggcatggctggccgtggcgtggagccacccgacgacccgtgtcttcgtcgtctccggcgggcaggtgctgatcgacgacacccccgacgggggcaccgagatcgtcatgacccaggccttcgaggccccggtcaccgagacccaccggtatttcctcggcaccgacgaggacggcgtcagctacttcgcgctccagaaggactcgctgcccggccgcatggaccagtcggcccggcccgcgggactccgcgaagcgggtcttctcctcggcccccgcgacgcgggcctgatggtgcacgcggtcgccctggagaactggcagcggctgcaccgcttctgctcccgctgcggcgagcgcaccgtcatcgccgcggccggccacatccgccgctgccaggcctgcggcgccgagcactacccgcgtaccgacccggcggtcatcatgctggtcaccgacgaccaggaccgggccctgctgggccgccaggtgcactggccggagggccgcttctccacgctcgccgggttcgtcgaaccgggggagtcgatcgagcagtccgtggcccgcgaggtgtacgaggaggccgggatcaccgtcggcgaggtcgagtacatcgccagccagccctggccgttcccctccagcctgatgctcggcttcatggcgcgggcgacctccttcgacatcaacgtcgacggcgaggagatcgaggaggcccgctggttctcccgcgaggacctcaccgccgccttcgagtccggtgaggtcatgccgccgttcggcatctcgatcgcggcccgcctgatcgaactctggtacggcaagccgctcccgaagccgggcgccgtgaagcggaccggctgactccgtaccccggacacacgactgcccccggcggtgccgggggcagtggtacgcgcgacgggcagtcgtccatcggccggatcaggcggcgagcgcctgcttcacctgcgcgagagacgggttggtcatgaccgactcggtgcccgagggggccacgatcagcagggtggggaccgtctggtttccgccattcgccttctcgacgaacgcggccgactccgggtcgtgctcgatgttgacctcgttgtacgcgatgccctcgcggtccatctggctcttcagccgacggcagtagccgcaccaggtggtgctgtacatcgtcacagtgcccgccatgtcgctggcgctccttcgtctcgtccgtacgctgcgcggccggcagcgtcactcgcggtccggccgccgtccgcggccctcccacaaccttgaggaacgtacgggacacggccaccattcccaccacgcccccgtacccggccggaccacgcccccgtacccggccccgcaccggtcccgcgcggcaccgaccggtacgacgaatacctcacccctgtggacaaccgccgcatccgcctcctgggacctggcagcatggcggggtgacagcagcaacgcactccaccctcttcccacaggttcccgagaccccggacgccgtgctcgacgggctcgaccccgagcagcgcgaggtggctctggccctgcacggaccggtgtgcgtgctggccggagccggtacgggcaagacccgcgcgatcacccaccgcatcgcgtacggggtgcgggcgggcatcctccagcccgccactgtgctcgccgtcaccttcaccaaccgggccgccggagagatgcgcggccgcctgaggcagctcggcgcgaccggtgtccaggcgcggaccttccactccgccgccctccgacagctccagtacttctggccgaaagcagtcggtggcgagctgccccggctgctggagcggaaggtgcagctggtcgccgaggccgccgcccgctgcgagctccggctcgaccgcaacgagctgcgggacgtcaccagcgagatcgagtgggccaaggtcacccagaccgtccccgccgactacccggccgccgtcgccaagacccagcgggacgccccccgcaatccggcggtcctctcccagatctactccacgtacgaacagctcaagcgcgaccgctcggtgatcgacttcgaggacgtgctgctgctcaccgtcggcatcctccaggaccggagcgacatcgcggagcacgtgcgcggccagtaccagcatttcgtcgtcgacgagtaccaggacgtgagcccgctccagcagcggctgctcgacctctgggtcggggaccgggacgatctctgcgtcgtcggcgacgccagccagacgatctactccttcaccggggccacccccgaccacctgctgaacttccgcacccgccaccccggggcgaccgtggtcaagctggtgcgggactaccgctccaccccccaggtcgtccacctcgccaacggcctgctgagccaggcccacggcaaggccgccgaccaccggctggagctggtctcgcagcgcgagaagggccccgaacccgtctacacggagtattccgacgagcccaccgaggccgagggcaccgcccgacgcatccgggatctcatcgccgccggcgtgccggccggcgagatcgccgtgctctaccgcgtcaactcccagtccgaggtctacgagcaggccctcgcggacgccggggtgccctaccagctgcgcggcgccgagcggttcttcgagcgggccgaggtccgcgaggcgggcaccgccctgcgcggagcggcccgcgccgggcgcaacgactccctgctcgacgaggcggaaggcctgccctcccaggtgcgggcggtgctctccaccaagggctggaccggccggccgcccgccgggtcgggggccgtgcgcgaccgctgggagtcgctggccgcgctggtgcgcctcgcggaggacttcgagacggcgaaacccggagcgaccctaaccgacctggtccgcgagctggacgagcgggctgccgcccagcacgccccgacggtccagggggtgacgctggcctcgctgcactcggcgaagggcctggaatgggacgccgtgttcctggtcggcctgaccgagggcatgatgccgatcgcctacgccaagaccgacgagcaggtcgaggaggagcggcgcctgatgtacgtcgggatcacccgcgcccgcgtccacctctcgctctcctgggccctgtcccggtcgcctggcggccgggcgagccgaaagccgacccgcttcctgaacgggctgcggccgggctcggcgccctcgggcgcgcggaccggggccgccggcggcggaggcatcgaccgggggaccggccgggcggcggcggcgagccggaccccggtggtcgagcggaagcaccggggtccggtgcggtgccgggtctgcggacgcacgctcaccgacgcgggcgagatgaagctgatgcgctgcgaggagtgcccctcggacatggacgaggcgctgtacgggcggctctacgactggcgcgccgcccaggcggcgctgctgggccagccggacttctgcgtgttcaccgagaagacactcatggcgatcgccgaggccgtgccgtccaccgagggcgagctggtcgtcatcgccggcgtcggcaaccggaagttgagccgcttcggcaccgacgttctggctatctgcgcaggtgaggcggttgatggtgagtcccaggacgaggtcgacgagacctgaggaaaactcgtccagaaaatagtttgcgcccgccccagtcgtcaccataggttcttaaccacgggaacagcgacttctctgaagccctgattccgtgctgtacttatccgaatacgcaggaccggccccggccggtccccctgagacgccgagaggaggcgattgaagtgatcagcatcatcgaaacccagaaaatgaccgatctctcggtcgtctccgcctgctcgctcggcctcacccgctcctcggttgcctcgcttcgcgccaccggtctgtccggcatttctgccgtccgtccgctgtccctggtgagcctccccgtgacgcgggagcgcaatgagcgaccgatcgaggcaccggcggcagcagtagcgaaggcagcacaggctcaggcctatgcctttgcggcagccggtgccggagccaagaagcagacgcagcagcaccacacgatgtgggccttccgtgggcctgaaccctggagcgatccagcctgatccagcatcaggccggcgccttcagggccgcggaaccccactcgggatccgcggcccttttgttttgtccgaacggacgagacggaacgaaggagcctcgggacaagcaggacctggtaccagccgccaaccggccaacaggccggcacgaccagacgaggacaccacccaccgtgcacatcgaaacgcacgccccgtcagtaccgctttccaccccgatctcgccgcccggctccacggaggactccgccttgaccccgctcaccacgctcaccgcgctcgacgacgccatcgagaacctcggcgtacccgtcccctgccgttcctacgacccggaggtcttcttcgcggagtcgcccgccgacgtcgagtacgccaagtccctctgccgtacctgcccgctcgtcgaggcctgcctcgccggggcgaaggaccgccgcgagccgtggggtgtctggggtggcgagctcttcgtccagggtgtcgtcgtggctcgcaagcgtccgcgtggccgtccgcgcaagaacccggtcgcagcgtgaccgcgacctgtggggtccccgcccccacacgcaggctccgcctcggaacgatcgaccgtccccagacccatgacccccggaatcaggcaccaatgatcacccccacgaaggagcccgtcggctccgccacccccgacgtcaccatcatcggcgcgaacgactcgcgtcagaacaggacccgcgaaatgcaactcatcccagaagccatggcgcgtgcgcatatgcacgaccgcctgcgggaggcccaggaggaccgacagtcggcccgcctgatcgccgcccgccggatgcagcgccgagcggagcgcgcctcgctgcgcgcccgccgcgcgctggccatggcggtcatgcactgaccgtgcacccatcacctcaccgcggtgccgtccggacacggacggcaccgcggtgcgttgttccgtcggccgtccggtcgcggggatatcgtcaggaggtggacgaggagacccattcccccgagcagtccgccgacggaagcgtggtgtgcgctcgctgcggcaccaccgccgaaggcgagacagccccgccgacctggctctgctccgtggaggacggacgccgcctcctcttctgcgaggggtgcgcccgcctccatatccgtgcgatcgagagccgcctcgactcggtctggtggtgaccgcggccccgggccacttctacgcctggacgggctccccttccggctcgccctcctcctcggcgtactccgtgtcctccgcctccgtgtcctccgcgaggaaccccggcagccacgcctccagttcgtcgcgcagccggaccgtcgcgccgagctggcacagcaccccgatggtgctgagcgtgacccggtgtatcaggacgtaggacggggggaggttcagctgccttccgagctgatgggcgggggaacgcggatcggctatccgggccgcctgttcacggatccagctacgactgaaggtgaactcctccacctgggtgggctcgatgatcgggagcaggtagccgagcaccgcgtccgggtccagatctatcgactccttcacgaagccctcctcgcgcagcagcccgtacacccccgccgcgtcgccctccagcgtcagccgcagggagtcgccgatgttctgcggcagcccgcccgggagtcggtcgaccgtgccgaagtccagcactcccagccgccacgacccgaccgaaccgccgtcctcctccgtctgcccttcctgcgccgccgccgggggcagcagtcggaagttgcccggatgcgggtcggcgtgcagcaggccggtgcgcgccggaccggagaagaggaagcgggccagcaactgccccgcacggtcccgctgttccgccgtaccctccgcgatgacctcggacagcgggattccgtcgatccactccgtcaccagcacctggtcggactggtgcaccacctgagggatcaccacatccgggtcgccttcgaactccgccgcgtgctcctgttgcgcctgcgcctccagctcgtagtccagctcttccgagacccggtcccggagctccttgatcagcggtttgatgtccatccccggaaccagcggaccgagcagccgggcgaaccggctgagctgggcgaggtcggagagcaacgcctcgcccgccccgggatactgcaccttcacggcgacctcgcggccgtcgtgccacaccgcccggtgcacctgcccgatcgaggcggcagccgccggcgtgtcctcgaactccaggaaatactcccgccagtcctccccgatgcgttcggtaaggaccccgtggaccgtgcgcgcgggcaacggcggtgcggcctcctggagcttggtgagcgcggcccgatacggtccggcgacctcttcgggcagcgccgactcgaagacggagagggcctggcccagcttcatggccccgcccttcagctcgcccagggtcttgaacaactggtccgccgtgcgctgctgcacctcacgggcgaccaactcggccgactttccgccgatccgcttgcccagaccccatgtggcacggccggcgaagccgagcggaagcgcggccagcttggccgtacgcgtaaccgccttccggggaagatcagacatgtgcccctccagttcccagactgccgtgccgctcgtgcctccggtgtctctccggcgacggcggtcaccccgccattgtgtcctgcgccggaagaccaccggaggcccgttccctcatagcgcccccggccgccccgcaggagcagtccgcatgcgggccgatcggctcggaacgccagtccagcaacggtagagcggcctcccagcgggctccggtacaggcagggaggtccccgtccagaaacgccagggcatgtgccgcggcgagaccggcgaccgccgtcgcgagccccagatcgcaggcgggcaccgctccccgcctcccggaacgccactgcgccagcatccggggccactgcggatcccggtccgcacggtgcagctccaggcagcccgcacagccggtgcccccgggcaggacgagaggcccgaccacccctgtggcctcgaccactcccgcatagagatgaggagtgcccgacgcgatccaggggccggccgtgtccgcgacgggcgcgtacaccgcgaggccgtcccggggagcgacgacgatcagggacaggccgggctgtccggcgcttcccggcaggtcggccccggctccgtccggcctcgctcgccggggagcgggcccgggcgcggaccggcggacgagccggcgggccgccacatcgcgccgttcccccacggatgccggggggagtcccgcgggcgccacgtcccagagctcgacccgccccccgtcgagcacttccacatgccccacccccgcacctgacagcaccgaggcgatggacgccccgacccggcctgctccccgcacctggacccgc

SEQ ID NO: 3137 - DNA, 8966 bp, Unknown
  Kingdom: Bacteria, Phylum: Actinobacteria, Class: Actinobacteria, Order: Streptomycetales, Family: Streptomycetaceae, Genus: Streptomyces
ccctggcgcaccggctgggcctcgctccctcgtccgtgtcggcccatctgtccgtgctgcgcggggcggggttgctggcctcgcggcgctacggacaccaggtgctgtacgagcgcacgccgctggggatcgcgctggccgcctcggactgacgcgcgccggaacgccgcgggcataagggtcacggacggtgtcgcaccgccactctcggtgaccgtcatgtcacgattgctccgtttccctgtgctccgtatccgtgagtcaccgccgtccgaggggtctggatgtccggccgcagaatcgtcccccgcgctctcccccgtaccgtccccgtcctggccgccctcaccctggcggccgtcctgaccgcgggctgctcgacaccggaaccgcacgtcacccggaccaccgaggcggcggacgacctcgtccggggcgaacccgccccgagcgcggcatccccgtactgggtcgacccgaacagcgacgccgcccgccaggtgcgcgcctgggagaaggaggggcgcgagacggaggcgaagatcctgcggcggatctccgggcggccggtggccgactggcccgcgtgggacgacccggccccggggatccgggccgccgcgcggtccgccgcccgtacgaagaagaccatcctgctcgtggcgtacaacatcccgcaccgcgactgcgggctctactccgcgggcggagcgaaggacgcggactcctaccgttcctggatcggggagttcgcggacgccatcggggacgcgtccgcgaccgtgatcctggagccggacgccctcccccacatcgcggacggctgcaccccgcccgagcaccacgccgagcgctaccagctcctgtccgaggcggtggacacgctcaaggccctgccgaagaccaaggtctacctggacgcgggcaacccggactggatcgacgagccgtccaagatggcgcagccgctgctacaggccggcatcgaccgggccgacggcttctcgctgaacgtgtccaacttccagtcgaacgagagcgtgaaggcgtacgccggccggctctccgacgccgtgggcggctcgcacttcgtgatcgacaccagccgcaacggcaacggccccctgtccgggggccgtgaggaggcctggtgcaatccgccgggccgggggctcggcacaccgccgaccaccgacaccggcgacgaccggctcgacgcctatctgtggatcaagcggccgggcgactccgacggcacctgccggggtggcccgccggccggcgactggtggccggagtacgcgctcggcctggcgaggcgcgccgcttcctgaaacgtcccggggcgccttcggggtcaggcgaccttgacccacttcgcctcggaggggacgccgtcggcgtccgtgacgaagagcatgtaccagccgggcggcaccagcgtggggtcgtccggcacggtcacgctcagcttgccgtcccccttcttcaggcccagttcgatggagcgctgctccacgtcggtggtgtgggtgacggcgctcggccgcatcagccgcgccgtggcgatccggtccgcgtcggcgctctcgtacgtgaccgtcgtgccgcgctcggcgtcctcggggccgttcccgatcaccgggcgcttgtccttgccgcggtgcagggcgggcggggtgtagacctccatccgctgctcgaacttgccgagcttggtgttgtccttgtcgccgtagagcgagtcggagccgaaggtcgcgacccgcccgtcgggcagcagcagcgcctcggagtggtagttgcgccccaccgtcggctcggccgcctccttgaacgtgttggtcttcgggtcgtaggactgcgccttcaggatgttgctggccccgcggccccggtagtcctcggatccaccgctggtgaagacggtgtcgtcgggcatgatcacgctgttcagatagcgcgtgccctgcggcaggtcggggccctcctcgaaggccgggctgtcctgcttgaggtcgatgaccgcggtgcgggcggtggacttcttggactcgccgaccccgccgccgccgagcaccatcaccttctggtcctgcaccggcggcagcagcagcgaggccgccgtctccagctcgtcggtgtcggtcagtccgggcaccttggtgaaggtgttcttcttgatgtcccagatcccgggctcgcgtcccttgtccgccgggccgtaaccggcgttggcgcccgggtagaagagcttgccgcccttggtcaggaagagggccgggtaggtagggaagtagtggaaggggcccttggaccacttcttcgtcttcgggtcgtagatctcgttgtcgcccgggaggatcgcgccgacgtcgtcgaggccggagacggcgagcaccctgccgtcctccaggcccacgagcgtcggataccagcgggcctccttcatcgggtcgaccttgatgtacttctccgccgtcgggtcgaactcgtaggcggcgcggatcccctggaagtcctgcttgtccatggtgatcttctcggcgaggccgtaggagttgtcggcttccttgcccttcagcccgacgatctcgtactgggcggcgtccgtcgccaccgcctcggggccgtcgtccgcggcctcgacgaagacccgctgctcggcggcggtcaccttggtcttccacggcttcatctggccgctcttgaagtagtcgacctcgaactcgcgcttggccttggggacggtgacgtcgaacttggccacgtactcgacgccggacggcgagcggaagaccgtgcccttcttgagcttcagcggcttgtcggggttctcgttcttgacccgcataccgccgccggcccgcttcaccttgtcgtcgagcacctcgtagcgggcggtgccgcccgcgatcaggaggcggccgtcggggagctgggcgtggccgccgcagaagaagtcctcgggggtggggatcttctggaaggtgttctcggccggatcccacaggaccgtgtcgaaggtgcccgcgtcgaagttcttctcgtcgttgccggagcccgcgacgatcagcaccttcccggtgtgcaggagcgccgcgtggatcgcgttggtccggtactccttcggaatgttcacgcgctcccaggagccgtactccgccttgtactccggctggtcgatcttgtacgcgtgatacctgtcctcggcgaaggacagggccgcgggtgcgttcagcccggcgagcagcaccaccgcgccgccgcccaggagcgtcttcctcatctgcttcgagggccggtaggccatgggtcagttccctcctgcggtggtggtggcggtggtgccggcgctcgccgcggtggtcgccgacggcgcgggaccggcggcataggccggctcgggcggcgggggcgacgggaccgggacggcgcgcgcggtctcggcgcgcttgtcctgccggacggtccaggcccaggcgccgaccggggagagggagatcgccagaccgagcgtcgcccaggtccgcatcgccacatgggtgtggtccaggtacaccgacgcggcgagcgaggagagcaggaccgccgcccagaagaggtggatacggaaggtgagcagccggtccggggaggcctggccgcccttgggcgtgacgacgaaccggccgtcggtgcgcagcacggccgaacccagcgacttcaggtagatcggggcggagagcgccgacatggccatgccggcgagaccgccggatccctcgggctcgtgcggggagacgttgtgccggcggttccagaggtagagcccgatctggagggcggcggcgtcgctgtacagcatcagccagatggaggcggcgacctgggtgccggacgccccgaaccagaggaacagcacacagctgaggacgccgagcagccagttgaccgcggtcatcgggtagtagacgagcatcagcgtgtagctgaggaggcggccggggggcacccggaacagcgccttgccgtactgcttgaacagcgtctcgtacgttccccgggaccagcgcagctgctgggtgaagaagtccgtccaggaggcgggcccctcgcccacggccagcacgtcgggggtgtagacggagcgccagtagtgtccggtgcgcgggttgcggcgtcggtggatctcgaagccggtggccatgtcctcggtgatcgagtcgtacaggccgccgacctgccgcagcgcggcgatgcgcacgacgttgttggtgccgacgaacatcggggcgccgtagcggttgcccgcgcgctggatcagggcgtggaagaggaactgctgcgattcggcggccttggtgacggccgagtcgtagttcccgtagacctgcggtccgacgacgaaggcgacgtccgggtcgcggaagtagcccatcatccgctccaggaagttgggcatgggcacgtggtcggtgtcgacggaggcgaagaagtcgtagtcgccgccgtgccgggcgatccaggcgttgtagttgccgtgcttcgtcttcgccttgtggacgcccttgtcgcggttccactcggggaccccgcgccgggtgaagtggtggacgcccagttcggcgcagagcatccgggccccggggtcgtcgccctcgtcgagcagccagacgtccagcgggccggggtgcttcaggcgtacggcgcccttgagggtggcgcggaccatggagagcggttccttgccggggacgtacgtggtcaggaaggcgaccttggtgccgggctcgggcgtcaccgggaccgggtcccgcgcgacgagcgtggcgtgcgcgatggagaccacgttgaccagcatgaacagctcgatcagggcgatcgacaccagcatcacggtgtcggcgacgaccagccagcgctccccgttctcccgctcggtccagtgcgtgggccagaccaggtacagcaggaggatcccggtgagcaccggagcgagggtcatcagcaggatggctcttattcggtgcttctccgtcgagagcaggctcttgtaccgcacccggtaccccgtcggttccggctccgtgagcggacccgcgagccggctgtaggtgtcgtagtcgtagccctccgaccgcaccgtgcctcccactgtcgaacgggttgatatccccacagaaggggacagctaacggtgtgtcgacttggcaggtccgagtgagcggtttttgatccggaaccggaaaagcccccggccgtgtggcgccgggggcttttcgggtgaacgggaacgtgccgcgcggacggtgcgtcagaaggtcaggcgcccccgaggtaccgctccacggtctcgaccttggaggtcaggccgtcggtgacgccgggccggatgtcggccttcagtaccagggagacgcggccggcgcgggcctcgacggcggccacggcgcgcttgacgacgtccatgacctcgtcccactccccctcgatggaggtgaacatggcatcggtgcggttgggaagcccggatgcgcgtacgaccctcacggcgtcggcgacgtactccccgacgtcctcgccgacaccgagcggggagacggagaacgcgacgatcatgcgctgaccgtgccctcgcggcgggcgcgggcggcgatgacgccgtcggcctcgtactgcttgaggagcttgtcgccgtagagcccgccgaaggggatcagggacaggacgaagaagagggcgacgcgcttgagcggccacttggccttcgtccagacgtcgagcaggaacacggcgtagatcacgaagagcacgccgtggatcatgccgagcggcatcatcaggaagtcgatgtccgagacgcggctgaggaccgagccgaagaggatcagggcggggaaggacagcgcctcgggaatcgagatgaggcgcagccggtgcagggcggaagcggtcttgatgtccacaggggcaccttcgatgggagggtcgcgagggcttgtgaaccgaggcacaagccgcccccattgtggcatcgcggcggggcgcccccggcggcgggggccgccccgtccgccggtgcgcgtatcgccgcatatcagggccggtccacgtgcgcatcagggacgtaacggttacggagcctctggccggggtgcggcgcggacggctaccttcgtcgcgtggcgatgttccgactccaaggcagcaagacgctcgccgtcgacctgacgggcgacgccgtcaaggcgaagaacggctcgatggtcgcgtacgacggccgggtgaccttcaagaagatgtccggcggcggtgaagggctccgcggcatggtgacccgccggctgaccggtgagcagatgacggtgatggaggtgtccgggcagggcacctgctacttcgccgaccgggcgagcgagatcaacctggtctcgctccagggcgacaccctgtacgtggaggcgagcaatctgctggccaccgacgccgggctgcgcaccggcacgacgttcaccgggctgcgcggcggggcgagcggcaacggcctgttcaccaccacggtggagggcaccgggcaggcggcgatcctgtcggacggcacggcggtcctgctgcgggtgtccccgcagtatccgctgatggtcgaccccggcgcgtacatcgcccaccagggcaggctgcggcagaacctccaggcgggggtgaacttccggacgctgatgggcgagggctccggcgaggcgttccagatccgcttcgagggcgacggtctggtctatgtgcagccgagcgagcgcaacaccgtcggaggcgatgtctgatgccgttccgggagatcaactccaagatggtcgaggccaccctggccccgggccagaagctgttcagccagcgcggcgcgatgctggcgtaccggggcgaggtgtccttcaccccgaacctccaggggggccggggcggcgtggcgtcgatgatcggccgccgggtggcgggcgagtcgacgccgctgatgacggtcgagggctcgggcacggtgatgttcggccacggcggccaccacatccaggtgatcgagctggcgggcgacaccctgtacgtggaggccgaccggctgctcgcgttcgacgggacgctccagcagggcacgatgttcatgggctcacagggcggggtgatgggcatggtgcgcggccaggtgaccggccagggcctgttcaccaccaccctcaaggggcacggcgcggtcgcggtcatggcgcacggcggggtgatcgaactgccgatcacgccgggccgggacgtccatgtggacccgcaggcctatgtcgcccaccacggtgaggtccggaacaagctgtccacggcggtcggctggcgggacatggtgggtcggggctccggcgaggcgttccagctggagctgagcggcagtggtgcggtgtacgtccaggcgtcggaggagaagctgtgagcacgcccgtggtcctcgacccgatgacgctgccgtcggacgacaacgtcaacgcgtacaccttctgcgtggagctcaaggggagccggtggttcctgcagaagggcaagatgatcgcctactacgggcagatccagttcgacggcatcggacacggccggttcgagcggctggtgcgctccagcttccattcgccgctgcacgcgagcgactgggtggtggccgagggcagcgggaagatgctgctggcggaccgggcgttcgatgtgaactccttcgacctggaggacgggaacctcacgatccggtccgggaacctgctggcgtaccagccgacgatggcgctcaagcagtcgatcgtgccggggttcgtgacgctgatcggcacggggaagttcgtggccgcgtcgaacggtccggtggtgttcatggagccgccgctgcgggtggatccgcaggccttggtgggctgggccgactgcccctccccgtgccaccactacgaccacggctacctgacgggcgtgatgggcggtatccggtcactcacggggatcggcgggacgtcgggcgaggagcaccagttcgagttcgtcggggcgggcacggtgctgctccagtcgagcgaggcgctgatggcggagcaggcggcgggcgtggtaccgaacgaacccggcgttccgggcggcgggggtcgacccggatccgctccgcgcatgcccggccagctgggggacctccagcgtcgcttcgggttgtgagcggtagtctgcggagtgtgacgtcgaacgtctgcgcccggccgtcggtgcttgccgaagggcctgcaggcgctcccgcgggcgggggtgccggtcgtcacaccccaatttcgtccggctttcaacttcttaggtagaatccatatatggagaccgagacggccacccgctggctgagcgacacggagcagtgcgcctggcgcacccacctggacgtcagcaggctgctgatgcaccaactggagaaggacctccagccgttcggcctgaccatgaacgactacgagatcctggtcaacctctccgaatcggacgaccagcgcatgcggatgagcgacctcgccgccgccaccctccagtccaagagccggctctcgcaccagatcacccgtatggagaccgccgggctggtccgtcgcacccactgcgagtcggaccggcgcggactgttcgccgtcctcaccgagcacggcgcggagaccatgcgcaaggtcgccccgcaccacgtcgcctcggtgcggcagcacttcatggacctgctgtcccccgaggcgctcgccgacctgcacgcggcgctgaccccgatcgcggagcacctgcgcggcaagcgcggcaagctgtaggacccggagctgtcaggccgggcggggcagccacagccggaaggccgcgccgccctcggccgcccggcccaccgtcagcgtcccgtcgtggcgcgagacgacgtcccgggcgatggccaggcccagacc

SEQ ID NO: 3138 - DNA, 8971 bp, Unknown
  Kingdom: Bacteria, Phylum: Actinobacteria, Class: Actinobacteria, Order: Streptomycetales, Family: Streptomycetaceae, Genus: Streptomyces
ccgcctcggtctgccccggcctccgcccccaccacgtgccggagcccgaagccggggcagaccgaggcggccgggtttcatcgtgcggacggccaggaccgtgaacttccggtccaggtacatcacatcgatggggaaccgcatccggaaggtgtgcacactcccgcacggggtgagcatcattgccccctcgatcccgtcccgcccgagcaaccccttggtacgggcccggtacgacgccgctatccgcagcggcacctcccgggtcccggagtccgtgccgaccgtgagcgtcccgtcgccatcgcgccatgtcctcatgggcaccgaccgtaacccccggcggacgcgcccgggtccgatacggccgcgcttgggcccccgggcccaagacccctgttcccgcagcccattagggtcgtcccgtggacgccgcgctgctcgccctcgccgcggtctggggtgccgtcaccggactgctgatcccgcgtgccgcctaccggttcgccgtcgagccggaggaaccctggcgtgcggcgtgccccgcgggacacccgtttaccggcccggtccgcggctggctcggcccggcccggtgtgcgcgctgcgccgccgccccgggaacaccggccgcgcccgggaccgacatcaccgccgtcgacaccgacaccgacaccgccgtcggccggtcggccgccgtgcccggagaggcccccgccggagcgggccgcgtcgccggaactccggcccccgcgccggccgcctacgcccccggtgtcctcgcgcccctggtcaccgtggtcgcctgtgtcgcgctcgccgccgccaccggggccaggcccgagctgatcgggtggctggcgctgacccccgtcgccgtgctcctcgccgtcgtcgaccggcggcgggccggccgagtccacggcggcgcccagcgacttgtacgcctgggagatctgctggaaggcggccgagtcggtcttctggacgtcggcgggcttgctgttgtccgcggtctgctgctggatggaggcgttggcgttggcgatcttctgcagttgcggctgaacctggtcgcagaccttcttggcccagtcgttgaccttgttgtcgctgtcgtcgctgcagcccgacagcgtcagtacgagtaccgcaccgccggacagtgcggctgcaagcttcttgttcaccggattggtcccttccaaggctctcggccccggaacttacacgccggggggacgacagccgggtgccggtcatccggtgtgcatgcttttgaagccatttgcaccaagggaaatgagggagatgccactcgcgcagagattcggacgcacgatcggtcactcatccgaaaggatgttcctgatcatcggccccccaccgacgaggacgacaccggacgaggacggaggggggtgcgggggaacagaggacgccggaagaggcaggcggcggagcagacgaaggcggacggcgcgtcaccccgcgccgcccgcccactccttgaccgcacgtcacaccagtacgtgcccggttcacctcactgcgtacgactcacaggatcgccgcacaacggatcgcggaaccgcgcgcacgtacaggtcccaggtccgcacagacggctcacggagccgccgcgggatccggcgcggggaccgaggggcctccgtcccccgaggcgtcgtcgtcgcccacggcgatgccgcgccgcttggagacgtagaccgcgacgacgatgatcccgatggcgacgacggccaccagagcccgcacccagggattcgcgtccgctccgtaactgaactgcacgatcgccggcgcgatgagcagggcgaccaggttcatcaccttgaggagcgggttgatcgccggacccgccgtgtccttgaacgggtcgccgaccgtgtcgccgatgacggtcgcggcgtgggcctcgctgcccttgccgccgtggtgaccgtcctcgacgagtttcttggcgttgtcccaggcgccgccggagttggcgaggaacacggccatcagcgtgcctgtggcgatcgcgccggcgaggtacgagccgagggctccgacgccgagggtgaagccgaccccgatcggcgccagcaccgccagcaggcccggcgtggccagttcgcgcagggcgtcacgggtgcagatgtcgacgacgcggccgtactccggcttctccgagtagtccatgatcccgggatgctcgcggaactgccgcctgacctcgtagaccacggctccggcggaccgggacacggcgttgatggccagcccggagaacaggaagacgaccgcggcgcccaggatcaggccgacgaggttgttgggctgcgagatgtccaggctcagccccagctcgcccgccccggccccgacctcgtccaccgccgtggcgatggcgtcgcggtaggacccgaagagcgccgccgccgcgaggacggcggtggcgatggcgatgcccttggtgatggccttggtcgtgttgccgaccgcgtccaggtcggtgagcacctgggctccggcccccgtgacgtccccggacatctccgcgatgccctgggcgttgtccgagaccggcccgaaggtgtccatggccacgatgacgcccaccgtggtgaggagtcccgtcccggcgagcgcgaccgcgaagagcgccagcatgatcgacgtaccgcccagcaggaacgccccgtagacgccgaggctgatcagcagcgcggtgtagacggccgattccagcccgatggagatgcccgccagcaccacggtggccggaccggtgagcgaggacttcccgatgtcccggaccgggcggcgattggtctcggtgaagtagccggtgagctgctggatgagcgcggccaggacgatgccgatggccaccgcgaccagggcgaagatccgcggatcgccgccgtgcccggcgatcgcctcgtcggtgaccccgcccagttccgcgtacgaggagggcagataggtgaaggcggcgacggccaccagcgccagcgagatcaccgcggagatgaagaagccgcggttgatcgcggtcatcccgctgcggtcggcgcggcgcggggccaccgcgaagatcccgatcatcgcggtgacgacgccgatcgccggcaccatcaaggggaaggcgaggccggagtcgccgaacgcggccgtaccgaggatgagcgcggcgacgagcgtcaccgcgtacgactcgaagaggtcggcggccatgcccgcgcagtcaccgacgttgtcgcccacgttgtcggcgatggtggcggcgttgcgcggatcgtcctccgggatgccctgctccaccttgcccaccaggtcggcgccgacatccgccgccttggtgaagatcccaccgccgaccctcatgaacatggcgatcagcgccgcgccgagaccgaacccctccagcaccttgggcgcgtcggccgcatagacgagcaccacgcaggaggccccgagcaggccgagtcccaccgtgatcattccgaccacgccaccggttcggaaagcgatcttcatcgctttgtgcgagacagcggtgagatccttttccggttccccttccgctggagtcgcctcacgcgcggctgcggccacccgcacattgctccgcacggcgagccgcatgccgatgtatccggtcgccgccgagaaaagcgcacccaccaggaagaagagggaacgccccgcgcgctgcgaccagttgtcggccggcagcaggaacaggaggaagaacacgacgacggagaagacaccgaccgtgcgcagttgcctggccagataggcgttcgcaccctcctggaccgccgcggcgatctccttcatgcgttcggtgccctcgccggccgccaggacctggcgcacgagcagctgggcgacgatcagcgcggcgactgcgacgaccgccaccacgatgacgatcagccggttgccgtcggtgagtaccgccgccgcgagggagacgggtcggtcggaaaacgcggattcttgcgtcagtgctgccattggggtggtgaagaactccgccatacgtcctccttgacgctcagcgctcaagtcgtggacggattgtagggagcggaacctgatcaaaacagtgggcgggaagagaattgatcgctctccccccaacgccgaaagatcaacggagagattctgctcgaatgcagtaatggagcaggtgcattacgcggagagaatcaagaaaaaaggccctgctcagcagggcctgggaaaacgaaacatcacccgcgcacctcaaggcccacaggtctcagcgcctcaggaccgcagggcggccttagaccgcagggtgcctcagaccgcaggctggcctcagcactcagcactcagcactcagcactcagcactcagcactcagcaccagtctcagacacccgcctcgatacctggagtcaccgccacggacgcgggtaccgacctcgggtacaggcggggcccctccggggggccctcaggatcgtgccgcggcgccggccgtcggccaggtcatgcggatcactccgccacccgcaccggaacggacctccacgtcgtcgacgagaccgctgatgaccgcgaggcccatctcgtcctcgccctcgctgtccgtctcgggatcgggccggtccggcccccctccggaaactccggagccgttgcgcgccccggacgcggcgggatccccgccggggccgggaacgctgtcccccacctcgatggagaacgacttctcttcctcggtcagcgcgacgctgaccggcgcggtgatgccgtgactgcgatgcagcccgaccgcgcggctgcacgcctctccgacggcgagcctgacctcgtcgagcaccgcctcgtcgacgccggccctgcgcgccacggcggccgccaccaggcgggccgtcctgacatgttcaggctgggcgctgaagcggagttcaacggtggccatgacatccccctcgaacgttcgggcgtacgcctcagaggtcccgggcgtgtcgcccggcacccctgctcttctcctccggaaaccgacaaagccgacagccgacccgagggtcgaccgcctgcccgtcacggcccatgcgctgccgctgtcggtctgttcactgcctgccggccgacccgggggccggtccgctccgacctcagtcggtggcggcgacagcctcgtcgaccgtggtgtgaatcgggaacaccttggtcagacctgtgatccggaagatcttgagaatgcgctcctggttgcagaccaggcgcaacgagccctcgtgggcccggacacgcttcaagccgcccacgagcacgccgaggccggtggagtcgaggaagtcgacgccttccatgtcgacaaccaagtggtagctgccgtcattcaccaactcgaccaactgctcgcgcagcttgggcgcggtatacacatcaatctcgccaccgacctcgacgaccgtacggtcgccaccagggccggacacattgcgagtcgacagggacaggtccacggatcctccagcaccttgctatcgagcggtcgcccctcgctctccccgacggaggccaggggacggatcgccagccgcgatggcattcaatcacttaccagcagccatgcacgacgccttgggaccattgtccgtcacgccagtgacacactcggtgccgatggccaagaatcaccgtcccggacaaccacccgagagtgggggctcgcgcccctctcccgccatgatcctcgaccggctcgccgcaggggcgggccgggccgcgcgcatcactcatacggagcacttgcccccgagatcgggaacccatgccatctggccggatcgcatccggccagaagtgatctcggcgatcgaaaaggccgggatcgcccatccgtgggcgcatcaggctgctgcggcggagcacgcgctggacggcgagtcggtcgtgatcgccaccggcacggcctccgggaagtccctcgcgtacctcgcgccggtcctcagcaccctcctggacggctccgaggcccccaacggccgcgggaccaccgccctgtacctcgcccccgccaaggccctcgcagccgaccagcggcgctcggtgaaggcgctcgcagccccgctcggcaacgccatcaggccggcggtctacgacggcgacacccccgtcgaagaacgcgaatgggtgcggcagtacgcgaactacgtcctgaccaaccccgacatgctgcaccgcgggatcctgccgtcccacccccgctgggcgtccttcctgcgtaccctgcggttcgtcgtgatcgacgagtgccacacctaccgaggcgtcttcggctcccacgtcgcccagatcctgcgccgcctacgccgcctgtgtgcccgctacggggccgatccggtcttcctgctggcctccgccacggcggcggaccccgcggtcgcagccgggcgtctgacgggcctgccggtccgggaggtgtccgacgacgcctccccgcgcggcgagctggtcttcgccctctgggagcccccgctgaccgacctgcagggcgagaagggcgcacccgtacgccgtaccgcgacggccgagaccgccgacctgctcaccgacctgaccctccagggcgtccgctcggtcgccttcgtgcgctcccggcgcggcgcggaactgatctcggtgatcgccaaggagcgcctcgcggaggtcgaccgctcgctgccgaagcgggtcgccgcctatcgtgggggttacctccccgaggagcgccgggccctggagcaggcgctgcactccggcgagctgctcggtctggcggccaccaccgccctggaactgggcatcgacgtctccggcctcggcgcggtcgtcatctccggctacccgggcacacgggcgtccctctggcagcaggccggccgggccggccggtcgggccagggcgccctggccgttctcgtggcccgcgacgacccgctggacacgtatctggtgcaccaccccgaggcgctgttccagcagcccgtcgagtcgacggtgctggacccggacaacccctacgtcctcgccccccacctctgcgccgcggccgccgaactgcccctcaccgaacccgacatcgccctcttcggccccgccgtgcctgaactgctgccgcagctggaagcggcgaagctgctgcgcagacgggcatcgggctggcactggacccggcgcgaacgggccgccgacctggccgacatccggggcggcggcggccgtcccgtccagatcgtcgaggagggcaccggccgcctgctgggcaccgtcgacgcggccgccgcccacacggccgtccacgagggggccgtccatctccaccagggccgcacccacctggtccggaaactggacctggaggactccgtggccctggtcgagcaggccgacccgccgtactcgacggtcgcccgcgacaccacggccatcaccgtcctgcagaccgacaccgagatcccctggggtcaggggcggctctgctacggctccgtcgaggtcaccaaccaggtcgtctccttcctccgccggaagctcatcaccggggaagtcctgggcgagacgaagctcgacctgccgccccgcaccctgcggacccgtgccgtgtggtggacggtcaccgaggaccagctcgacgccgcccgcatcaatccggagatcctcggcggcgcgctccacgccgcggaacacgcgtcgatcggcctgcttccgctcttcgccacctgcgaccgctgggacatcggcggcgtgtccgtaccgctgcacccggacaccctgctgccgacggtcttcgtgtacgacggccacccaggaggagccggattcgccgagcgggccttccacaccgcccgtacgtggctgacggcgacccgggaggccatcgcgtcctgcgagtgcgaggcgggctgcccttcctgcatccagtcccccaagtgcggcaacggcaacgaacccctgcacaaacgcggagccgtacgcctgctcaccgaactcctcagcgccgcacccccggaaccggacgaaccgaccacaccggacgaaccgaccgcgccggacggaccgaccgcgccgaaggattgagccgccgggacagcaccgccgggcggaccggccgtcgccccgtggcgttcacgagtccctgtcaggtcggcaagagcggcatgaccaaccgcttcagctccgcctcgccgatcgctccgatccatgtcgcgacgatccacccctccgggtcgacgatgatcgtgaaaggggtatccggcggtgttcacgacacccttcggaagctgaaggagctgctcccggccccgcgggtcgcgcaggctcggatagacgagctccgcgtccttctcgaaggcacgtgcctcgccgaccgacacgtccgctttgatccccaccacccgcaggccctcgccccgcagttcctcgagcacccgggagagccccggagcctctgcacggcacggtccgcaccacgacgcccacgcgttgaccacgacgaccttgccgcgcagtcccttcacgcgaaaccggccgccaccgtcgacgcgtccccccgccatctccggcatcgccacccgatccgcgggagcgtacgacttcagcggcgcgggcccgccggcgtcgtccacgggcagggtcgatgtcgagcatcccgtctgcacaaccagcaggacggccaccgcggtcgagggcaggagtgtcttcgcgttcgccgatgatgccaccgggtccgtggactggcgcactgccgccgcgaaacaccttgcctgccgaccggctcaccccgcggcgatcattccctcgacctcccaacaggcccagggtcgaccggagacccggcccggggcagcggagtcccggcccgcggatcggccgatggtccggcccggggatcggccgatggtccggcccggggatcggccgatgg

SEQ ID NO: 3139 - DNA, 5809 bp, Unknown
  Kingdom: Bacteria, Phylum: Actinobacteria, Class: Actinobacteria, Order: Streptomycetales, Family: Streptomycetaceae, Genus: Streptomyces
cgcgaccggctcggccacgggagcggcctccatcacgggtgcggcctcggccaccggagcgggaaccaccggggtctcggcgaccgccacggccgcctcggcgacagcctcgggggcgctgacgcgggtacggcggcgacggcgcggcgtacgcggcgcgtcgtcggacgcctcgtcaccggccggtgcgaccgcgacgaccggggtggtctccttggcgggtgcgggcaccgtcgcggcgccctcctccgcgacggacccgccacgggtgcggcgacgctgacgcggcgtacgggtgcggggctcgcgctcctcccgggcgggggccggtgcggcggccttgcggccgcggccgccggtctcgccgaggtcctcgacctcttccgcgcgcagaccggcacgggtccgctcggcgcgcggcagcacacccttggtgcccgccgggatgccgagctcctcgaagaggtgcggcgaggtggagtacgtctcgggcgggtccgggaacttcaggtccagggccttgttgatcagctgccagcgcgggatgtcgtcccagtcgaccagcgtgatcgcgatgcccttggcgcccgcgcggccggtgcggccgatgcggtggaggtaggtcttctcgtcctccggcgactggtagttgatgacgtgggtcacaccctcgacatcgataccgcgcgcggcgacgtcggtgcagaccaggacgtcgaccttgccgttgcggaaggcgcgcagcgcctgctcgcgggcgccctggccgaggtcgccgtggaccgcgccggaggcgaagccacgcttctccagctgctcggcgatgtcggcggccgtgcgcttcgtgcggcagaagatcatcgcgagcccgcggccgtcggcctgcaggatccgggagagcatctccggcttgtccatgttgtgcgcacggtagacgtgctggaccgtgttcttgacggtcgtgccctcgtcgtcgggcgacgtggcgttgatgtgcgtcggctgcgacatgtagcggcgcgcgaggctgatgacggcaccgggcatggtggccgagaacagcatcgtctggcgcttgggcggcagcatcgtgatgatgcgctcgacgtcgggaaggaagcccaggtccagcatctcgtcggcctcgtcgaggacgagcccgcggatgtgggagaggtcgagcttgcgctggcccgccaggtccagaagacggcccggggtgccgacgatcacgtcgacgcccttcttgagggcctcgacctggggctcgtacgcccggccgccgtagatcgcgagaacgcggacgttacggaccttgccggccgtgagcaggtcgttggtgacctgctggcacagctcgcgggtggggacgacgacgagcgcctgcggcgcgtcggtcagctgctcgggcgtggcacgccccgcctcgacgtcggcgggaacggtcacgcgctccaggagggggagcccgaagccgagcgtcttgccggtgccggtcttggcctggccgatgacgtcggagccggagagcgctacggggagcgtcatctcctggatggggaagggggacatgatgccgacagcctcaagggcttcggccgtctcggaaagaatgccgaggtcgcggaacgtagtcagggtgctgcctcttctgtgagacgcggtccgaggcgaacgctgggggtcgtaccgtgccggggttggtcatccggccgtggatgggccgggtggcgcgggaccactgccgtcgctcgagcgctcgtgccgctgagggggcccctcatctgcagtcgtacgtgtcgtacgcaccgcgtggagggctgtcgggtcggagccgatcgggccaccgaccgggcatcctcattcaagggcgcgcccctggcacagcacagtgctcagtaagcgcattaccactgtaccccggattcgcgcatgtgtgttggacgaattcatcggaacggtatgaggcccccggctgaccaggcccttccgccctgcgcggagcgggctatcgttccgttcatggagacgcctgaccacgccactgagacccccgccgaagcttccgcggccaccgggatcgccgcccaggactgggccaccgcggccgccgacccgcagtaccgcgccgcggtcgtggacctgctcggcgccctcgcctacggagagctggcggccttcgagcggctggccgaggacgcgaagctcgcgccgacactcggcgacaaggcggagctggcgaagatggccgccgccgagttccaccacttcgagcagctcaaccggcggctcaccgccgtggacgaggaccctaccgccgcgatggagccgttcgccaaggcgctcgacgacttccaccgccagacggcgccgtccgactggctggagggcctggtcaaggcgtacgtcggtgactcgatcgcgagcgacttctaccgggaggtggcggcccggctggacaccgacacccggtccctggtcctgtccgtgctcgacgacacgggtcacggcaacttcgccgtggagaaggtgcgcgccgctatcgaggccgacccgcggctcggcggccggctcgcgctgtgggcgcgccggctgatgggcgaggcgctgtcgcaggcccagcgggtggtcgccgaccgcgacgccctctcgacgatgctggtgggcggcgtcgcggacggcttcgacctggcggaggtgggccggatgttctcgcggatcaccgaggcccacaccaagcggatggccgcgctgggactggccgcgtaacaccccgctactgggccgccgccgaccgggcgaggcggcggccgcgtggtcggatcaggagcgacagcgtcaccgccccgacggacacggctccgatcagcgtcgccaggacgtggtcggtacccagcgcggcatgcgtcagatacgcgccgaacagggcaccgagcgcgccggtgagatataccgcacggctggacggcaggcggtcggccagcgatcggagcgccgcccaggacagggcgagtccgaggacggcggcgccgaaggattcccagatcacggaggatcacctcgcggggggtgtgcggggcgggcaaatcggtcgtaggcggtactacccccggcctgtggagggcaatcctccagcggcccgttccgacccgtacgggaggctccggacagaacgcgggagcggcccggcggggaatccccgccgggccgctcctgtgatcaacgcgtccggtggactacagcgccccgaaccccacccgccgggtggtcggctcaccgatctccacatacgcgatccggtcggccggcaccagaaccttgcggcccttgtcgtccgtgaggctgagcagctccgccttgccgcccagtgcagcggcgaccgcgctctcgacgtcctcggcggaaagcccgctctccagaacgatctcgcggggcgtgtgctgcaccccgatcttgacctccacggctatgtccctccgacggtcagtccttgcgcggcgaaccgcgccgtacgcagccacattagcccggcgggagcggcgctcagggcccgaccggcaacgcccgcagcgaacacggcgtcaggcgtcgcccgccggagggctcagatctgctcgacgccgtgcagcgggaagcccgcgataccccgccaggccagcgaggtgaggagctggacggccgtgtcacgggggatggcggaccggctggagagccagtagcgcgccaccacctgggagacgccgccgaggcccacggccagcagcatggactcctccttggacagaccggtgtccccggcgatcacgtcggagatggcctcggcgcactggagggacacccggtcgacccgctcgcgcacggccggctcgttggtcaggtcggactcgaagaccaggcggaacgcgccgccctcgtcctccacgtaagcgaagtaggcgtccatcgtcgcctcgacgcgcagtttgttgtccgtcgtcgaggccagcgccgtgcgcactgcctggagcagcgactcgcagtgctggtcgaggagggcgaggtagagctccagctttccggggaagtgctggtagagcacaggcttgctgactccggcccgctcggcgatgtcgtccatcgcggcggagtggtagccctgcgcgacgaagacctcctgtgcggcgcccagcagctgattgcgtcgggcgcggcggggaaggcgtgtaccccgcgggcgcgccgcctctgtctgctcgatggctgtcacgccgcctcccaaatatgtgttccagcacagccggtccgtgcacgctgcgccgtacagccatcgtacttttgggtaacccgggtatgcgcggcgcggacgcagaatttcatggaccggacggctgtggaagccacagttcttcctggtcgcgagcaaaccggggcgtattaccggtattcgtcctcatccaagggaatcaccctgcgctgttccgccgcatcggcctcattggcggtggccggatcgacgctctccgcccgttcgtcgtcctcgggccggacatccgcccgctgctcggccgcgtccgcctccggggcctcgggccccggctcttccggctcggcgttctcgaaggtgtccgggtcgctcgggtcgaccgtcatgtgcagctcccttcctttccctgaagcgtaggagctacccgtccaccccgcgatgcggcctgtgacggcgaacacatgaatgagggcgtgatcgtctcgtaacattgccgcatgtcttcgaccgagctgccgggtgtccaggccgccgcagccgcggtggctcccacggtcagtgccgtccgggtcgccgacggcgaacggctgcgctccgtgtcgctgccggggatcgggctgaacatccgctgccggccgggcgaccggaccggactgcctcccgcgctgtacgtgcacgggctcggcggctcgtcgcagaactggtccgcgctgatgccgctgctgtccgacctggtcgacggcgaggcggtcgacctgccaggattcggggactccccgccgccggacgacggcaattactcggtgaccggacacgcccgtgcggtgatccggctgctggacgcggaggagcgggggcccgttcacctgttcggcaattcgctgggcggcgccgtcgccacccgggtcgccgccgtccgccccgacctggtgcgcaccctcaccctgatctcgcccgccctgccggagtggagggtgcagcgacccgccgttccgaccggtctcctggcggtgccgggagtcgcatccctcttcgcccggctcacgaagggctggacggcggagcagcggacgcgcggagtcatggcactctgttacggcgatccggcacgggtctccgacgaagccttccgccacgcggtggccgagatggagcgacggctggagctgccgtacttctgggacgcgatgacgcgttcggcccggggcatcgtcgatgcgtacaccctgggcggccagcacggactgtggcgccaggccgagcgggtgctcgcaccgacccagctcgtgtacggcggacgggaccagctcgtctcgtaccggatggcacgcagggcgtccgcggccttccgcgacgcccggctgctgaccctgcccgacgcggggcacgtggcgatgatggagtacccggaggcggtcgcccaggcgttccgggaactgctggacgattgcggcgggagctgatccggggcgtgggacgacacagtcgaaagggctccggggcgatccgtccggacgcggcggcaacggaaccgggcggcgagcgcgccgcggcgaggcccgcgcc

SEQ ID NO: 3140 - DNA, 6452 bp, Unknown
  Kingdom: Bacteria, Phylum: Actinobacteria, Class: Actinobacteria, Order: Streptomycetales, Family: Streptomycetaceae, Genus: Streptomyces
ccgcggaccggtcggcgggaccacggcggggcggtgcgctgggaggcaccttgccgatcacctcccggggccgacgtcctcgcggaagcccgccccggaaaccacggcggcctcccaccgggtgtccggtgggaggccgttcctggtcgtagtccggccgagcggcctaggcggcgaccgccttcgtcgccttgctgaccgccgagccactggcgtggccggcgaggtgcgcggtgaccttcaccgtgatcgtccggccccgctgggccgccttgagcggcagtgtggcagcggtggccccggagatggccgcgccgttggcgtaccactggtaggcccacgacgacggcttcggcgcccacgcgccccggcctacggtgagcgtggaccccaccttggccgtgccggagatcaccggcaggaccgtcgccttcggggcgtcgcccttggcgaccgtgaccgccgcgctcgtcgcgctgccgtcggcgtgccctgtcagccgggcggtgacggtgacggtgatcttcttgccgagctgcgtcgccggtaccgcgtacgtggcggccgtcgcaccggagaccgccgcaccgtccgccttccactggtaggcgtacgaggacggcgtcaccgtccaggaaccggtgctcgcgctcagcgtcgcgccgaccttgggcgccccggtgatcaccggcggcagggtggaggcgagccgcgcgggcgtgacggtgaacgaaccccgcgggtgctcggtgccgttgtgcgtgacgacggagacgttccagacgccggtcgcggcgccggtcaggtcgaggaccaccgtgagcgtcctgcggtcggcggagacggcggtggtcgtcgactccacctccttgccgccgaggccgatgcggacgacgtcgtccttgtgcagcgccgtgcccgtgagcgtcacggtcaccttgccgccggccgcgccggtggtcggggctaccgtcccgatggtgaccgtctccgcaccgcagcggatgccggagcagacggcctccgccgcgtacgaggtcttcgcggcggtctccggaagcgacaggaccagggtgctcggggtggggtccttggagtagggctcgctgacggcgcactggtaaccggtggggatgtacctggtgcagccgttgtcgaggctggcgtcgtagagcgaggggaccgccgtcgcctcggcgccgtcggtgtcgctgatcttcatgtcgaagcggtcgcggtaggcggtcggcagcgccgcgcagaaggtgctgtgcgcctcgtcgagtgtgccggtgacggggccgtacccgtaactgacgttgggcaccgcgacgcatccttcggcggggccggccgcggtggcgatgcgcacggcgtcgaaccggtagtcgggcgcggccttcagtccggcgcgcacggtgaccaggacctggtagctggtggaaccggtgaccgcgcacgcctggttccggttgcacagggcctcgccgttcgcgccgtgaaccaccacgttcgcgcttcccagggcgtcgcgcacatcgacgtgcacggtgtcctcggcgtcagctgtggtgatctggcggcagcgcagctcaccgggtgcgcccatcgcgccgcccgaggaggggccgccggcccggaccaccgggttgggcgtgcagcccttcgcggtggcggtgacgtccctgcgggtcagcgtgtaggtggtcttgctgtcccggcccgtgaacagcacggtgtacgcggtgccgggcttcagctcgcaggtggtccacgtgctggtcgaggggtagacggagcaggcctggacgcccttctcgtccagcaccgtgaactgggctgtcaacgtctgccccggtgcggcctggagctggatgttctcccgcccgctgtgcgcgtcggcggggatgctcaggcactgcgagaagactccgtcgccggtggtgatgcgggcggcggggctctgtgcggtgaagtcgccggccgggacggccgggcagccggaggcggcgtcggtgcggtgcagtgccagggcgtacgcgccggtcgccgggtcgtcgtcgtcggtggagacgtgcagccggaagggcgccctgccgtccagttggcaggtgccggacgtgagggcggtcccctcgcactggtacgcgccgtcggcgtcgtacaccgtcacctcggggtgcgggcccggcccgccgagggacttcaggacggccattcgagccccggtgggaaggtccagcaagacgcagtcgatctcccccgccgaggtgaacccggcccggtgcacgcccatgcctgcgggtgcgcagccgacgtccgaggcgcggtcgatgatgagggtggcctggtcggtgtagaccgtgtagtcaccggccgcgggaagatcgcacccgtcccaggtgttgcagacggtcttgccggcgcggtcgtagaccgtgagcttggtacgggaggtgtcgaccgcgtagacctcgtgggggccggcgtgggacgcggtgaacgtcttgcagccggtggccggagtcacggtggtgggcgcggagttgtaggcgttgaccgggatccgggcgcagccggccgggtcggagatgcggcggaccttcagctggtactcggccgggaagccgccctccgcctcgacgacgtgggacaggacgcggtaggggccgtcgcccgggagcacgcagccctcgctgtcgtcctcgttgaagtgcgggcagatccgggcgccggtctcgtcggtgatccaggagaggccgtggccgtacttcgtggtggtgatctcgtcggtgagccgctcgcccggcttcgcctcgatccgcacacactgcacggccgtcgggcccgcggtcagggccacgaggggcggggtgtcccagccggtcgggatcggggcggcgcagccctcgtccgtgccgatcgggaccagtccgaaggtgaacttactggtgtccgcccagttgttgaacagccgcagcgtgtacgtgccggtgcgctccagccggcaccagccctcgccccactgcgggtcgtagcagtcgacctgctcctcgccgtcgtagaccgtggtgtacacgttgtggcttccggtgcccgactccaggaggcggtgcaggccgggcttcgcgacggtgaaggtgtagcaggcggtcccgtcggcggggagggtgagcgtgttcccctcgggcgcgggctcgccgtacgcggagagcgggaaggacgggcagtcctcgccggcggccggggcggcggtcgtggcggtggtggcggtgctcgcccgcgccgctcccaccgggaccagcagcgtgaccagaacggtgaacgtgagcagaagtgcggtgtacgccgcggatctcgcggccgtacacagacgtggtggcatgggtccgttccccccggagcggtgaaggatgtgctccggttctccgcggacagctcgttcggcgggcctctgagcacagcgatatgtgcccgccctgtgaaggggcgagcacatgatgatcgcacagcagggcgaccggacgacatgtcaattcggagccgccgcgacggtccccgatccggcccggtccgcacgggagtcccaggggggcctcagtcccccagcaccgcctgcatcacgctcttcgcgatcggggcgcccagccggccgcccgagatgtcggagcgggagatgtccatgtccgtcgggtcgatgaacacggcgaccgcgaccgaacggccgtcgtccttcttgccgtagctgacgaaccagccgtacgggacctcgtcgcggacgttcacgccgcgctgggcggtgcccgtcttgccgccgaccgtcacaccgtcgatcagggcgcgctgggcgctgccctccttcgcggtgtgctccatcatctcctggaccttcttcgccgtctcgggcgagacggcctggctcatctccgtcggctcgttcttctccagcgtggagaggtccgggccgcgcagctcgtcgacgatgtagggctgcatcagcttgccgtcgttggcgagggccgccgtgaccatcgccatctgcatcggggtgctggtgaggctgccctggcccatgccggtgagggccgtgccgggcttgtcgagcttcggcgggtagaggctcttggtggcgagcatgtcgccgaactcctccgcgtacacgtcctcgttgaagccgaacttctccgccgtctcccgcatccggtcctcgcccagctcggacgccgcgtcgaggaagacgttgttgcaggagtactgcatggcggtcttcatcgacgccttgttgcacaccgcgtcgcccgcctcactgccgatcttgttggtggagagcggcagggggtacggcgagaccgcgtccgtccgggcgtccacgtcggtgaccacaccgtgctccagcgccgccgcggccgtgaggatcttgaaggtggagccgggcgggtaggtctcgcgcagcgggcggttggccagcggcttgcccttcttcttctccagcgccgtgaagcggtcgctctccttgaacgagatgccggcgaaggtctcggggtcgtacgagggcgtggagaccagggacagcaccttgccggtgcgcgggtccagggcgaccaccgcgccccgggcgcccaggtccgtcaggcccttgtaggccgccttctgcgccttggcgtcgatcgtggtgatcacgtcgccgccgcgccggggctgccccgtcaggacgtccttggcgtgccggaaggcgaagcggtcgtcctggccgctgaggacgctgtcgtaggtccgctccagcagcgaggtgccccgggactgggaggcgtacccggtgacgggcgcgtacatcggaccgtccttgtaggtccggaggaacgcgtagtcacggctctcggtctccttcgacccggtgatcgccttgccgccgacgatgatgtcgccgcgcggggtggagaaccgttcgaaccgcacccgggcgttgttctcgtgctgggccagctcctggcggtcgacgtgctggagccagttcgcccgcagcagcagggccagcaccagcagcccgcagaagatcgctatgtgccgcaacggcctgttcattccactccccacccgggcgggctccggtccacgcgacggggcgcccgccgaccgggcccgcgtatgcgttccccgatgaacaagaatgccctgtgggcgtgcccggttgcaccggcggccccgggtgcgcctcctcagcggtacgcggcgcagccgtcggagacacgcgacgtggacgtcagaggtacgcggcgtagtcgtccagcgtccgcaggacctccggttcgtccgccgggggcagctggagcacgacctcctcgatgcccagatccgcgtagtgggcgagcttccccggactgggaagcaccgcgtacggcaccacctggagatccttcgggtcgcgcccggccgcctcccaggccgtccgcagcttcggcagggactcggtgaggcctccgccgccgatgggcagccagccgtccgcgtactccgcgatgtgcgcgaacagcttggggcccgccccgccgccgatcagggtgcgcgggccgttgaccgggccgcgcggccgctgggccggcttggggtgcgcctcgctcgcccgcaccgacccgaacgtgccctcgtagccggtcggctcgtccgcccacagggcccgcatcagggccatccggtcccgccccaggtcccggcgcgtcgaccactccaccccgtggtcggccgcctcctcgacgttccagccgtagccgatgccgagggtgaaccggccgccggagaggtggtccagggtggccgcctgtttggcgaggccgatcgggtcgtgctgggcgaccagggtgatgccggtgcccagggcgaggcgctcggtgacggcggcggcctggccgagggcgacgaacgggtccagggtgcggccgtactcccggggcagctcaccgcccatcgggtacggcgtgctgcggatcaccggaatgtgcgtgtgctcgggcaggtacagcccgccgaacccccgctgctccagctcgcgggcgagcctgaccggggtcaccgtctcgtcggtgaggaagatcgttgtggagatccgcatcgagaacacctccgtcgtccgtcagcgcgtcatgcgtgcgaagggccaaggtatgccgtacgacgaagaaatccgagaccgtcgcccgcgtgcgacggaagcggaaggagaggagctgcgatggggccgggactgggaccgggactggggtacttcctgttgccggcgggcggcgcgctgagcctgaccggggtcgccaccggcaacggcacgctgatcagcctgagctggatcatgtgggtgctcgggatcctgctgctgttccggaaccgttcccgccgccacgtcgatccgcggaagctcgcggcggcggccgccgccggggacccccgggccgtgcggcggc

SEQ ID NO: 3141 - DNA, 4190 bp, Unknown
  Kingdom: Bacteria, Phylum: Actinobacteria, Class: Actinobacteria, Order: Streptomycetales, Family: Streptomycetaceae, Genus: Streptomyces
  misc_feature (410)..(515): n is a, c, g, or t
gtatcgggcgcgggaaggtgcgcggtgtcgtgcacggggtcgtgcgccgtcccgcgcacggtgtcctgggccgggtcctgggccgggtccggcggcggcgtggctccgtcggtcgccggttcgggagtggcggccggcccgggaggtgcggacggaacggacggcgcggccggtaccgcgttgccctcgttgccctcgttctcggtgctcacagctctttactcctcggttccactcggcatccagtcggcgttcggcaagaaatccgctgtgcacgtgtctgcggccagcttttcccacaacacgtcgggccactgtaagcaggacctgtgcatccgcacaccaatctttacatccgacaaaacagacctccagggtgacatgtgctcagccatcctcccggcggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggctcaccgccgacggccacctcgtctgcgtccacgaccggcgggtgaaccgtacgtccaacgggcgcggcgccgtgtcggcgctggagctcgccgacctcgccgccctcgacttcggctcctggaaggaccgggaggagtcgcccgactgggatccggtgccgggcgagctcacctccgtactcaccctggaacggctcctggagctcttcaccgaggtccgggccaccgggcggccgctgcaactcgccatcgagacgaagcaccccacccgctgggccgggcaggtcgaggagcggctgctgcatctcctgaagcgcttcgggctgaccgaaccgcccgcggacggcccctcccccatccgcgtcatgagcttctccgcccgctccctccaccgcgtccaggccgccgcgcccgcgctgccgacggtctacctgatgcagttcgtctcgccccggatgcgtgacggacgactgcccgccggggcccggatcgcgggaccgggcatgcggatcgtgcgcagccaccccggatacatcgaacggctgcaccgcgcggggcaccgggtgcacgtgtggaccgtgaacgaaccggccgacgtcgacctgtgcgccgaactcggcgtcgaggcgatcatcaccaaccgcccgaagcaggttctgtcccaactgggccgcatttagtacggatgaggacccaccagggctccgacctcggtcgttacggggtgtgcaccggcgcactcgctgcgcgttcgatcgttacgagtgcgtcaccgacagtgcactggccggtttccggtgcagctcagtggggcatccaacccgtggcgtggggcaaaggaggtctcgggggtggcgttggtggtggcacaagaggtgcccgcgtcgtcgagcatggccattcctcatggccctgccggcgtggggcaggcacgacaccggatgcgtgaacagttgcgcggcaacggggtgtcggacgccgtcgtcgacgacgctgttctgatcctttccgaactcctcagcaacgcctgccggcacggcaggcccctggggcggcacaccgacgtcggcgacggagacatccgcgccgcctggcgggtggacaccggcggcgcgctcaccgtggaggtcacggacggcggtggcccgacccgcccgattccggccaccccttcggtgacggcacgcggcggccggggcctcaacatcatcagcgccctggcccaggaatggggcgtacgggacgactcgtccggcgaggtcaccgtctgggccctggtctcctcgaagaagccgcccggcatcagcggcaacggctccggtgcggacggctccggcgccaacggcacctccgggctcaccgggttcgagggcctggacctctccgaggccttcgacgacgtgggttgagcgcacgagcgacgcggggccggcgcccgaacggcgtgggtcccgcacacggatgacgtggcccgagcgcgcggatgccgtgggcggagcccgtacgggggacgagcgaggcgctccgggcggctaggctcgcgccgagtccgcactgtcgcaatcgggagaatgcccaccatggccaagaagcgccctcagtccaaggccgggaagcagcagctcaaggacggtgagatcccggtcgtcggggcccgtgagccctgcccgtgcggatcgggccgccgttacaaggcgtgtcacggacgcgccgccgcccaggccgtgactgagctcgtgcaccgccccttcgagggactcgcgggcgagtgcgactgggtcgcgctgcgcgagctggtgcccgccgccacggtcgaactgaccctcaaggacgggctgcccgagggagttccgtcggtgacgctcgcgacggtcctgccgatggcctggccggcactgcgccgcgacgacggttccgtcctgctcgccctgcagaacgacacctcttccggcgacctcagccgcgacctcgcggacaccctccagcgcgccctggaggccgatcccggctccccggtcaccgcccgccgcgtgccggccgacggtccgcgcctccaggacctcctcgccccggacgccgctttcgagccgaacgtgcactccgggttcgagttctgggttccggacgcggagaacgccacgccggaggtgtccgcctccctggagcgcgcgaacgccgcagcgatcccgacgacgctgctgtccggcgtcgacgccgcgtactggtgcgagaccccggagaagaaccacctgcgctgggtcatgccgcaccccgaggagcagctcctcgacgcgctcgcccggctgcacgccgccggctcctcctcactcggcgacgacacccgcctggtcgggtcgttccgggcgcacgggctcgtggtccccgtctgggacctgcccagctcgatgggggccgaggcgtgcgagaagcccgccgtcgagttcgccgagcgactggcggcggcgctcgcgtccgacgctccgctcacccccgaggaacgccgcgcccggggcggtctcaccaaccgccaggtgaccctcagctgacagtgacgacagaaggccggagacggtgacccgcgtcacaactcgccgtactcgtaagtaaatcggcgtccctacaggcgagatcgaatttgcgaacggcagatctcttgttacggttctagaagcccggtcgctggtgcatcccccgtcgccagcgaccgggcgtcttcgtttccggctgcggcccgccctgtgacacccccgggtgcggtggccgcaccgcccctgaaaccccgcccgccgcgccggagtccgtacatcggcgtccggcacatcggggtcaggtggcctttccgccgacccggtcagtccctggcgtccggcgcccgttcggatccggcgcgaagcagcagcggcgcctcgtccgccggtccggcgcccacgaactccgcgaccgccgtggcggaccggggtacggccagggtgggaacgcgcggcgtctcgcaggtgccaggctcgtcgtccgtggccgacgcgcaatgcagcgccacggtccgcccgcccggtcccatcagcgtgagcacgggccggagttcctcgccggtcgcgttccggtagtaggcgcgcgcccagaccccgccgtcctgggtcaggacgcaggtctgcgcctcgacgccttccggtgcgaccagctcggggccgcaccgggccaccgcctccggccgccgtccgccgccctcggtttccctgccgccctcaccgtccccgccttccctgagatcgtcgcccccagaagagggtgaacgatcaaactcggacagagatccggcttctgtgctcattcccgatggcgatttcagcaacgccggagaaagcacagcggagtcatctccggataggctgtcaaaagtctttgtccgcgctctttctggcggtccgccaggcgatttcgcctcgcccggatcacccggaacggcatccggagcaacggcgggatccgcggaagcgaccagcggaaccaggcagccgaacacggcggcagccatgaggccgatcatgcggatattcatggtggccccacctggcgactgcacggaattcctggcgacggggcgtcgataacggcgccatgcgcgccaccggctcacgcggcacccgttgaccggggatccggcccggctcac

SEQ ID NO: 3142 - DNA, 12846 bp, Unknown
  Kingdom: Bacteria, Phylum: Actinobacteria, Class: Actinobacteria, Order: Streptomycetales, Family: Streptomycetaceae, Genus: Streptomyces
ctcgccctggtagacgtaggcggagccgggcagggcgagcatcagcagggaggcggcgcgggcccggcgcaggcccagctcgcggtcgccgggggtacggatctgggtgccgaggcccgccgggttggcgaagcgggtggcgtgccgggtgacgtcgtggttggagagcacccaggtggtgggcgcgccgaccgggcgcatcgcggcgagcgaggcgtcgatgacctcgcgcagctcggcggcgtcccaggcggtggccaggtactggaagttgaacgcctggtgcatctcgtcggggcgcacgtagttcgcggtgcgctcgacggtcggggtccaggcctcggcgacggcgatgcggtcacccgggtactcgtcgaggatggtgcgccagctgcggtagatcgcgtgcacgccgtcctggtcgaagaacggcatgacgtcgttgccgagcagcttgagctggtcgtgggagccgaggtcgggcagtccctcggccttgacgaggccgtgggcgacgtcgacccggaagccgtcgacgcccatgtcgagccagaagcgcaggatggagcggaactcgtcggcgacggccgggtgctcccagttgaagtcgggctgctcgggggcgaagaggtggaggtaccagtcgccgggggtgccgtccgggttcgccgtacgggtccaggcggggccgccgaagatggactcccagtcgttgggcgggagttcgccgtcggcgccctttccggggcggaagtggtagcgctcgcgcagggcggagccggggccctcggccagggcgcgcttgaaccactcgtgctggtcggaggagtggttggggaccaggtcgacgatgacgcgcaggcccaggccgtgcgcctcgcggatcagcgcgtcggcgtccagcaggttgccgaacatcgggtcgatggcccggtagtcggcgacgtcgtagcccgcgtccgcctgcggggaggcgtagaaggggctgagccagaccgcgtcgacgcccaggtccttcaggtggggcaggcgggcggtgacgccggcgaggtcgcccatgccgtcgccgttgccgtcggcgaagctccgcggatagacctggtagatcaccgcgtcctgccaccagccggtgcggtggcccggggcgtcgtcggacgtgccggtggagggggcagcgaggtgctgggtcatgtcgtccctggggtgtctgggtggggagcggcgccggggaccgggtcggggtttccggcgccgccgtgacgggtgcggtggtgcgggtggccaggggtctctcagcccttgacggctccggcggacatgccggtgaccaggtgcttctgggcgaagaggaacaccagggcggccgggatggcgatgagcacggaggccgccgtcatggggccccactgggctccgtactggttgacgaacttctggagtccgccggccagcgtgaggttctcgtcgccgaccaggaaggcggaggcgtacgccacttcgccccaggcggtgatgaacgagtagaacgcggtgaccgcgagacccggcttggccagcggcaggatgagccggaagaaggtgccgaacggggtgaggccgtcgacctcgcccgactcgtcgatctcgcgcgggatggtgtcgaagaagcccttcatcatccaggcgcagaacggcaccgagatggtgaggtaggtgatgacgagtcccatgggctggttgagcagccccaggctcgacatgatgttgtagatcggcacgatgaggacggcgaccgggaacatctgggtgatcagcagcgtccacatcagcccgcgcttgccggggaagcggaagcggctcaccgcgtatccggtggtggcggcgacgaagacgccgatcacggtggagagcgcggagatgatcacggagttggcgaaccagttgaggaactccgtgtcgcggatcaggttcgtgtagttgacgaacgtcgtctcgcggaagaagtccgtggtggtcgcgtacttggcgggcttgagcgaggtcagcaggacccacagcaccgggaagaccgcgatcaccgaggcgatgatcagggtgaggtgcagggcgacggaggcgagcggggagcgttcgccgcgcagccggaccttgggcacggcgtgccgggcggaggtgtcggtcgcggtggtcaccagttgtctccctgggagcgcaggactcgccggtagacgacggcgaagagcatcaggagtacgaggatcagcacgccccaggtggaggactgcgcgtagtcgcgcgggctgatctcgaaggagaacttgtacgcctgggtcacgaggatctgggtggcctcgccgggtccgccgcgggtcagcaggaagatcaccgggaacatgttgaaggtccagatggtggagagcaggaccaccgtggtggagaccgggcgcagtccgggcagcgtgatgtggcggaagcgctgccaggcggtggcgccgtccatctcggccgcctcgtactgctcggaggggatggactggagtccgccgaggagggcgaccatcatgaacgggatgccgagccagacgttgacggcgatgaccgcgaacttggcccaggtcgggtcgttcagccacgggacggcgtcgatgccggcgccgccgaggatcttgttgagcagaccgcgctcctcgttgtagaggaagcgccaggcgaagacggagacgaagccggggatggcccaggggaggatgagggccatgcggtaggcggagcgtccggcgatgcggcggttgaggatgttcgccagggccatgccgaggacgaacgtgacgctcacgcaggagacggtccacaccagcgtccagccgagcgtgtcgaggaactgcgagccggtcagcgcgtcgatgtagttgtccgcgccgacgaactcgtaggtggcggggatctcgttgacaccgatggaacgtgcgacgttgcgctcgtcggcgtcggtcatcgagaggtagatgccgcggaccagcggatagccgatgatcacgccgatcacgacgacgaccggggcgaccatggcccaggcgtaccagtggaccgacagggcccgccggatccggccgggcttcggtggtggggtgccagtaccgcggctccggccgcgggcgacgttctcgcccgcggccttcaccaccgactggctggtgtggacagccatcagtcggccaaccttcctgttacttccagccctcgaggagcttgcggtaggagtcgccggtcgacttggcggccttctccggtgtggtctggccggtgaggaccttggtgtactcgatgccgagcggagcgaagaggctgccgccctcggggatccaggggcgctcgacggcggtctcgacgaccggcttgaagaagccgacgatctcgctgtccacggcctcctgcttggcgtacgcggaggtgcgggtgggcagcaggttcagctcgccggcggcggtggcctggctgtccacggaggtcatgtactcgacgaaggcgtaggaggcgtcgaggttcttggagcccgcgtagacggcgaggttgtggccgccctgcggggcgccctgggcgacggagccggccgggaccggggcgatgcccaggttgtccttgtccgtgaactccttgccggtcagtgtgtcggcgacggcccaggggccgttgatcatcatcgcgacgtcgccgctcttgaacgactgcatcatgttctcccagccgtccgaggcgtccgtcttcgcggtgccgtcgtcgaccagggccttgaccgccttgaacgccttgacgccctcgggcttgtccacggtgatggacttggagccggcgtcgacgaggtcgccgccctctccgtacaggaaggagaggaagtagtacgggtcgtcgccgcgcaggtagaggccggtcttgccggtcttgtccttgatcttcttcgcgacggtcttgaggtcgtccaggttggcgggcgcctcgacgccggcctccttgagcagcttcttgttgtagaagatgcccatggagtcgatgacctgcgggaccgcgtaggtcttgtcctcgtacttggtggacgcgacggcctgcttcaggaagtcgtcctggttcttcagggcgggggtgccgtccagcggggccaggtagccgaggttcgcgaagtccggcgtccaggcgacctcggagcggatcacgtcgggggcgccgtcgccggcctgggcggcgttcttgaacttgttctgcgcgtcgccgaagggcacgttgacgtacttgacgtcgaccttcgggtgcttcttctcgaagccctcggccagcttcttgaagaccttgtcctcgctgccgacgctggaggtgtcccaccaggtcaccgtgccggagagctcgcccgagctcttgccgccgccggactcgtcgtcgctgccgcaggcggtcgccgcgagcgccagggccgcgaccagggcggtggccgttatgccacgtcgcatctgaactccttcaactgccgtaccgctccgtcgcggcgccgggtcgacgtgaacgtaacaaggatgaaagacgaccgaaagaccttgcggaagatttctgcaagccttggtgatcgttacattcgcgtgtcctcaaggttgccgtcaagccccttgacgacagtcccccatccctggcaggggcaggcgggacacggcatatccgcagtgcgacgatccgaccgcagtccgcgatccgggcccgcaagtccttgcaaggcgttgccggaaaggtctccggcaccctcccccgcgccaccccgcacacggtgggcaatccgacaccggcccggtacagtcccatcccatgaccgcacggcttgccgatatcgcaactcaggcgggggtcagcgaagcaacggtcagccgggtcctgaacggcaagcccggagtcgcggcgaccacccgcgaatccgtcctcgcggcgctcgacgtactggggtacgaacgcccggtgcggctgcgcaggcgcagcgcgggactggtcggcctgatcaccccggagctggagaacccgatcttcccggcgttggcgcaggtcatcggccaggcactgacccggcagggctacaccccggtgctggcgacccagacgcccggcggctccaccgaggacgaactcaccgaaatgctggtggaccggggtgtttccggcatcatcttcgtctccgggctgcacgcggacacctcggccgacatgcagcgctacgagcaactgcgcggccagggcgtccccttcgtcctggtgaacggcttctccgccaaggtgcaggcgccgttcatctcgccggacgaccgcgcggcgatgcgcctggcggtgacgcatctggtggcgctgggccacacccgtatcggtctcgcggtcggacccaaacgcttcgtgccggtcctccgcaagatcgagggcttccacgcgacgatgcgtgagcagctgggcctcgcaccggaggaggtggaggagttgatccagcactctctgtacaccctggagggcggtcaggccgccgcctccgccctgatggagcgcggctgcacggcggtcgtgtgcgcgagcgacatgatggcgctcggggcgatccgggcggcccgccggctgtcgaaggacgtgccgcgcgatctctcggtcgtgggctacgacgactcgccgctcatagcgttcacggacccgccgctgacgacgatccggcagccggtgacggcgatgggccaggccgccgtccgcacgctcctggaggagatcggcggaaccccggcaccgcacagtgagttcgtcttcatgcctgagctggtggtccgcggctcgacggcatcgggccccgcaggcggctcagggtcgccccctcgtccttgagacgcaggatgtgcgaccggaacccgaccggaggatgatcgggggcaggggaatcactatggaagactctctgcctatgggtgaaacacaggtgacagcacacgaaggccggtcgacggccggtccttcacccatcgcggccgatgtggcggcccccggggccgccaccgcgcccaccactcccccggcttccgggaagaccggccgaccggcctggctccgcaccctgcgggtcccccgccgtccccggctctggttcgagatcctgctcatcgcggtcagttactggctgtactcacttgtgcgcaatgccgtcccggagcagaaggcgcaggcgctgcgcaacgcggactggatctggtcggcggaaaagtccgtgggcctggccttcgaggagacggtcaatcacgcggtcaattccgtgacatggctgatcgtgtcgatgaactactactacgcgacgctgcacttcgtcgtgaccatcggcgtcctcgtctggctgttccgccgccacccgggccgttacgcggcgacgcggctggtgctcttcgcgacgacggccgtggccctgctcggctactacctctacccgctggcgccaccccgtctgatgaacggcgcgaacttcatcgacaccgtgctcctgcacgagacgtggggctcgatggcctcgggcaacttcaagaacatgtcgaaccagtacgcggcgatgccgtcgatgcacatcggctggtcgctctggtgcggcctgacgatcttcgccctggcctcggcgccctgggcccgcatcctgggcctgctctacccgacgctcaccctggtcgtcatcgtggccaccgccaaccacttctggctggacgcggtgggcggcatggcctgcctcacgttcggctacacggtctcccgcgtctggtacggctcgctcccgcaccggctgccgaagtgggtgccggaccgccggggacgactgaccggcctacgagacgcccggctgccacgcccggcatcggagccggacccggaacgacggcccgaatccggcccgtcccccgaaaccagccgctcccccgaatccagtccctccggcgtctgaggagcggggcccggggcggagcccccgggcgcggggccgggctccgggagcacgcccctacgacgccgccccgtagaaccgctcctccaccaccgcccgcgccctccgtgtgatccgccggtagtcgtccaacatgtccccgacatgccccggctcgtatcccaggtaccgcccgaccgccgccacctcgcgcgggtcggacggaaacgtgtcgcccggccgcccgcgcaccagcatcaccgcgttgcggacccgcgtcgccaggacccacgcctcgtccagcgtctgcgcgtcctccgccggaatcagctccgccgcacaggcggcggccagcgcctcacgcgtacgcgtcgtacgcagccccggctccgcccacccgtgctgcatctgcatcagctgcacggtccactcgacgtcgctcagcccgccccgccccagcttcgtgtggagcgtggggtccgcgccgcgcggcatccgctcggactccatccgcgccttgagccggcggatctcccgtacggcgtcctcgccgagcccttccatcggataccgcagcggatcggccagctcgatgaagtcacgccccagctcctcgtcgcccgccaccggttcggcccgcagcaacgcctggctctcccagaccagcgaccagcgccggtagtaggcctcgtacgacttcagcgtgcgcaccagcggtccgctcttgccctccgggcgcaggtcggcgtcgatcagcagcggcggatcggcggtcggcagctgaagcagccgtcgcatctctccgacgaccgtgttggcggcccgggccgcctcctcgtcgctcacgccctcgcgcggccggtggacgaagaggacgtcggcgtcggagccgtagctcagctcgtgcccgccgaagcggcccatgccgatgacggcgaaccgggtcggcagggtgtcaccccactgcgcgcggacggctgcccgcagcgcgcccgcgacggtggcggcgttgaggtcgctgacggccgagccgacgcggtcgacgagggccccgtgatcctgctcggcggggttgtcctcggtgccgtacgagccgatgaggtcggcggccgtcgtgcggaacagctcgcggcgacgtaccccgcgcaccaccgcgacggccgactccgcgtccccggcacgccccaccgcggccagtacctcctgctccaggtgggcccgggtgcggggtgcgagtccctccgggtcgccgaggatcgtcaccgcctccggagcccgcatcagcaggtccggcgcgaggcggccggcggagaggacccgggcgaggttctccgcggcggcgccctcgtcgcgcaggagccgcaggtaccacggggtcttgccgagcgcgtcggacaccttgcggaaaccgaggagcccggcgtccgggtcggcggagtccgcgaaccagccgagcagcaccggcagcagggtccgctggatggcggccttgcgggagaccccggaggagagagcctccaggtgccgcagggcggccgccgggtcggcgtacccgagtgcctccaggcggatcgcggcggccttggcgctgagccgggactcggcgggggccagctgggcgacggcgtccagcagcggccggtagaagatcttctcgtgcagccgccgcacgacggaggcgtgccgcttccatgccttgttcagctcggtcaccgggtcggtgcgcatcccgagcgaccggccgagccgccgcaggtccgcctcgccctcggggacgaggtgggtgcggcgcagccggtagagctggatgcggtgctccatggagcgcaggaagcggtacgcctcgtcgagctgggcggcgtccgcgcgccccacgtacccgccctcggcgagcgcccgcagcgccttgagggtggagccgctgtgcagggaggcatcgctgcgtccgtgcaccaactggaggagctgcaccgcgaattcgacgtcccgcagtccgccggggccgagcttcagctcccgctcgatccggtccgcggggatgttgtcgacgacgcggcggcgcatcttctgcacgtcggggacgaagttctcccggtcggcggcaccccagacgagcggcgacaccgcctcgacgtactccgcgcccagctcggggtcgccggccaccgcgcgggccttcagcagggcctggaactcccaggtcttggcccagcgctggtagtaggcgaggtgggagctgagggtgcgcaccagcggcccgttgcggccctcggggcggaggttggcgtcgacctcccagatggtgccctcgccggtggtctcggagcagatcctcatcatgtgggcggccagccgggtggcggcctgcatggctttggtctcgtcgaccccgtcgcgcgcctccccgacgaagatcacgtcgacgtcggagacgtagttcagctcccggccgccgcacttgcccatcgcgacgacggcgagtcggcactgcgccgcgtcctcgggtgcggccgtccgggcgatggcgagagcggcgcgcagggtggccgtggcgaggtcggccagttcggcggcggtctgcgcgaggtcggtcgtcccgcacacgtcccgggcggcgagggtgagcaggcatctgcggtaggcgacccgcagcgagtccgggtcgacggcctcggcgagcccgcgctcgaactcggcgaccccggggtgcaggtcgaccgcctcgtacgtgacgagcgccttccagtcgcgcgggtgccgggccaggtggtccccgagcgcctccgaggcgccgaggaccccgagaagccggtcacgcaggggtttggcggtgacgagggtgtcgagcagcacctgccgctcgctctccgcctcggcctcgacgatccggaccaggccgcgcagggccagatccgggtcggcggtggccccgagcgcctccaggaggaccgggtccgaccgtacggatgccagcgcgtccaggtcgaggagctgctccgcggcggacgggtcggtgaatccgtgccgcagcagcctggtgaacgtactgcttctgcgccccggcaccgtcgtcattccgtgctctcccgccagccgaaccgaaaccgtgtccccgtgcgtcgccccggtgcggctccgtcgccgccccggggcccttcgagcctagtcctgtgccggcggatccggggtggtggcggggtccccgcacgcaggaatccccggctggtccgctgctccgacagggaccgtcccgacgaggacggtggcgtacaactcctcggagaccaggacccgggtgctcagcccggcggcgcgcaggaccttgaccgccgtgtcccgctgccgctcgctcgcctccacgagcaggctgccgccgggcgcgagccactgaggcgcttcggcggcgacccggcgcatgacgtcgagcccgtcgccacccccgtccagggcgacgcggggttcatggatgcgggcctcggcgggcagcagcccgacgtcgtcggtgggaacgtaggggacgttggcgagcagcacgtcgacccggccgcgcagggcggcgggcagcggggcgaacaggtcgccctcgtagacgtgccccaggtcgccgacgttgcgccgggcgcagcgcacggcggcgggttcgacgtcgcaggcgtgcagttcggccgcgtccgacgcggcggcgagagcgacgccgagcgcgccggagccgcagcagaggtcgacgacgacggcccggcggggtgcgagggccgcggcctgcgcgaccaggaactccgtacggcggcggggcacgaagacgcccgcgtccacggcgaagcggcgaccgtggaaatgcgcccagcccaggacgtgttcgagcggcagtccggcggcgcggcgctcgacgagcagggacagttcgccggcggaggcggcggcctcgtggaggagacgggcctcgtcctcggcgaagacacagccggcgcggcggagggctacgacggtggaggagaacgacccggaggaggtggagaaggagctgaaggggtgaaccggcatacgagcgaagcctttcgggaaaaccgatgggcgctccgcgatcggcttatgccgtccggtcggctactgccggtcgtacgacgcgatcgcgcggggtgagcacccagcctgatccagcggtaatgggtctcacctcctcggtcgatctcgtcggtcccgtggcgtacgggggtcgtaaccctacaacagcccgttcccacgcccgtgcggggcgtgggaacgggccgctttctgccgaatcgggcgtcgctcgcccagccggaacgggcgtcgcccgcctacccggccggaaacgggcgtcgctcgcccactcggccggaacgggcgtcggccgcctacagatcgacgctgtcccgcagcttggtgggcgtcaggaagagggaggcgatcacaccgatcacggcgatgccggccgagatgaggaagatgtggccggtcgcctccccgtacgcggcccggacgatgtcctggacctggggcggcatggcggcgacgttgagggtggagccgctggagccggacgcggccgggtcgacgccgagcctcgtcagcccgtcggtgatccgggtggcgacctggtgggcgaggaccgcgccgagcaccgagacgcccatggtgccgccgagggagcggaagaaggtgatcgccccgctggccgcgccgatctcgctgagcgggacggtgttctggaggacgagcaccaggttctgcatcgacatgccgaccccgacgcccacgcccagcatgcccagtgacaccaggacgagcgaggtccggtggtcgatgaaggacagccccaggaagccgacggcgagaacgatcacacccgcgacgatgaacggtttgaccttgccggtcttcgacacgaggcgtccggcgacggtcgaggagacgaggacgcccgccatcagcgggatggtgaggagtccggcctcggtgggcgagtaaccccgcccgatctggaagtactggccgaggaagaccgcaccgccgaacatggccatgccgaccgcgaggctggcgacgatggcgagggcggggtcccggcggcggacgacgtgcatcggcacgacgggctccttgacccgggtctcgacgagaacggccgcaccgaggacgagtgcgctcccgccgaccatgaggccgctctgccaggagatccagtcgaagtcggtgccgacgaaggtgacccagaggagcaggaggctgaccccggcggcgatcagcgacgcgccgaggtagtcgaccttggtgtcgggcctgcggacctcggcgaggtgcagggtgcgggcgaggatcacggaggcgatcagcgtgaagggcacggcgatgaagaagcaccagcgccagccgagccaggaggcgtcggtgatgaacccgccgagcagcggcccgccgacggtggcgacggccatgacgccgccgaggtaaccgttgtagcggccgcgctccttcgggctgatcatcgcggcgatgatcacctggacgagcacctggagcgcgcccatgccgagcccctgtacggcacggaaggcgatcaactgctcggtggaccgggcgaatccgcaggcgatcgacgagacgacgaagagcccgatggctatctggagcagcagcttcttgctgaacaggtcggcgagcttgccccagatcggggtggaggccgtggaggccagcagggtcgaggtgacgacccaggtgtactgcgactgcgtgccgtcgagggacccgatgatctgcgggagcgcgaccgagaccacggtgctgctgatcatcgccacgaacagcacgatgagcagtccgctcagggcccgcaggacatgccggtggtccatgggtgcggcggcgggagccccggccggggc

SEQ ID NO: 3143 - DNA, 10139 bp, Unknown
  Kingdom: Bacteria, Phylum: Actinobacteria, Class: Actinobacteria, Order: Streptomycetales, Family: Streptomycetaceae, Genus: Streptomyces
  misc_feature (9890)..(9891): n is a, c, g, or t
gacgtagaagccgcgcgcggccagatcccgctgtgcctcgcggatgcggtcctccggcaccgtcaggaacgtgccgcccgaggcccgaaccgccgccaggatctgccgggcgcgcggcgggcgggggatggcgatgccctccgcgagggtggcggggaccacggcggccggatcggccggggggaggtcgtccgcgcccgcgtggaaggcggcggccagcggggagacagcctcggcctggacggcgatcagccggggacgggtttcgatcaggccgagcgcgtgcagttcggcggtggcgagggccgcgcccagcagcagggtgccgttgccgaccgggacggccagcgcgtccggcagccggccgccgaggtcctcccacagctcgtacacgtacgtcttcgtgccgtgcaggaagtacgggttgaagacgtgcgaggcgtagaagacgcccggcccgtccgccgccgcgcgggcggcgcgcgcggtcgcctcccggccgcccgggaccgtgaccaggtgcgcgccgtgggcccggatctgctcggtcttcttcggggacgtgccctcggggacgtacacggtgcaggggagtcccgcccgcgcgcagtacgcggcgatcgacgtgcccgcgttgcccgtgctgtccgccacgacccggtccgggcccagccgccgggccagctccgcgagcatcaccgcgccccggtccttgaaggagagcgtcggcatgaggtagtcgagcttcgccgagacggtgtccgtgagcgggacgagcggggtgcggccctcgcccagggagatcggcggggcggcgagcggcaggaattcctcgtaacgccacaatgaatcgacccgcccggaaagcgcgttcggcgccacgccccgcgcgggggtgaagtcgaggtcccaggggccccggcagaccgggcagcaccaggtcagggcagtgatctcggaccgggtcccgtccgccgggcagtgataggccgtcatgcccaccagcatgtcaggcgtatggcaggtgaatgacatgcgtatggaactcctcaaggcacccttgtgagttcgccatggatcggtcaatctttcgctggcagcagggcatgccgctcaccgggcgacgcagaaaacggggcgatcggacggctgatttgtcatgctcctgtcgggagtcgtcgtgcggctccggcaccaccccccaccagagcaccgcctatgaggaggacccctcacatgtcagtgacgcgtcacaccccccaggcccgtcgaagactcgccgcggcgaccgtcatagccaccgcagccgccgtcgcactcgccaccgccgccctcccggcgaccgcggccgagcgcgcacccgaaggcgtgattctgaacgcgggcgctccgggcaccatcagcgacagctacatcgtcacgctgaaggactcggccgcgaggtccgactccgcccagggcaaggccctcgcgaagaagtacggtgcgggcatcgaacgcacctaccgctcggccctcaacggctacgcggtcgaggcctcggccgccgaggcgaggaagttcgccgccgacccggccgtcgcgtccgtctcgcagaaccgcaccttcacggcttccgccacccagaacaacccgccctcctggggcctcgaccggatcgaccagcggagcctgccgctggaccagcgctacacctaccccgacaaggccggcgagggcgtcaccgcctacatcatcgacaccggggtgcgcatcagccacagcgacttcggtggccgggccttcaacggcttcgacgccgtggacaacgacaacgtgtcgcaggacggcaacggccacggcacgcacgtggcgggcaccgtggcgggtaccgcgcacggcgtggccaagaaggccaagatcgtcggcgtgcgcgtgctgaacaacagcggctccggcaccaccgcgggggtcgtcgcgggcatcgactgggtgacggccaacgccgtcaagccggccgtcgccaacatgagcctcggcggcggtgccgactcggtgctcgacgccgccgtgcgccggtccgtcgcctccggcgtcacctacgccgtcgcggcgggcaacgagtccaccgacgcctccaccaagtcgccggcgcgtgtcgccgaggcgatcacggtgggctcgacgaccaacaccgacgcccgctccagcttctccaactacggctcgatcgtggacatcttcgcccccggttcctcgatcacctcgtcgtggcacaccagcgacagcgccacgaacaccatctccggcacgtcgatggccagcccgcacgtcgccggcgccgccgccatctacctcgccgacaacccggcctcgacccccgcccaggtatccgccggactcgtcgcggcctccacccccggggtcgtcaccaacccgggcaccggctcgccgaaccggctgctgtacgtcggtccgggcggcaccaccccgccccccggcaagaagttcgagaacaccaccgggtacgcgatcaacgacaacgccaccgtcgaggcgccggtcaccgtcaccggtgtcaccggtaacgccccggccgcgctgagcgtcccggtcaacatctcgcacacctacatcggcgacctgaagatcgacctggtcgcgcccgacggttcggtctacaacctgaaggcgtacggctccggcggcagcagcgacaacgtggtcaccacgtacaccgtcaacgcctcctccgaggtcgccaacggcacctggaagctccgggtcagcgacaacgccaacgccgacaccgggcggatcaacagctgggcgctccagttctgaacacgctccgccgtgctgaaccgaaccgctgaatcgccgggtccctgaagtcgggccggggtggccgcgtcacgcggccaccccggcccttcggcgctgggccgtgtccgcaaagtctcgtctggcccgcgggcggacgacgatacttcgcggagactccctagcggcggttgagcccgcggtcgaccgcggtgatcagctcgccgttctccgtgtccccgtccagcgaccagaacatcgccccgccgagacccttgtcccggatgtacgaggccttggtgcgcagcacctgcgggtcgtcgtacgtccacagcgtcgtgccgtcgaacagccacgcgtggccgttctccgcgtcacggtggatcttgtacgtccccgaggcggccagctgcttcaggaccttgtagtcctcgtagcccgccgcccaggtggccggagccgggcccgtggccggctgccccatgcccgtgccgccgccgctcaccccggtccagccctggccgtaggtcggcatgcccatcacgagcttgtgccgcggcgcgccgcggcgtacccagtcgcgcacggtccggtcgacgctgaagtcgttcttcgcgtacagggccgactgctgggccgtcttcttctcgccggagacgtggtagtcgtagccctggatgttgacgaagtcgaagtccttcatgaggcgcttcacgtcgaagcccgcgtcgatcgccttcgggttggccgccacgtaggccgacaggtcgtagtgcttgggcttcggcttcccgtgcccgtggcccttgcccgccttcgcctcggccttcgcccggctcttcgcgtaggcgtcgagctgggtgcggaactcgtggatcagtgcggtgaagttcttcttgtcctccgggcggtagacggtgccctcgttgcccggcgagccgggccactcccagtcgacgtcgatgccgtcgaagaggccggccgccgcgccgtcgccgccgcgtgccccgtccaccgggaggttgcccttgatgtacaggtcgaggcaggaggcgacgagcgccttgcgggaggccgcggtacggaccgcgtcggagaagtgggtggagtagctccagccgcccagcgagatcatgaccttgagaccggggtgcttggccttcagttcgcgcagctggttgaagttgcccgcgagcggctgggtgtcggtgtcggcgacgccgtccaccgatcccgccgcgtcgagcggacgggcgtagtccgcccaggcgtcggcctggccggggatgttgccggtgaagcacctgccctcggcgttgacgttgccgaaggcgtagttgatgtgggtcagcttggccgcggccccgctggtgtccaggtccttgacctggaagtcgcgtccgtagacgccccattgggtgaagtagccgatgctcttgtacgcggggcggtggtggcccttgtcgcggtcgccgtcgttgctccggtcggggccggaggtggcggtggccgcgggcgcgatgcccgccaccagggccagggcgacgccggcggtggtcattcgggacaggtttcttcgacgcatgagtctcgttcctgtgcgtgatccggtgcggagggaaagcggagggaaagcggagggaaagcggaggggaagcgggaggaaggacgggagtcgtgctgtgcacaggaaggtattggtctggaccaaaaatggtcaagggtccgggagttgccggacttcggcggtgatgccggcgcggccgtgtcgacctgcggaacgctgggcagggtggagacgtcggagcgtccgggaccgatccggtgaccgcgtccggggtatgcgtggaccgtcatgagatcatcacattgggtgaaactctggcctatgcttgcggtgcacaacccacggttgtcaggctgtcgcagactgtcaacctgttgggagtggcctgtgactttcggtgagcagcccgcctatctgcgcgtggcgagcgatctcagggagaagatcgtcaacggcgcgctgccgccccatacccgcctgccgtcgcaggctcgcatccgggaggagtacggggtctcggacaccgtcgccctggaggcgcgcaaggtcctcatggcggaggggctggtcgaggggcgctccggctccggcacctatgtgcgcgagcgtcccgtgccccgcatgatcgcccgctccggctaccggccggacaagggggcgagtccgttccggcaggaacagacggcggagggggcgcgcgggacctgggagtcccgcagtgagcaggagggggcgaaccccgagatcgccgaacggctgggcatcgagccgggcgaccgcgtgatgcgcacgcactacgtcttccgggaggcgggtgaaccgatcatgctctccacctcctgggagccgctcgccgtcaccggccgcacgcccgtgatgctgccggaggagggcccgttgggcggctgcggggtggtcgaccggatggccgcgatcgacgtcgtcgtggacaacgtcgccgaggaggtcggcgcgcgcccggggctggcggaggagctcctggcgctcggcggcgtgccgggtcatgtggtcatcgtcatcgggcgtacgtactacgcgtcgggccgggccgtggagacggccgacgtggtggtaccggcggaccggtaccgggtcgcctaccacctgccggtgagatgaggtgaggtgacgccccgtcggtccggtcgaggcgtacggaccggggctgacgggccgtgcgggccgggactgttgggtcacgagggggcgcactccgcgggtgcgcccctttcgtgatggccggatgtgtatctctttgtgcaaagtcgcctgcactgagtgaaggtcaggcgtacgctcgggcatatgcgtactgcggtttcctggggatccttagagacgtgcacgccggtgggaagaggggcgatatgcgggggagcgacacgatgagcgacagcggcgccgtgctcccttggcaggtgatacggcaggacgacggaggcaaccgctaccgcgtgggcaggtatgccacgcaggccgaggcgcagaaggtcgccgacggcctcgacgaccgccatcgccaccaggtctaccgggtggagcgcgtgggccagggcaccaggccctgacgcggcggacggcccggtggggccccgggaggccgttccgtctcccggggccccacggccttcgcggagcctctccgtcctcgccctgccgcctccgtgcccgtccccgggttccgcgctacggcggtgcggacggtagggtcccgccccgaccgggggcgcggaggccgccggaggtgcggcgagcggggtggagtggtggcggtgctgatcgacacggtggcatgggtgcggatcgagggcggcagaatcctctgtgcgcggccccggggcaaggacgtcttctacatcccgggcggcaagcgcgagggtgcggagaccgatctgcagaccctcctgcgtgagatcgaggaggagctgacggtcggcctgatccgggagaccgtcgtccacgccgggacgtacgaggcccccgtggacgaccggcccgacgccgccgtcgtgcggatgagctgctactacggcgactaccgcggcacgctcgccgcgagcagtgagatcgaggagatggcgtggttctccttcgccgaccgggccctcgtgccgcccgtggaccagttgctcttcgacgacctcagggcggcgggcgcgctgggctgacccccggccggtggtgcgcgtacgcccgtctgcaccaaacgccaggttgcacggtagtgagcaacaaatggtgggtatgggctgtttagtccctatttgtataaggggtgcgcccgcggtcgtccctgggaagtgatcggcgtgatcgataccgaaggcgactgcgccgagtgggccttcccggccgaacccggttccgtacggagcgcccggcacgcagtccggggtgcgctggggtcctggggcctcgacgccgcggtgggcgacctggcggttctgctcgtcagcgagctggtgaccaactccctccggtatgcctccgggcccatcggcgtacgcctggtccagtcgcgcgcggacggggatcttccgctcgccgatcgtcctcccgccgccccggtactgctggtggaagtctccgatccgcttccggatccacccaccgaacgcagtgcgggacccgacgacgaaggcgggcggggactccagctcgtggcctgttccgcacgtcgttggggaacccgtcgcggaaagagcggcaagacggtgtggttcgagctggctctccctggttaggagagtggagggacgcacagcgatcaccagaggtcgggcagaacctggctgaaagggactgagaccttgctgtgatcgtgaacgccgtgtcggtcggggccgtagtgctgaatactgcgggcaggaccggtccggtgtgtgagctggaggggacggtcgcgtgagcgaaatacctgggacaacgagcgatgtcgtcgggaccacgggcgatgtcgtgtggcagagcagcccgcccggctcgatctatgactacatcagggtcgcctccttctcgatcggccccgacggtctgatcgagcagtggagcagccgggccgccggtctgttcggcatgtcctcgaccgaggcgatcggccgcgacccggtggaggccttcatgcccgccgagctgcgctcggacggccaccggcgggtcggcgagatcctcgacggcaaggagtggacgggtctcgtcccgttccggatgccgggcgagggcggggcgcacggcgtcgccgaggtctatgtgatgccgagtctgacgggccggggggagcgggccgcgctctgtatcgtcgtggacgtccgggccctccgcagcatcgagacggacctcgcggcgtcacaggccatattcggtcaatctcctttcggcttcgtgctgttcggcatggacttcaccgtcgtccgggccaaccagcgcttcgccacggtcttcggcggcgcggccgacgaccaccggggccgcacggtggaggactatctgccgcgagccgaggccgaccggctgtccgccaccctgaaacgggtcctggagaccggggagtcggtcaccgatctccagctcgtcggcaccacccccggcggcaccgagcgccgccactggtccatgaacctctaccgggtgcacagcggggccggccgccccgtcggtatcgccggcctcgccaccgacgtcacccgccggcacatcgccgcccgagaggcggccagcgcccgccgcaacctcgccctcctcaacgaggccagcgcccgcatcggcaattccctggacctggagaccaccgcccgcgagcttctcgacgtggccgtccccggcttctgcgacctcgccaccgtcgacctctaccaggggctgctcaccggcgaggaggccgctcccggcagttgggcgcccgcccaccgcgaatccgccggaggctcggccgagctgcgccgggtggcccacgccagcgcggtctccgacgccctgcccaccgccgcggcgggcagcgggaccccgggaccggacgacctgccgcccgcgctcggctccgtccaccgcttcccgttcggctcaccctgcgccatggcgctgcgctccggccgggtcgaggacgtccccggcgacgagatgggcttcgtgcagtcgacgctcgccgtgccgatggtcgcgcacgacaccgtcgtcggcctcgtccagttctcccggacgaagggcagcgagccgttcggggagcgcgaccgggcgctggccaccgaactggccgcccgcgccgccgtctgcatcgacaacgcccgcctctaccgccgcgagcacgaacgcgccctgatcctccagcgcagcctcctgcctcccggcgacccggaggccgccggactcgacatcgcctgccgctatctgccgggcaacaccgccaccgaggtcggcggcgactggttcgacgtgatcccgctgtccggcgcccgggtcggtctggtcatcggcgatgtcgtcgggcacggcatcggagccgccgcgaccatgggccggctgcgcaccgccgtacagacgctggccgacatggatcttcccccggacgagctgctggcacgtctggacgatctcgtcctgcggctcagcgaggaggagcgcgcggggggaccggcggagcggggcgggacgacggtggtcggcgccacctgcctgtacgccgtctacgatccggcgaacggctcctgcacgatggcgcgggccggtcatccgccgccggtggtcgtcacgccggacaacacggtcagcttcccggacctgccagccgggcctcccctgggactcggcgggctgcccttcgagtccctggagatcgagctgcccgaagggagcctcctcggcctctacaccgacgggctcatcgaaggtgccgacaaggacctcggacgcggaatggagcggctgggccgggcggtgtcccgggacgggatgccgctggaggacctctgtccggcggtggtcaaggaactgctgcccgtcccccagcccgacgacatcgcgctgctcctcgcccggacgcatcggctgagccccgagcacctggcttcgtgggacgtccccgtggaccccgcggcggtcggggagacccgggccaaggtctcccgccagctggaggcgtgggggctcgcggatctgtcgatgacgacggagctgatcgtcagcgaactggtgaccaacgcgatccggtacgccgcggggccggtacggctgcggttgctgttccagtcggcgctgacctgcgaggtgtccgacgcgagcaacacctcaccgcggctgcggcacgccaggacgacggacgagggcgggcgcgggctgttcctggtcgcgcagctcgcccatcgttggggcacgcgctacaccccccgggggaagatcatctgggcggagcagccccttccctgatccggcctgatcgacacgaccccctgggtgtgtccgcaaagtctcgtccggcccagagggcggacgagactttgcggacacnngtccgccgtccaggaccacgatccggtcggccctgcggaccgtggccgggcggtgggcgatcaccagggtcgtccgggtggtggagtcggccgcgagcgcccgggacagttccgcgtcgccccgatggtccagatgcgccgtcgtctcgtccaggacgagtacgcgcggcccgctcagcagtccccgggccagggccacccgggcgcgctggccgccggacagggtcgcgccgcgctcgccgacggcg

SEQ ID NO: 3144 - DNA, 8504 bp, Unknown
  Kingdom: Bacteria, Phylum: Actinobacteria, Class: Actinobacteria, Order: Streptomycetales, Family: Streptomycetaceae, Genus: Streptomyces
gtccaccaggcgctgcgcggcgctcgggtcggcgttgtcggcggcgatcccgaccgcgtccgggcccagctcggcggcggcctccacgacggacttctcgtcccggccggtgatgatcagtttcgcgccgtcggcggcgagggagcgggccgtggcgttgccgaggccccgggtcgctccggtgacgatgtagacgcggtccttcagtccaagatccatggtcctatcctgccgggtcctccccggccaggtcgacagcggagttcaccagtccgatatggctgaaggcctgcgggaagttgcccagctgccgccccgccgccacgtcgtactcctcggccagcaggcccacgtcgttgcgcagctccagcagatgatcgaacagctcccgcgcctcgtccggcctgccgatccgctgcaacgcgtcgaccagccagaacgaacaggcgaggaacgcgccctcgtcgccgggcagtccgtccacggaggagccctgggtgctgtagcgacggaccagaccgtcgctgcccagctcgtcgcggaccgcgtccaccgtgccgatcacccgggggtcgtccggcggcaggaacccggtccgcacgatgagcagcgtcgcggcgtccagttcccgtgacccgtacgactgggtgaaggtgttccgctcggggtcgtaccccttctcgcagacctcggcgtgcacggcgtcccgcatcgcccgccagcggtcggcgtcgccgggcagctcggaattctcctccaaggagcgcaccgcccggtcggcggcgacccaggccatcaccttggagtgcacgaagtgccgccgggcaccgcggacctcccacagtccctcgtcgggctcgcgccaggtcgactccaggaagccgagcaggctgagctggagattccaggcgtgcggcttgtcgccgagaccggcgacgcgggcgaggcggagcgcgtcgatgacctcgccgtacacgtcgagctgacgctgacggacggccgcgttgccggtgcgcaccggccgggagtgctcgtacccggcgagccagggaagctccgactcgggcagccgccgctcgcccgccagcccgtacatgatctggaggtcggccgggtccccggcgacggcccgcagcagccagtcccgccaggcctccgcctcctccagatagccggccgagaccatcgccccgagtgtcagcgtggcgtcccgcagccagcagtagcggtagtcccagttccgtacgccgccgatctcctccggcagggaggtggtcggggccgccacgatgccgcccgtcgggccgtaggtcagcgccttcagggtgatcagggagcgcagcacggcgtcgcggtaggggccttcgtaggtgcagcccgcggtccacttcgcccagtcgtgcagggtgtgcttcaacgccttgcgcgggtcgatgagcttcgggcgcggcgagtgcgaggggtgccaggtcaggacgaacgccacgctctcgccctcggtgacggtgaacgtggagcaggtgctgaactgctggccccacgtcttgaccggcggctcgctgcgcagccatacggagtcgggcccggcgaccgccacccggtggccgtgcgaccggcggacccagggcaccaccgaaccgaagtcgaagcgcagccgcagcaccgaactcatgtcgacggtgccgctgacgccctcgacgatccgcatcaggtccggcgacttgtcgcgctgcggcatgaagtcgatgaccttgacggtgccggtccgcgtctcccagtacgtctccaggaccagggagtcgtccacgtacccgcgccgggtgcaggtgtccgaggcgcccgctcccttgggcgcgatacgccagtggccgttctcctcggtgccgaggagggcggcgaagcaggcgccggaatcgaagcgcggcaggcagagccagtcgacggaaccgttcctgccgacgagcgcggcggtctggagatcgccgatcagggcgtagtcctcgatgcgtggggtcacgccaggcgttttcccggaccgggccgatgtcaaccagccgaccggtcaaccggtccggggtgtgccgggaatctcaggcgctcgccggttcgggctgctcgggggcgtcggccggcgcgttctcggccgccgcctgctcacggtcgcgcttctcacggcgtacgagaatgatccagccgaccgggacggcggcgacgaacagccaccactggacggcgtaggccatgtgcgggccgatcgagctgtcgtcgggggaggcgatctgctcgggcagatcacccgtcggacggggggcggtctgctcgatgtacccgccgaggaccgtccgggacagcaactgggactgctggtcgctgttgatcagcatcacctgccggtccggcagtcccgccaggtccttgatgccgctgctgccggtcgtctcgtccgccttgaggcggccggtgacggtcacttcgccccggggtgcgggaggcacgtcggggaaggcggtctggttcggcgcggccgggacccagccgcggttgatcaggacggtgccgccgcccttgaggtccagcggggtcaggacatggacgccgatgcggtcgtcgtccgaggtacggcggcggacgaccacctcgtgctccgtgtcgaacgtccccgtcgcggtgaccgcccgccagtagtccgagcgcgggacggtgtgtccgggagaggtgagttcggagaccgggaccggctgcgcgtcgaggttccgcgagatcagcccgttctgctcgacccggtgttcgtgccggtggaactgccagaaacccagctcgatcatcgtcgggatcagcacgaggccgagcagggtgaggatcacccactgccgggtcaacaggaagcggtacaccccatgaccgtacaaccggggtcatggggtgcggcactcaggggtactgccggagtgatccggcgatggaatgttccgtcacactttgtccacgatgcctgccttcccctcggcgcgggcgcagtgggcgccgcagtaccagtgcccgtcgacctcgacgccctgcccgatcacctggacccggcagtgctcgcagatcggcgccatgcggtgaatggcgcaggagaagcagtcgaagacgtgcaccgcgccctgcgcgtgcacctcgaaggacatgccgtagtcgtttccgcaaacctcgcaacgtgccatgcgccacagggtgggacgcccggcggtcacggggcgagcggctgccgggcgagtcgtgcgcggttcactccgatgacggtgcgggggcctggtgcggcagagtcgtccccggagccggttcggcgggggccacgtcgcgcagcagatgggtgaaggcgctctcctccaggatcggcgtgccgaacgtcttggccttctgcgtcttggaggtggccgcgtccgggtcgttggtcaccagcagactggtcagccgcgacacactggtcgccacgtgcaggcctgcctccaccgctcggtcctccagcagctcccggtcgatcgaggtgtccccggagaaggccacccgcatcccctgctggagcggcttctccttctcgtaccgccccgggttgggatacgggcaggccggccgcttgcgcgagggccgccagctgttctgctgccgggagggctgatagccgacgcgcggggtgacgggggagtcggaccactcggtcagcggacggcactccagcaggggcaatcgcaccccgccccgggccgccgcgtgcaggctcggccggaacgcctcggcgagcaccctggcgtcgtccagggcgtggtgggcctgctgctgtacgactccgaaatgcgcggccagcgaggccagcttgtggttgggcagcggcagccgcagctccttggccagcgcgatcgtgcacagccggtgctcgaccggggcgatcaccgaggcccgtgcgtactcccgggcgatcatcgaccagtcgaacgccgcgttgtgcgcgacgagcacccggtccttcagccgctccgacagctcggcggccacttcggggaagagcggcgcgccttcgagcacgtcgctcgtcagcccgtggatccagacgggaccggggtcccgctccgggttgaccagcgtgtaccagtggtcctcgacattgcccagggcgtccagccggtagacggcggcggagattatccggtcgtcgcgggcgagtccggtggtctccacgtcgacgaccgcgtacccctgggggtaggcggtcggccatggtgcggctgtcaggcggtcgtcgagcatggtcacagagaatacgggccatgactgacagtcccctattcggccgtctccggtgacgtgatcgcgcggtcaggggaggcggacgatccgttcgggcgggaagagttcggcgccggtgacgggggtgttgtgggtcgcgtagatcgtcatgcgttcggagggggcgaggggagcgaggtcgaatggctccttgtccccgtggagggtgagggcggtgagggacgtgagtccgccgagaggcgtgaggtccaactgttggtcgcctgctaccaggaagagtttgcgcagcctggtgagtggggccatcaactccaggtcgatgttcggcatgtacatcagatgcatgcgctccaggtggtgcagcgacggcatccggctcagctgccggaggtgggtcacgccgtaaaggctcaacgctcgcagattcgtccagcgctccaacccctccaggctcaggtagcgggtctgccgcagcagctcgagttcggtcacctgttcgcagaccgggagttcgccgatgctctccatgacgaaggggtggcagagcgccaagaaccggagatccggcatgttcgcgagcggggacggatcgagtgacgggtggagttcggcaagggacagccactccagcccaggtcgtgccaggggttcgatgcaacggatccgcaggcagccgctcaacccgatctcgcgcaggcgtggcatggccgcgagggcgctcacgtcctcgatcaggttgttgcggtacacgaagacccgttgcacgtccggccgcgaggtcacctgggacaggtcatggtgatcacccgtcacgtgtacgttgctcagatccgggatgtgccgcagggcggagagctgcgccccggtctccgcccgcgcatggctgccttcccaggtacggaaagccatgatctcccgcgcgtacggctccgcgtcgaatcctgcccaggcctgggacactgcctcgccgatcaactcgtgctcgtcgtcccggaactgtttcaccaactcgtacgccgcttcgctgcccaccgccccggccgtacgtacgaccgcagccgattcccgctcgttcagcccgtccagcatcgaggacagcagctccagtgccagatcgcccaccttggccagctcgtcgatgtcctcctggctgtccggcggcagcagcctctcggtccgtgcttccacctcctcgcgcaccgtcggatccagttccggcgcgtgggccagactccccgccgccagcaggaccaacctgtgcccgtgctccggctccgcgtccgcccgctccagcaaggacctcagcagcgacgcccgctcgtccggccgcgcatgccccaccgccatctgcaccacgtcgtcccactggtcctcgtgggcgtggcggaccaggacgccgaagtcacgggcctccacggcggccttcgcgcccagatagtcctggaacgtgcggtgcacgaaccccaccacgcccgctgcgggttcacgcagcagaccgcttcggttgagcaggtgggagaagacctggtcgggggtgccccggacctgcgacatggcccgcatccagtcggagatcagcgccaccgcctcgtcctgccgggcttcgaccaggccgttgcggatcagccagtacgcgaggcgttgcagcagggccgtctgctcctcgcgggtcaggtcgacgccctccaccccgatgatctcgcgctccgtgtcgcgccggacaagcagcatgtccagcgccgcgtcgtacagctccttgcgcgcccggggcagctgcatccggcggtcccggttcagcgcgcagagcagggcgcacatcagcgggttcgtcgcgagcagccccagatcccgccgggtgccgaccgcacgacggagcgcgttctcgtacgtgtccagctcggcgcgttcgtcgtcggaccggcactccgagcgggccgcgcggtgccagtgctcgacgaaggcgcggacgtcctcctggctcatcgccagcaaggtgtgtggttcgaagccggaggcggacagccaggtctccggcactgccgacgggcgggtcgtcaccacgtaccgggcccgggggtaggcggcgatcaggtccttcagccagcgttccgtgcgtttgcgcagccggtccggcacctcgtccacgccgtccaccaggaccagcgcccggccctgctgcatcagccggtccgcccagccggccggggccgagccgtgcagcgggacgccggccgcgcgcaggaagtccgccggggcgggcagggcgtcgagggccgtgaaggcgcgcaggcgcaggacgaaggggacgcatcggttccagtccgccagctcgccgccgaaagtctgccgcgcggcgttcagcgccagccactgcaccagcgtgctcttgccggaaccggccgggccgcgcagcagcagccggtcccactcgccgagggcctgctcgatcccgatcgaggtccggaccggctgccctggtccgtgccggccgtcgacctcgtaaccgctgaccgagaggctgatgtaggccgtctccagcggccattcgcccgccgacctgccgagcgtcagcccgaagaggcccatccggttgttggaggtcgccatgaactccgcgtaccgccgttcgaagtcgaggtccgccgcgtccgggcgtgggccgacccggtcgcgtacgtcctccaccagctcccgcgtccgtcccaccgcgcggacctgctccaccgccgcccgcgccgcgaacgacgggtgcgcggtcagctgctccaccaggtgcgcacagcagcggtcgaggaggtcctcgtacaggtcgacggcccgcgccgagagcccggcggcgggggccgacagctcggcgcgcagccgctcggggtccagctccagggcgaagagccgtccggcgtccggctcgtccgccgccgcgaacgtgtcctgtacggaggtgagcgcggccagccgctcgtgctcgggcaggtcggcgaacgcatcggtcatgcggcccgcgagcaccttcgccagccggtccggcttcgcgggacgggggaggggacggaccggatccgggaccaggcccgcgccctgtctgggggtcagcagcgccttcgctgccgtgccgatcaccgtcgtggccagccgtaacagggcaacttccgtaccggacacgtgtgttcctcccctgggacccgtaccgcagatcctacggcgggggcgactggcagaaagtgccaaagactgctgacgccaggtctcgcatacttgtgggtaacaacgtctagccctcgccgacccgcggccctacggtgctcgcatggagccgaacctgcccgatgtcgtgctgtggtcaataccggccttcgtgctgctcaccgtgatcgagatggtcagctaccgcctccacccggacgaggacgccgccgggtacgagaccaaggacgccgccaccagcctcaccatgggcatcggcagcctgggcttcgacctgctgtggaagatccccatcctggcgatctacatgggggtctacgaactgacgccgctgcgggtgcccgtggtgtggtggaccgtcctcctgatgctcctcgcccaggacttcttctactactggtcccaccgcggccaccatgtgatccggatcctgtgggcctgccatgtggtccaccactccagcgagaagttcaacctcaccaccgcactgcgccagccctggacctccgcgaccgtctggcccttctacctgccgctgatcgcctgcggggtgcacccggcggcgctcgcgttctgccagtcggccaacctcgtctaccagttctgggtgcacaccgagcgcgtcggcaagctcccccgccccttcgagtacgtcctcaacacgccctcccaccaccgcgtccaccacgcctcccaaggcggctacctggaccgcaactacggcgggatcctgatcgtctgggaccggatgttcgggtccttcgcggccgagaccgagcgacccgtctacgggctcaccaagaacatctccacccacaacccgctgcgcgtcgcgacccacgagtacgccgccatcgcccgggacgtccgggccgccgagacctggagcgagcgggcggggcgggtcttccgcgggccgggctggcagccggcgccgaaggcgggggcagtgggggcggaggcctcggcagccgcctccgtacccgcccaggccacggcctccgcccccgccg

SEQ ID NO: 3145 - DNA, 11694 bp, Unknown
  Kingdom: Bacteria, Phylum: Actinobacteria, Class: Actinobacteria, Order: Streptomycetales, Family: Streptomycetaceae, Genus: Streptomyces
ccggtcgacttccccgcgccctgggggccggtgaggaagggggcggggacggggacgccggggccgaggcagccgatgagccaggcgatggcgaggcattcggtttcggcgttggcgaagttgcacagccgcatcagcaggtcgatgcccttgccgtcggtgtccttggccggcagggggagctctccggtgagctgggtgcgccgccagcacacctcccgcgggtcgggcaccgtgatctcccacccgttggggtggatacggacggactgcccgtcggcgcggccgaggtcgagccaggtggctccgtcgaagccgggggcgacgcggatgtgtacggcctgggtggtctcggtcatcgccagcgcctcgatcaagtccaacgcctccttcaaagcggtgccgttgaagacaccgaccccgtcccggaacatgcccaccatcagctcctgccggtggctgcccgtcgtgccctgcgaccggatcggacgggcgacgggatggccgttcttctgcgcgtagacggttccgtcggcagtgcggaagtaccggaagtgggactgcgcgtagtcgctgatgacctcgcgcgccgggttcttctcatcctcggacatgtcacatccccagtgcggtgcgggcgttggaccaggcgtccgcgcagtgccgggggctctcgcccttggcctgcgccgcggcgaacaacctggcggcgtgggcgtcggtcaggcagccgcaccggccgtgggcggacagcacggcgaggaacgtgcggtacacggtcgcgtgcacggcgctggctgcctcgcggatgcgctgctccgccatggcgatgccgcgctccaggtaggcgggggtgcggtgacggcactccccgcccccggccggaacggccacggtgacgggccggaccggcgacggcttcttgacgatcagggcccgcacggcatcgggcagggtggtcatggtgccggtgccggggctgagccaccgggcgtaggacatggccgacttgatgtcgacgccgggccgcacggcgttcgcggactgcatcgcgccccggtagatccagtgctcgccccgcgtcgtggccacggtgcgggtggtgggcagcgtgcggcgggcccacgcgatggcgtcggcgtggtcgaggtcgacaacggtcagcccgattccgccggggtgccaggcgacggccgccgcctgcttccaggacgacgcccacacgggcccggtgagagtgtcgtggtcggtggtggcggcggcccacgcgtggcacgggcgggggcaggcgcaggggcccggggtcttcatgttcggtcgcccgccgcacgaggtgtacaggcaggaggggcagttggcgaacggcaccttgcccttgcgcaacggcagcacgggcacgccccgggcggccagggcgagggcggtgctcaggtgggcattcacgctgccgccccctcggtgggctcggcgtgcgcggcgacaatctccatcagcaaggtctcggcggccatgaggtggccgacgaggacacccgggttggtgaggtcgatgacgccgatgttggcgacgtaggcgtgggcggcctcgatcgcgacgagccgtgcggcctcccgcacgggggtggggtgagtcatgatgggtgtctccagttctgagagaagtgctggcagacgagagcggccccggttcttggtcggacaaggggccgctttcggctttccgggcgtaggtgatgttcacggcgtcggggtgatgccgggcttgctcctccttcctgagattggtcgctgtgtgtgagagggagggaggctggggagtgcgaaaaaccctggttctcaggggttttcgcaggtgagtggaacgcacctccctgcctccctaacggggtgttgcggctggtcaggttggggaggcggggtcagggaggcgggtagggagttctccctgcctccctgcccgcctcccttcacgctgtgtgactttcgggggtggtgtcggtgcggtcctcggatgcttcgaggagccgggcccggctgacgaccatgaccccgccggacttgtaggccggtgccccgaccgcgtccagggcgttggcgaggtcgctggcggtccacccgtggtactcgcccgggttgtgggcggcgaggcgctggcggacctcgtcggtccgcatccgcttggcctcgcccagcaccgtcaggaagtcggtcaggtggtcggcgggctcatcggccggcgcgtcctgggcggtcgccatgccttcgcgcagggcgagggcgcgcttgacgacgggggtgatctggtcggtgctggagtccttgcggacgtagaaggagcggatcagctcgaacgggttcttcgtgaacccgaccgtcagcgcggtgccgacgttctcggcggggttgaggttggtcgcggtgatcccggccttgtgcttgccggtcccgaggagtccgtcgttggcgacgtggtcgcccacggcgaacgcgacccggtgggaggtgttgcgggtgacgtccttcgggatgctgtccgccgtgggggagaccgtgacccagatgagggtgatgccgaccttgcgggccttcttcatcaccttcaccgcgagttcggcggcctcggccccgtacttcttgtgcatgaacagttcgtggcactcgtcgaacacgacgaccttcggccgcatcctggggtcgcgctgtgcgagtgcgcgggtcaggcggacctcgtcgcctccgagctgttcgaggagcttgccgcgctcggtgacctcgttgcgcaggttccgcagggccttgactgcggcttcgatctgctcgtcctcgtcgcccttgaccagggttcggaggcgttcgcgcatcgggtcgtagtcgacgttgtaggccatgacgtacgcctcgatgtcgaccagcggatcgagcatcgcccccagcagcagggccacgaccagggacgacttgcccacgcccatgattccaccggcgatccagttggcggccatgagcttgccgtagatgatgtccccgcgctgggacaccccgatgggcacgcccttgaagtagtcggcctctccgccggtcaacagcggccagtcaggcaccttccccgacagcgacccctggtcggccacccacagatcgaggacgctggcctctgcttcggtgggccagacctcgaccggcttgcgcatcaggttgtgggccaggacggtcttcttgtcggtgaccatctcgaccgtcacacccatggggagttgaagccgggagtgccacccgttgcccagccgggttgtcggggccacccagcggggttgccagccctccttgaacgcggcgttgagcttcgggatgcccaggtgccgcagggcgtccaggatcgcgccctcgtcgggcaccacgtcgcggccctcggtgtcggtggcgggcatcgcccacgcgggggcggcctgctggtgacggcccaccgcccacacggcggcgagggcgagccacgggccgaccgcgaggagcgggccccagaccacggtcacgatgacgaccagcagccggatcaggtccaccagcgccatcaacggggtgacgacgtcggcggggtccttcgtggcgatggcgagcgcgatcccgaccgcgaggagcaggccgagtccgccggccgccccgtatccggcggccttgaccgcctgctgcggtgcggtcaacaggtccatgcgccgcttgtgccgctcggcccggaagcggtgcagccgctcttcccactcctgggccagttcggtgttccccgcggcttccgccgcccgcagcatccgcaggtaccgggacgcggtccgcccctcccacgcacggcgggccacgatccgcccgccgccgaccacgtacatgccgtggcggacggtgaaccgggcggtggaacgggtgcggtcgtgggtggcgaccctgcgcacggcgcggccggtacggacgatccgcgacccctgcgggacgaccttgggcggcggactggtcggtgcggtggccgggtccttgaccagggtgacgggttcggccggcggggtggggcggtggtcgtcgaggtggtgcacggtccccattccggggtccgcgacggcgggttcggtcatgatgaacgtgcctctcctgatcaatggcttgggtggggtgtgatgggggcggccggtttccttggccgggttcggccgcccccgctcagctctgctcggccttgtgaacggcccgctcggcgaggcgtacgcgctgctcggcggccttgcgggcctcgcgggcggcggccctgtcggcgcgcggcgcggtccgctcgaccgccttggcggtggcgaggtcctggcgggcgtcggcctggaccttgtgcagcgcggccagctcctgtgcgccccgggcggcggcggcctggtcgatgcgctcgatcttccggcggatctccgggtccaggcagtccgcgagggactgacggaaccccttgcggaacagcttgccgcgctcgcgggactcggccttggtgtagctgtgcacgatggaacctccctgatggggccgggctgtccggctccccttgccgccctggtggtggccggggcgacgcgggcagccgtcaggcgggccggagtccggggcactgcccggagtgcttgtccgcccacgcggtgagcgagtgctccgcgtaggccgccatcccgcagagcaggcattcggccgtgcaggcgtcgggggcgtggggcttaggaacgggccggacagagacggtggcgagcgtgggtacaggaacgtggtccatcgggttcagtccttccggggtgctggtcaggcgggtcggagttcgttggtgtggcacaggacgggggcgatccagatactgatccggtccaccgtccaccggccctcggtgagggggccgggcggtacgtcgtcgagaatccggccggtcttgccggccgcgcgcgggtcgtcctcacacgagacgatccgcacccggtcacctgccttgaacatgggcttctctccctggtcagcggctcttgcgggtggtcttgccgtccttgccgccgaccgacttcacgacggtgacgacgccccacgcgcagacggaggcgaccaaggcgaggagcgcgaggttcgcggcaatcgcggtgaggacgccgacgaggagcgggccgaagtagaccccggcggccacggccccggcgcccacgccggagccgagcgcgaggcgctgcaccgtccggtccggcggggcctggtggacgtggaccacctgcgggacgacgttggcgggctggtagctggtggggaggtggtcggtgtaggcgggggtgccgtccgggaggtgcacgacggacggccggcggggttcgggcaggttgttcacagctcttcctccgggccggtggcgttgaggcagcgcttgcactggccgacgtcgaagccgtagaggtgttggccgcagtagtagccgccgcagccgtgttcgtcgccgccgggctgttcgccgcagaggcgggcgaggccacggtcgatggcctcggtgcagttgggttcctcacaggtagcgggcacggcgtatccggcaacgatggtctgaccgttgcgggtgatctcgtactgggcgtagcccatggcggggtccttccgagtcagcggggcggggtgtcgtggcagggcacgcacattccgagcgaccggggaatgcaatagcccatgtcggtgcggcagttggggcaggtgcggcgggcccgcatcgccgccgcgagcgcggcggcacggcccggggtcatgggccggacgggcttggcccggtcaacgcggtagaggtaggcgaccaacggagccctgcggcggcgggggcggtggacttcggcaacgacgtcctgaccacccggccgcagccccagcgcgcggagctgacggcgggtggccagaccatcgggggcgagacgccaccggtagacgtcggccatcaggccgccgcctcacccggactggccaactgctcacgctcggcgcgcagggtgtcgcgcaggacgcgggccttggccggggaggtgtggaccgccttacggatgccctcggcggtcagatcccgatccgaccagtcggccgtagccgaccgcgcctcgatcagaagctgatcggcagtgcgggccggtcgactcgaccgggccacctcagggatgcggccggtcgcccgacgcggacgggtcgactcagcggccaccgatccggccgggacccgatcggtcgacttcaccagggacaccgccggggcggcctccagctccgcagccaccgggggcggggtgatcggcgcgggggccgatactcccaggtcagccgtagaccgatttacatatgtctcggtcgattcatcctggttcggtgtggtggccgggtgctcgatcggtcggtggtgcagcaccttggcgacgaggtcggagccgaagtagatcgacccgaccggcagcgacgtggccagcaggaccagcgcccagttggcggggtcccagtcggccagtcgaccccagtcgacgcccttgtcgtgcagctccgggacgagaccgtgtacgtagttgaggacgagtgaggccagcgtgtaggcggccagcacccgcagtgcgaaccggcgcgcgtcaccggtcaggaccagcgtcgcgaccagggcgagcgccatcagaccgtcgacgacgaacgggtagagggtggcggcggtctcgtcggccccggtggcggtggcgacgtcgcgcagcgcgttccaggagacccggaacgccatggcgaccacaccgaccagagcggcgatcagcaggcccttgccccagcggttcatgccgcaccaccccggcgatagtggaccgagaggacccatccgaaggtctgggcgagagcgccgacgacggccacggcgcgccataccgggcggccggtggccgttgcgagcgaggccccgatgacggccagggcgataccggcgaacaccagcaggagcgcccgccggacggcgatggtgttggtgtcgttcatgccgcaccgtccttgcgccggacgttcgcggacgccagcaggtggacgcgttccatggcaccggtggggcactcctgccactgccacccggcggagtccgcgaggacgtaaccgagcttggccagggcgtccgtccgttcctgcaacgtggggaccggcccggtccgcccgaacgagtgctcgggccagtccaggctcagccggtcggtgacgacgtacagctcccactcaccggagaagctgttggacaaccgcgcgccgtagaccttcatgccgcaccccccgacaccttggcgtccgtcgcggcggcggtgaggttggccaggtcgcggcgggcggccagcacccgccggcgggcccggcggatacgccgctcgtccagctccgtcggcgtgcggtcgatggtcatgatctgcgcgtccagcagagcgacgtccgccagaatcagcggcatctcccggtcgatcgcgtccagctcggcgttcgacggctcaccgtcgaacggggcggcggtaacggccgcctgaagtgctgcgatggtcttcatgagtcgttctctccctgtgaaggtcgtgcggctcgacagcggccccggtgttcgagcaccggggccgcgctgcgttgtgaagtggttggggtgtcaggcggtggcggcggcgcggacgaggtcgtcggcggcctcgatcgcggcctcgcggtagaagtcgaggagttcgcggttctcggtgttccgcagggcgtacgtcgcgccggccgcgtcctgggcgaccccggcaagctcgggggcgaggatcgccagcgtggtcagcggcgcggtcagcgcggagcgggtgttgtgactggccgcgcgggcggcctggtagtcggcgtccgaagcgccggacagccgcagatcctcgcggacccacatcgacaggcggtgatcggccagcgccaccgtcagggcggtgacggccgcgatccggtcccgccgctcctcgtacccacgaacctcagcgcggtccttgcgggcggtgcgctgctggagcatgtaggcggtcacggaccccaggagggttcccagtaccgcgatgacgcttccccacatggcaggttcctctcgtcggttgagcccgctgcgagtgcggcgggtgtgcgtgccccgggccggattcgatccggcgtcgtcgcggctcccgcgtggcgggtccggggcttcggttctcgtgttcgctcggcgctgctcggtccggggagatccgaagtcccggacgtctgaggggggcagcttcaaggtgtgccgtagcggttctttcgagtcggtggcgtgtcccccatctggggtgttgggccccggtgtgacgggggccccttctcggccgactgatctccactcgcctcggccggaacggtcacggccgccgtactgcggtggatcacgctgtggagttgttgtgcttgagggcatgcaatgcacggaacccgaggggctcctgcactcctgcactcatgtgcaggagttacgttcatcagagtgcccaactcctatacatgagtcaacccgccgcgagagatttcttcacggcgggctgcaagggcacgtgctggtcagtccccagccgggatgcggtagtcaaggacgaactggtcagcagccatgatcgtgtcgcacacctcaaccacgcggccatctgcggtttccgcgctccgtgtcaggtggatgactggtgatcccgggctgagggtgagcgcggccgcctccgccttggtggccaggcgggcgcgcaccgtttccacgaactgactcagggtgtggccgtggtcttccaggcgcgcgtagatgccaccaccccccggattctcctcgaacagctccgggatgtccttggcgatgtcccaaggcaggtacgacgtggcttcctcggtaggtgtcccatcgctgaagtagagccgccggcgggcgaggaccttggttccgtctgggacccccaggcgctccgctacctcgcccgacgcctcggtggggccgatgtagagcactgtgacgcccggcgtcttccctgcctgctccgtctcagcgaggtacgcagcttttccggcccggcggtgggatcgcctgaagcggtccgaagatttgcggcgaacggggggctggctcttcacgaacgaacccttgccgtgaagcgtatcgatcaggccagtcggtcggagttccgcaacggccttgcgggccgtcccttgcgaaaccgagtagcgggtcatgagttctgactcgctggggactttctcaccaggcttcagtaccccttccctgatctgctgagtgaggtcgttggcgatctgtaggtaccggggctgaccggtgtccctagaggctgctgtgcccatgtccttctactctcctatgctcatatacatgagtaacgctacccaggaaggtgcgccaatgtcgctgcactcggtttcagtggcaggcgtggttgtccgcgaggacggccgtgtcctcgcgatccgacgggctgacaacggtgcttgggaagctccgggtggcgttctggagctggatgaacgcccggaggacggtgcctgcagggaggtgctggaggaaaccggcgtcaaggtgagcccggtccgcctcacgggtgtgtacaagaacatgacgcgaggggtggtggcgctcgtgtttcgctgccggatgactggtgggagcgagcagacctccgaggaatcgaccgccgtacgatggctcacccgtgaggaggtcccgacactcatgacggaggcgtacgcggttcgggtgctagacgccctcgatgatgcgggaacgcaggtgcgcgcgcacgacggtcgccgattgctggatgccgggtaggacgcggtttcgggtgcctgaccggcggccgaggcggtgcggcccggccgtcggggggccaacgacgacccacaaccaccatcaacgaccggcaccgttccgcccgggtcgccgctgagctgggcgacatcccggggcacctcggcgtgcctgagtcactggatgaaccatgcctaagcccccgcccgggagtggagctctgcaggtcacagccgagaatcaggaactcaggggcaagattcggtggggtctagaaaccagcgggtcgtttcgagctagccctatgggccatggctccctggagcactccgcgcgaaagatcttttcctccacagcccgtggcgggcaaagttgcagatcagcgcgctgatcaaggccgtagcaagaccttgtcaacaggcctgtcccctgggatgtccacagaaatgcctaggttatgaacagatcttgaggacttaccaacagggcctgtggataagtagattggccagcacttgcgttggtgcgaatatcgacgcagcgtcaccctctggacggccgcgtggcgaacggccctcagaggtatgcgcgttcgaatcgcatcgtagggacggagatcccaaatgaaccaggtgccggcagcgccgccgcaactccacgccttcattgacgaagctggggttagggcccatacgccgaagtccagtgatcacttcgtcatgtctgctgtgatcgtggaggaccgcaacctcggcgcggccgcacagttcctggcggacctccgacaggcgacaggccgtggccccggcgtccacctgcattggcagaacttcaaccacgtggaccgagtgcacgccgcccagagcctcggcacgcagccatgggccacgatctcgaccgtcgtggtgtgcaagcggcatctggcgcagacgaccatgaacgaagaccacttctacctgtacacgctgcgcttcctgctggagcgactttcctggatcgcccgagactcgaacgcggtgatggcgtacaccgttgctcacatcgtgcgcatgcagttgtccaagctgcgccaatatgaggccgccctgagggggcagcaaacgcagatcacctggtcggccctcgatccgaagggcggccggatcgatcagccgaagaatcttgaactgctctccctggcggacatcgctgcatcggccacgtttagcgcctttaacccggacaggcacagcaacaccgaggagcgctatctgcggtccttggcgccacggctgtaccgccgccccccgggcatgatcacctcgtacgggatgaagatgcatccgtgggtgaacagcacaaaggccgcgtacccgtgggtagcgaccttgtgaagcacgtcagccggcttatgccgcatacgcgggtgctgacgtttccgaccagcagacgaccatccgtgcacctctactgtacgggaatgaggcgcacggtcaaccggcaattcggacattagggctgccgttcgagtaacttatcgaacacgtgtgcgcatgctgcgcaggtgtaactggcgcatcacctaggcgggcaaccggcacgagtagagcctcaggctgccggtgctcgttgtcctgttctttgttcagttcgctcgtgtccgccgtggttcgtcgtcgtacgccgacactggctgagctgccgaacgaacgctcatggacgatcgcgaacagccactcgcacagttggaaagcgtgttgggggcaacccctcacgagttcgaatctcgtatcctccgccattgctctcaccgggcaatacgtcgaaggcccccgcagctcgctgcgggggccttcg

SEQ ID NO: 3146 - DNA, 3388 bp, Unknown
  Kingdom: Bacteria, Phylum: Actinobacteria, Class: Actinobacteria, Order: Streptomycetales, Family: Streptomycetaceae, Genus: Streptomyces
gtacgacatccccggccgcaccggcacccggatcgagccggagaccctgctgcggctggcggagcacccgcgcgtggtggcggtgaaggactgctcctacgacctgctcggctcgacgaaggtgctggcccgtacgtcgctggcgtactactcggggtgcgaggagctgaacctgccgctgtacgcggtgggcggcgcggggtacgtcagcacggtcgcgaacgtggccccgcgccaggtacgggcgccgctggacgcgttcgacgcgggccgcaccgacgaggcggcccggctcaacgggctcacggcgcgcctcaccgaactgatgatggcgagcggcctccccggcaccgtcaccgtgaaggcgctcctggccgcgggaccggtccgggaaccgctgcagcccgccgggcgcggtgcggccgacgggctgcgtgcggcgtacgaggagctcctcgcggcctgatcctccgtacgggggaacctagttgtgggcgtgcaggacctcgttgaggccaccccacaccgcgttgttcgggcgggcctcgacggtgccggtgaccgagttgcggcggaagaggatgttggaggcgccggacagctcgcgggccttgacgacctggccgtccggcagcgtgacccgcgtgccggcggtgacgtacaggccggcctccacgacgcactcgtcgccgagcgcgatcccgacgcccgcctccgcgccgaccaggcagcgctcgccgatgacgatgcgctccgtgccaccgccggagagggtgcccatggtggacgcgccgccgccgatgtccgagccgtcgccgacgacgacgcccgcggagatccggccctcgaccatggacgtgccgagcgtgcccgcgttgaagttgacgaagccctcgtgcatcacggtggtcccggcggcgaggtgcgcgccgagccggacgcggtcggcgtcggcgatgcgtacacccttgggtgcgacgtagtccgtcatccgggggaacttgtcgaccgacgtgacctggaggtgcaggccctcggcgcgggcgttgagccgcacgcgctccaggtcgtcgacggcgaccgggccgagcgaggtccaggcgacgttggcgagcagcccgaagagcccgtcgaggttctggccgtgcggccggacgagccggtgcgagagcaggtgcaggcgcaggtaggcgtcgtgcgcgtcgagcggcttgtcgtcgagcgaggagatgaccgtggacacggcgacgacctcgacgccgcgccgggcgtccacgccgagggccttggcggcgccctcaccgagccggttgacggcctcgtccgggccgaggcgcgtcgtaccggccgggccggggtcggaagtcagctcgggggcggggaaccaggtgtcgaggacggtgccgtcaccggcgacggtggcgaggccggcggcgacggcgccggtggtgcgggcagaaccctgggaagtcgtgtcggtcatgaacagcaacctaaccggccggggcccgctcgggcgaaccggtctcagtacccggttcgggaacggaaggggacggcgcgtcgtcgcggacctcggttctcaccagagcctcgctcgacaccacccggtcctcgctgatgggcacaccgtcgatcttcccgcctgcgcggtacacgctgcgcttcccgcggtatgcgaaggtctccgggtcgatcagcacctcttcccgcaggttcgccagttcggcgaactcgcggtccgtccgggacacgaccagggcggggcgccccagcaggtcctcgaccggccggcccgtgatccgcacaccgggaatcgtcttcagggcccggaccatcgcggctcgtgcccggggcggaacgaaagcgacggtggagagggtcagtacgaccctccggtagtccgcgttgtccttcgacccctgcaactcgtcatcgatggggatgaccgcacgcagggcccggagcagttggcgcgggtcctccggaagcctcgccaggagctgcttctgcgccttcggcgacggccacggggccgtgtccgcatcaccgtggaccctgccgagggtacgggtgcgactctcgccggtgccgtacttcacccagctctcgcctgtgaccgggatggtggagggtttccagccgttcggcgcgttcttctgagtcaccggattgagatcgtccgcgaagttgagacctgcggtcttcgcctcggtcctgcggtagatccactcgtcgtcgcgcggctcggccacggacccgtactcggcccgctgccccccgtccgacctaagggctccgaagatcgtcgcggcgacgacgatcagggccacggccgccggcgcgccgacgagggcgaatccgcggccggcggggcggaaccgcgccggtcgccggccgatggctgcttccagtctgctctctccggcgtccagcctgcgctggtccgggggcggaacattcgaacgcaacgtacgcagggtgtccagatcatccatggctgatggcctccggggcgatgtcggcggtgaaggagggatgggcgtcgctcagagaggcacggaccttgcgacgtgcccggttgagcctggagcgcaccgttccgatcggaatggacagggcgtccgcgacctcctggtacgtcaggtccgcccaggcgaccagcagcaggacgtgccggtcgccggccgaaagcccggccagcgcggcggccagtcctgcgtggacggactgggcgacgaccctgctgtcggcccggtccacccaggactcggcgacggggtcccggccggtgcgtgccagcgctcgcagggcgcgcacctcggaacggcggtgcttgccgatgaggttcgccgcgatgccgtagagccagggcttggcgctcgcccgctccgggtcgtagcgcgtgcgggtacgaaaggccgagaggaacgtgtcggcggtgatgtcgtcggccgccgagtcccccaacctgcgggccgcgtaccggtggatgtcccgggcgtgccggcggtacaactccgagaaccgctcgggactgtcgagggactgggcgatgacggcggcgtcgtcggaccagaggccggtcatgtcgtctccgctgaatgaatgcttgtcacaccaggtattacccgacgcctcacaacgcgttcacgcggtcccgcccggcctgccggcggaggcgggctcaggcgccgccgtccacgatccgggccagcatctcccgggtgcggggcgcgtcgaacgtgccgccggtgagcagcgcctggaggcagatgccgtccatcagcgcgacgagggcccgcgcggtctccgggtcggtgcgccgggacagcagctcgacggcctcctcggtccactcggcggcgacggggcgcagcgcggggcg

SEQ ID NO: 3147 - DNA, 5004 bp, Unknown
  Kingdom: Bacteria, Phylum: Actinobacteria, Class: Actinobacteria, Order: Streptomycetales, Family: Streptomycetaceae, Genus: Streptomyces
ggggcgggcgggtgtcgcccgcccaccccggcgcgggaccggctcgtgccggtccggtgtcaggtcagccgatggccttgtcgatcgtccgcacggccgcgtcccacgcgtcgtcggggctggtgccgcgctgctccatgttgttgatctgggtggagatggagtccttgatgacgccgtccttcgggccgatgaccgcctcggggatggacttcgcgccgtcggcgtagatctggccgatgggggcgttgttgaagtacggcagagtcgcgttcttcacgtccggcaggtcgtaggcgccctggttggaggggaagacgccgatcgccttgaagacggcggcctgctgcgcgggggcggtcagccacttgacgagcttggtggcctcggcgacgttcttcccggacttcgggacggcgaggaaggagccgccccagttggcggaggtgttgccgggagcgctggtgatgtcccacttgcccttgttggcgtcaccggcgtaggtggagatctggccggccatccaggcggggcagacgacggtggcgacggtgctcttgcgcagggccgcctgccactggtcctcgaactgggccagcccctgcgtcagcttcttggacgcggcctcggcggcgagcttccagcccttctcgacgctggcgctcttctcgtagatcggcttgccgctcgcgtcgtagtactgctcgggactggagctgaccacggcgttgaacatggcgctcgcggagtccatgaagtacgtgccctcgggggccttcttcttgtactgctcgcccagcgcgaggaagtcctcccagccgccctcggtcagcttcgcgacctcggcgcggtcggtgggcagtcccgccttctcgaacagctcacggttgtagcagagggacatcgggccgatgtcagtgcccgcgccgatgaccgcgccgttgggggcggtggcctgcttcgccttccacgacacccactcgtccacgccgatcgtcttggagaggtcgacgaaggagtccgccttggtgtcgacgatctccttgatccggccgacctcgatgccctggacgtcggcgaggccgctgccggagttcagctgctggaggagcttggggtagtagttcttctcctcggcggtggtgtcctccttcaccgtgatcttcgggttcaactcgtggtacttctcgaagagcccggcttccttgtacccgaactgcccgaagtcggcgacggtcagggtgatgttcccgtccgcgtcggctcccttgtccgagtcggacgagccgccgcatccggtgaggaggagggcggtgaccgtgaggcccgtggtggccacgtaggcggctcgtcggcgtcgaccggcaacgctgcgggtgatgcgcattccactgctccttgttccggggtggtaccggcgctgatccgcgagacagggcggagggcgtcgggtctgctgcgggaggaagcgcgcgagaccttcccccagagtgggagcgctcccatgcgccattgccggaaggttgctgcctcaagggggtgggtgtcaagagttgaagacgattccgttgccgaaggatgtccgacgcgtcaccgaggggtgttcggccacccctcccgtcggaaggtgaacgagggcaggccgggccgggtgagctgcctgggcaccccacccctgttaatttctcccttatgtaccttttgatcatcccggtcgccgacaccagctccggtgggtgaggcgggatgggcgttctgcgcgaccatcccgaactggccctcttcttctgcctcgcggccggctacctcgtcggcaagctccgcgtcggcccgatcacgctcggcggcatctgcggcaccctgatcgtgtcgctgctgctcggcacccggcacatcagcgtcgacgacgacgtcaagacggtattcttcgcgctgttcatcttctcgctcggctacatggccgggccgcagttcttcgccaacctcaaccgcaagagcctgcggttcttcacgctctgtctgatcgagctggtctgcgtcctgggcatcgccttcgggctcgccaaggccttcgacctggacgtgggcacggcatccggaatcctcgcgggagcggccaccgagtccgccgtggtggggacggcgaccgaggccatcggcaagctcgacgacctgaccgccgggcagatcagccagtaccaggggcacgtcgccaccgcgtacacggtctgctatctcttcggcctgatcaccatcgtgctcttcaccagccagatcatgccgatgctgctccgcatcaacctggcggacgcctcgcgcgagctgtgggagaagatgcgcggcggccagggcggtctggagtccgacgagcgcgaggcgctgcccggcctggtcggccgcacctatctggtgacgctggcggacggacggaccgtcggcgctctggagagcgccctgggcggccggatcaccgtcgagggcgtcaagcgcggcagcaggctgctgacgccctcccccggcctccagctgacactcagcgacctgatccaggtggtcggggtgcggtcggccatcatcgaggcgggccgggagatcggcccggagaccccggccgtgccgggtctcgacaccccactggccaccggtcaggtcgccgtcaccgagaaggagacgatcggcgccacgatcgaccggctggagaagcgccacccggagttccgcaaggacggcgtctacatcaccgacgtgctgcgcaacgaccagcacctgcccgccagcggggagacggtcctcgcccggggcgacgtgctcaccctggtcggcgcccggggcgggctgaaccggctcgtcgccaagctcggcgcggtggtgaagaacgacgccaccgacttcatctacctcggcttcggcatcgtggcgggctccctgctcggccagatcgtcgtcgagttcggggacatcccgatgtcgctcggcaccggcggcggctgtctgatctccggcctggtcttcggctggttccgctcccgcagccagaccttcggcgcgttcccgccgcaggccgcgagcacgctcaaggacatgggcctggccgtcttcatcgcctgtacgggactggcggcgggaccccaggcctggccgctgctgaaggagtacggggcgctgctgccgttcgcgggcatcgccatggtgctggtcccggcgaccgtctccctgatcgtcgggcgcaagctgctgaagatcgagaaaccgctgctgatcggcgcgatcgccgggcagcagtgctcgaccccggcgatcacctcgatcacccaggtggcccagagctccgtaccgcttctcggctacacgatcacgtacacgctctccaacttcctgctgccgctgaccggtcccatcctcgtcggcgtgctgggtgcgtgacgtgatcgacttcccgaggccgaaggacgggctgccgaggctctgccgccgtgaccgagcccgtcccgaggagctttccgtcggcaacgtcccgccggcggtgcggagcgccgtgatcatcctgctgaaccactgacctgctacggagtggacaccaccatgcccaagaccagcatcagccgtgaagagatccggtcgttcgcccagctctcccccttcgagctgaaggacaagttcatccggatcgcgacggccgcgcagagcgatcagccgggtcagaaggggaagtcgacccggacgatgctgaacgcgggccgcggcaacccgaactgggtggccacgggaccccgcgaggcgtaccacgcgctcggctacttcgcgctctcggagtcccggcgggtgtggacggccgacaacctgggcggcatgccggagcagtcggggtgtgcggaccgcttcgagcacttcgtccgtacgcacccggagctgccgggcatcgagctgctgaaggcgagcgtggatctggcggtgaagcggttcggcttcgaccgggacgccttcgtgcacgagctggcggactcctcgatcggcgacaactacccggtgccggaccggatcctgcatcacaccgagcagatcgtgcgcggctacatcacggacgagatgttcgaccaccggccgccggagggacagacactgagcctgttcgcgaccgagggcggaacggcggcgatgtgctacgtcttcgactcgctgatgaagaacgggatcctgcggaagggcgaccggatcgccctgatggtgccggtgttcaccccgtacctggagatcccggagctggacacgtacgacttcgacgtggtgcgggtggaggcgagcctgttcacggagaccggggtgcggcagtggcgctacccggaggaggagatcgccaagctggcggacccctcggtgaagctggtctgctgtgtgaacccgagcaacccgccctcgctggcgctctccacccgggtcgccgagcagatcgtgtccatcgtcggcgagcagaacccgaacctgatcatcgtgaccgacgacgtgtacgggaccttcgtggagggcttccgctcgctcgcggccgacctgccgcgcaacacggtcctcgtctactcctactccaagcactacggagcgaccggctggcggctcggggtgatcgcgctgcacgacgacaacgtgatcgacgggatgctggcggagcaggaccgggcgcagaaggaccggttgaacaggcgctacgggacgctgtcgctggagccggagaagatccggttcatcgaccggctggtggcggactcccggcaggtggcgctgaaccacacggcgggtctgtcgctgccgcagcagacgatgatggcgctgttctcgctgttcgacatgctcgacgagggccaggcctacaagcaccggatccgggcgatcgtccagcaacggctcgaactcctgctggagggagcgcacatgaaggtctcggaggatccgaagcgggcggcgtactacatcgaactggacctgctggccgaggccgagcgggtgcacgga

SEQ ID NO: 3148 - DNA, 15940 bp, Unknown
  Kingdom: Bacteria, Phylum: Actinobacteria, Class: Actinobacteria, Order: Streptomycetales, Family: Streptomycetaceae, Genus: Streptomyces
cgccggcccgggtgaccggttcgtggttgcgcaggtcgccgagggcggtgatcgcgacggtgatcgtgtcgccgccgaccacatcgccgccgaccacggcggcgcccgccacctggcactcgtcgcgcagcccgtccatcagctcggcggcccaggtgacggggaggtcggcggggacgacgaggccgaggagcagcgcggtgggcacggcgcccatcgccgcgatgtcggcgaggttctgggcggcggccttgcggccgacgtcgtacgccgtcgaccagtcacgccggaaatgccgcccttccagcaggatgtccgtactggccacgaccctgcggtcgggggcggccacgaccgcggcgtcgtcgccgggtcccagccgtaccgccggagtggtggtgagccgggacgtgagctctctgatgagcccgaactcccccaactcgcccacggttcccttcaccgagtctcacctctcctttatcgccccggacacccgtccgggcccccggtcgcgagccgtctgtgctgtcggtaccgtcaagagatacgtcaacttctgcgctctgtacgccacgctgtggacgtcatccggcccgtaggtctccccgtggcccgcggcaacgcgataacgtggcgtccctttcccccacatgatcctcgtggccgccctggaggttccgtggtacaggcgtacatcctcatccagaccgaagtgggcaaggcgtcgatcgtcgccgagaccatttccaagatcccgggagtcatccaggcagaggacgtcaccggtccgtacgacgtgatcgtgcgggcccaagcagacacggtcgatgaactcggccgcatggtggtcgccaaagtgcagcaggtggacggcatcacacgaaccctgacctgcccggtcgtccacctctgacccccgtctaggctgggccggtgacgtcatccgcccgccgttccccccgctcgatattcctcggtccgtccgctgccgtgctcgtgctggccgcggcgggctgctctctcagcgacgcgcagccctcgatcacggttcccacgccgtcctcggaggccgccgcgtactgcgaggccctggacgaggcactgccgaagaccgtcctcgaactggaacgcagcgacccctccccggattcggagctgaccgccggctggggggacggggcgatcgtactgcgctgcggggtcccccggcccgccgagatggacgacccccagtcacagggcgtcgaggcggacggtgtgcagtggatgctggaggagcccgaggactccggtccgcggttcaccaccacgtaccgcaaggcgtacgtcgaggtcacgctcgactcgacgtacgcccacgacatcacgccgctggcctcgttcgccggccccgtctcgaagacggtcccgagcaagttctgaaggccggccgccggccagggcgtgtccggccctgacccgccggacacgccctgggtcagcgcagtccggtggagcgggtcaacgcggcctggatcagccggtcgaccagctccgggtagtcgacgccgctctcctgccacatgcgcgggtacatggagatcggggtgaagcccggcagggtgttgatctcgttgatcacgaagccgccgtcctcggtgaggaagaagtcggcgcgcaccaggccctcgcaggagacggcgtcgaaggcggcgacggcgagccgccgcacctcggcggtctgctcctcggtgagcggtgcgggcacgagcccggcggccgagtcgatgtacttggcctcgaagtcgtagaagtcgtgcgcggtgaccggcgggatctcggcgggcacgctggcgcgcgggccgtcctcgaactccagcaccccgcactcgatctcgcggccgcgcagcagcgactcgacgaggaacttcgggtcgtggcggcgggcctcctcgatcgcctcgtcgaggccttcgatgccgtcgaccttggtgatgcccatcgaggagccgccacgtgcgggcttgatgaacagcggccagccgtgctcgccggcgaagtccacgatccgcttgcgcgcggcggcggggtcgttgtcccactcgcgggggcggacgacctcgtacggtccgaccggcagtccgaaggagaggaagacgcgcttcatgtactccttgtcctggccgacggcggaggcgagaacacccgcgccgacatagggaacaccggagagttcgagcagtccctggagggtgccgtcctccccgtacgggccgtgcagcacggggaagacgacgtcgacctcgcccagcgccttgggcaccgagccgggttcgctgtagaggacctcgcggctgccggggtccacggagagcacgacgctgccctcggcggactcggtgagccggtccacgtcggggaccttgcggtcggcgatggccatgcgttcgggatcgtcggcggtgagcgcccagcggccgtccgtcgtgatgccgatcggcaggacgtcgtacttggtccggtcgatggccttcatgacggcgccggccgtgacgaccgagatgccgtgttcggagctgcggccgccgaacacgacagccacgcggggcttgcggcgctgcggctcagggctctcggcgcgctcagggctctgggggaggttctcgctgctcatatcgcgatgagcgtacctgctggtaggggagacgtcagcgtcgctcggccttggcgctccgcgacatcagctccttgacggcgacgaccggggacttgccctcgtggacgatggagacgacggtctcggtgatgggcatgtcgaccccgtgcctgcgtgccaggtcgaggaccgattcgcaggacttgaccccctcggccgtctgcttggtgacggcgatcgtctcctggagcgtcatgccccggccgaggttggtgccgaaggtgtggttgcgcgagagcggcgaggagcaggtggccaccaggtcgcccaggcccgcgagtccggagaacgtcaacgggtcggcgcccatggccagacccagtcgggtggtctcggcgaggccccgggtgatgagggagcccttggtgttgtcgccgaggcccatgccgtccgcgatgccgacggcgaggccgatgacgttcttcacggcgccgccgagctcgcagccgaccacgtcggtgttggtgtacggccggaagtacgaggtgtggcaggcggcctggaggcgctgggcgacggactcgtcggcgcaggcgacgacagccgcggcggggcgtcgctcggcgatctccttggccaggttgggtcccgacacgacggcgatgcggtcggcggacaccttggtgacgtccgcgatcacctcgctcatcagctcggcggtgcccagctcgacgcccttcatcagggagaccaggacggtgtccggctccaggtgcggggcccagtcggcgagattggcgcgcagcgtctgggagggcacgacgaggaaggcgaactccgccccgcgcagggcctcggcggcgtccgtggtggcgcggatggagtcggggagcgcgatgcccgggaggtagtccgggttggtgcgggtggtgttgatggtctcggcgacctcggcgcggcgtccccagagggtgacctcgcagcccgcgtcggcgaggatcacggcgaaggccgtaccccatgagccggttccgaagacggctgcttttacggggtgcgtcacgtgggtccctttccctgggccctgcgccgttggtcagcacgggctttgcggtgatcgtagagctcggcgggcgctttctcgccgcgcagttcctccagctcgcgggtgaccgccgccatgatgacctcggtcgcctcgcggagcacctcgggggtcggctccagaccgtggaagcggctgaggtcgacgggcggtccggcctgcacctggagcgtcttgcgggggaacagccggaacttgttctccttggcgtacggcggcatcgcgaggttggcgccccactgggcgacggggatgacgggagccttggtcatcagggcgacccgggcggccccggtcttgccggccatcggccacatgtcggggtcccgggtgagggtgccctcggggtagaaggcgacgcactcaccgcgctcgatggcgtcgacggcggcccggaaggcgtccagggcgttggtggtctcgcggtagacggggatctggccggtgccgcgcagcatcatccccacgaacggggtgcggaagaggcccgccttcgccaggagccgcggcacccgcccggtgttgtactggaagtggccgtaggagagcgggtccagataggagttgtgattgacggcggtgatgaatccgccgtcggccggaatgtgttccatcccccgccagtcgcgcttgaacagaaccaccaatggcggcttggcgatgaccgccgccaggcggtaccaaaagccgattctgcggcgggacactcggacaccttcctcaaggacttcgacctgcagcctggctactgacggtcaagtctcgccccaggcccctgctctgtcgagaacaccgtacgcctcacgttcggtagcggtcctccaggttgtcgtaccggcaggcgagaataagtcctcacgcgtacggagggggagatcgccacgaacaccgatccggccgggccctggtccctggtcgttccgctgaagccgctcgcacgggccaagagccgcctggggcgggcggcgggcgaggatgcgcggccccggctggccctggcgttcgcccaggacacggtggccgcggcgctggcctgctcccgcgtgcgggatgtggtggtcgtcacggacgacgccgtggccgcggcggctctttccgcactgggggcgcggatcgtgccggacgctccggcggccgggctcaacgcggcgctcacgcacggcgcacgctccgtgcgggccctgcggcccgccgccgcggtcgccgcgctcaacgcggatctgccggctctgcgcaccggtgaattggcgcgggtgctcgattttgcttccgcttttcccaacgcttttctccgggacgcggcgggaatcgggacgacatttctggctgcggcgagcggtgcggaattccgtccggctttcggcggtccgtccggggcccggcacctggcgtcgggtgcggtggaaatagcgttgtccggagtcgactcggtgcgccgggacgtggatacgggtgatgatctgcgggtcgctctggccctgggggtggggtcgcacacggcgcgtatcgcgaccgtccccgccccgtcccgtgaccgataggctgccgcccatgcaggcgacctcgtacacgtacgaccccgagacccgcagcggcagcgtgctgctggacgacggcaccccggtggacttcgacgccccggccttcgacgcgggcggcctgctgctgctgcgtccggggcagcgggtgcggatcgagggcgagggtgagggagcggccctgcggatcacgctggtgaccctgcagacgttctgaccccgctcccgaccggagcgacaccgctgggccgaacggggcccggacagcccgcgggccgggctcccccggaggggagcccggcccggcgcgttgtgaggagcgagcgggtgcccggtctcacttcttgcgtgcggtggccttcttggccgtggtcgtgcgcgccgtggtcttcttcgcgggcgccttcttcgccgtggtcttcttggcgggcgcggtcttgctggcgacggccttcttggcggtcgtcgcggccttcttcgccggggtcgccttcttggcggccgccgaggccttcttggccgtcggggtggtcttcttcgcggtgaccttcttggctgcggcggtggtcttcttcgccggagtcgccttcttggcggtggtcttcttcgcggtggccttcttggcggccgacttcttggcggcagcggccttcaccgtcgtacgggcggcggaagatccgcccgagaggctgcccttgggggccttcttgacggccacgtcgttcttggggagcttcttcgagccgctcaccaggtccttgaaaccctggcccgcgcggaagcggggcaccgaggtcttcttgacccggacgcgctcacccgtctgcgggttgcgggcgtaccgggcggggcgatcgaccttctcgaacgagccgaagccggtgaccgagacacggtccccggcgacaacggcacggacgatcgcgtcgagtaccgcgtcgacagcgtctgcggcctgctggcggccgccgaccttgtcggcaatcgcttctacgagctgcgccttgttcacgtcttccccttcggagacattgccagaacgaaagtgttcaagctttttcgcacgttaggcagatatataccgcaaatcaaacacgaaacgggctaatcaccctagtgccgcaacgaagtcgaccgatgcgcagttccacgtgtcagtcaccttcggggaatcggccctcatcgaggtccttcatcaaccggtccagacgccttgccgcgtccgggagatcgtgcttcgccgcggccgtgacgaccagcagcttccgggtcagcgccatccgtacgctctccgggacttgcagtgcacgcaccttcgcgtgcgcttccttcaatcggtcggcgacttggccatagagcttgagttggctgtcgcgttccatgcaccgattgtgccatctggggcgagttgtcgcccgacggggtctcaacaagcgactgcgccccctgccgggaggcagggggcgcagtcctggaaaagcgctgctcaggcggcaatggtacgcggcttgaaggcgggccttgccgcctcgtacgcggcgatgtccgcttcgttctgaagggtgaggctgatgtcgtcgaggccgttgagcagtcgccagcgggcgttctcgtcgagctcgaagtcggcggtgatgcctgcggcgcggacctggcgcgcctccaggtcgacggtcacctcgacggtcggatcggcctccgtcagctcccagagggcgtcgacgaccttctgctccaggaccacggtgagcagcccgttcttcagcgagttgccgcggaagatgtcagcgaaccgggaggagacgacggccttgaagccgtagttctgcagggcccagaccgcgtgttcgcgggaggaacccgtaccgaagtcgggaccggcgaccaggaccgaggcaccctcgcgctcggggcggttgaggacgaagttctcgtccttgcgccaggcttcgaagagcccgtcctcgaacccgtcgcgggtgaccttcttcagccagtgcgcggggatgatctggtcggtgtcgacgttgctgcggcgcagcggaacggcccggccggtgtgcgtggtgaatgcttccatggctatcggactccggcgggggtacgggcgtcggacaggtcggcgggcgaggccagatggcccagtaccgcggtggcggcggcgacctggggcgagaccagatgggtgcggccgcccttgccctgccgtccctcgaagttgcggttcgaggtggaggcggagcgctcgccgggggcgagctggtcggggttcatgccgaggcacatcgagcaacccgcgtgccgccattcggctccggcctcggtgaacaccttgtccaggccctcggagacggcctggagggcgacccggaccgagccggggacgaccagcatgcgtacaccgtcggcgactttgcggccgtccaggatcgaggccgcgttgcgcaggtcctcgatgcggccgttggtgcacgaacctacgaagacggtgtcgacgttgatgtcgcgcagcggctgcccggcggtcaaccccatgtattccagggccttttcggcggcgaagcgctccgaggcgtcctcgtacgaagccgggtcggggacattggccgacaggggcgcgccctggccggggttggtgccccaggtgacgaacggggccagctcggtggcgtcgatgacgacctcggcgtcgaacaccgcgtcgtcgtcggagcgcagggtcttccagtacgcgacggcggcgtcccagtcctcgccctcgggggcgtggtcgcggcccttgaggtagtcgaaggtggtggcgtccggggcgatcatgcccgcgcgggcgccggcctcgatcgacatgttgcagatggtcatccgggcctccatcgagagcttctcgatggcggagccgcggtattcgaggatgtagccctggccgccgccggtgccgatccgggcgatgatcgccaggatcaggtccttcgcggtgacctcgtcgggcagttcgccctcgaccgtgatggccatggtcttcgggcgggccagcggcagcgtctgggtggcgaggacgtgctccacctggctggtgccgatgccgaacgccagcgcgccgaacgcgccgtgcgtggaggtgtgggagtcgccgcagaccaccgtggtgcccggctgggtcagacccagctgcgggccgaccacgtgcacgacgccctgctcgacgtcgcccagcgggtgcagccggacgccgaagtcggcgcagttcttgcgcagggtctccagctgcgcgcgtgagaccgggtcggcgatcggcttgtcgatgtcgagggtcggggtgttgtggtcctcggtggcgatggtgaggtcgaggcgtcgtaccggacgtccggcctggcgcagcccgtcgaaggcctgcgggctggtcacctcgtgcagcaggtgcagatcgatgaagagaaggtcgggctcgccctccgcgcgccggaccacatggtcctcccagaccttctccgcgagtgtcctacccatcgctttccctccggccggcgtcttcgccggcccaactagagattcggtgcgcctccgtccggacccccgtgcggggcggtggctacgagccgttgtgcggccgcccccacaggttcgcaacttccgccggaaattgaacttgcgtttcacagagtgagacgggagtatcgtcgtatggacaactctagcggcgtcggcgttctcgacaaggcagctctggtattgagcgccctggagtccggtccggccaccctcgccgggctggtcgcggcgaccgggctcgcacggcccacggcccatcggctggccgtggcactggaacaccaccggatggtggcgagggatatgcagggccggttcattctcggcccccggctgtcggaactggcagccgcggcgggcgaggaccgcctgctggccacggccggaccggtgctcacccacctgcgcgacatcaccggcgagagcgcgcagctctaccgccggcagggcgacatgcgcatctgcgtggcggcggcggagcggctgtccggactccgggacacggtgccggtcggctcgaccctcacgatgaaggcgggctcctccgcccagatcctgatggcctgggaggagccggagcgcctgcaccggggtctccagggcgccagattcacggcgacggcgctctccggcgtacggcggcggggctgggcccagtcgatcggcgagcgggagccgggcgtcgcctccgtctccgctccggtgcgcggcccttcgaaccgggtggtcgcggcggtctcggtctccgggccgatcgagcgactgacgcgtcatccgggccggatgcacgcccaggcggtcatcgactcggcagcacggctgagcgaggccctgcgccgcacgggctgacgccgcacgcatccctcccaccgaacttccaaaaggccgccccagcgtcgtggcggcccttttctcttccggaccctcccctgccgggcgcaaccgcggtgccgggcaggcgacttggcgcgaggcaccccgctccggacaagcgggaaggccctccaccgaagtgaagggccttcccgtactgctgtgttgtacccccgaccggattcgaaccggcgctactgccgtgagagggcagcgtgctaggccgctacacaacgggggcgtggttactgctgacttgcgctgggctaccaggactcgaacctagaatgacggtaccagaaaccgtagtgttgccaattacaccatagcccatggtgtgacaagtacccccgaccggattcgaaccggcgctactgccgtgagagggcagcgtgctaggccgctacacaacgggggccctagcgatcctgcatcaagaacgtgggtgcgacccagatgttctcgcgggaaggatctgtacccccgaccggattcgaaccggcgctactgccgtgagagggcagcgtgctaggccgctacacaacgggggcttgtcctgctgatcttgctcgtactgcttggttttgcgctgggctaccaggactcgaacctagaatgacggtaccagaaaccgtagtgttgccaattacaccatagcccactgaaacgcaaccccggtggggtctcatttctgtctgcgcttcccggccggatctttcggcccgctcgggcggcgcagaaagaacattacccgaaggtgtccggcgctccaaaacgggtattgcccgccagcagaccgggcagctggtcgagcccggtgatcgtcacgagatccggcctcccgcccctgccccgccggtcgagccagatgccggtcagcccggcggcgacggccccgctcgcgtcgatgtcgggctcgtcgcccacgtacgccacctcgtgcggctccagtgcgagcgcctcgcaggccgcgtggaaggcgccggcctccggcttggagatccccagctccacggcgcagaccatcgactcgaaccggtcgcggacgccgagcgcggtgagcttgcggtgttggttgtaggtgctggagttggagaggatcgcgtgccggtagtcgggggccagcaggtccaggaccggcagcacgtccgggaagagccgccaggcggcctcgtagtggaccaggtgtccggcgaaccagtcgtcggcctcggcgtcctccatggcccgcgagaggaatgcgcggacccggtcccgccgctgcccgagaaagtccgtctcccccgcggcgacgcgcgcccagtgcacggcggtgatcgccttccaggcgtcgagggcctcgtcgaccgaggcgtaggcctccggcagccccacgctccccagatgccgccgcatgccggtgtggtcggcgccggcgtagtcgaagatcgtgtcgtcgatgtcccagagcacggctcggatcggcatggagctcacggtagccgccggcagccgccgacggtgggcgaaagccgaggagggccgcagcccacgggctgcggccctcctcggggggtgtgctgtcgcctacgcggtcagcttcgccagcgcggcgtccacgcgggccaggctcttgtcgcggcccaggatctccagggactcgaagagcggcaggccgacggtgcggccggtgacggcgacgcggaccggggcctgcgccttgccgagcttgaggccgtgggcctcacccgcggtgaggacggcgttcttcagggactcggcgttccagtctgcggcggcgaggttggcgcgggcggtggtcaggagcgcttccgagccctccttcatcgccttgttccaggaggtctcgtcgtacaccggctcgtcgaggaagaggaagtcgacgttgtcggtgatgtcggagagcaccgtgacccgggtctgggcgtgcggggcgatctccgcccacttctccgcgtcgaaggcctccggggcccagggagcgaagggagcccgcagccaggggccgcaggcctcggcgaaggccttcacatccagcatgcggatgtgctcggcgttgatgtgctcgcacttcttgaggtcgaagcgggccgggttggcgttgacgtccttgatgtcgaacgcggcgaccagctcgtccatcgagaagatgtcgcggtcctcggcgatcgaccagcccagcagcgagaggtagttcaacaggccctcggggaggaagccgcgctcgcggtagaggttgagcgaggcctgcgggtcgcgcttggagagcttcttgttgccctcgcccatgacgtacggcaggtggccgaaggccggggtgtccttggcgatgcccagctcgatgagcgctcggtagagggcgatctggcgcggggtggaggagagcaggtcctcgccgcgcaggacgtgggtgatctccatcagcgcgtcgtcgaccgggttgaccagcgtgtagagcggggccccgttggcgcggacgatgccgtagtccgggacgttctccggctggacggtgatgtcgccgcggaccaggtcggtgaaggtgatggcctcgtcgggcatccggaagcgcacgatcgagctacggccctcggcctcgtacgcggccttctgctcggcggtgaggtcgcggcagtggccgtcgtagccggacggcttccccgcggcgcgggcggcgtcgcggcgggtgtccagctcctccgtggtgcagtagcaggggtaggcgtacccggcggcgagcagcttctcggcgacgtccttgtacaggtccatccgctgcgactggcggtagggggcgtgcgggccgccgatctcggggccctcgtcccagtccaggcccagccagcgcatcgagtcgagcagctgctggtaggactcctccgagtcgcgcgccgcgtcggtgtcctcgatccggaagaccagggtgccctggtggtgccgggcgaaggcccagttgaagagcgccgtccggaccaggcccacgtgcgggttgccggtcggggagggacagaaacgtacgcgatggggcctcccctggtcgagcggagccgagagcttggggaaaggtgcgttagccacgcttgatcaccttgttggtgagagtgccgatgccttcgatggtgacggcgacctcgtcgccgatgtgcaggggtccgacccctgcgggggtgcccgtgaggatcacgtcgcccgggagcagcgtcatggcctccgtgatgtggacgatcaggtcctcgatggagcggaccatgtcgctggtgcggccgagttgtctctgctcgccgttgaccgtcgcctggatggtgaggtcgtgggggtccacgtcggtctccacccaggggcccagcggacaggaggtgtcgaagcccttggcgcgggcccactgcttctcgcgctgctgcacatcgcgggcggtgacgtcgttggcgcaggtgtagccgaggatgacgtccttgacgcgctcgcgggggacctcgcggcacatgcggccgatgaccacggccagctcggcctcgtggtgcaggtcgttcgagaaggaggggtactcgatcgcgtcaccggagccgatcaccgaggtggtgggcttgaagaaggtgatcggcgcgtcggggacctcgtgaccgagttcggcggcgtgctccgcgtagttgcggccgatggccacgaccttgttggggagcacggggggcagcagccggaccttgttcagcgggaccttggtgcccgagagctcgaagtcggcgtacggaatgcccttgatgatgtcgaggacgaggtcaccggattccacggtgccctgcccctcgacggcgccgaaggcgacattgccgtcgatggagaacctggcgatgcgcacgggatgctgtcgcccctcacttgctggctgactgaagactgacgctccaggctaacgcggtgagaggggacagcctcgcgtatcgcggggtggccggccgggggcctactgggcggccgcgaccggggcttccatcaggatggtgcggcgcgggttggccgtcacggtcggcagggcggcggcgtgctccggctggggaggcgtctgcagcgcttcggcgtccttgaggtgcgccagcgtggtgcgccgggggttggcaatgttgcggaacatcgtcgtcgtcttcatctgccgtcaggaccctgtcggtgagggcgtcgctcgtcgcggcgccgggttgtcggattcgccatccctgtaaagcgtcaggctaaacatccgattccccgccggagtcgggatgaggcgacgatcatcatgtgagtttgctcacgaactaatcgacaattgccctattagggacagttgatcttgggccagaaaacggacattgcagcactgaatccaccattccgctcctgatcgtcgcgtctgggacaccccccgtccctaggggactcctccccaatagtccgctttacccacgatcacgctccactgcttgttacccgttcatcacaacgtgtcacccaggtcacagcccggtacatgggccttgttggagatcctgcactgtgctggaattccacgcaccgccgcgggtttcagtgccggcgcgcaggggcgcaacgcagcgccgagtggcggcgggagggggaagtacgccggtcactcatacgaccaccatggggcgcgtccagtgccccacgacgccgacaccgttcttgtccgcataacgcgggcgggacgcctggtccagaggttgcgacgctagtgcagggacgtttcaagagggatggcagcgctccggcggaacaggagccgcgcggcgggaccgaccgcggttcctcgccccagcacgcccagaaccccgggccggccggtgccggcgacaacagcgaccgcgcacagcgctcgggctccacgacgagcggcggcgcggagccgaacacgcccgcacagccgcgcggcccggtcgacacgggttcgcgaatagctctccgcaactggcgcatcagcacgcgactggtctcgctcctcgccctccccgtggtcgccgcgaccagcctgggcggcctgaggatcaacgagtccatgaacgacagccagcagctggagcacatgcagctgctgacgaagatgaccaagcaggcgacctcgctcgcccaggcgctgcaggtggagcgcgaccagtcggccggcccgctgtcgaacaagtccaagcccaccgactacaaggtcaccgggccccgggacaagaccgaccgggccaaggacgccttcctcgacgagaccgactccatcggtgactccgagggcgacgaggcgctcgacagcatccacgcgagcatctcgcagatcgcctcccagctgggcaccatccgtacgatccgcaagacggcgtacgaagagggcgcaccgagtctcaacacgatcgaccagtacaaccagctgatcacctcgctgctgagcctctcgcaggacatggcgcaggcgaccagcaacccggacatgatcaagcggacccgggccctggcggcgttctcctccgccaaggagtacgcctcggtccagcgcgcggtcatcgccgcggcgctgccgggcggttcggtgaaggagccgcacctcaacccgaacgaccggcagttcggctccaacgcgctcgccaaggagtcccgggccctcacctcgttcaagacgatctacgggacgaccggggagagcgccgaggagctcatggctcccctggacaacggcaacccggagatcaacgccgggaacatgtacgccaagcggatcctggacaccacgaacgggatcgagggcaagcaggtccggtcgtacctggactggtacgaccagagcaccatcaagatcaaggccatggagacgatcgaggccaccctcctcagcgacatggaggccaaggcccgcgagctgcgccaggcctcccagcgcgaggcgatcgtcaacggtgcggtcatcctcatcgtgctcggcgtctcgctcgtcggcgccttcgtggtggcccgctccatgatccgctcgctgcggcgtctgcaggacaccgccacccgggtcgcccaggaccggctgcccgagctcgtcaagcagctctccgagaccgacccgcaggacgtcgacacctccgtcgagtcggtcggcgtgcactcccgggacgagatcggccaggtggccgcggccttcgacgacgtgcaccgcgaggccgtccgcctcgccgccgagcaggccctcctccggggcaacgtcaacgcgat

SEQ ID NO: 3149 - DNA, 3965 bp, Unknown
  Kingdom: Bacteria, Phylum: Actinobacteria, Class: Actinobacteria, Order: Streptomycetales, Family: Streptomycetaceae, Genus: Streptomyces
ggaacggacgcttccttcggtcccgtttcaccggggccctccgggcgcttcccttcgttttcttctttgtcctgctgtcctgcgtttccgactctatcagactctttcgtgtccgattcccggtcgaagcgggtctcgcatctctcaccttccaggtgcttcgctttcgcgttttccctttccggcgagtccgactctatcagatcctttcgggcctgattcccagtcagcggggtttgtcttcccggctgttgggccgttccgacgctcaaactctagcggattctcccggcggctcataatcgggccttcgcaatgaattccggcatgccgaaatcatcccgagtgggagatcgtgctgaagtttggttgccgcgtccgcagcgggatcggctgccgcggaaccgttccggctccgtgacaactcggagaactttacggatccaccaagggtgtgtcaaccctcccccggtggcctccgcagggcctctgtcctggccctcagtccaggtcggtgagccggccgccggcgtccggctgggcgtgctcgacgcggcgcaggagacggaccagcagttcgccgaggacaccgcgttcgtcgccggagaggtcctggaggaggtcctcctcgaagtcgctcgccatgcgcatcgcctcgagccacttcgtacggccttcgtcggtcagctcgacgatgacgcggacccggttgttctcgtcgcggtcgcgggtgaccaggccttcgccggccatccggtcgatgcgatgggtcatggcggccggggtgaggccgaggcgcttggccagttcgccggggcccagacggtacggagcgcccgccaggaccagggtcttgaggacttcccactcggcgttgctgatgccgagcgcggcgacctgtctcccgtacgcgacgttcatccggcggttcagtcggcccagcgcggagacgacctgttcgacctgagggtcgaggtcgcggaactcgcgctggtaggcggcgatctgttcgtcgaggctcggctcgctggggccgggctcctcggtgctctcagacatggcgggcagtatgacacgaccccaccacccttgaagtccttcagcctgtagttttcaccttctaagtttagtgctaaagtcttcgagtctgatttctacgtgtcaggcctcgacgctccgcgctcggggctttcgagttctgaggtaggtgagtgtgaccagggagatgggcgcagcgctgcggcggatccagctgggcagcgcgctgagcgcgttcgggctcgggttcaccgttccgtatctgtacgtctacgtggcgcaggtgcgggatctgggcgccgggacggcgggagtcgtcctggccgccttcgcgatggcagcgctggccgttctgccgttcaccgggcgggccatcgaccggcggggcccgttgcccgtgctggtggtggcctccgttctggcctccgtgggcgcggcggccctggggttcgcgagcagtgttcctgccgccgtgatgtccgccgcggtgctgggcgcgggcactgccgtcatgcagccggccctcgccacgatgctggtctggtgttccagcaccgcgacccgtacgcgggccttcgccacgcagttcttcctgcagaacctggggctcggcctcggcgggctcgtcggcgggcagctggtggacgtgagccgtccggcgagcttcacgatgctcttcctgatcgaggccgtgatgttcgtggtgctcggcgtcgtggtgacgaccgtgcggatgccccgtccggcgtcgctcggtggcgcccgcccggtggacggttccgccgcgaagggcggcgggctgcgggcactgctctcgcaccgggccatggtgcagctgtgcgtgctggggttcgtgctgttcttcgcctgctacgggcagttcgagtccggcctggccgcgtacggcacggaggccgccgggatcgcgccctccaccctcggtttcgcgctggccgccaacaccgcggtcatcgtcgtggcgcagttcgtcgtgctgcggctcgtggagcggcggcggcgcagccgggtcatcgccgcggtcggcctgatctgggcgttcgcctggatcgtggcggggtacgcggggctgggccacggcagccagaccatggcgacggccgcgttcatctcgacgtacgcgctgttcgggctgggtgaggcgatgctgtcgccgaccgtcgccccgctggtcgccgatctggcgccggagtcgatggtcgggcagtacaactcggcgttcgccctgtgcaagcagctcgcgctcgcggtcgggccggccgtcggcgggccgatgggagcgtccctgcacggcccgtacatcgtgaccttcgtgctgttctcgctgggcatcacggtgctcgccctgcggctgggccgtcggctcacccccgtacaggaccagccgtcgctcgcaggcgtcccgtcgcgggtggtggtggtgtcactgcccgagggcggggacggtggggagaccgggagcgccgggtccgggtctccctcggtctccaccgcggcttccgcctccaccggtcactgagccggtcgccgcgggagtgccctgctcaccgcggcagggcgaactcgcaccagaccgccttgccgccgcccggcgtgcgccgactgccccacgaggtggcgatcgaggcgatgatcgagatgccgcgtcccgcctcgtccgccggttcggcctggcggcgtcgcggcaggtggtcgtcgccgtcggtgacttcgacgatcagccgccggtccgtacgccgcagtcccaggcgcatcggcggggtgccgtgctggagggagttcgcgaccagttcgctggtggcgaggacgcccaggtcgcggagctcgacggggaagcgccaggaggtcaggaccccggtggcgaaggcgcgggcgcgcggggcggcctcgatgccgccgaggagatcgagcgcggcgttgtggaacagctcggcgttcgatcccgtacgggcggggtgctggaccaccaggaccgccacgtcgtcgtcgtgctcggcggtcacgccgagggagcggatcagccggtcgcagaccacctgcggtgatcccttggcgcccgagagggcgcgggccagtgaggcgacgccctcgtcgatgtcctcactgcgccgttcgaccaggccgtccgtatagaggaccgcggtggagccgggcggcagcgcgatggtgcccgaggtgtggacccagccgccggtgccgagcggggggccggtggggtcggcggcccggtggacggtgccgtcctcgtcacagacgaggatcgggaggtgtccggcggaggcgtagacgaggtgtccctcgttcggatcatggacggcgtagacgcaggtcgcgatctggctggcgtcgatctcggcggcgaggacgtccagcagttggatcacctcgtgcggcgggaggtcgagccgggcgtaggcgcggacggcggtgcggagctggcccatcacggcggcggcccggaccccgcggcccatcacatcgccgatgaccagtgcggtgcggcccgcgccgagggtgatgacgtcgtaccagtcgccgcccaccgcggcgtcggttccgccgggttggtaggtggcggcgatgcggaggtcgtcgggctgttccaactcctgcgggagcagggagcgctggagggtgacggccgtttcgcggtggcggcgctcgctggtgcgcaggcgttcggcggcttcggcgtggtcggtgacgtcggcggcgtagacgaggacgccgccttctcccttgccgtctccccccgttcccttgccgtcctcgtgccgcgtggtgctccaggcggtgaccggggtgcaggtcacggtgtacgaaccgccctcggcggtcctgcgggacttgaccgtacgggcggtgccgctgcgcaggacctggtcgagcagcgggaccacgctgagctg

SEQ ID NO: 3150 - DNA, 6607 bp, Unknown
  Kingdom: Bacteria, Phylum: Actinobacteria, Class: Actinobacteria, Order: Streptomycetales, Family: Streptomycetaceae, Genus: Streptomyces
gtccccccgcagcagccggaggcgtacggacagcagtcccaggccgcccagccgcagccgcaggcctacggacaacagccgcctgtcgacccgcgtacgggcggagcctggcccaccccggtcgcgcacgaccagcgcgagcggtcggtgcccggcgccccgctcgggtacacggcggccgtcgagctctcctccgaccggctggtgcggggcaagcagaaggccaagagcagccgtaacccctccgccgcctcccggttcaagctgggcggcaagaaggaggaggccgagcggctgcgcaagctggagctgatccgcaccccggtgctgtcctgctaccggatcgccgtcatcagtctcaagggcggggtcggcaagaccaccacgacgaccgcgctgggttcgacgctggccaccgagcggcaggacaagatcctcgccatcgacgccaacccggacgccggcacgctgggccgacgggtgcgccgcgagaccggggcgaccatccgcgacctggtgcaggcgatcccgtacctcaactcgtacatggacatccggcggttcacctcgcaggcgccctccggtctggagatcatcgccaacgacgttgaccccgcggtctccacgacgttcaacgacgaggactaccggcgcgcgatcgaggtgctcggcaagcagtacccgatcattctcaccgactcgggcaccgggctgctctacagcgcgatgcgcggggttctcgacctcgccgaccagctgatcatcatctcgacgccctcggtcgacggcgcgtccagcgcgtcgacgacgctggactggctctcggcgcacggctacgccgacctggtgcagcgttcactcaccgtcatctccggtgtccgcgagaccggcaagatgatcaaggtggacgacatcgtccagcacttcgagacacgttgccgcggagtcgtcgtcgtgccgttcgacgagcacctggcagcgggcgccgaggtcgacctcgacatgatgcggcccaagacccgtgaggcgtacttccacctctcggcgctggtggccgaggacttcgcgcgggcccagcagcagcaggggctgtggacgggggacggccagaacccgccgccgcagttcgccccgcccatgcccggccggcagggctacccggcggcggcccagccgatgccgggacagcagatccccggtcagcagggcggccccggtcagccggcagcgggccagcaggttcccggccagcacgtccccggacagcaggtcccgggccagcagaaccccggtcagcagccgtacgcaccgcagcagcccggccccggccagccctacccgcagcagcaccccgggcagccgcagcagggacaccagcagccgtaccccccgcagcagccctacggtggacagccgccgtacgggggatatcaggccgccggtcagccgggtggcccctacgctccgcagggggctcccggcggaccgcagaacgggtggctccaggcgcctcccccgcaggccgggccgggtgcgccggcgacaggcgcgccgcagcaggcgcagccggagcagcagagcgggcaggcagacccggcaggccagcccgagttgcagggtccggtgcctcccgccggctggcagcagacgcctccgcagccgccgccggcacctcagcagtagggcctgagtggttgagaccaatgagggcaagtgaaggacccgtacggctcgcgcggtgcgggtccttccgctattcccgcagcccacacgctgtttgactgaccgttgacgagcctcgaccaccgctgataaaccttcgcttcaccaactggcgaaccagagatctacccgccttcttcagcgagtgatgacgcgaggtccccgtccatggtcactagagttccccaccactccacccggccacgccgacgcctgcgcctcctgctggcctccggcgtggccgccctggcactcaccgccgggtccgtcgtacccggaaacctgctcgcgcccgccccctccgaggcgcgcgcggacgacgggaagacgacgctcacggtcgccgtcgcacagagcgtcgactcgctcagcccgttcctggcgcagcggctgctcagcacgagcgtcatgcggctgatgtacgacttcctcaccaactacgaccccaaggacaacaaggcgatcccggccctcgccaccgcgtgggagccctccgcggacaagctgacgtggacgtacacgatccgctcggactcgaagtggtccgacgggcagcaggccaccgccgaggacgcggcctggacgttcaacaagatgatgacggacgaggccgccgcgacctccaacggcagcttcgtcggcaacttcgagaaggtgaccgcccccagcaaggacaagctggtcatcaagttgaaggagccgcaggccacgatggccgcgctcgatgtgccgatcgtcccgaagcacctctgggagaaggtcggcgacttctcgaagttcaacaacgacaaggagttccccatcgtggggaacggtccgttcatcgtgacggactacaaggtcgacagctatgtgaagctgaaggccaacaaggacttctggcgcgggtcccccaagttcgacgaactggtcttccgctactacaaggaccaggacgcggccgtggccgccctgcgcaagggcgaggtgtccttcgtcgcgggcagccccagcctgaccccggcccagtccgcctcgctggagaaggctccggacatcaaggtgaacgacgccccgggccgccgcttcttcgcgctcgccgtgaaccccggcgcccgcaccaaggacggacagaagttcggcgacgggcacccggcactgctggaccagaaggtgcgccacgcgctgttcatggcggtcgaccgcaagaccatcatcgacaaggtcttccagggccacgccgtcgagggtgagggctacatcccgccgcgcttcggcgactacttctggaagccgtcggcggaccagaagctcgcctacgacccggcgcgggccggatccctgctggacgaggccgggtacaagaagaacggcgcgggcaagcgcgtcggcaaggacggcaagccgctcgacttccgcatcctctgccacgccaccgaccccaacgacaaggcgatcggcaagtacctccaggagtggtggggcgagcagggcatcgggctgaaggtcgactgcctcgacaacgtttccgacccctggtacgccggtgagtacgacctcgccttcgacggctggtccgtcaaccccgaccccgacttcgtcctgtcgatccacacctgcggcgccctgccgacgaaggcgaaggagacggcctcgaccgacaacttcatctgcgaccagcggtacgacgagctctacaagaagcaactggccgagtacgaccccgccaagcgggcggatctggtcaagcaactggagtcgcggctgtacgacaccgggtacatgaacgtcatggcgtacccgaatgccgtcgaggcctaccgcaccgaccacatcgagtccatcaccaccatgccgtcggccgcgggcaacatctacggccaggacggctactggagctggtggtcggcggtcccggccgccggggcctcctcgtccggttcctccgactccggtggcagctccaccggagtgctcatcggggtcgggatcgccgtcgtcgtcctcgccggtggcggactcctgttcgccatgcgtcgccgctccaccgcggaagaccgtgaatagtccatgagctcagaaagcactcccgccctgctgaagggcgcggcgggcgtggagagcaccgaatccggcggcccggctccggccgggccgtcggcccgctccccgcgctcccgctccaccgccgcctacgcccgctacgcggcgggcaagctcgccggggcggccgtctccctcttcgccgtcctcgtcaccagcttcttcctcttccggctgatccccggcgacccggtcaagcagatgaccggcggccgtcaggtgtcgaccgagcagatcgcggcgatgcgccgcgagttcggtctggacctgccgctgtgggagcagttcacccagtactgcggcaaggcgctgaccggcgacttcggaacgtcgtaccagttccgcgccccggtcgtcgacaagatcgccgaggcgctgcccgccaccctgctgctgaccggcaccgccttcgtgatctacacgctgctcggcatctggctgggcgcgcgctccgcgtggcgcaacggcagtaccggggaccgcgccaacaccgcgttcgcgctgacgctgtactcggtgccctcgttctggctcggcctgctcctcatcatcaccctgtcggtgggcatcggcccgatccccgggctcttcccgaccggcggtatggagtccggcgacaccgagggcttcgaccgggtgctggacatcgcccaccacctggtcctgcccgtcgtcacgctcgtcgccgtggagtacgcgcgcaccctgctggtgatgcgctcctcgctgctggacgagatgggcagcgactatctgacgaccgcccgcgccaaggggctgcgcgacgacctcgtacgccggaagcacgccgtgccgaacgcgatgctgccgaccgtgacgctgcttttcgtgaacctcggcacgacggtcgccggggcgatcctggtggagaccgtgttctcctggccgggtctcggcggcctcttctaccaggcgctgagcgtgcccgacctgccgttggtgcaggcgctgttcttcgtgttcgccgccgcggtgatcctgatgaacacgctggccgatgtgatctatccgctgctcgatccccgggtgggccgatgacgacgtcgatgcagaagcccgagccgctggagccggacgcccggaagccctccggggagccggagaaggtggtcccggtacagagcccgcgcgccctcacccgggcccggcggcggcaggcggtgctccgcttctggcggcagtaccgcacgcaccgcgccgggctcgtcggactcgccgtgctcgcggtgatcgctctgctcgcgctgaccgccccgctgctggtgggagccgactcgcagagcgtgaccagtgccccgggcggcccgatggaggccccgagcggtgaattcccgctcgggaccgaccagttcggccgcagcctgctggccctgatgctctgggggacccgggtctcgctgacggtcggcctgctcgccgcgttcctgtccgtggcgatcggcaccctcatcgggatcaccgcgggccacttcaagggctggtacgccaccgtcatcatgcgggtcaccgactggttcctggtgatgccgaccctggtgctggccatcgccctggcgaccgtgctctcccggtcggtctggacgacgatcctggcgatcggcgtgacgacctggccgacgaccgcccgcctggtccgcgcccagacgctgtcggtcgagtcccgcccgtacatcgagcgctcccgggcgctcggcggcggacacgggcacatcatgtcccgccatgtgctgcccaatgtgatgccgctggtgctggcccagaccacgctcgtgatctccaccgccatcctcaccgaggcgaccctcgccttcctcgggctcagcgatcccacgatcgtctcctggggcggtctgctccaggacgcccgcgaggccggcgcggtcagctccggcaactggtggtacctcgctccgcccggtctcgccatcgccgtggtcgccctcgccttcaccctgtgcggccgtgccatcgagtccgtgctcaaccccaagctgggggtgtcccgttgaccgccacgaccacgaccaccacgccgaacccggacccgtccggttcccccgacccgacgaggcccaccggcgatccgccgctcctggaggtgcggaacctgaccgtcacctacgggggcggcgccgacgccgtccccgccgtacggggtgtcgatctgcgggtcgaggccgggcagaagctcggcatcgccggggagtccggctgcggcaagtcgacgctggccctcgcgctgctgcggctgctgcccgcgacggccacgctgtccggcgagatcctcctcgacggcgaggacgtcctgaccatgaagtgggggcggctgcgggccgtccgctgggcgggcgcgtcgatcgtcttccagggcgcgatgcactcgctgaacgccgtgcaccgggtcggggaccagatcgccgagccgatcctgctccacagcaaggccactcccgccgccgctcgcaggagggccggtgagctgctggagcaggtggggctgcccgccgcccgggcccaggcctatccgcacgagctgtccggcggtcagcggcagcgcgtgatgatcgccatggcgctggcctgcgatccgcggctgatcgtcgcggacgagccgaccaccgccctcgacgtgatgatccaggcgcagatcctgcggctgatcgaggcgctcgtcgcggaccaggacgtcgggctgatcatgatcagccacgacctcgcggtgctcgccgccacctgtgaccggctctcggtgatgtacgcgggccgggtcgtcgaggagggc

SEQ ID NO: 3151 - DNA, 11488 bp, Unknown
  Kingdom: Bacteria, Phylum: Actinobacteria, Class: Actinobacteria, Order: Streptomycetales, Family: Streptomycetaceae, Genus: Streptomyces
caccgccatggcgccgacgaccgcctcgcggtgctgatgcgtggtgtacgaggagatctccgcctggtgcgtggcctgctccggatcgtccgcgtaccaggcgccgagcggggcgatgcgcatcgccgaaccattgccccaggagccctggccctggaacagcgccgaggacagttcccgccagtcgccgccctcccgtacgagcctgaggagccggttgacggcgggaccgtaaccccggtcgaagtcgtggtgctcggcgaaggaacgggcgagcgcgtcctggtcgacacggccgtgggcgctgagcacggcgaggaccgagcaggccatctcggtgtcgtcggtccactgccagggcccgggcggcacggcccgctgtttcagcagggggtagttgacggggacgaagaactgggagcccagggcgtctcccacggacagcccacgcaggctggccagggcgcgttcgaagcgccgctcggaagcagaatcagcggtcatcgccctgccactctatccggtgcggccgtacggctcaggggtccgccagctctgaaagggccggtcgagggtgtagcggccgttctcgcccagcagcagggtccgtgtctcgccgttgcccgggttggacagcgactcgaactccgcgaccgaccagtggaaccagcgcatgcagaacagccgcatcgtcaggccatgggtgaccagcaggacgttctccgggtggtccggctcctcgaagctccggtgcaggctctccaggaacgccccgacccggtcgtagacgtcggcgccggactcgccctgggcgaagcggtagaagaagtgcccgtaggcgtcccggtaggccttctgcagccgtacgtcgtcccggtcctgccagttgccccagtcctgctcgcgcagccggggctcctcgcggacgcggacgcgtgccgggtcgaggccgaaggcccggaacgtctcatgggtgcggcggtacggcgagatgtagacgctcacccgctcctcgccgaactgctcgcgcagaccctccccggtctcccgggcctgccgcagacccgtgtcggtgagccggagcgcgtgatcgggctcccgctcgtacaccgtgtcgtcggcgttgccctcggactcgccgtgccggacgaggacaatgcgctgcggtcgtgccatgccccgagcctagatcgggtccggcgggcacgagtggtcggggccgcacaccagaagcgcgcgaacccgggtcacaccgtccaggagggttccagctccacgacgtctcccgtcagcgcgatcacgtccgtctcggtctgcgcgcgggccgccagccgctcggcccccgccgcgcggtacttgccgcgctcggcgctcgacttccacagggacagcgccaggaactcgttgccgggagcctcgccgaacacgccgcgcagcatgccgggcgacccggccatggcgggattccacacctgctgctgcatcagcacgaagtgctcggcgcgctcctcgtgcacccggctgtgcgcgaccctgacgacgtccgcctccgcgaagtgcggctcgaagcccgtcttcacgtcgaagcggcgctcgaagagggttacctgcatgtcgcggaacatgcccgactgcccggccgccagccggtcgtgcccgcgggccatgaaggagtcgtagaagacgcggttctcccagaacgcgaagacatgggcgacgtcggggcgtgttcggctccacccgccgctctgtcctctgaaccccggctcgccgagcagccccgcccacttccgctgtccccgttcgaaaccatgacggtccaccacggagcagcgaatccacttcaccagcaccgcgccatcgtacggcgcggaacgtggcacgcgtcactgtcccggggagcccgccccgaccggtcgttccgctcgcccccgcgtcgcgggggccgtgaggaggcttcaacacacgtgccgggtcgggagggtggcccgaatccgacgcccgtggccggagcagttggttccgccgccggttccgtacatgatcgggtgaatcgtgtatcaggtgatggatacggtccgtgggccgtcggccgggagggaagtcccttgagcactccgaacaaggacatcgaaaaggtcgaggtgcgggtcaaatgggaccccagcccgcacggcgcggcggccaacgacctcgacatcatcgctgcgacctacccggccgacgagccgtacggagcccccgcctatctggtgcacttcgacagccgctcgccggacggcaccatcacgctgaaccgggacagccggaacggccagggtttcggcttcgacgaggtcatgaccgtcgagctgaaccggctggcggacgcgtacgggcgggtggtggtcggtgtcgccatccagcagcgcgacggtcacaagaccttcggcgacatagggaacacggcgatggagatccgcgagggctacaccaacctgaccgagagcgacttctcggacgtggcgtgggcgaccgccgcggtcgtcggggagttcacccgggacggctcgggtctctggggattccggtcggccgtacgcggcttcgacggcgaccccgacacgttcgccgcggtgatgggaagccgggccgccgaagggtgacgtcgaccagttccggccaacccggcgtgggcgtcggtgacctgccggaaagggaccggggacatgccgaaggggaccggccggtggccggtccccttcgtgaaccgcgggtcagccgcgcgtcggcgcggttccgcgtccggtcagctgcagccgctcgtcgagccgcagccctcgcagatgtagcaggagccggcgcgctgcatcttcgtaccgcaggagaagcagagcggggcgtcggcgctgatgccgagctgcatctcgaccagttcggccgaggtgtgcgccgtcttcggtgccggcttcgcggcgggctcctcgggagccgccaccaccttcaggggctcggcgcggaccggggccgactgggccaggctgtccgcgtccaggccgtccgcctcgaacgacggctcgtaactgccggtgtccaggtgacgctgacgctcctcggcggagtggatgccgagggccgagcgggtctcgaagggcaggaagtcgagcgccaggcgacggaagatgtagtcgacgatcgactgcgccatccgcacgtccgggtcgtccgtcatcccggccggctcgaagcgcatgttggtgaacttcgagacgtacgtctccagcgggacgccgtactgcagaccgaccgagacggcgatggagaaggcgtccatcatgcccgcgagggtcgaaccctgcttggacatcttcaggaagacctcgccgagaccgtcgtccgggtaggagttggcggtcatgtagccctcggcgccgcccaccgtgaaggaggtggtgatgccgggacggcccttggggaggcgcttgcggaccgggcggtactcgacgaccttctcgaccgccgtgcggatggtctcctcggccttcgcggtgacctcttccttctccttgtccttggtcttggcggagaggggctggccgaccttgcagttgtcgcggtagatcgcgagcgccttgacgcccatcttccacgcctcgaagtagacctcctcgacgtcctcgacggtggccgtctcggggaggttcaccgtcttggagagcgcgccggagatccacggctggatggccgccatcatccggacgtggcccatcgcggagatggagcgctcgcccatcgcgcagtcgaagacctcgtagtgctcggtcttcagggcgggggcgtcgaccacgttgccgttctcggcgatgtgggcgacgatcgcctcgatctgctcgggctggtagccgagacggcgcagcgcctgcggcaccgtgccgttgacgatctgcatcgagccgccgccgaccagcttcttgaacttgaccagggcgaggtcgggctccagaccggtggtgtcgcaggacatcgcgagaccgatggtgccggtgggcgcgatgaccgaggcctgcgcgttgcggaagccgttcttcgctccgagccggatcacgtcctgccaggcctccgtcgcggcggcccagaccggcgagtcgaggtcatcgacgtggacggccttggcgttggcgtcggagtgctgcttcatgacgcgctggtgcggctcggcgttacgggcgtagccgtcgtacgggccgacgaccgcggccagctcggcggagcggcggtaggaggtgccggtcatcagcgaggtgatggctccggccagcgcgcggccgccgtcgctgtcgtacgcgtgaccggtcgccatcaggagggcgccgaggttggcgtagccgatgccgagctgacggtaggcgcgggtgttctcgccgatcttctgcgtggggaagtccgcgaagcagatcgagatgtccatcgcggtgatgaccagctcgacgaccttggcgaagcgctcggactcgaaggactggttgcccaggccgtcgtccttgaggaacttcatcaggttcagcgaggcgaggttgcacgaggtgttgtccaggtgcatgtactcgctgcacgggttcgagccgttgatccggccggactccgggcaggtgtgccaggcgttgatggtgtcgtcgtactggatgcccgggtcggcgcacgcccaggcggcctcggccatcttgcggaagagggacttggcctcgacctcttcgatgacctcgccggtcatccgggcgcgcagcccgaacttgccgcccgcctcgacggccttcatgaactcgtcgttcacccggaccgagttgttggcgttctggtactggacggacgtgatgtcgtcgccgcccagatccatgtcgaagcccgcgtcgcgcagtgcgcggatcttctcctcctccttgaccttggtctcgatgaagtcctcgatgtcggggtggtcgacgtcgaggatgaccatcttggccgcacggcgggtggcgccgcccgacttgatcgttccggcggacgcgtcggcgccgcgcatgaacgagaccggtcccgaggcgttgccgccggaggagaggagctccttggaggagcggatacgggagaggttcaggccggcgccggagccgcccttgaagatcatgccctcttccttgtaccagtcgaggatcgactccatggagtcgtcgacggccaggatgaagcaggcggagacctgctgcggctggggcgtgccgacgttgaaccagaccggggagttgaagctgaagacctggtgcaggagggcgtacgccagctcgtgctcgaagatctccgcgtccgcgggcgaggcgaagtagctgttgtcctcccctgccttccggtacgtcttcacgatccggtcgatcagctgcttgaggccggtctcgcgctgcggcgtgccgacggccccgcggaagtacttgctggtgacgatgttgaccgcgttcaccgaccagaagtcggggaactcgacgccacgctgctcgaagttgatcgagccgtcgcgccaattggtcatgacgacgtcacggcgctcccacgcgacctcgtcgtacggatgcacgccggggttggtgtggatgcgctcgatacgcagacccttgctcgtcttggcgcccttggtacgggaacctcgtgccgggccgctcgccgtctctgtcatgccgcctcccatatgtgggcgaaaacgccctgaagtgcccagatcttcccaggcacaatgtgtgtccgatgctccggaagccgcactcggcagccggaggcacatctcatgtcgccctgccgccggtccgcagagttgcgtctgcgggcacgggcgtcccgggcgggtaccgctcagtcggcggcaatggcgggcacggggacctcaagggtctctccgctcccgccgtcctctgcggaaggccgctgcgtacgcagttccacgatggcggcctcgaagtcttccaaggaatcgaacgcccggtacacggacgcgaagcgcaggtacgcgacgaggtcgagctcctgcagcgggccgaggatggccagtcccacgtcgtgggtggtcagctcggcactgccggtggcgcgcaccgcctcctcgacccgctggccgagcttggcgagggcgtcctccgtgacgggtcgcccctggcatgccttgcggacgccggagatgaccttggtgcggctgaagggctcggtcacgccgctgcgcttgaccaccatcagcgagcaggtctccaccgtggtgaaacggcgggaacagtcggggcactgccggcggcgacggatcgacgtcccgtcgtcggtggtgcgactgtcgacgaccctgctgtcggggtgcctgcagaaggggcagtgcatggctcccaaccctccttcacacgcacgactgaatagcctcttcagggccttgtccgggcccttggaagcagtccccagcataggcgatgaccacggtgcgattgaaccgcgaccacaacttctgggtgactggagcaatccaaccactagatctagggttgagtcgcgttttcgaccccatcgcgtgtcgcgcgccggacctcgcccggaggccgcccggggggagcgtgggccagaggagagggtacgggaaaggcggggccgccgagccgccggggcttcggcgcacgggtccggatgaaagactcgggcgaggacggcgaccggcctccgcggaacgttcgcacggcctctattctggtgctcatacacctgtcggtagcaccgcggcacccctttattcgtttttcactcgaacgtgtgtttggcgcaacctttcgaaagctactaccgttgtccagctagggagaacattcgagaggggccgacgtgaccaccaccgcagacagtgccgccatcaccgcccgggaccaccgctcccagagccgacttgagccggtgcatgccatgaatgactcagtcacgaacacggaggggcccgagcccgcgcgcccggggcgttccatgcccggcaggccccccggcatccgggcggacagctcggggctcacggaccggcaacggcgggtcatcgaggtcatccgtgactccgtgcaacggcggggctacccgccttccatgcgggagatcggtcaggcggtgggactgtccagcacgtcgtccgtcgcccatcagctgatggcgctggagcgcaagggattcctccgccgggacccgcaccggccccgcgcctacgaggtgcgcggatcggaccagcccagcacccagccgaccgacacgacgggcaagcccgccgcgtcctatgtgccgctggtgggccggatcgccgccggtggcccgatcctcgcggaggagtccgtcgaggacgtcttcccgctcccccgccagctcgtcggcgacggtgagctgttcgtcctgaaggtcgtcggcgactcgatgatcgaggccgcgatctgtgacggcgactgggtcaccgtccgccgccagcccgtcgcggagaacggggacatcgtcgccgccatgctcgacggcgaggcgacggtcaagcgcttccgccgggaggacggtcacgtatggctgctccctcacaacgccgcgtaccagccgatccccggcgacgaggccacgatcctcggcaaggtggtggcggtgctgcgccgggtctgaggacgccagatccgagaaaagcgccggtcacggctgtctgccccggggtcactgcctaggacgtcgatcatgacgtcggtcccggggctttggcttgtccacccgcccggtgccgggcgggtggacggctacggccggatcaggccccgtccgccttggcccgtgcgtcgatggcggccagtgagcggcgcgcctggttcgggtcggtggtgtaccagaagtccggcagcgaggcgcgcagatagctcccgtaccgcgcgttggcgagcctcgggtccagcacggcgacgacgcccttgtcgcccgtggcccggaccagccggcccgcgccctgggccatcagcagcgcggcgtgcgtcgccgccaccgccatgaagccgttgccgcccgcctcctcgaccgccttctgccgtgcgctcatcagcggatcgtccggccgggggaacggaatccggtccatgaccaccagctgacagctcgctcccgggacgtccacgccctgccagagcgacagggtgccgaacaggcaggtctccgggtcggcggcgaagttcttgatcagctcgccgagcgtctcctcgccctggagcaggatcggcttgtccaggcggccccgcagctcctcggccgccgccttggctccccgcatggaggagaacaggcccagcgtgcggccgccggccgcctccaccagctcggcgagctcgtccagcatgtccgtacgggagccttcgcgtcccggggtgttcagatgccgggcgacgtagaggatgccctgcttcgggtagtcgaacggggagccgacgtccagccccttccactgcgggacgtcctcgcccgccgtgccctcgggggccagccccagggacgcgcccactccgttgaagtctccgccgagcttgagggtggccgaggtcagcaccacggaccgctcggcgaagagcttctcgcgcagcagcccggagacggagagcggggcgacccggacggaggctccgaaccggtcgtgctgctcgtaccagacgacgtcgtactcggaaccctgggtgatgcgctcggcgacgccgtggatcgactcgaccgaggccagggcctgcttgcggacggcgttctcgtcctcgaccgacttgtcccgggtggcgccgatggcggagatcaccgtacgtgccgcgtcgcgcagcgccatcaacgcgtacccgaggtcctcgggcacctcttccagccgacccgggagcgccagctccatgacccgttcgaagccctcggccgcggtctgcagggcgtcggcggccttctcgttgaccagcttcgccgcccggcggaccgcgcggttgacctgggcgggggtgagctcgccggtggcgacgccggtgacgcgggagaccagctcatgggcctcgtcgacgatcagcacctcgtgcgacggcagcaccggcgcgccctcgatggcgtcgatcgcgagcagcgcgtggttggtgacgaccacgtccgcgagcttcgcgcgctcgcgggccgcctccgcgaagcactccgcgccgtacgcgcacttcgtcgcgcccaggcactcgcgcgaggagaccgagatctgcgcccaggcccggtccgagacgccaggggtcagatcgtcccggtcgcccgtctccgtctcgtccgaccagtcccgcagccgcagcaggtcctggccgagcttgctggacggggccgccgcctcgaactggtcgaacagcccctcctcctcgtcctgcggaaccccttcgtggagccggtgcaggcagagatagttcgaccggcccttgagcatggcgaactgcgggcggcggcgcagcagcggatgcagggcatcgaccgtacgcggcaggtcccgctccaccagctgtcgctggagggcgagggtggccgtggccacgacgacccgctccccgtgcgccagggccggcaccagatagccgagcgacttgcccgtaccggtgccggcctggacgagcaggtgggattggtcgtcgacggcctcggcgacggcctcggccatggtgacctggccgggcctttccgtaccgccgacggcggtgacggcggcgtgcaggagctcggggagggatggcttcgtcatagcccgaccaccctacggcgcaccactgacaacggcgatcactcccggacgcgggcggaggggtgcaacgggttggggaccgtgccgtggatcgccgcgtgcggcctgctggcacggtcccggtagccgtcgacgagcaggcggttgcggttcagacagaggcgctcgatctcgggggtgagcatgtcgaagagctcgaaccgctccttcagctccgggaagcgggcgtggtggcggactatctccgcccggacgagtgaccagaacacgtcctcggagacaccgagctgctcctcgcacaggggggacaggtagcggaagacgcccacgaagaggccggagtggatgaactgggtgaggaaggacggctcctcggtgaggaggacggcgcgcacctcggcgggcatgccgacgtgctcgggcagcgggtgggcgctgatgttgacgtcgtcgacgaagtccttgatggcgagccgtacgggcacgtcgttctcgtcgaacacgacgatggcgttctcgccatggggggagaagacggtgccgtagcggtagaggaagtgcagcaggggcggcagcagggccccgaagagccgcttcagccagacgtccggggacaggccggagcgctcgaccagctccgcggtgaacgcgcggcccgccggatccgtatggaggagggaagcgagcgtgcgggcgcgttcgcccggcacgaggcggggcggcaggggctcccgccagatcgcgccgaggatctccttgtactggtagggcgcttcggggaggtggtcgtacagcgggtgctccacggcgacggaggcgacctcgccgaggaggacgacccggcaggtgtcgcgcaggaaggggtcggcctcgcacagcccctggacccaggcggtgaccgcgggggcggcgagggtccgctcggtcggcaggccgcgccagaccagggtgttgaggatggagagcgggagcttcacggtgtgccgctcggggtgctccacgttcgcgaacgtgcggatggactgctgcgggaggcgggcgtccccgtcggtgtgcagggccacgatgtcgccgtcggcgatggccggggcgaagagcggcacgatccactcgtcccactgccaggggtgcacggggaggtagaggtagtcccgcgggtcgtgtcccccggcccgcagcacctcgccgaaggcgtcccggacgctcgggtcgagctctccggcgtacagctggtcgggggtggtgaggcggcccacgccccggtactgcgcgatgcgggtgctgaccgcgatccacggcagccggagcgggctgcgggtctcgggggtgaagcgggcggcgtcggcggcggagaagccgagccgtcccttgctcgccaccagccaggggtggccggtctgatggccctccagctccgcgtagtccagagcggcgagccggtccgcggtgagcgccgtgtggtcgagccgggcgtcggcggacagggtccgggtcagctcgcggatgaggtggcccagcgtcgtgccgtcgagcccgaggagatcccgggcccgggtgaggaacgtcagcgggtcgcggaacggccgggagccggtggccgagccgttggcccgcgcctcggcgctcgcggcggtgggtgagccgtgggcgtgggcgtccgggggccccgccgtgacctcgatcgagtcggggtcgacgcgccagctgccgtagacgccg

SEQ ID NO: 3152 - DNA, 3636 bp, Unknown
  Kingdom: Bacteria, Phylum: Actinobacteria, Class: Actinobacteria, Order: Streptomycetales, Family: Streptomycetaceae, Genus: Streptomyces
cccggaacggcacgatccgcacccccgggtcgtccccggcgaggcgggccacccggtcgctgtgcaggcccgcgcagttgaccagcaccctggcccggacgaccaggccgtccgccgtgcgcaccgcgacaccccagggacgccggtccaccgcggtgacctccgcgccgtaccgcacgatgccgcccgtggcggtgacctcggaggcgaagcggccggcgacggcggtgaagtcgcagacgcccgtcgtgccgacccggatcgccgcgaggccccggacctccggctcgtactccgcgatctgggcggggcccagctcccgcacgggcagtccgtgctcgcggccacgctgcaccagcccgtgcagccggggcagctcggagcgttcggtggcgacgatcagcttgccggtgatggcgtgggcgatggagtgctcggcgcagaagtccgccagctcggcggagccgcgcaccgcgtaccgggccttgagggaaccggggcggtagtagatgccgctgtggatcacgccgctgttgcggccggtctggtggcgggcggggccgcgctccttctccaggaccgtcacccgggtgcccggcgcggaccgcagaagcgcatacgcggtcgacagaccgacgatcccgccgccgatcaccagcacatcgcagtcgtacgccgcgtgcgtcatcatcacgccacctcccaccccgatagtgcactgacccactgacaaccggctcaaacccgagccgggcagggcgtggcgcacactccgcccggcggcctcccgggccgggtcccgccgggcggcttccgccgcccggctcagaccggggtgaccagcagcgggcgcgcccgttcccgcagctcagcgacgcggggctcgtccccgtacggctccaggcggtggagcaggtcgcgcacgtactccgtggtgcgggccgaggagatccgcccggcgacctccaccgcccgggtgcccgccgcgcaggccgcgtccagattgcccgactccagctcggcgacggcggacacgacgagccgcagtccgtggctgcggacgaactcctcggtcggccgggacagcgcctgctccgtgaagcgccgcacctggcggggggccttcaggtcccggtagcactcggcggcgtcggcggcgaaccggtcgtagccgtagaagccgagccagggcgggtcggaatcgcccgcccgggaccgctccagccagctctccgcgcccttgagcgcggcccccgcggccggagcgtcgcccgccttcgcgtgagcacgggcctccaccagccggaagaagctcatggtgcgggcggtggcgagaccgcggttgcgctcgacggccgcctgggcgaggtcgaccccttcgtcggcgaagccgcggtaggtcgcctggagggacatcgaggcgaggacatagccgccgagcgggacgtcggcggcggcccgggccaggcgcagggcctggatgtaatagcgctgggcggcctcctgctggccggtgtcgaaggccatccagccggccagccgggtcagctcggccgaagcgccgaacagggcccgcccgacctcgtcggtgtacgagccgaggagcagcggtgcggcgtcgacgcgtaaacactcgggaaccatggaggagcgccagtcgccgcccccgtacttggagtcccagcggcgggcgtcctgggccgcctcgcgcagcttcgacacatcgctgtgcccgacccgcagcggtgaggcgtccgccacggcctccgggccgggctggatcgggacggagcccgccgcgccgggcgtggcgccgccggtgtggagaatgtgtgcgccccgggcgtccggtgcggcccccggtccgcggggaccggccccgccggggctcgcggatccgccgccgcgcaccccgaggatcgcggcctgtgccgccgtgggatcccgggccaccgacggatcggcgggggttatcagccagcgcgacgcgggggtcgcataggcgctcaccgagaacgatcccgccagggactgccagatcccgccgccgccccggcgcccggccagatccagccggtacagctcggtcgccgaccggaccgcctcgcccacgtcccgggggaaggcgaggccggcctccggggccgggtccgcgtcggcgaggccgatctcgtgcagcgggaccggccggccgagcttggccccgatcgccgccgcgatgagatgcggcgccgcgccctgcggcaccatccccttggcgacccatcgggccaccgaggtcttgtcgtagcgaagtgtcagaccgcgctgtgctccgaggtcgttgacccgccgggcgagcccggcgttactgattcccgcgagggcgagaaccgtgccgagcttctcgttcggcccgcgttgctccctggacatgcgccacccctcgacacacagacagccgccgcgtcaccgagaacggcgcgcggcattcgtaccgatgcctccccaggttcgaacctccgtactccgcctgcacacgcatgtggccgagccccgaggaatatgcccccctgctgagaacaccagtaaacacagcgtagttctccccatccctaccgttaaggggcagacgtccggatggcgggattgttgtccgtgcgggcggtccgggccgcccgggcgccgacgcgcgggccgggcagcggcgtgctcccggtgtgtggccgtgcgcccggccgtgcgctctggcccggtgatcggcggaacgcttgtctgggtaccgcgtgggtcggcccgctgcactggactcagtgggctgggggaaaccgccgctccattccccgcgggcggtggaccggtccgggaggtgaggcccacctcccggactgtgcgtggaagggttcgccaggggggcgcggcacgacaggcgcgcagggtggcgcttcgagagaatggccgaatagcgacggtccggtgagggtctggccaacggtccgactatggccggatatcggcgctgtttccgggcggcgccggcccctcccctcccgtgggggcgggccggggcggcgcggagaccgtacggccaggcctccgtaactcccggaaccggcagttccgttgttgtcgtcgcggtgaagaccacgccgggcctttgccaggggcgcatgctcttccggtgtgcgctgcccgtacaccctctcgtgcggcattgtcgtggcagcatgtcccgcagcggcgtttcgctcgtcaagtgcgccgtttgtccacagcctgtggaggcggcgatgcgttggttggtgggatggagcagtatcgccgcgagcttcggcaccgtcggcgccgtcggaaacggcggagaggggcgcacggttcaccccgtgggctcccaactcctgtggggagacccggatccgctgtgggcggtcggcgactggcgacccgacgagatccgcgtcatcggcgtcgcgacccccgaaggagcgcccaccgcccgcctcgcggtcctcggctgctgcggcgccaccgacgagcagctgcgcgtcgggctgctcgccgcacgcggcggcgcgatgcgccatctcaccgcctggcccggcagttacaccgccgtcgtgcagatcggccgccgcatcaccgtcgcgggcgacctgg

SEQ ID NO: 3153 - DNA, 5662 bp, Unknown
  Kingdom: Bacteria, Phylum: Actinobacteria, Class: Actinobacteria, Order: Streptomycetales, Family: Streptomycetaceae, Genus: Streptomyces
cgccgccgcgctggacgtcctggaggccgcccgccgttcggcccgcgagggcgtctccgtcacccttctcccgcaccacgacgaagaagaggagcagcgcgcatgagcaccgcgtcccccaccatctccgagctgatcgcccaggagcgccggctcactctgccgcacttcggccacgacgacgcgttcgtgctcggcagcctgctggtcgcgctggcccgggagcggcacgcaccggtcgcgatcgacatccggcgcggtgcgcagcagctcttccacgcggcgctgcccggctccagcgcggacaacgacgcgtggatcgaccgcaagcgcaaggtcgtcgagcggtacggcgagagctcgtacctggtgggcacccggttccgggcgaagggcaccacgttcgaggagtcctcgcgcctggacccggacacgtacgcggcgcacggcggttcgttcccgatcgcggtggagggcgcgggtgtgatcggcacggtcacggtgtccgggctgccgcaggccgaggaccacgcgatggtggtcgaggcgctggagcagttcgcggcgacgacgggggcctgagcgtccgtacgcggggtgggagcggggcgccatcaccgtacgggagcggggcggggcgtcacgtacgcacacgcgacgccccgccccctcatgcgtcggcggggactacgcccccttgagctcctgccgctgccggccgagcccctccacctccagctccaccacgtcgcccgccctcaggtacggcttcggctcgggctgacccatcgcgaccccggcgggcgtgccggtgttgatcacgtcaccggggtagagcgtcatgaagtggctgagatagcggacgacctcgcccaccgggaagatctgctcggccgtgctgccgttctgcttcagctcgccgttgacccagagccgcagcgacagtgcctgcgggtcgggcacctcgtcggcggtgaccagccagggccccagcgggttgaacgtctcgcagttcttgcccttgtcccaggtgccgccgcgctcgatctggaactcgcgctcggacacgtcatgcgccgtcgcgtacccggcgacgtgcgcgagaccttcctcggccgtctccaggtagcgggcggtccgcccgatgacgacggccagctcgacctcccagtcggtcttccggctgccgcgcggcaccaggaccgtgtcgtcgggcccgacgacggtgtcgggggccttgaagaacaggatcggctccgccgggatctccgcacccgtctcggcggcgtggtcgtggtagttcagcccgatgcacacgatcttgccgatacgcccgagcggcgggccggtccgcagccccgtcgcgtccagggcgggcagcacgccgggcgcctcggcggccgcccgtacccgggcgagcgcggaggcgtcggcgagcagctcgccgtcgatgtcggggacgatccccgacagatcacgcagagtcccgtcgcggtcgagaagtgcggggcgctcggcgcccgccgtaccgactcgaagcagcttcaacggtccaactcctcttggtcgaggtggtggccctccggcgggttgcggccgacggaggacttggccgatcgtccaagagatgcgatcactccgcaagacctcgttcacacactggaccggcgcggcggacgccgattacgccgccgtggccatggcgctaccggtgaccggcatgtcgcggtacagccaggctcgctcgacggcggtccaggtggtcgtggtgacgacgtagagagcggcggccagcgggacgacggccacggtgatcagggtgaagaaggacagcagtggcatgagcttcgtcatcgcccccatgcccggcacggcctgtccgtccgggccggcggcgggcgtcatcgggttggcggccatctgccgcttggtgcgtccgtagttgaacgtggcgacggcggcgacgatcgcgaagagacccaggtagacccagccctggccgccgaagacgccgccgtgcgcgagcgcgtcgtgccagcgcccgccgagcggtgcgccgagcaggtcgtggctgagcagcgcgttgggctcgccgccgatggagctgctggagaacaggtggtagagcaggaagaacgcgggcatctggaggaggctcggcaggcagccggagagcggcgacaccttctcggcggcgtgcagctccatgatcgccttctgcatccgctccgggttcttgccgtgcttcttgcggagttcggcgatctgcggctggagccggctgcgggccttctggccgcgtgcggcggcccgcgacagggggtggacggccagccggacgagcgcggtgaacaggacgatcgcggcggcggtcgacgcggtctggaagaacggctggagcaggtcggcgagggagccgaccaggctcgcgaaagcggacatgaaggcggacatgggtgagccctccgggggtctcgtcgtgccgggaggtacctgcgaggaggtacggggtgatcactcggcatgacgaccggcgcggggacgcaccgcccgtacgggacgcacgtacgcgagaggcgcggaggcgcggaggcgcggaggcgcggaggcgcggaggcgcggaggcgtacgtacgagaaggcgtgcgggagaggtgcggggtgcgctacgcggcggccgtcaggagggcgtgcccgggtgctcggggcctggtgcggccccgggcgtcgggatcgcgctgcggaaggaacgcggtgcgctgctcccggtccctgatggccgtacggacccgggtgcggggcaccggggacgcgcagcgggcgctgatgacggagcaggcgaggagcgcggagccggcggccgcggtggcggcgagcgcgacggccgcggagaggctgccgccctcggcgaggaggacctcggtgaggaagaggacgaggagtccggcgggccgcagcagccgggcgaaggcgcggcgcagggcgttggcgtccctcacggcgtgcacctcctgcccttcgtaaggctcattcctgccgtacgagactgcgtacggcactcccttcgttatacacgatgatcggatgcgctccgggcggcccgggtaacggcgagagggtcgccctcctcccccatcggatcaccggccagcacctcggcgtcgggccgcgggtccacgtcgcgggccccggcgaaggtgacggcgagcgcgacaaccagattggcggcgagggcgacgagcccggcgttcacacctccccacgggtcgttcccgctgaagacgaggacgcagaccaccgcgacgccgacgatcagcccgctgaacgcgccccggagggtgagccgccgccagaccagggcgagcagcaccatcggaagcagctgcgccatcccctcgtacgagatgagggagaggcgtacgagggtgttgggggcggtgtacgtgagcagcagcgcgaggccgcccgcgacgaccacgacgacctgggcggcggacttctgccgatcggcgagacgcggcacgagcgacagcacgctgcgcccccacatcgtcccgatgaccagcatgaagacggccatgggcacgatggaggagagccccgcggcgaccccgatgacgccgaccgcccaggcgggcagcgagtcgacgaccagcttgaacagcgcgaggttcgactcggcgccggccagtcccggcaccacgaacagggctgcgaggccgagcagcatcgggacgaagagcagggcgttgtacgcgggcaggtacatggcgttgcggcgcagcgcgtcggcgttcctggctccgaggtatccggcgacggtggtggggaagatgacgacggtcagcgagttcaggaacgtggtgctgatgaaccacagctccccgagcccgctgcctcccgcgtccccgctcccgccgcccccgtgtcccggaagggtcagccagtcgctcttctcggtgacgagccggtcgaggaagggcccgtacccgtcgaagtagtgcagcgggacgtacagcgcgaggaaccccagggtggcgatgaccaggacgtccttcagcacggacacccaggcgctgccgcgcagaccgctgaccacgacgaagccggtggtgacggcgaaggcgacgaagtaggcccagttcaggctgacggccccgtaggagatgacggagaggaccacccccatgccggtgatctggagctggatgtacggcagcaggaacaccgtggccagcaccgcgaccaccgcgccgagccagggccggccgaagcggtgggcgaccatgtcggtgatgccgacgaggccgtgccggcgggcgtacccccagagcatcggcccgacgacgtacccgatcgcgtaaccgcaggacatgtaggcgacgacgtacaggacgggtgccccgtagttgtagccccagccggcggcccccagatagctgaagctggtgtagccctcgcccgccatcagcacccagatgaagacggggcccagactccgcccgcccacggaccactcggcgagcccgccgcccttgccgcgcccgcgcagggcgaggaggccgagggtgacggcggcgaccatgaagacggcgaagacggaggtggcgacgacggcgttcaccggcggtcccctctccgcgtgagccacacggcgaccggcgtgaggagggtcgccccgaggagccacacgaagaggaagggcatgccgaacacgaggggggtgacccggttcacgaacggcagcacaccgaggtacaggacataggggacgagcagccacagcaactggggacgtcgtctgatcactccgaacacccggggaccctactccgcgccgcccggggtctccgtcaccgcgggcgcatcgaggtgagcttcccccagacgacgagccggtagcgggagctgaactcgggggtgcaggtggtcagggtgaggtagtagccgggcgcgctgtagccggcggaggtcgtgatgttgctgcgcggcacgggcgcgatgaccccgctgtccgacggcgcggtccgcgcgagccgtttgccgacggtgtacgtgtagacggcgtcccgggtctcgacggtgatccggtcgccgccgcgcagccggtcgatgtggcggaagggttcgccgtgggtgttgcggtgcccggcgagcgcgaagttcccggcctgcccggcccgcgcggtgcgggcgtagtgcccgacgtacccacggtcgagcaccccacccttgctggtgccctcggcgacgggtgcggtcagcccgatccgggggatgcgcagcacggcgtacgcctggtcccagcggggggcggaccggggacgggcagggctgtcggacgccgccggagcgtccggcgcgccctcgggccctcgggcggaggccgaaggccgggggctcccctccctcaccccgtcgtcaacggcggccggctcgtcccactcccgccgcaggctctgcacggtgcgcccggcctcggcgcgcgcctcgcggttggtccaccagagctggtggacgacgaggaggagcagcacgacaccgagggtcacgacgaactcggcggacacccacagcccccgggcgagaagacggggcgcaccgcccccgcgccgccgcacgaccgcccggatccggaccccccgtccccgcccccctccccc

SEQ ID NO: 3154 - DNA, 6296 bp, Unknown
  Kingdom: Bacteria, Phylum: Actinobacteria, Class: Actinobacteria, Order: Streptomycetales, Family: Streptomycetaceae, Genus: Streptomyces
gacctggccgccggcggccacgaccgccgccgcccggggctcaaccacctggcgttccacgtcgcggaccggaccgccctcgacgcgctggtcgccgaggccccggcatacggctggcggctgctgttccccgaccgccatccgtacgcgggtggcgagggtcatcacgccgcctatctggaggacccggcggggtacgaggtggagctcgtcgccgactcccggccccggccctgaaccgcccggcggttcgtccgggcctccgcacccgacgggtgttcagccgagcagggcggtgagcccctccgtccgggccaggcgttccagctcgtccagggccgctgccgccgccccggccgccgccggatcgcgctcggccaggccgctcccggcgaactcgtcctcgtccaggcgcagtaccgtcgagccgtcggccgagacccacaggtccaggtcgaggtcctcgaccgccagcactccgttcgcgagcacggcgggccgggtgatgtcgcagtaccagcccttgagcccgccgtcgccggtgcggacctccttcaccgcgaaccaccggtcccgccagtagtgctcggtgaagacgtctcccggttcgaaccggacgaagccgaagtcccgaaccccgggcgcggcccacggcgcccggacggtgacgcggacgccgtcgtcccggaccagctccgccggatacctgatcttggtgcggccggccttggacaggtcgacgaccaggcccttcgtgcggcccgcgcgggtctcagagcgtgcggacatggcggacctccgtcgcgcagacctggtagccgaaccactggttgacggccagcatcgggccgttgccggtgtcgttggaggtgtaggcgtccgtgtacccggccgcccgcgcccggtgcagcgagtcgttcttcgcgagcttcgccaggccacgcccccggaactcccgcagggtgccggtcatgccgctcagatacgtccgcaggccgtcggtggtggccgcgctgaacgccgccaccttcccgtccaccagtacgaccgaggtgagcccccggtcgaaggccgggtgccgccaggtgctcgtcagccagtcctcgtagtcgtccagctcggaggtgatgtcgccgggctcgtcggccgtgacctcggcgtccgcgtcgaacagcggccggggatcgtcggcgaagtcggagccggtccggagctcgacaccggccgggagctcctgacgcggtggcagggtcccgcccgcgaggtcgaggtgctggaagtgcgctgagcggctgggcagatagccccgcttacgggcgaactccaggctctccgggttgtcgatgacccacgcgtacaggaccgtggccccggcctcggccaggtgctcctcagccgtgcgcagcagcagcgagcccgcgccgcggttggtgcggccggggagcgtctgcggcgtgaagaacccctgccccggctccgggctctcgtgggcgatgcccgcctgggccgtggcgatgatctcgccgtcctcctcggcgaccagcagccggtagtgccggtccggatgggcgtgggccaggtcatggacgacctgttcgggggtggccaccatccaggggaccgatgcccggcgggcctgggtccatgcctccgcgtcggacggccggaaatcgcgcacgatcacagtcatgcggtggaccgtatgcgcagccgcgctccggacgcctcccctttttccgccggtgggggagaatcggcccgtgactgacaagatcgtcctcgacccggactccggcatcgcgccgtacgagcaactgcgcacccggctctccgaactggcccgttccggcgcgttgcccgtcggccaccggctcccgaccgtacgcggcttcgccgaggagctgggcctcgccgccaacaccgtcgccaaggcctaccgggccctggaggcggacggggtgatcgagacccggggccgcaacggaaccttcgtcgcggccgccgggggagccgctgaacagcgggccgcgaccgcagcgcggttgtacgccgagaccgccgagcggctcggcctcacccggcagcaggccctgtcgctggccaaggacgcggtgcgcgcggcgtacggggactgaggcgtcacgcgggcacccgcagcggtcgaccggctgctacaggtacagcccggcgtccgggcccgcgtcctgcttcggcaccgaggcggggccgaagccccggcgcagcgcgtacaactcggcgagggagttgccctcccggctcaccccttcgtccgtgcccagccaggccaccgactcctgacgggtcaacgggccgacctcgatcctggccagacagcggccgggccgtacgaccgccgggtgcagccgctccaggtcctcattggtggtgacccccaccagcacgttgcggccctggcccagcagaccgtccgtcaggttcagcagccgggacagggcctggccggccgtgtgcttggcctcgccgcggatcagctcgtcgcagtcctccaggagcagcagccgccacctccccttcgccgtgccgtcgtcctcgccgatcgcgatgtccatcagatagccgacgtcgttgaagagccgctcggggtccagcacgcagtcgacctggcaccagtcgcgccaggagcgggccagggtgcgcagcgcggacgtcttgccggtgccgggcgggccgtgcagcaggagcagccggcccgcgacgtcgtccggcgtcaccttcatcagccggcccatcgcgtcggccaccggcgcggtgtagttggggcggacctcgtcccagcttccggcggtgatccggcgggtggtgcggtacgggccgcggcgcggggagacgtaccagaagcccatggtcacgttgtcgggctgcggttcgggctcgtcctgcgccccctcggtggcctggccgaggatcttctccgccagttcctcgctggtcgcggtgacggtgacgtccgcaccccggttccaccgggacgtcagcagggtccatccctcgccctccgcgagcgtcgcgctgcggtcgtcgtcgcgggcggcgcgcagcaccgtggcgtccggcggcagcagcgtcgctccggccttgacccggtcgagggaggaactgtgcgagtacggctgctcgcccgtcgcgaagcggccgaggaagagcgcgtcgacgacatcggacggtgaatcgctgtcgtcgacggtgagccggatcggcagagcggattcgggggagtcggacatggcgcccatgatccggcacggcgtgcccccgtgcacccgggtttcgcaggctcgggtggcgggaaagcggtgcgccccgcacccgacgggacgacagcggggcgtcaaggagcgcgggttgaacgaccgggggcggacggaagcacaccactcttatttttggcatgaacacttccggtgcggtgtgggtgctgctactacggagtaggcagatatcccctgctcaaggaggtcccatgaaaatgtccagactcgtggcgttctcgtcctcgctcctgctcggcgccgccctcgccctcaccggtgccggggtcgcgaacgccgactcgtccgtcgcggccgtcgactacgtcgccctcggcgactcgtactcctccggcgtcggagccggcagctacgacggctccagctgcaagcgcagcagccgtgcctaccccgccctctgggcggccgccaactccccgtcctcgttcgacttcgccgcctgttccggcgcccggaccggagacgtcacgggcggtcagctcggccggctgaacacctcgaccgacctcgtctcgatctccatcggcggcaacgacgcgggcttcgccgacgtcatgacgacctgtgtcctgcagtccgaggccacctgtctcagtcggatcgccaccgcccgcgcctacgtcgactccaccctgcccggccggctcgactccgtgtacacggccatccgctccaaggccccctccgcgcaggtcgtcgtcctcgggtacccccgcttctaccagctcggcggcggctgcctcgccggtctgagcgagaaggagcgctccgccatcaacggggcgtccgaccacctcaacacggccaccgccaagcgggcggcggaccacggcttcaccttcggcgacgtcaggacgaccttcaccgggcacgagatctgctcgggcaacgcctggctgcacagtgtgaactggctcaatatcggcgagtcctaccaccccaccgccgccgggcagtcgggcggctatcttcccgtcctcaactccgctctctgaccgaaggtccggcgctccgaccggagcgttccgccacccgccgtccctctgagcgccatgcgcagggggacggccgggcaggtcctccgaaccgcgcgaaccacccgaactgcccgaagtcgccctggaatcgcgcggattcggtaacgaggtgtcaacctccgtatgtgtgtgcgtaatcctgtggccgggatacacgggtgtcgccgcgggacgatagggttaacctgcccggaccgggtgccctcgtacgggtggggagtgacatggaacagataacggtgcgaagcaggccgcgtgtgcctgccatcacatgcgggagcggtgcgaccagtacgcgcctcgaccgccatctcgcggtgctcggcggccctgtcgtcccgcagcgcgagtcggcggaagcgaccctgctgatgcgtgagctgacctcgcgtgatgccgcgcacacccgccggagcaggagcgcacgcgtgtcgctcttcgcgccgctgcggcgactgcggcgctcgctcttcggcagccgccgctgacccacggcatcgcccgtcgggaccggcccgccgctcgggacggttcagacgatcactccgtcccggcgcagcgccgatgtctgctcgtccgtcatccccagggctcgcagcagcgcatcggtgtgctcacccagcgccggtacggcacccatccgtgcctcctcgctccccggcagcgtgatcggcggcagcagcgcccgcaacggccccaccggtgtccccaccttccgccaccggtcccgcgccgcgagctgcggatgcgccgccacatcggccaccgtgttcagccgggcacaggcgatgcccgccgcctcaagaccggccagcgcctcccgccccgtcagagccgccagcccccggctcaccgcctcatcggtccgctcccggttcgcggtgcgcgccgcgttcgtcgcgaagtccgggtcgtcggccaactcgggccgcccgagcacctgttccgccagccgccgccactcccggtcgttctgcacggagagcagcacctgctcaccgtcggccgtcgcgtaggcgtcgtagggagcgatcaccgagtgcgcgaggccggtgcgcgccgggggagcggagccgtgcgtcccctggtgcagcgggtgacccatccactcggccagcgcgtccagcatcgagacctccaccgggccgccccgcccggtgttcgcccgccgcaggagcgccgcgagcaccccggagaacgcgtacatcgccgccgcgatgtccgccgcgggaatgcccgccttcaccggccggtccgccgtccccgtcaccgagaccaggccggcctcgcactgcacgagcatgtcgtaggcccgcttgtgcgcgtacggcccgtccgcgccgtaaccggagatgtcgaccgccaccaggcgcgggtgcgccgcgcagagcgaggcggcgtcgaggccgagccgggccgccgccccctgggccaggttctggacgaacacatcggctccggcgacgagttcacggaccaccgcgaggccgcgcggatccttcaggtcgacggcgagggactccttgccgcggttgcaccagacgaagtgcgaggcgaggccgcgcgccgccgtgtcgtagccgcgcgcgaagtcgccgccgtccgggcgctccaccttgatgaccctggctccgaggtcggcgagctgccgggtggcgaagggtgcggcgaccgcctgctcgacggccaccacggtgacgccgtcgagggggagtggcaatgtgttcatgaccccgtgcttaccccctgaccggcgcttctgccacctccgcccgccctgcggactccccggcccgcgctacagcagcgcgaactgtccctccgggccctcctcctggtgcccgagcaccgatgcgggacgccgtgccgaggacggcaccggcagcaccccggccgcccgcagctcggcgcgtccgatcagcggccccgcctccagcgccgcccgcag

SEQ ID NO: 3155 - DNA, 4055 bp, Unknown
  Kingdom: Bacteria, Phylum: Actinobacteria, Class: Actinobacteria, Order: Streptomycetales, Family: Streptomycetaceae, Genus: Streptomyces
gcctggtggtggggggtgtgtggtccgggatacgcccgggtccggtcgggccgagccctggtccggtccggggtggttcggggtgcgcccggagtgtgccggggtgcgcccgggtctggtgcgggtgcggtggtcggtggcctccgggtccggtggcggggccggcagggggcggacgtcagatggcggccttcttgaggcgccgtcgctcccgctcggagagtccgccccagatgccgaagcgttcgtcgttggaaagggcgtactcaaggcattccgaacgcacctcacaggcgaggcagaccttcttggcctcgcgggtggatccgcccttttcgggaaagaaggactcgggatcggtctgggcgcacagtgcgcgctcctgccagccgagttcctcgtccgcgtcctcgaccagcagttgctggaacagctcggtcatgtgcgcccctcgtctgtctcttgcgtcccgtgatgcagccgtttgcggctgaacgacacgagtgaaattacaagtgtgtagctccgggccagtcaagcgaggatctgctattggccccgggattcactctgcggaaccaagcgtatgcagaaagtgttcaaatcagcaaaaacctgacatatgccacaggctccacagccccacaccctccccgtgaaagacgagcgaaggtgtccttgtgttgcgattcgatcaccgaagcgatcaagatcacagtcaggtcacggagcgtcagtcgcgtttgagggcgcggatgatgcgccacatgtccctgctcaggggtgcataaacctttctccggacccgtcgaccggaaggggtgaaacattgcccccatatcgggcatcgggttgacagcggccgaccgagccggtctccttggtcccatgccagcgaccacagccatgcacgtcacccacatccgtgggttccgtagtgctgtccaggcccgctgttgctgttccagctgtcacagctgttgatgccgtagcgctccagctctgatccagcctctccggtcgagcgtccttcttcgtctcctcccgctctccccgcacttcccgcggctcgttccgagctgccgacgctcaccgcgactccccgcacgtgcaccccatgccgaggaaccaccgcagccatgaacagcgacagcgaccttcagatcgccggcgacatccttgaggtccagcacctcctgcagcccgcccgcgagcacccctccaccgtctccgaattcgtcggcctcgcgcgctccgtcgcggccgaccgcgcgcagtgggccggaatcgtccagtacgactccgcctcccgctggtaccaccgcctgcaccagggccccggttacgaggtgtggctgctcagctgggtgcccgggcagggcagcggacgccacgaccacggcctctccgccggcgtactgacggtcctggaaggcgagttgaccgagcgcaccgagcgcgggacgcgcgccctcggcgcgggcgcgcagcgtgccttcgccccggggtacgtccatgaagtggtcaacgactcgctcgaaccggccgtgagtctgcacatctactacccggggctgaccgagatgccgatgcacgccacgcaaagcgccccgacggccgtggacgccgtacccgcctgacaaactgctctgcatgcgcattgttgttctggccggtggtatcggcggtgcccgcttccttcgcggcctcaagcaggccgcgcccgacgcggacatcacggtgatcggcaacacgggtgatgacatccatctgttcgggctgaaggtctgtcccgacctcgacaccgtgatgtacaccctcggcggtggcatcaacgaggagcagggctggggacggaccgacgagaccttccaggtcaaggaggaactcgcggcgtacggagtgggccccgagtggttcgggctcggtgaccgcgacttcgcgacccatatcgtccgtacgcagatgctgggcgcgggttatccgctgagcgcggtcaccgaggcgctctgcgcccggtggcagccgggcgtgcggctgctccccatgtccgacgaccgggtcgagacgcatgtcgccgtcgagatggacggcgagagcaaggcgatccacttccaggagtactgggtgaagctgcgcgcctccgtcgtggcgcaggcgatcgtgccggtcggcgcggagcaggccgagccggctccgggggtgctggaggccatcggttcggccgatgtcatcgtcttcccgccgtcgaacccggtggtgtccgtcggcacgatcctggccgtgcccgggatccgggaggccatcgccgaagccggggttccggtcgtcggcctctcccccatcgtcggggacgcaccggtgcgcgggatggcggacaaggtgctcgccgcggtgggcgtcgagtcgaccgccgcggcggtggcccagcactacggttccgggctgctggacggctggctggtggacacggtggacgcgggtgcggtcggcgaggtcgaggcggcggggatccgctgccgggcggtgccgctgatgatgacggacgtggacgcgaccgccgagatggctcggcaggcgctggacctggccgaggaggtccggacgtgagcggttctcctggcgtcggtgacggtggtccgggggccggtgacggtactcctgtggtttctgacggtgctgtggcttccggcggtgctgtggcttccggcggtgcgccctcgttccgggtctgggcggtgggcgggattcccgaagtacgggccggtgacgatctcgccaagctgatcgccgcggccgagcccggactggtcgacggggacatcctgctcgtcacctcgaagatcgtttccaaggccgagggccggatcctccgggccgccgaccgcgaggccgccatagacgccgagaccgtgcgggtcgtggcccggcgcgggacgctgcggatcgtggagaaccggcaggggctggtcctggccgccgccggggtcgacgcctcgaacacgcaggccgggaccgtactgctgctgccggaggactccgacgcctccgcccgggccatccgggacgggctgcgggacaccctcggtgtggaggtcggcgtcgtcgtcacggacaccttcgggcggccctggcgcaacgggctgaccgatgtcgcgatcggggcggccggggtgcgggtgctggacgatctgcgcggcgggacggacgcgtacggcaatccgctcagcgccacggtcgtggccacggcggacgagctggccgcggccggggacctcgtcaagggcaaggcggagggtctgccggtcgccgtggtgcggggactgcggcatgtggttacccctgtcccgtccccggacctgtccgcggcctcgccctcgtccctcgtcggcgcggacgattccggcgctcgggcgctcgtccggggtgcggccgacgacatgttccggctcgggacgtcggaggcggtccgtgaagcggtgacgctgcggcgtacggtgcgcgagttcaccgacgagccggtggatccgggggccgtgcggcgggcggttgcggcggcggtgaccgcgccggctcctcatcacacgacgccgtggcggttcgtgctgctggagtccgccgagtcgcggacccggttgctcgacgcgatgcgggacgcgtggatcgaggacctgcggcgcgacggcaagagcgaggagtcgatcgcccggcgggtgcggcgcggtgatgtcctgcgcaacgcgccgtatctggcggtgccgtgcctggtgatggacggcgcgcacacgtacggggacgagcgccgcgacaccgcggagcgcgagatgttcgtcgtcgcggcgggcgcgggcgtgcagaacttcctggtggccctggcgggtgagcggctggggtcggcgtgggtgtcctccacgatgttctgccggtccgtggtgcgggaggtgttgtcgctgccgtcgtcctgggatccgttgggggcggtggctgtggggcatgcggcgggggcgcctcccgagcggggcgttcgggatgcggaggcgtttctcaccgtgcgg

SEQ ID NO: 3156 - DNA, 4332 bp, Unknown
  Kingdom: Bacteria, Phylum: Actinobacteria, Class: Actinobacteria, Order: Streptomycetales, Family: Streptomycetaceae, Genus: Streptomyces
  misc_feature (4116)..(4126): n is a, c, g, or t
gggtgggaggcgttccgcccgccggggacggctgtggctccgcggtcgggccgatgactaggtcagacccacctcggcacaggcggcggcgtacgtcgccgtgcacacctcggcggtcttgagcggctttccgtccccgaccagaacctccgcgatgttctcccgggtgaccacggtgggggtgaagagttccgagggggtgccgaagagcgtggtggtgccccggggctcctttccctcggcgaaggcgtacgccgcgctggccgcggcttcggcgacggtcttgatgggcttggagatggtgttgtactggtcgccctcgatgatccgctgggcggcggcgagttcggcgtcgttcccggtcaccggcggcaccctcgctccggccgccttgaacgcggcgatggaaccgccgcccgtgccgtcgttggcggccaccactccggcgatcttccccgggaacttgctgatctggccgctgacccagctctgggccttgcccggttcccaggcaggggtgtcgtactcggcgaggagatcgaagccgctggagtcgaccgcgctgtgtatgcccttcttgatcaggcctgccgccgcgtcggtcggcgatccgttgacctggaggagaccgccctcggccgaggtggccctgaggtgctccaccagggacgtgccgatcatggagccgatcttctcgttgtcgaaggagacgtagtagtcggccttgaccgccgggatcggccggtcgtacgcgatgacggggacccctcgcccttgtgccgtacggacggtgctggccgccgcggcggagtccaccggatcgatcacgatgacgtcggcgccctgcgcgagagcggagtcggcctgctgctgttgcttcgccgcatcgccgcccgcgttctggtacaggacctcgcaaccaccgcagagatccttcaccttggccttgaagaggggagcgtcgtacagctcgtaccgggtggaggcgatatcgggcatcaggaatgcgatcttcgcgtcctgcgatgacctgccgtccgtgccgttcggcgctttcgtcgaacaggcggcggcggagacgatcaccgtcatcacggacaaggcagcggcgaacgatctgacagagcgttgcttcactggaatctcccggtcttcaggcggagagcctccttcgtcgcgtcaaattaacagcgcacatgttaggagtgtcaatggtcatgtcataaataacaggaccgcgggcccgctcagaggcgtccggtcaaccgatcgaccgcgcgcgagccctccattcggttcgggccgtcgccaactccgcccggtaccgctcgtatccgtcctcgtacagcgcccgtacgtccgcacgcggttcgacgacctggtggcgccccggcggagcctcgtacccgggggacagcgaggcccgggcgacggacaccacgccgagcgccccgacctgctcctccagcggaacgcggacgggccggccgaggacgtcggcgatcagccgggcccacatcaccgaccgtgtgccgccgccgcacagggcgagggtgccgctcagtcccgccgtgtccaggcagtgccgggccgcgtagccgacggcctcgcagacggcccggacggcgtcctcccggccggtcgccagactgagtccgtcgagccggccctgggccgacggctcgacgaacggcgcccgttcgcccgcttcggacaggaaggggaaggcgtggacgccccgggcgccgggcgggctgtcggtgagcaggccgtccacgtcggccgtggtcgcgccgacgagggcgagcacccactccagcgccgccgttcccaccatggcgggcatggcgcgcagccaccggccgggcgtgggcgtgcacagccacatcccggcgggctccgcgagcggatcgagatcgacccggtcggtcagcacctgggccagctccagctccgccgtcgcgaagtccaccgcctcctccacccggcccagctcgatcagcgacaccacggtgtgcagccggttcgccgcctcgtgggcctgggagcgcagcgcctgcgtgaaaccgcgctcggagtccagttcaccggagagcgcctgcaactcggtgtggtcccgcagggtcaccaccgtgccgcgccgctcaccgcccaccaccggacgggtgttgaccacgacgacccgctccgccgtcaggtgcagctcgtccacccgcgcctccgacgccagcagcgccccggtcagcggcgcgggcagggccagctcgtcgaccgtgcggccgaccgcctccgcgtccggctccaggcccagcagctcccgcccggcgtcgttgatcagcgcgatccgccgccgcccgtccagcatcagcagcccctcgcgcaccgcgtgcagggtggcctggtggtagtcgtgcagccggctcagctcggccgcgttcatcccgtgggtgtgccgccgcagccgcgcgttgaccacgtacgtgccgatcccgccgagcgccagcgccccgcccgcggcgagcgcgagcgcgccgagctggtcccgtacctgcgaggagacccggtccacggtgatgcccgcgctgaccaggccgacgatcctcccgttgtcgcggatcggggtcaccacccggatcgaggggcccagcgtgccggtgtacgtctcggtgaaggtctgcccgcgcagggccttcgcggtgttcccgaggaaggtgtccccgatctgcgccgtgtccggatgcgtccagcgcacccgctcggggtccatgatcgtgatgaaggcgatcccggtgtcctcgcgcacccgctccgcgtacggctggagcgcggcggacgggtccggggtgcggatggcctcccgtacggaaggggaatcggccactgccagcgccgccacccggacctgccgggcggccgtctcctcggcctgcgcgctgcccgagacgtacgcgaagacggcgcaccccgccaccaccgcggcgatcagcacgacctgcatggcgaagagctggcccgccaggcttcgggggcgggtacgggggaggcgcataccccacagtctgcctcgctccgccgggcctgctccgggtggccggaaagtgactgtgaacgatatgaacacaagggtgaccggggtcacagagcggtggatagtcgccggagcccccagggacgggggcgtcatgaccgagccgaggagccccaccatggctgtggcagccaaacaacgggaccgcacccactacctgtacatcgccgtgatcgccgccgtggcgctcggcatcctggtgggcttcgcggcccccggggtggccgtcgagctgaagcccatcggcgccggcttcgtgaacctgatcaagatgatgatctcgccgatcatcttctgcacgatcgtgctgggcgtcggctcggtccgcaaggccgccaaggtcggcgcggtcggcggtctggcgctgggctacttcctggtcatgtcgaccgtggccctcgccatcggcctgctcgtcggcaacgtcctggagcccggctccaccctccacatcaccgagcaggcgcgggcggcgggcgaggcgcaggcgtcgggcgcgagcgagtccaccgcggacttcctgctcggcatcatcccgacgacgatcgtctccgccttcaccgcgggcgaggtcctccagaccctgctcgtcgcgctgctcgcgggcttcgcgctccaggcgatgggctcggccggcgagccgatcatccgcggcatcacccacatccagcgcctcgtcttccgcatcctcgccatgatcatgtgggccgccccggtcggcgcgttcggcgcgatcgccgcggtggtcggcgagaccggcctcgacgccctgaagtccctggcgatcatcatgatcggcttctacgtcacctgcgcgctgttcgtcttcgtggtgctcggcgcgatcctgcgcctggtcgccggggtcaacctgttctcgctgctgaagtacctgggccgcgagttcctgctcatcctgtccacctcctcctccgagtcggccctgccgcggctgatcgcgaagatggagcacctgggcgtcagcaagcccgtcgtcggcatcaccgtgccgaccggctactccttcnnnnnnnnnnncggcgggtgtgaccggcgcgggtctggccaccctggcaggcgggctccagtcgcaccgacccgaactcgtcgacggcgtcggcctgatcgtcggcatcgaccgcttcatgagcgaggcccgcgcgctgacgaacttcgcgggcaacgcggtcgccacggtgctggtcggccactggaccaaggagatcgacaaggaccgggtgaac

SEQ ID NO: 3157 - DNA, 2371 bp, Unknown
  Kingdom: Bacteria, Phylum: Actinobacteria, Class: Actinobacteria, Order: Streptomycetales, Family: Streptomycetaceae, Genus: Streptomyces
cgggtcaccgtctgcgacgcccgccccgtcttcgccacccgcgagcgcttccccacggcggacgaggtcgtccgcgcctggccgcacacctacctggagtccaccgaggtcgacgcccgcaccgcgatctgcgtgctcacccacgaccccaggttcgatgtgcccctgctcgtcgcggccctgcgcacgcccgccgcgtacatcggggtgatgggaagccgccgcacccaccgcgaccggctgacccggctgcgtgcggccggggtggacgaggcgcacctcgcccgcctcgcctcacccgtgggcctcgacctcggagcccgtacgccggaggagacagccgtctccatcgccgccgagatcatccagcaccgctggggcggcacgggtcggccgctcggcgagctgtcgggggcgatccaccacggcggaccggccgcccaggggtagtcggtcaccgtcgcaccgcctcgcgcggcgtcctcccccgcctgcggcggcacgccaccgctctcgcccggacggtccatcgcgcgccattccggccgcagccccgtcagattcgtggtgaggaagtacgcggccgcgcaagcgagcagcaacggagtcggtccgttcgtggacgggccgaccgccgccacccgggagcgtccgccgtcaccgcgtctccgttccctgcgcaggggcgtccggacggtcggacacgtcatctgttgtcagacggcgcagcctggaccgcgaagagttcttcgcgaagaactcttcgcggtctgttccccgcggtacggccgatgagttccgggtcgggcgggggtcatccccgggggaccgcacgcaggcaagtgttcgcacctgaaggagacgccgtggccaagctcatctactccatgatcacctcgctcgacggatacgcggaggcgacggagggcggcctcggcaccggggccgaggacccggaggtgcacaccttcgtcggcgacctcttccgccccgtcggcacgtatctctacggccggcggatgtacgagacgatggtctactgggagaccgcgcacaccgagcccggccggccgccgtacatcctgcagtacgcccgcgactggcaggccgcggagaaggtcgtgtactccacgacgctcgatgaggtgtccagcgcgaagaccaggatcgagcggaccttcgacccggacgcggtgcgccggctcaaggccgaggccgaccacgacctcacggtcgacggaccgaacctcgcggcccaggcgatcgcggccggcctggtggacgagtaccacctgttcatcaccacgagtgtggtgggcggcgggaagcggttcttccccgacagcgtgcgtctcgacctcgaacgggtcgaggtgcgtgcctttgacagcggactgatctacgcgcgctaccggacccctgaagtccgctgaccccgggccgggcggaggcgctcgcccggggccgacgcaggactccctccgccttcctcagggcggcgacggagtacggagatgctcaggcctccccgccgcacgccgccgcccagtggcacgccacctgggtgtccccgccgccgctcagcaccggcagatccaccgtgcggcacgcctcggccacccccgcccgatccgcctcgcccgaggccaggacctggcagcggacgtggaaccggcagccggagggcaccttcgaggggtccggcggttccccggccagcacgaccggttcgccttccgcctccgggagcacggacaacagggcccgcgtgtacggatgccgaggggccgtgagcagctgctcgaccggacccgtctccacgatccggcccagatacatcaccgccacccggtccgcgatgttccaggcgagccccagatcgtgggtgacgaccagcgccgagagccccagctcgtcccgcaggcgcagcagcagcgccaggatctcgccccgtaccgacgcgtccagcgacgccaccggctcgtcggccacgatcagctccggctccagcaccagggccccggcgatcacgacgcgctggcgctgaccgcccgacagctcgtgcgggaagcgcaggaagaaccgttcgggcggtcgcagcccggcccgggacagggctccggcgacggcggcccgctcgtccccggcgtacccgtggatgcgcaacccctcggccaccgcgtcgtacaccgtgtgccgggggttgagcgagccgctcgggtcctggaggaccagctgcacgcgcttgcggtacgccttcagcgcccggcccgagtagtcgagcggtgcgccgccgaaggtgacccgccccgaggtgggcgggaccaggccgagcagggaccgggcgagcgtcgtcttgccgcagccggac

SEQ ID NO: 3158 - DNA, 3831 bp, Unknown
  Kingdom: Bacteria, Phylum: Actinobacteria, Class: Actinobacteria, Order: Streptomycetales, Family: Streptomycetaceae, Genus: Streptomyces
gctgcccactccgacgggtgacgccaaggcgttccggcgcctggcccggcggcgcaaccgccgggtcgtggacgcccgtggcctggccgcgatcgaccgtgccgaacgggaccgggggcggcgcgacgggcggccccgggtgaagctcgccaccgtcgacgagctggtcgcgacggcgagagcgggccggctcctgcggctgtcgcgctgactgttcgccgcgatcgccgctcgtacgaaatccggcccggggcacggcggttcaaccgccgttccccgggccgcgctctgttcgggcgacgatcaggccttggactccgaggcctccggcgctcctgagggggcgttcgaatcggccggccgaagcggcgcggtcgccgggcgtacggggatgagggcggcgacgagcgccgccgtgaggcccaccccgcagccgatgagcatcgcgacgcggaagccgtcccgggaggccagcgggaagccgccgaagtccgtggtcatccgggccaggaccacgccgatcaccgccgccgcgaaggacgtgccgatcgaacgcatcagggcgttgaaactgttcgccgacgcggtctcggaccggggcaccgcacccatgatgagcgcgggcatcgccccgtaagcgaagccgacgcccgagttgcagacgagggtgacgatcagcaggctccacggggagtccgcgccgatcagcgggacggacaggccgtagccggcggcgatgaggaggctgccgacggccagggtgaccttcgggcccttggcggcggacagcttcgcgccgaccggggacatcgccatcatcatcaggcccgccggggccatccacagacccatcgcgagcatcgactggcccaggccgtacccggtggcctcgggcagttggagcagctggggcacgacgagggactgcgcgtacatcgcgaagccgaccaggatcgaggcggtgttcgtcatcaggacctgggggcggacggtgacgcgcaggtcgaccagcggttcgctgaggcgcagttcccaccagccccaggcgggcagcagcaccagcacggcggcgaagagggcgagcgtggcgacgctgccccagccccagtcggcgcccttggagacggcgagcagcaggcagatcagggcggcgcccaggccgacggcgccgagcaggtcgaagctggtggaccgggtggccgggcggtccccggggaccagggccaggatcagcgcgccgaccgcgacggccagcacggcgaccacccagaacagcacccgccagctggtgttctccgcgatggcggcggcgaacggcaggcccagcgcgccgcccacgcccatcgaggcgctcatgaccgcgatggacgggccgagcttctcggccggcaccacatcacgcagcaggctgatgccgagcgggaccacgcccatgcccaggccctggagcccgcgtccggcgatcatcgggaccaccgacgaggacagggcgcagaccaccgagccgaggaccagcgggacgagcgagacgagcagcatgcgccgcttgccgtacatgtcgccgagccggccggcgacgggcgtggccacggcggcggccagcagggtggcggtgatcacccaggaggcgttcgagggggaggtgtcgaacagcttcggcagctccgcgatcagcggcaccaccagggtctgggtgagcgccgccacgatgccggcgaaggccaggatgccgaccacgcctcccgggcgggctgcggggggtgaactctccacgggtgctgctccctcttgcccttccgggcctgtcgtcggttccggctgtcggttccggtcgttcgtgctcgtgctctgtacgcgcgctcggcgttcgagactatgcaagatacacggcttgtgcatgatgcatagcatgtgcatcatgcacatctatcgtgatagacctggtcaacgaaggaagcagcgcgtggacaagcccatcgaccggatcgaacgcgagacgatgctgctcggccggtacatgcacatggtcaccccgcgcgtggactggcagctcgaccgttccgcctacatcctgctcagccggatccaggcggaaggtcccatgtccatcagccagctcagcgacgccttcggtctggacgcctccacgctcaaccggcagaccgccgcgatgctgcgggccggggtcgtcgagcgcatcccggaccccgacggcggcatcgcccgtaagttcgccatcaccgaggagggcgagcgccgcctcgacaacgaccggaccaggaatctggcgggcctcgcgaaggtcctcacggactggacccccgaggaggcccagcaactggccgactccctcagccgcctgaacctctccatcgagcgtctcgacggacggccctggccgcgcgactgaagcgcggcccggcacgcgtcccggtggctcagtggcggcccgcgatgcggtccgccacccgggcgacggggtccgtgccggggcggggtgacccgctctcgcggcggtcggcggcgcggtaggccgcgtacatgccgtggacgccgagccagcggaagggttccggctcccagcggcggaccttgtgattgacccagggcagggtggtgagatccgtcggtcccgcctggccggagtcctgctggatcaggtcgcgcaaggtgcgggcggcgaggttggcggtggcgacgccggagccgacgtaaccgcccgcccagcccaggcccgtggagcggtccagggtgaccgtggcgcaccagtcgcgcgggacgccgaggacgccggaccaggcgtggtcgacgtggacgcccgccgtggtggggaagagccggaccatcaggtcgcgcagggccgcgaccgtcccgggccgggtacggccgtcgttgtcggtggccgagccgaagcggtacggatagccgcggccgccgagcgcgatgcggtcgtccgcggtgcgctgggcgtagaagtaggcgtgggccatgtcgccgagggtctcgcgaccctcccacccgatcgtgtcccagatccgggcgggcagcggctcggtgacgatcatggaggagttcatcgggagccaggtgcgcttctggcccttgaggctcgcggtgaagccctcggtgcagcgcaggacgtacggggcgcggaccgtgccgtacggcgtcacggcgtgcttgggcttgatctcggtgaccggcgtcgactcgtggatggtcacgccgagcgcctccaccacgtccgcgaggcccttgaccagcttggccgggtgcagccgggctccgtgcggggtccaggtcgagccgacggccccggtcacatggacgcgctcggcggtctcgcgggcgccgcgcaggacccggtcactctccccgaaggcgatctcgacactgtggaagtccttgagacgggcgagctgggagggggtgtgggccacctccaggacgccgccccggtggatgtccgcgtcgatcttctcctcggcggcggtcctcacgacctcgccgacggtctcgttcatcgccttctggagccggacggcggcgtcgtggccgtgcagcttggcgtaccggtcgcggcccgcgatgccgttgtacagccagccgccgttacggccggaggctccgtaaccgcagaacttggcttccaggacggtgatgttgaggaaggggacggccttcttcaggtagtacgcggtccagagcccggtgtagccgccgccgacgatgcagacgtcgacgctcgtgtcgccggggaggggttcgcgcggcgtgggggtgccctcctgcgcgtaccagaacgatatgccgccgacgacggtactgacg

SEQ ID NO: 3159 - DNA, 6486 bp, Unknown
  Kingdom: Bacteria, Phylum: Actinobacteria, Class: Actinobacteria, Order: Streptomycetales, Family: Streptomycetaceae, Genus: Streptomyces
cggatcagcggcgcgagcgagcgggcgaccctgcccgacgagctggtccgcacggtgcgcgaactggacggcgtgcgcggcgcggcgccggtacgggtcgagtacagcgtgaacatgccggatgccgcggcaggtgacagcggtgcgaacggagacggcaccggctcggacgactccggtacgggtgcgggtaacggcagcgcggacgacgcgaaggccgcggccctggtgggcgtcgatcccgcgtcgtacgccgaactggcccgcgcgaccgggctgcccgccttcccggccgcccggctgaaggccaccggctcctcggcccctctgcccgagggagcgaaggccggccccgagagggtcctgccggccatcgcctccccggcggtggcggcccgcctgggcagggagccgcgcgcgatcgagacgctgtccggggacttcgaggtccaggtcgtggggaccgtgtcgcgcgtcgcctccgtctcccccacggacttcctgatcgtgaactccgccgccctggagcagaaggcgcccaccagactgctcctcaccggcgcaccggatcccgggagactgcgcgcggcggtcgaaggaaacggcaaggagtacgccgtacagctgcggtccgaggagcgcgcgcggtatgtgaacaccccgatgcaggcgggggccgagcggatctacctcgcggccgtcgcggcgggcgccggatacgcgctgctggccgtactgctgtcactgctccagaccgcgccggagcgcaagacgctgctggcacggctgcgcacgatgggactcaccaccgggcagggcagaaagctgctggccttcgaggcgacaccgcaggcgctgctggcggcgggcggcggcctcttcaccggctgggcgaccatcgtcctgctctcccccggcatcgatctggtcccgctggcgctcgcgggcgtcgccggatcggacacgagccccgtcctgctgcgcaccgacctctggtcgctggcgctcccggccgccggggtggtggcactcgccgccgcggtcgcgggcgttcaggcgtggtgggcgagccgccgcggatcgatcaccgaactcagggcaggagactcccgatgacctcgtccaccgagaccgcaggcacggcccgcgcggccgaaacgacgctggcggagctggaacagcgggccgcggcccaccgggaccgcccttcctacgggcacgacgcgctgatcgcctgcgaccgtgtggtgcggatcttcaccacggacggggtggaggtgcaggccctccagggcctcgatctgctggtcaccgagggcgagttgatggccctggtgggggcgtcgggcagcggcaagtcgacgctgatgaacatcctggcgggcctggacgtgccgacggcgggatcggcgaaggtcgcgggctgcgatctgctgtcgatgggcccgaaggaacggctgcgctaccgccgggacgtggtcgggttcgtctggcagcagaccgcccgcaatctgctcccgtatctcaccgcgatccagaacatcaccctgcccatgcagctgcgcggtggcggcggtaagcgcgaacgggcggcccgagccgagtcgttgctcgccatgctcgacatcgcggactgccgcgaccgccgcccccagcagttgtccggcgggcagcagcagcgggtggccatcgcggtggcgctggccaactccccttccgtgctgctcgcggacgagccgaccggagagctggactcggccaccggggagcaggtcttcgccgcgttccggcgcgccaacgaggagttgggcacctcgatcgtgatcgtcacccatgaccaggcggtcgcgaacgaggtgcggcgtacggtcgccatccgcgacggccgtacgtcctccgaggtgctgcgccgtacggaggtggacgcggcgacgggccaggagtcccaggtggcccgggagtacgcgatgctcgaccgggcgggacggctccagttgcccgcggactacacgcggacgctggggatggaacaccgggtgctgctggagctggagcaggaccacatcggcgtctggccggacgcgcacggaacggccccggagaagccgggcgagtagaggcctcgggagcgggcgccggggtgcgcaccggcaggcgggagcacggcaagcagggcgtgggaccttcgggtcagcgggggccgacggtgaagggcagggcgccgagctcgccgctcgtcgcgcggcgcagggcgatcgagccgtacggggtccgcagccggagccaggtgcccgaggacagcagcgacaccgggaacttcgcgtcggcccggaggaagccgagggactgggccgcgtggacggcccggagcggaaggtccgtgtcgccgaccggccgggaccagatctcccggccgatacggtcccgctcggagcgggtgcgccgctcctcgggcagggcctcgtcccgggtgcggaactcggtgacggctgcctccagcgcggtgcgcagggcgcccggcccgggcagccccggctgctccagccagggaccccggggtggcaggacaccggtccagggcggcccggtgacgggagcgggcagcgtgccggagcccggctccgggtcacccgcggggtcgccgggccccggaacgtcgagggtttccagcagctccccggccgacaccgtgacgtcgagcgtctcggggcgggccaggcgggcggcgcggatggcgaggacctcgaaggagggcggacggccgaacacggccagtgcgtcgccgccgcccgcctgcagccggaccgcggcggcccggtcgtagtggagcagccggccgaggaaggcggcgagatccgccgcctccctcgcgtcggcgaaccgcagcgactgcacgggcacggtcatgccgcggcgggctcctctgcgaggtactgctggaggaagagcttctcctcggcggagatccgccggggccgctccgccgccaggtcgtacggcacgacgacggtcgaggcgcgtacgtacacctggtcggggtccttgatctcataggcgatcgtcagcgacgcggcgccgatcttcgtgacccacgactcgacggtcaccggctcatgccggtggaccagcggccgtacgtagtcgatctcgtgacgggccacgacggacccgcccgagaacgacggcgagccgtccccgggcgccagccggaacatgaagtcgatgcgcgcctcctccaggtagcggaggaagaccacgttgttgacgtggccgaaggcatccatgtccgaccagcgcaggggacagctgtagagatgacgagccaagacgatcagcctcgcgtgagcttcttgtacgtggcacggtgcgggcgggccgcgtccgcgccgagccgctcgatcttgttcttctcgtacgactcgaagttgccctcgaaccagtaccacttcgagtcaccctcgtaggcgaggatgtgcgtggcgacgcggtccaggaaccagcggtcgtgggagatgaccacagcggcgcccgggaactccaggagggcgttctccagcgaggagagcgtctcgacgtcgaggtcgttggtgggttcgtcgaggagcagcaggttgccgccctccttgagcgtcagcgccaggttgaggcggttgcgctcaccaccggacaggacgccggccggcttctgctggtccggtcccttgaatccgaacgcggagacgtaggcgcgcgagggcatctcgacctggccgacgttgatgtagtccagctcgtccgagacgacggcccagagggtcttcttcgggtcgatgttggcgcgggactggtcgacgtaggagatcttgaccgtgtcgccgaccttgatggcgccgctgtccggcgtctccaggccctggatcatcttgaacagcgtggtcttgcccgcgccgttcggaccgatgatgccgacgatgccgttacggggcagcgtgaacgacaggtcgtcgatgaggaccttgtcgccgaaggccttcgagaggttctcgacctcgacgacgatggaaccgagccgcgggcccggcggaatctggatctcctcgaagtccagcttccgcatcttgtccgcctcggccgccatctcctcgtaccgggcgagacgggccttggacttggtctggcggcccttggcgttggaccggacccactccagctcttccttgagccgcttctggcgcttctcgtccttgcggccctcgaccttgaggcgggtctgcttcttctccaggtacgtggagtagttgccctcgtaggcgatcgcacggccgcggtcgagttcgaggatccactcggcgacgttgttcaggaagtaccggtcgtgggtgacagcgatgacgcagcccgcgtacttcgacaggtgctgctccagccagttcaccgactcggcgtccaggtggttggtgggctcgtcgaggagaagcaggtccggggcctcgatgagcagcttgcagagcgccacccggcgcttctcgccaccggagaggttggtgaccggccagtcgccgggcgggcagcccagggcgtccatggcctgctccagctgggcgtccaggtcccacgcgttcgcgtggtccaggtcctcctggagcttgcccatctcctccatcagcgcgtcggagtagtcggtcgccatcagctcggcgacctcgttgaagcgcttgagcttgcccatgatctcggcggcgccgtcctggacgttctccaggacggtcttctcctcgtccagctttggctcctgcatgaggatgccgacgctgaacccgggcgtcaggaacgcgtcaccgttggacggctgctccaggcccgccatgatcttcagcaccgtggacttaccggcgccgttgggccccacgacaccgatcttcgcgccgggcaggaagttcaaggtgacgtcatcaaggatcaccttgtcgccgtgcgccttgcgcgtcttgcgcatggtgtagatgaactcagccaagagaaaccgtccggcagcaatagaggtgtgagcagatacacccatcttgcctgacggccctccccggaaggaaacccgcccacccgccggcacccgaaccggtcacctcatgcgtgcggacgctcactcaccgtcggtgtgcggctacttccggcggaggacgaagaccgcaccgccgccgaggacgagcagcccgatggcgacggcggcgagcatcggagtggcgctggagccaccggtctcggcgaggtcgccctccagtcccgacgtggtggagccggtcgtggccggaaccgactgctgggcgctccgcgtgccgatgtcgttgccggcgtcgccctcgctctcccggtccaggacgctgccactcgtggcgcagtccagcaccccggtgaaggtcctggagaatcccgcgggcccggtgatggtgaagtcgtacgcctggtcctcggcgacggggaccgtcaccgtgcgggtcgccccggcggcgatggtgtgctcggttccggccagctcgaaggtgaacggctggtcgccccggttggcggccgtgatgtccacgccgcccgtggcgcagttcttccgcgcggtcagtgcgggggcggcgcccgtctcggcccaggtggcgccggcccgtgcggagaccgtggactcgctggagccggccaggatctgggtctgggtgcggccggccccggcgaaggcccggccgaccggcacggaggtcgttgcctggacggccagggaggcggtgccgtcggcggtgtccttcggcacggcgaagtagagccggtccccgtccgtcgccgaggtgaccggggcacccttgtcgtccgtgaccgtgacgccgctggccgccgcgtccaccggaggcgacaccgagacctggtccgcgtcggtgcggacggtcacggggccgagccgctcaccggcccggccggagacggcggccggctccagggtcagcgaggcccggggctccttcgtcttgcgcgcgttgcggtgcagccagtcggcgagtttctccgcctgcttgtccgacgcggtgacatcggcgttgtccgagtagcgccagatggcgacctgggtcccggcggcggcggtccgctcggtcagcggaccggtgccggccgcgtcggcgagcgcggccaggtcgtcgacctgggggtaggagtgctggaggatccagcggatcttccccgcgttccggttgccgctcagcgaggtctcggcccagggggtctccaggtacttcgcctggtcctgggtggggttgtggaggtcgatgcagtaggtcttgagcttgccgccgccgtccacggtcatctcgaacagtccggcgggcagttcctgggtccgggcgggagcaccgttcttccccgcgatgcggagcacggcgctgtcgaaggtcttcagcccgtcgagcaccgcggccgcaccgctgtggtgccgacccgggtcgtcggccgccgccggtccggcgccgacga

SEQ ID NO: 3160 - DNA, 717 bp, Unknown
  Kingdom: Bacteria, Phylum: Actinobacteria, Class: Actinobacteria, Order: Streptomycetales, Family: Streptomycetaceae, Genus: Streptomyces
ccggggccggggacggggtggacgggcggtggtccgcggagcccgtcgcgtgccgtacgcggtcgcctccctgcgtccggggcggcggcgccaccgagcgggccaggccccgggtgacggcctcctgaatggatccggccagtccggtggcctcggccaccccctggtcggcgagcatctcggcgagcccgccggcgtacccctgtcccacggcgcggaccttccaggcgtcctggcggcggtagagctccagggcgctgaccgcggactcggcgtcgaggccggtgagcgtgaaggtggcgatctcggcgccgtcgagcccggtgacggcgacgaagggggcgggaacggcgccgaaccgtgccggcccgccggctccgacgggaagcgcgagcagcacggtgacccggtgggcgcctgcgggcagtgcctccaggtcgacggcgagccggtggtcggccgccgcctgctgggagacctccagcccggggagctggggcgagccggggtgggcgatccactcgacgccgcgcaccgtgccccgttcgtcgccgagggtggccccggccacgacgggtgtgcccgccgagacccggatctccagacgggtctggggcaaggtgtggttctgcccccggaccagttcggccgtcattgccctgtccccctcgacgatggcccgcgcgccgttgggcgcggtgccgtgcgtgccgcgtt

SEQ ID NO: 3161 - DNA, 2366 bp, Unknown
  Kingdom: Bacteria, Phylum: Actinobacteria, Class: Actinobacteria, Order: Streptomycetales, Family: Streptomycetaceae, Genus: Streptomyces
cgccgacgcgggcaggtccacccccgccgtcctcagctgctcggccgtcagccacaccgccgccgcgcccggcagggtccgcgccgcgttctccacgtacgggccgccaccggtgaccttgacctccgccaccatcgtgacgagcaggtcgcaccggacgagatacagcggggccttcttcggtgtgtgggcgttgcgctcgacggttcccgacaccgtggcggccccggcgtcgcccgtgctcgtcgtccggtatcccgacagtccctcgccgacgcgccactcggcgccgttctgcacgccggtcatcccggcctgcaccgtgctcgccgtggtgctgccccgctgaccgccggcctggtggccgcccagcacgaacgtctccgtgcccggccccgccgcctcgtgcaccagctgcggagccgtcagtgccagcctggtgcccaccgcgccgttcagcgcggccagcctgcgcggatagcgcaggttcttcaccacccacccggaggacgcggcctgccgcagcgcggcggtgatcgcccgggggctgaagcgttcctcgacggccagccggggcgcgaggccctccgtggccagcgccgggtcctggcggcccgccccgccccgggcggcggcccgggcgaggagtgcgagggcgaggtcgcggaccggctgcccgtcgccgacggtctccaccagctgccagtcccgcaccagtcccccggcggccggtaccggggtgagcgacgccaggtcgccgatgcccgccgcggcgaccgtccgctccgggccgggtgcctgcccgtcgcccgcgtccagccgccgcttctcctccgtgcccaccgtgaactcggccggcgtcagcagacgtacgtcctgctcctccaggcgcaggccggacagcagcctggcctccggcacgtcccggccgggtccgcccggggtcagggcacgggccagcttgcgctgccgcgaggtcatggtgacgtccacgttcaggcgcagcgccgccccgaacgcgctcgccttctccgatccgttggtgaggacgtcggtacgggtggtggggccgccctggttgcggcgggtgccggtgttctgccgctcgtagcgggccgagccggtgagcacacccggcaccagccgggcctgggccagcaccatgccgccgatcgaccgcgaactgctgcgcccgctctgcacgttcgcggcgacaccggcgtggctgcgcaccagccagtcgtcgatgtcgccgaggtggctcgtcccggccaggtcaccgtggacccggagttggacgtcgtgggcgtgcatggtggtcttgcggcgcagccggacccggatgccggtggacaacaactggtccttgttcacccgcaggttggtctcggagagcgcggccatcagctcacggtgattgtggcgctgcgcctcgtcctcctcacggctgaggcccgccgggggcgcggtgacgccgaaggcggggagatacccggtcagccgggggtcggtggcgaacagctcccgtacggccttcagcaggggtgcggtgtcgagccggccgagcgtgacgctcgatcccatcgcaccgaacggcaggtggcgttcgtccgccgcctgctctccctccggcaccccctcctgtgtcccctccggcccggcgcccgcctgccgcgcctgcggcggttcgacgaacgcgcccgccgtcactccttgcggcagcggcaggcccaactcctgtgcctcgtccgcccgcaggccgacccagaaccgcatggtgtgcgtggcgacccgcgtctccgggcgcaggatcatcccggccgaccggggtccggtgccctccacggtcagccgcacggtgccgaggtacagcaccttctcaccccgcacctccgcgccctgccggctggagacggtctgctcgttcacgctgaaccgggacgcgcgggccccggcgaccggcatcgcggtggcccgtaccacggccgcgttggccgccgccccgaacccggccgccgggccgatcccgccggtgacggcacgccccttgcccgccgcctcggtcgtggtgtgctgggactgctggtgggtgcggagctgggtcccgccggtggcccaggccggggagagcccggtgaccactccccgcatgcggtaactgcctgcggtgctgccgtccttggagtgcagatcgtccccggtgacgccgtcgcgcagcagccggggcaggtcctccagcacggtgggggtggcggtcgccccgtacaggcgggagcggccgggcgctccgggtgcggtcagcgaggggtgcaggacggaggcgaccgcgtcgaacagcccgccgccgccctcgtgcggtcctgcgg

SEQ ID NO: 3162 - DNA, 4776 bp, Unknown
  Kingdom: Bacteria, Phylum: Actinobacteria, Class: Actinobacteria, Order: Streptomycetales, Family: Streptomycetaceae, Genus: Streptomyces
gtcggcgagctggaaggcgatgccgagccgctcgccgtactgcgtgaggacgtccacggtccgctcgtcggcgccggacatcatcgcgccgaagcggccggacacggcgaccagcgagccggtcttgccgctgaggacgtccaggtagtggtcgaccgggtcgcgtccgtcgcgcgggcccgcggtctccaggatctggccggtgacgagccgctcgaaggcctcggcctggatgcggacggcctcggggccgaggtcggccaggatgtgggaggcgcgggcgaagaggaagtcgccggtgaggacggcgacggagttgccccagcgggtgttggcgctgggcaccccgcgccgcacgtcggcctcgtccatcacgtcgtcgtggtacagcgtggccaggtgggtcagctcgacgacgacggcggacgggacgactcccggcgcgtcgggatcaccgaactgtgacgcgagcatgaccagcaacgggcggaaccgcttgcctcccgcgcgcaccaggtgctgggcggcctccgtgatgaagggcacatcgctcttggtggcttcgagcaggcccgtctcgacagctgccaggcccaactggacatcggtctcaagagactggtcccgcacgtgcagtccgaacggcccgacgacggtcacgagggcatctcctgtctgctgacgatcacacgcaatgtcgatgtgtcgctgtcttcactcaactcagcgtatccggtcccctttggatcaccgtgggcggcttcccgccgccgccggtatgttcgggatcagctcatacgatcaggagtccccgttttgtcccacagcaccgccggcaccgagccgacccagcccccgcccgaggacgatcacgccttcttcgggcagccacggggcctgatgaccctgtccggcctggaggtctgggagcggttctcgttcctgggcatgcaggccattctggtgctgttcttcgccgacacggtggcgaacggcggcatggacatggaccccggaaccgccgcttccgtctccgccgcctacgggacgctggtctatctggtctccgtggcgggcggctggctggccgaccggatcctcggctcgtaccgggccgtgctgtacggcggcatcctcatcgcgtgcggccattactccatggcggttcccaccgacgccatgacctgggtgggtctcggcctgatcagcgccggaacaggcctgctcaagccgaacgtggcctccatggtcggcaagctctaccgcaccgacgacgagcggcgcgacgccggcttcgccctctactacatgggcatcaacatcggcgccttcgccgggccgctgatcaccggctggctcggcgaccacgtcagctggcactggggcttctcggccgccgcggtcgggatgaccctcggtctgatccagtacgtggcgggccgccgtcacctggccgggcgtaagcacgccgccgaattcgcgctggcccccgaggcgatgcgccgcgcggtccgcctgatcatcggcggggccgtcgtggtcgccgcggtggccaccgcgctggccctggcgggctggctgacgatggaccggttcgtcgacgtgctcaccgtcatctcggtgatcgcgccgatcgtctacttcgtggtgatgttccgctccccccgggtcaccgccgaggagcgcggcagactccgcccgtacatcgtcctcttcctcggctccgtcgtcttcaacttcatcctcttccaggcgtactcgacgatgatgctgctcgcgtcgacgaacgcccggaccgagatcctcggcttcaccttcccggccagctggtacgcctccgcgctcggagccttcgaggtcgcgctcgccccggtcgtcgccgcggtctgggccaggatgggcctccgccagccgcacgcctccaacaagatcgccttcggggtgatcctcggcgggctctccttcctgctgatggtcctgccgacctccgggcacgccgacgacacgtaccgcatggcggcctggtggatcgtgggctcgtacctgctgctcgggctcggcgacatcctgctggagacctccggcatgtccgccaccaccaagctcgcccccaaggcgttcgccagccagacgatggccctgtggttcctctcgctcgccctggccaacggcatccaggcccagatcgtgaagctgtacggagaggtctccaaccccgcctacttcggcgtcaacggcgccatcgccgtggcggcgggcgtggcgatgatcgccgccgccccctggctgaaacgcacgatgcaccccgtccactgagcgcgccctccgccccccgtcgtcgtacatcgaggtgacccatgaacatcacgaccgagttcccgtacgagaccacccgcgaggacgtctccatcccgctgtccgacggcacccggctctacgcccggatctggcggccgctgaccgacgaaccggtcccggccctgctggagtacctgccctaccggctcagcgactggaccgctccccgcgactggcagcgccacccctggtacgcgggccacggctacgcctccgtacgggtcgacgtccggggccacggcaacagcgagggactgccgggcgatgagtacgacgcgcgggaactggaggacggggtcgccgtcatccactggctggcccagcaggagtggtgctccggacgggtcgggatgttcggcatctcctggggcggcttcaactcgctccagatcgccgcgctcgctcccgagccgctgaaggcgatcgtcaccgtctgctcggccgacgaccgctacgacaacgacgtccactacatgggcggctccgtcctcgccgtggacatgcacgcctgggccgccaccatgctcgccttcgtctgccggccgccggaccccgcgcaggtcggcgacgactggcgggagatgtggctgaagcggctggaggccgtcgaccccttcatccacacctggctggcccaccagagccgcgacgactactggaagcacggcagcgtctgcgaggactacggcgcgatcaaggcgaaggtcctcgcggtcggcggctggcacgacccgtaccgggacaccgtcctgcggctcgtggagcacctggacccggagcaggtgcgcgggctgatcggcccctggtcgcaccagtaccccgaccggggactgccgccggggcccgcgatcggcttcctccaggagacactgcgctggtgggaccagcacctcaagggccaggagacgggcgtgatgcgggagccgctgctgcggtcctggatcagcggctcgcacccgcccgccacggtgtacgagacgctgccgggacgctgggtcggggacgcgagctggccgtcggagaacgtctccccggtggcgtacgccctccagggcggtgagcggatcgtcgcctcgccgcagcagaccggcgtggacgcgggccgcttcttcccgttcggcaacgacgcggacctgccgccggaccagcgggacgaggacgcgaagtcggtgtcgttcgaattccccgtcgaggaggcgccgatcgagatcctcggccgcccccgggtgaagctccgcatccggatggacgtgccgcgcggccaggccatcgcccggctctgcgacgtcgcaccggacggctcctccaccctggtcacccggggcgtcctcaacctcgcggcccggcacggccgcgaccgcaccgacgactggccccccggcgcgaccgaggacgtggtcttcgacctcaacggcatcgggcacaccttcccgcccggccaccgcatccggctcgccgtctcctcctcgtactggccctggatctggccgcaggccggctcggcgggcttcaccctggacgcggacggcagcctcgtcgaactcccggtgcgccgccacaccgaggacccggcgatcgccttcggggagcccgagcagtccgaaccgctcggcgtggtctacccggtcaccctggaggagccgcgtcccgaacgcctcgtcctccgcgatgtcgccaagggcgaatggcgcatggaggtcgacccccgctacggcggtacgcgggtctaccccgacggcctcgaattcaccgaggacgccctggagacgtacaccatccagcaggacgacccgctctccgcgcggacccgctccgactggcggatccggctgcaccgcccggagatggcctgggacgtggagatcgagacccgctccgagatcgccgccgacgaccaggacttcatcacctccaacgaggtgatctgcaaggacggcggagaggtcgtcttccaccgcacctgggagaagcgcatcccgcgcacggcgggctgagcggcctccccgttccgccgtcggtcccccggatttccggggccgacgaactttccgggcaatgcgcacagttggggatagtcagggcactgccgctgggtaggagcaccgacgtaacgtgtcctcaacgcgacctggaaagcgaggcagcaccacatgcccgagcagagcagcccgctcgatctggccgagggcgatcccttcggcccgcacaaccttccgtacggtgtgttctccacccccgaccaccccgacgaccgccgggtcggcgtccgcatcggcaaccacgtcctggacgccggggccgccgcccacgcactgggctccccctacgcggggctgctcgcacagccgagcctgacgccgctgctcgctgcgggccgcaccgcctggcgggacgtgcgccgcgcgctcaccgcctggc

SEQ ID NO: 3163 - DNA, 5560 bp, Unknown
  Kingdom: Bacteria, Phylum: Actinobacteria, Class: Actinobacteria, Order: Streptomycetales, Family: Streptomycetaceae, Genus: Streptomyces
  misc_feature (5023)..(5024): n is a, c, g, or t
ggtcgccgcccgggtcctcgccgctccccccgtccgcggggcccgctccgaggtagacggtgtcgaggtcccggtaggaagcgtcgtcagacttacgggagttgacgaccgtgttgtcgaggtcccggttctgcgcggcgaactgggccttggggatgttccgcttcggctgcctggagaagtcgacgccgccgaccccctggttgtagaccttgccgccgtacttcagctcgaaccactcgatccccttcttgatcgagtccatgtagcggttccagacctgctcacggttccagtcctggtgggggtcgcgcagcggccacgcggtcacgtcgtcgctgttgatgatctcgcggaagtccgtgggcctcttggcgtcctgctgccggatgtactcggcggcgacgcgggcggtgtacacggcccgcaggtcggcgtagtcgcggtcggtgttgacgcgctcctccacgagcggcatcacgttcgtggcgatggaccgctcgatcgccttcttctcggcgtcggacaggtccttgcactcggtggagccggggacggtgtagtccacgtcgagccactgcgtgctgaccttgaggggggcgtcgaggatgtagatcccgccgtcctcctcacggacctgggcgggcttcggctcgatccacatccgtacgcccgggaagcacggcatcccgttccggcgcggcgccgtgtcccagtaccgcttggccccggcgtgcttgtcggggttcacggcctcgctgaagtcgtgcttcatctccaggtcggcctccaggaggacacggccggcgtcggtcttgccgaacttcgtgtccatgaccttgttcggctgatccgggttcaggttcacccagaacttgtcgggggtgagcgcgagccaggtgaacagggcgtcggaggagagctgcatccggacctcgccgccgaagccggggttgttgtcggggtcgggcatcaggtcggacttcatcgagtacgacatgcccttgcccttgccgagcccgccgacgtaacggagttcgagggtggtgaagtcgacgccacccggaccgccccggggaagggtgcccctcgggtccagacggttggcgtcccgctggaagcgcttcgcctcctccagggtcttgccggaggacagggcgcgctcgttgacgggtcccctggtgccgcaggtgttggcgccggccgccatcaggcgggtgccggtctggcaggcgggagcgaaccagcgctggtggtcggagtacccgcggatcggggtggtcctggggaccgggttgtacatccgctggttgccccggacctggccggtcttcccgttgcgcatgttccgcacgtcgcgctccaggtcggcgatgtgcttgacctggcccttggtgaacttcttcgcgccgctgtagcggaaggtgtggtccggcatcgaccgggcgacgacacggtccttcgtgagctgcttggtcgtcagcttcgagttcgacttgaactcgttgaattccttcttcgccttgttgtaggcgtcgtaccggcgttcgccgaccttctcaccgttctggtcgaacagctcgacggtgacctcgcacaaccagtccgggccgatcagcttgtagtcgcggaccagttgccgctcgaagccggagcccttgtggttgttgacctggttgcggatgtaccgcttgtcgaaccagtgcttgaagcccaggccctctttgttcgcgaagtaccgggcgtagatctccatcgcacggtcggcgggattcttcgacgtgtcggcgatcttcttccaggcggcgacgttcttgtccgggtctccgggcacctgggacagggccttcttcttctcggcggccgtcggggtcttcaggccgtcgtacgcctggccgggaaggtcgaactcgaagttcttcgggagggccctgtccttgtggatcgggccggtgaggtcgtcggggaacccggagttcgccggggtcttgtcggcgggcttgaggccgttgcgaacgtcgcagcgcttccccgagccgggcttcatcttcgcggtgacgggcggacccgccgcccgggcggtctcgatggccggcagaccggtcacggcgactgcggcggcaaggccgaaagcagcagtgaaacgggccgcgaaccgccaccgggacggtatacggaacgtgtgattcaagggctcgtctttccctctcgtgaggggccttgatgggtcgtgggcggcacgccaggcccccgtgacatgtacgcgccgcccgaacaccatagacccggcgagccctgcgggaagaaggaattccgggcgtgtcgagggccccgaactcctttatgaagaacgcgagttcacacgaagtacaagccctccatattctgcacggaatcctcggaatgccttacccggaatgccgtggtccccatctcctcccacccccatggatcggagggtcccagcgccagtccggccagtgacgcccacgcgacctcgttcgcggcctcgcgcaggtcgataccggcgttgtcgagctgccagcccttcagctccagagaggcgatcacggcgcgcgggtcgcccgtgacgacgaacggctcgtccccgggccagccggaggcgtggaacatcaccccgtccggcagccacacgaggtcctcggtgtgctccccgcccccgtagtaggtgacccggcccacgatccgcgcgtcgggaaaccgctcgcgcaacacctgggccgccgatcgcagcggctcgtcgttgccgtcggtcgcgaacgccggattcacgatgctcagcgttccgccccacgcggcggcgtggacgatgtccagatcggcacgcacagaggacggcaacggcgtcagaaccgagcgcgccccgaggtcttccaggacctcctcgatcccctcgaacgacgcggcgaacgcgcgggcccgctccgggtcctgggcagggaggtcacgggcgtcgacgtcgaacggcggctgggcgacggtgagatggcacagtcccatcgagccgcgcacggtccgctccggggcggatgtccagtggtcggtgtcagtcatgcgggccacggtagtggccctcggtcccgcatcacccgccccggttcaccacccccggccgtgccgacgcttcggcccggaccgtcccacccgtaggggaagagggttgtgcagcctggccatatatcgccggtacgcccgcgcctcggccgaggcggcacatcaggtccaccggagatgcctcgtgcgccatccgcgtgaagaacccgtcggagacatggtcccgcacaggctcctccaggcgtcgcgccctccgccgtgtcgtgggcagggggcagagttactgatcctcctggtccgaggccgtggaccgcacgagggagacgggctccgtctgctggtcggaggcggagacacgggtggtgtggcgggtgaggcgcaggcccatggcggtgaggacctcggtgtcgtagagcgcgcacaggagcgccgcggcggccgggagcgacagcggagtggccggattgtgcccgagcagggcggccgtttcggggtcgttgagggcggcctgcctggcatgggcgagcacctgacgagggtcgtcgacgatgagctcatcgatctggatccgctgggcgcggacgcgcagatcgagggcgcgggccggggcgggcctcggggccccgacgacggaccggagtttcgggtgggccggacgggtcaggtcggtcaggtcggtcaggtgcttcatgcggtgggctccagagaacgggccgccggaacgacgatgcgcggaacggcggtacgcggaacggcggtgcacggaacggctggggcggtgcggctggagcgggccgaagcaggagggcgagcaagatcggcccggtctcaccgagttggtgtgcggaggagtcggacatgcttaccttgagagcgccgtgcgaccgtcgcaaggtgcgctgtgtgcactgtgcgcagactgcgcggaatgtcggatagatcgagccggagcggggaccggagcgggaagggggacgccgtggcgcgcgagaggtcggggcggacggcgcggcatctggttctggtggcccgcctgcggcggctgcgggagggcgccggtctgtccgtcccccaggccgccacgcagctgggatggcatccctcgacgctgcggcggctggagcaggcgcagacctccctcgacgtggggcaggtgtccgccctgctcgccgcctacggggcgggtgcggcggagaccgacgacatcatgggacggctcaacgcggccaacatgcccggctggtggcatccgtggcgcgacgcgatggctccctggctgatggacctgatgagcgtggagtccgcggccggcgtcgtacgcacgtgggacccggcgctggttcccctgctgctgcggaccccggcctacgcgatggccgtggacgaactcaggtgccccgaccgggacgcggccggccggcagcggcgggcggactttctggtcgagcgtcagaagcggctccaggaacagcagacccggctctgggcgctgcttcccgtcaccgcgctgcgggtccgggtgggcggcgacgacgtgatgcgcgagcaggtcagaacgattcagcagatcgcggagcgcggggatgtgacggtccagctgcaccccgagtacgcaccgccgcacccgctgaccggcgtcccggcgctgaccctctaccgggtggagatccgggagatcgcggaccatgtggtgcgggagggcgggctccccggcacggcggaggtgtgggacagcccccaccccgtgcagacgtatcagggaatgctggacgtgtcgtgcgtgatggcgatgcggccggcccgaacaggagaggtactacaggatgagtacgaccggaaatgggcctgaactgcccgcgcagatcgacacgagcgtcgcgcactccgcacgtgtctggaactactggctcggcggcaaggacaatttcccggcggaccgggcggcggnncggatcgtctacgtcgaccacgatcccctggtgctcctgcacgtccacgcgctgctgaccagcacccccgagggtgcgaccgcctacgtcgaggcggacatgcgcgacacggagaccgtgctcaccggtgcggcgaagaccctggacctgacccggcccgtcgccctcgtgatcagtgacgtcctgggccacatcgtggactgggacgacgccctgtccctggtgcggcggctggtggaccgcctgccctccggcagctacctctcgctcagccactccaccgcctccgacgacgcccaccgcgccgtccaggacgagtacaacgcgagcggcgcgatcccgtacatcttccgggagccggagaccacgatcgcgttcttcgaggggctggagatggtggagccgggcatggtgtcctggccgaactggcggcccgacgcgaacaccggcaccaccacggcacgggccgggtggggcgcggtcgcccgcattccctgacccacgtccgcaactgccgcgccgcgcccggaagttcc

SEQ ID NO: 3164 - DNA, 14272 bp, Unknown
  Kingdom: Bacteria, Phylum: Actinobacteria, Class: Actinobacteria, Order: Streptomycetales, Family: Streptomycetaceae, Genus: Streptomyces
ccggcggcgagcagggagacgacgccgtcaccccgtggcgtaccgcgttgcggacctccggcgacgccacgcccgtctgttccaccgccggggcggggggtgcgctgtactgctcggcggccggggccggcacagccaggatcgatccggcggacgggcgcgtgctgtggtcggcccggtcctcctcgtcgcggacggccgtccacgctccgatcgtctcgggcggggtcgtgctgtccgcgggcccggacgggaagctgcgcgcgttcgacccggtgaagggcaccgccgtccgggacaccgcgctgtccgcgagccccggtggcgcgttcccggcgggcgacaccctgctggccgtcgcggacgacggcacggtgacggcgctggacggtgcgagcggtgcgccccgctggaaggggccgctggcgaagcacacccggcccgacttcgccctgtacgacgcggcgtccggactcgcctacgccttcgagcacgcgccctccggcgcgtcgaccctcgtcacggcggtggacgccgcgagcggcgaggcctcctggcagcggcggctggccggggtgctcaccccggtcggcacggccggggccggggagctggtgctgacggcgatggacgagaactcggacaccgccgagctggtccggtacgcccccggtaccggcgcgtccgccagggtcccgctgcccttcacgttggacgggccgcaggtcgtcatggccggggacgtcgcgtacctgctggcgcgtggcgggtcgctgctcgccgtcgacaccgcggcgggcggtgcgaagccggagctgtggcggctggagacgggggtcgggcgtgcttccgctccggtgctcggggagggcgggcacctgtacttctccgcagcggacgggcggctgctggccgtcgacacggaccggggtgcgctggtggggcagacccgggcgcggctgagcggcgggaagctcgcctacgcctcggacctgcccgcaccggtgacggcggggcgcacggtcgtggggacggcaccggacgggtcggtgttcgcggtggacggggcggatccgagcgcctggtgagggcccggggccacctcaggtacccgacgctccgccccggaccccgctcctcaaacgccggagggcccgaaggccgagagatcaacccagcttcgagacgtcccggaccgcgccgcggtccgcgctcgtcgccatcgccgcgtaggcgcgcagcgcggccgagaccttgcggtcgcggttcttcggcgcgtacacgccgttcagcgcctcgcggcgggtggccagttcggcgtcgtcgacgagcagctcgatggagcggttcgggatgtcgatccggatccggtcgccgtcctcgacgagcgcgatggtgccgccggaggccgcctcgggcgaggcgtggccgatggagaggcccgacgtgccgccggagaagcggccgtcggtgaccagcgcgcagaccttgcccaggccccggcccttgaggaaggaggtggggtagagcatctcctgcatgccggggccgccgcgcgggccctcgtaacggatgacgacgacgtcgcccggctcgatctccttgcggaggatcttgtcgacggcctcgtcctgcgactcgcagacgacggccgggccctcgaaggtccagatcgactcgtcgacgccggccgtcttcacgacacagccgtccacggcgaggttgcccttgaggacggcgaggccgccgtccttggagtaggcgtgctcgacgtcgcggatgcagccgcccgccgcgtccaggtcgagggtgtcccaccgctcggactgcgagaaggcggtcgcggagcggacgcagccgggggcggcgtgccacagctcgatggcctcgggggacggggagccgccgcggacgtcccagttcttcagccactcggcgagggtgtcggagtgcaccgagtgcacgtcctcgttcagcagaccgccgcggtggagctcgccgaggagggcggggatgccgccggcccggtggacgtcctccatgtagtacgtaccgccgggggcgacgttgggggcgaccttggagaggcacgggaccctgcgcgagacctcgttgatgtcgtcgaggtcgtacgccagctccgcttcctcggccgcggccagcaggtgcaggatcgtgttggtcgagccgcccatggcgatgtccagcgccatcgcgttgtcgaacgcggcgcgggtgccgatggcgcgcggcaggaccgtctcgtcgtcctgctcgtagtagcgcttggtgatctcgacgaccgtgcggccggcgtcctcgtacagcgccctgcgggcggtgtgggtggcgaggacggagccgttgccggggagggagaggccgaggacctcggtcaggcagttcatcgagttggcggtgaacatgccggaacagctgccgcaggtggggcaggcgttctcctcgatgcggaggatgtcctcgtcggagacggactcgtcgaccgcgtcgctgatcgcgttgaccaggtcgagcttgcggaccgtgccgtcgacgagggtggccttgccggcctccatcgggccgccggagacgaagacggtcgggatgttgaggcgcatggcggccatcagcatgcccggggtgatcttgtcgcagttggagatgcagatcagcgcgtccgcgcagtgcgcctcgaccatgtactccacggagtcggcgatcaggtcgcgggagggcaggctgtagagcatgccgccgtggcccatcgcgatgccgtcgtccacggcgatggtgttgaactcgcgcgggaccgcgcccgccgccaggatcgcctcggagacgatccggccgaccggggcgaggtgggtgtggccggggacgaactcggtgaacgagttggcgaccgcgatgatcggcttgccgatgtccgcgctcgctacgcccgacgcgcgcataagggcgcgcgcgcccgccatgttgcgtccgtgggtgaccgtgcgggacctcagctgcggcatcgtcgctcgctccttcggcagagaagactgccttgcgcgttcgggcaggaaagactgtcttcgagcgtacgccccgaatccaagatctggacaccccgtccggaatgcgggacgcgatggccgatgggtgggcagccgcgcggagggcgtacgggggccgtacgggaggtcgtacgggggaccgtcagcgttcgcccaagtatctctggagcgcgggggcgaccatcgccacgatgtcctccgggtcggcggaggcgagcggctcggcgcggatcatgtaccgcagcgtcgcgatgccgatcatgtgcgaggcggccagctcggcgcggaacgtcgcgtccggtacgtcgagttccgccgcgatccgctccagcagccgccgcaggacgaattcgcgcagcaccttcgccgccgcctcgtgggtcagcgcggagcgcaggatcgccagcaggggggaccgggtggccgggtcctcccacacggagaggaagaagcgcgccaggcgctctcccaggccctccggcgggccgccgagaacggtgtggacgaccagggcgggttcgaaggtgacctcgacggcggcggcgaagacctcgtccttcgtgccgaagtagtggtgcacgagggccgcgtcgaccccggcggccttggcgatgccccggatcgacgtcttgtcgtagccgcgctcggcgaactccgtacgggccgcctccaggatgcgcgtacgggcgtcggggccctcggaggcggccttgcgggaggggcggccccggcggcgcggggcgggagcgtccccggtcacgggcggcggagctcggaggccgggtcggccgtgccggaagaggaccggccggaagaggaccgggcggaggtggccaggtggaggcgggtgaaggccagcgcctcggcgaggtcggcctcgcgttcggcggaggacatcgcgcgtcgggtgttgacctcgatgacgacatggccgtcgaagcccgtacgggcgaggcgctccagcaactccgcgcacggctggtcaccccggccgggcaccaggtgctcgtccttggccgagcccttgccgtcggcgaggtggacgtgggcgagccggtcgcccatccggtccaccatcgcgagcgcctcggtgcgggcggtcgcggtgtgcgagaggtcgaccgtgaagtgccggtagtcgtcgttggtgacgtcccagtcgggggcgtacgcgagcatctcgcggtcccggtagcgccaggggtacatgttctcgacggcgaaccggacgtccgtctcctccgccatccgccagatcccggtcacgaagtccttggcgtagttgcgctgccaccggaacggcgggtgcaccacgacggtggaggcaccgagcttctcggcggcggccctggcccgctggagcttgacccacgggtcggtggaccagacccgctgggtgatcaggaggcagggagcgtgcaccgcgaggatcgggacctggtggtagtcggagagccggcgcagggcctcgatgtcctggctgacggggtcggtccagaccatgacctcgacgccgtcgtaccccaggcgcgcggcgatctcgaaggccgtcgcggtggactcggggtagaccgaggccgttgacagggcgaccttcgcatcggggatgcgcaccactggttctgccacctggacagcgtacgggcaccggtgcgccgcgccgagggctcccggcggaaagtgatcagggccatggccctgaggagggtcaccccggcagcgcggcgtgttccgccgggaggtggtccaggcggcgcaggatgacgccctcgcgcagggcccagggacagatctccagctcctcgacgccgaacaggtccatcgccccctcggccaccagggacccggcgagcagctgggcggcccggccctcggagaccccggggagccggccgcgctcctcgaccgtcatcgccgccagcttgggcacccagtcctccagcgccttgcggctcagcgagcgctggacgtacaggccctcggtggaacgggcggcgccggcgatccgggcgagctgcttgaaggtcttggaggtggcgacgacgtggtcggggcggcccgcccgggcgaactcccccaccgtccgcgcgatgctggcccggacgtgccggcgcagcgccctgacctgctcgggacccgccgggtcgtccggcagccaggcgccggtgaggcggcccgcgccgagcggcagggagacggcggtgtccggctcctcgtcgatgccgaaggcgatctccagggagccgccgccgatgtcgaggacgagcagcttccccgccgaccagccgaaccagcggcgggcggccaggaaggtcagccgggcctcctcctcgccgctgaggaccgcgaggtcgacgccggtctcgacccgtacgcgctccaggaccaggtccgcgttggtcgcctcgcgcacggcggaggtggcgaaggcgagcacgtcctcgcaccccttgtcctcggcggcctggaccgcaccggcgatcgtcgccacgagccggtccacgccgagggggccgatcgcgccgccctcgtcgaggagttcggcgagccggagctccgccttgtgcgagtgcgcgggcagcgggcgggcgccggggtgggcgtcgaccaccagcagatgaaccgtgttcgatcccacgtcgaggactccgagtctcatacgggaacgctactgcgctgttggacctactctgggcgcgtgccaaagacgaaaaaggctaagcaggacaaagccacgaagaagcagaagtcgaacaagcaggcgtcaccgccggaggcgatcggacctgacccgtccgacgagaagggcatcgacttcgcgcgggcgtgggtggagttccccgacccggcggacgacgagcaggtcttccgctgcgatctgacctggctgacctcccggtggacctgcatcttcggcagcggctgccagggcatccaggcgggccgcgcggacgacggctgctgcacgctgggggcgcacttctccgacgaggacgacgagaagcgggtcgcggggcacgtggcgcggctgaccccggagctgtggcagttccacgacgtcggtacggagacgggctgggtcggcgtcgacgaggacggcgacaccgtcctgaacgcaaattctcccgtcggacagcgatgtgacgagaagttcgttgagtagaaagggatttccattgacgcgggccaccaacgcgagaacatcgtcgtcggggcaggcgccgagcagttccgcggtgatttccgccacggcttcgggagggagcgattccaaccggtggcgtgcggccccttcccggatgagccagtcgatggtctcctgggcgtgaccgggtgtgcgtgacgcgccgcgggcgagtatccacaggaccggcagcgaggccgatgcgtcgatcagattccgcagggcgtccgcggtgagatcgtccacgagatgcgcgtcgtccagggccacgagcagcggccggagccgggtggtgcgccggaggtattcgacgatgcggtcgaccggagcgagcgggtcgaaggtctgacggtcggtgaggagggcgtagtcccgcgcggggagattctcccggagcacgcgacgcagtgtgctgaacggggctcctgtgtccagtggtaccgccgtgccggcgacgaggccgaagcccgaggcctccccgtgcatcccggccaggcgcagcagttcgctctttccggtccctgcggcgccttcgacgacgaggcagctgccgcccccgggcgccgtgcgcccgagtgcctgtcgtatctcgtagaggatgatctctctgcccggaaacgcgggcgcggtggatttcacatcgttgcccatcaacatccgtaacctcaacagatcaagtcactgaattacttccggcctcctgtccgagacggctcggtggcaggtcccacgtgcggctgggcggctgggcgggaagagtgtgattggtgcggtgcgaattgctgagaagtgagtctgaccgggagctggggggatctaccccatgcgcggatttccaatctggctgaaatattcttgtcacgagtcagcggcctattgtcgggataccggtgttggttgtcgcgatttcgcttctcgcatgtctgtatccaggcccccgcgtcgtgacggggggcctggatgggcggctgtggtggccgcggcgggcgggctcaggcttccaggagcctcagcccgaccactccggcgatgatcgccacgacgcaggccagtcgggccgcggacgcggcttcgccctggacgatgccggcggtgacgacccccgccgcgccgatgccgacccagaccgcgtagcccgtgccgaccggtacttcacgcagggcgaaggtcagcagcacgaagctcagcatggagaaggagacgccgatgacgctgggccagagcttggtgaagccgttcgattccttcagggccagggcccatacgatctccaggagaccggccgccgtcaggatcacccacgccatcgctcctcccctcgtccgtgtcaccggtccgtcggtggtcatggcgacgcaccgtcgctttctcttcgtcgccgtccggcgacccggtcgcggtcaggcggtgtagccaccgtcgaccgccagtgaggtgccggtgatccactgcgcgtccggaccggcgaggaaggccacggccttcgcggtgtcggcccccgcgcccagaaccttcgccgcggtcctcagacgctcctcctcggcctcgtccgtgccgtccgggttcatgtcggtgacggtgggtccggggtccacgatgttcgcggtgatccccttgggcgccacgtcgtgggccaggcccttggtgaagccgatcagcgccgacttgctcatggcgtacagcgtcacgtccggcaccggcacgcggttggcccagcaactgccgatgctgatgatgcggccgccgtgtcccaggtgggggatggccgcctgggtggccaggaagacggcgcgcacgtggacggccagcgtgcggtcgatctcctccagcgtcacaccctcgatcgggccgtaggggaagatcccggcgttgttcaccaggatgtcgagccggccgagctccgacgcggcctgctcgacggaccggacgacggccgtcgggtccgcgctgtcggcctggatggccaggcccttgcgtccgagcgcctcgatcgccttgacgacttcctgggccttgtcggccgcgctcacatacgtcagggcgacgtccgcgccctcctccgccagtcggagggcggtcgcggcaccgattccgcggcttcctccggtcaccagtgccaccttgcccgcaagctgaggcatctcgctccattcacgctaaggtatatatctaggtcggacgatccagaaatactaaacaggcaggatggccgggggtcaacccttgtccgaggaggcagacatggccgaaagaggccgaccgcgcgcgttcgaccgcgccgcagcgctgcggcgcgcgatggagacgttctgggagttcgggtacgagggcacgaagctcacggacctgaccgccgccatgggcatcaactccgccagcctgtacaacacatttggctcgaaagagcagttgttccgcgaggccgtcgctctctacgaccgcaccgcgggctcggcgaccaaccgcgcactgcgcgaggcgccgacggcgcgggccgcggtggaggccatgctgcgcggcaacatcgacaccttcaccgacccggggacgcccagcggctgcatgatcgtgctgtcggccacgaactgttcgcaccagaacaggaaggtcgccgagcaccttgcgtggtggcggcggacctcggtatcggagctggagaagcggctggagcgggccgtcgaggagggggagctggcgccggggacggacgtccgctcgatcgccgccttctacgcgaccatcctgcacgggctgtcgatagaggcccgggacggcgtgtccctggaacggctccgctccacggtggaccacgccgtgaccctgtgggactccctggtgcgacagccggccgggcagcactgagggggcgaccggccgcatcagggccgggcgcccccttgtacgccgggcggggtcacccgcaggcggctgacccttcgaccgccttggtgtaggcgacgagcagcttctcgatggcgtccgggtcgtcgacgcccgtgtcgcgggtctcgaccgtgatgtagaggtcctgctccggatgctccgaagccttgcaggaggggacggtcttgcctacgccggctttcccggtgtgaatgaagcggaggtcgtccgacagcttcccgtcgtccgtgccggggtacgcctgcgagaccgcggccgtggtgtgcccctcactccaccaggcctgcgcgaggctgaggaccagcttgccgtccacggacaggttgcagcggatcgttccgccgttcggtttctgggtggcagtggtgagggagtcgccgccgggcagtacggccttcacctgtgcggggtccactgtggtcccgcacagggatgggggcacggtgtacgccttcttgggcggggcgtcgccggagcacgccgacaaggtggcggcgagagcgacggcggctgacacggagacgatcctgccgatgaatcggcgacgccgaggagttccactgacagacaacgcgagaagcctttcgaggtagaagcgggggaagacacggcaagcgctgtccccgggcatgaggtcagatgtccgtcttcagatgggggttcatctgatcggtgcttgtaccggcggccaggaacccgtcctgcgtggccctgcgagccttctcgtcgatgctgttgtccatcaggtcgtcacggccgtgcgccttcgccgcttcctctacggcttgctcggtgtattccgagttcttctcgacgccgttctcccacagttcgcccatgacaggaccggcgtcgtccttggccttcccctcggcgtccttgaagaaggattccaggaccatgctgctcgccgtctccgccaagccgccggccaccgcgccgccgaccgggctggcgacgaacgacgtgccgacgccgatacccgttccgatgccccccgagatggcgttcttccactgcgccacggactgctcgtacttcttgtccttttcctcggcttcgccggcgaccgcctcctggcggcccatggccagcgtgccggacacctcgcccgaaccgtgggcgatctcacggacggcgaactcggtgtccttcgaatagaccttgtccgccggcagatccgggttcatgtggtaatccatgaggttcgccatgtactgcttgttggccacctccacggccgcgtacccctcggggttctgtcccacggtcagcaacagggcgttgacatcgcggtggttgagcgtggcggagctgcctgcgacggggaacaggttgtccgtctcctcatcggagtcgttcgtcatggcccggttgatgtccggcaggtactccgaggtgatctgcccgatgctgtcacccatgtagttgtgcttggtgagccgttcgttgtcgtccgcgacggaggccacgatcgactcgaagagcttggtctgcccctcgttgtgggccggagtgtccactgtcggcagttcgccggcagggtgcccggtcgtggcggcctccagggcgagggcgaggttgttgcggccggtgttgtcgtcgtcgcccttgaagttggtctcctgcggccactcccgctcctcgaagaggtactggaagttggagagcgggatcttcccgttcttgccgttgccgtccgtatcgcgctcgaagggggagtcctccttcgagacgtactcctggttgaagaagtcggtggccgcgtccgggctgttggacagccccttgaggtatccggtcagtgggtcgtcgccgctgtcctcgccgatccggttgagccacgggtccgggccccggtgctgccacgccatgttctcgtgctcgccgttgccggtgagcttgcgttctgtctccatgagcttgttgccgtagctcttgaggaactggtcgtcgtagtcgccggtccgcatcaggttgctcatgacctggaagcccatggggccgccgccgtcccggccgatgggctgctcgcccagcttgatcatgttgcccttccagctcgtcatgtcggcggagtcgctctgggtggcggtggcgagcgtgaggccgagattgcgctggaggtcgtcgagcttgtcgagccgttcgctgcccacgtgcgggttcacggccgggtcgttgatgccctgccagaattcgagggccttcttgggcccgagctgcgtggcgaaccgctcggcgaacagcggatcgttcttgtacttgtccagaccgttgttgatcttgtcaaagtcggcgggcttgaggtcctcggggttcttcgccgcgatcttggcgaggtcctcggccgcctggacggcctcgacagcggagtcacggtccttgtaggaggcgtccgagaagcccatcgtggactggttggcaatcgcggtcagtaccttgctcgccgacgtgtcgctctccgtggccttcttgaggatcccctgcacttcgtcgcgcagcgcggtgacatcgctctggtcgtgctccgggacggaggtgcccttcgccgctcgatccgggtggatgttcatcgtgacggtgaaaccacccccgccgttgtcgaccacggtcagattcttcttggctccacggctgatggcctcctcgacgtccttcttgtgctgccggagctcgtcgcgggtgtcggtgaggatcttgctgatggtgttggcctgggtatgggcgtcggcgaactcaccggcggtcttgccgacgaactccttggtgacctgggcgttcaggccggcccagtcggccgagttggcggccttgcgcaacccgtcctcggcctgcttcttcagttgtgcgaggttgcgtacgagcaggccccagtcggagacggcttcgtcgagcgtcgcgaagttgccgaagcgcagcgcgtcgagatccatgagtggtcgattctccctgtacgtcttggtcgcgctgctacttcttctgctcgtacgccgggttcttcttccccggctcgccgacccgctcgtcgaatccggcgtccagggtgtcgatgctgctcatctgccgctggatgtagtggtcgtcgccggcgtgcaccttcttggtgacctgcatgtggttggcgatatgggcgcaggcgtccatgagcgacttcagctgctcgtcccaccgcttcgacacgtgcttgagcccgccgcccagcgcgaagccctggccgctcaggtcgccggccgctttgtcgctgctggaaacggctacccgggccttgccccacagctcgtcgtagagtccgtgtgcctggctgccgatcttcaccagatcgccgttggtcaccttgaggtcaccggtctgcccgggcagggcggccgagccgccgcccccggggtcgagctggttcaactgcatcccggcgggttgccgatggacggcgtccgacttcagctgttcccactcgtcccatgccatggaaaacccttcccccgtgcggccgctgcttttcgtcgcggttgatgagcgcctttgctcaggccaagctagcaactcgaccaggtgtccaagcggggcggagcccgatcctcggacagtggctgtgaccatctagtggaggtttcgggaccagcgccgtccgatgtcccgggatcaagtggtcggtctgctttcgcgccctgtggggcccgccggtacgccccgggagggccgcctcctcgtgcggcagccgtaccgttcgcacccaggacatcccgagccgctccatcaccctgcggcaggccagattgcgcacgtcgggctgggcggccacgcgttccgcctcgggcggcgatcacgggggcaggcgggtggtcgcgcggcgggcgcggctaacatcccctgtgaccgaaacgaccgaaccgccaggccgccgcacccccatattcgccgacctcaccccgctgcggctctcgcccgactaccggcggctctggttcgggaacaccgtctcctggatcggccagggcatgacgtcgctggcggtctcgctccaggtctacgacatcaccgggtccgcgttctccgtggggctcatcgggttctgctcactcgtgccgctggtcgtcttcgggctctacggcggggccgtcgcggacaccgtcgaccggcgcaagctcggcctgttcagtgccgccgggtcgtttctcctgtccgtcgtcctggtggcggcgacggtcgcgggcatcgaacgggtcgggctgctgtacgcggtcgtcgccctccaggccgtctgtttcgccctcaacgcgccggcccgttcctcgatgatcgcccggctgctgccggccgagcagctgcccgccgccaacgcgctgaactccatcaccagcacgacgggcatgctcgtcgggccggtgctgggcggtctgatcgtcggctggtggggctaccgctccgcgtacaccgtggacgccgtctgcttcaccgcctccctgtactccatgtggcggctgccctcgatgctgcccgaccggcaggacggcgacacggaaaagcgggcctccgtcctggacgggctgcgcttcctcgggacccggccgaacctgcggatgaccttcttcaccgacctgtgcgcgatggtcctcgcccatccccgcgcgctcttcccggtcatcgccgtcctctggtacgggggtgacgcgcggaccaccggaatgctcgtcgccgcgccggctctcggcgcgctgctcggcggagtgttctccggctggctcggccggatccggcggcaaggactcgcgatcctgctggccgtcggcgcctggggtaccgccatcgccgtcttcgggctcacccgcaacctctggctcgggctgctgttcctggcgctcgccggatgcgcggacaccatctccatggtcttccgcaacacgatgctccaggcggccgtgcccgacgagatgcgcggccggctccagggtgtcttcatcgtcgtcgtggcgggcggcccccgcctcggggacttcctggcgggctcggtggccgacctcgccacccccgcagtcgccgtcaccggcggaggcgtcctgtgtgtgaccggcgtggccctgctcgcgctgaaatggcgcgccttcgcccgctacgacgccca

SEQ ID NO: 3165 - DNA, 5571 bp, Unknown
  Kingdom: Bacteria, Phylum: Actinobacteria, Class: Actinobacteria, Order: Streptomycetales, Family: Streptomycetaceae, Genus: Streptomyces
cgaggacgcagacgacgagggcgtagagagcgatgcggggcatgggggtcgactcctgtcgggaacgggtcgcggtcccgtccagtgtcccccatgccccgttgtgccccgaccgggcccggcgggccggtcagacgtcggtggtgcgcagcccggcgtgggccttgtagcggcggttgaccgagatcaggttggcgaccagcgactcgacctgatgggcgttgcgcagccggccggcgaagatgccccgcatgccgggaatccggccggccagcgcctgcacgaggtccgtgtcggcacgggcctcgcccaggaccagcacgtcggtgtcgatctcctcgatggacgcgtcctggagcagtacggccgagaggtggtggaaggccgcggtgacccgggagtccggcagcagggcggcggcctgttcggcggcgctgccctcctccggcttgagggcgtaggcgcccttcttgtcgaagccgagcgggttgacgcagtcgatcacgagcttgcccgcgagttcctcgcgcagggactgaagcgtcttggcgtggccgtcccacggcacggcgacgatcacgatgtcgctgcgccgggcgcattccgcgttgtccgctccctcgacgccgaaacccagctcggccgcggcctgctcggcgcgggccgcgtcgcgggagccgagggtgaccttctgtccggcgcgggcgagccggtaggcgaggccacgtccctgcgggccggtcccgccgagcacgccgacgctcaggccggagacgtcgggaaggtcccaggggtccttggcggggggcttgggcgcgctgccgctgtcctgtgtagtcatgggcccgaccctactgccaggtagcccccgggaggccgccccggcgggcccccggtcccgctcaccgagcagccaccgcacggtccccgcgcggccctccgttcgggtgagggagcggtcggcggacgccggcggacccgttccgcccggcccggcgggcgtcgcggaaaatcggcttgcccgaaacgccctgccgtacggatcatggcccttcgtgacctcagcaccttcctcgccctcacccgcaccttcctcaccgctgtcggcccggatccgcgccctgctgccggacctctcgccgtggcgttcctcggcggacttccggctgctgtgggtccagggcctgatcacgtacttcggcagtttcatggcactcatcgcgctgccgctccagatcaaggacctcacgggctccccgctcgcggtcggggcgatgggcgcggtggagctggtgccgctggtggtcttcgggctgtacggcggggcgctcgcggactcggtggaccgccgccgggtcatcctgctcaccgaggcggggctcggggtgctcgccgcgatcctgctggtgaacgccctgctcccggagccgctgctgtggccgctgtacgtggtggccggcggggtgtccgcgctcgccggtctccagcggcccgcgctggactccctgatggcccggatcgtgccgcacaagcagcagacggcggcggccgcgctgaactcactgcgctggcagatcggggccatcgcgggcccggcgctggccggtctggtggtggcgtacgccggtcacggcacggcgtacggggtgacggtgtgcacgttcgccgcctcggtcgtgctctgtctgcggctctccccggcaccgccggcgcgggacgggcagaagccgtcgctgcgcgggatcgtcgagggggcgcggtacgcctggagccgaccggtgctgctggggacgtacgcgatcgacctggcggcgatgttcttcgccttcccgaacacgatcttcccgttcctggcggacgacctggacgcggagtggtcgctgggcctcatgtacgcggcgggctcggtcggctcgctggcactggggctgaccagcggctggacgagccgggtgcgcagacacgggctgttcgtggtgttcggcgcggcggcgtggggactggccatcgccgcggcgggctggttctccagtgtgtgggtggtgctgctctgcctggccgtggcgggagcgggcgacatgctgagcgggctggggcgcgcgaccatctggaaccagacgatcccggaggagctgcggggccggctcgcgggcatcgaggtgctctcgtacagcgtcggtccgcagctgggccaggtgcgggccggggcgatggcgggctggacggggacccggtcggcgatctggacgggcggggtggcgtgcgtggcgtcggtggtgctgttgaccgccgcgctgccgaagctggtgcggtacgactccgagacggatgaggacgcggtgcggcggcgggaggcgcgggcggaggcgtgagccgttcgcccggccggtgccggactcccggggctccgcccccgtccccgctcctcaagcgccggaggcgctggaaaagacgtcctcaatcgccggaagaactcaggtttccccccggacaggtccgcgggggaagaccgtcctcaatctcccggcgggcttgacttgcccttgccctcgtcctcgtcgtgccatttggggtcggtgtcccactccaggttccggtcgcgtgccgtgtccatcgcgtgctgtgccgcttcccgggaggtgtaggggccgaaccggttctgcgccgggcactccgggccctcctcgaccttcttgtgctccaggcagtagtaccattcgcccggtttgcctaccgtgcgcttcttgaacagggccatcgacggctccttcccttatcgccatggtgccccggggccgctggttagactcgctggcatgtctggccagtcgcttctcgtaccaggggagatcactcccgtccgttccgtacccggaaacatccggcgtcccgagtacgtggggaagccggccccgacgccgtacaccggcccggaggtccaggactccgacaccgtggagcggatgcgcgtcgcgggccgtatcgccgcgcaggcgatggaggaggccgccaagcacatcgccccgggggtcaccacggacgagctcgaccgggtcgcccacgactacatggtcgatcacggcgcgtacccctccacgctcggctaccggggcttcccgaaatcgctgtgcacctcgctcaacgaggtcatctgccacggcatccccgactccaccgtgctgcgcgacggcgacatcgtgaacctggacgtcaccgcgtacatcaacggggtgcacggcgacaacaacgccacctacctctgcggcgacgtggacgaggagtcgcgcctgctggtcgagcgcacccgggagtcgctgaaccgcgccatcaaggcggtcaggcccgggcgccagatcaatgtgatcggccgggtcatcgagtcgtacgcgaagcggttcggctacggggtcgtacgcgacttcaccgggcacgggatcaactcctcgttccactccggcctgatcatcccgcactacgacagcccgcacgccaccacggtgatgcagccggggatgacgttcaccatcgagccgatgctgacgctgggcacccacgagtacgacctgtgggaggacggctggaccgtggtgacgaaggaccggaagcggacggcccagttcgagcacacgctggtggtcacggagaccggagcggagatcctcactctcccgtaaatcaccccaaagctcacataacagcacccttcactctttccgcgcgtagccttttaccgacaggtagtcgggaaccagttgacttaggtaaacctaagtaggaggatcgggcgtatcggcacgcgccgccgcaccgctgcggcggtcgccgccgatacatccgtctctttctggacttcccgtcccctcggtccccggaggcccgccttggacgcaaccgccaccgccactcccttctcgacgctcatccgcaccgcgtcgcacgagcagcacaccgaggccgagacctcgaccttcatgagtgacctgctcagcgggcggctgggagtggacgcctacacgcgctacaccgagcaactgtggttcgtgtaccgggcgctggaggaaggcgcggaggccctgcgcgacgacccggtcgccggcccgttcatacggccggagctgatgcgctccaccgagctggagcgcgacctggcacatctgcgcggtgccgactggcgcgagggtgtcgagccgctgcccgccaccgccgcgtacgcggcccgggtcgcggagtgcgcgcgcacctggcccgccggttacatcgcccaccactacacgcgctacctcggcgacctctcgggcggtcagatcatccgcgacaaggcggagaagacctggggcttcgcacgcaagggcgacggcgtgcgcttctatgtcttcgaggagatcaccaacccggccgcgttcaagcggggttaccgcgagctgctggacgcggtgaacgcggacgacctggagaagcagcgcatcatcgaggagtgcaagcgagccttcgcactgaataccgcggtcttccgcgaactgggcgaggtctttccgctcagcgcgtgaccgagcgcgggcgaatgcgcccgtaagtgtgcggctccaccggattccggtggggccgcactctttttcctcttcctctttttcgcgcacgaaatgaggaatgccggtttgacacaagacgtttgacgctccaacaacctgcgggtagattccggaggcgtcttcaccgcatattcacatgacattcgggcggggggcccggatatgtacggatgtcatgcctgaaagggatttccctccgccggttcatatccgtctaccgacaggaaatccaccgtgcttcacctccgcccccgtgcggctgtgacgagcgggctgctggcagccgccctcgtctcaggcaccttcctggcccctgcggcacacgccgtggtgggaaccccctccgccgacaacgcctatgcgttcaccgcgcggctcgacataggcaacggcaagcgtgcgtgcaccgccacgctcgtcgaccgtgactggctcctgacggcggccagttgcttcgcggacaacccggccgcagcccagcaactcctgccgggcgcgccgaaggacgccaccacggccgtcgtcggccgtaccgacagcaccaccaccgcaggacaggtccgcacggtggtccggctcgtgccccgcgccgaccgggatctggtgctggcccggctgtccaagccggtcaccaccatcgtcccggccgccctcgccacgaccgcgcccgccgcgggcgagaccctcaccggcaccggcttcggccggaccgccgacgagtgggccccggtcaagatgcaccagggccgcttcacggtcgacgagtcggacgccaccagcgtgaacatcaccggtgtggacggcgcggccgtgtgcgccggcgacaccggtggtccggtcttccgcgagcagagcggctccgtcgctctggtcggtgtgaacagccgctcctggcagggtggttgcttcggcaccgacgccgcggagacccgtaccggcgcggtggagagccgcgtggacgacctccaggggtgggtcacgg

SEQ ID NO: 3166 - DNA, 5455 bp, Unknown
  Kingdom: Bacteria, Phylum: Actinobacteria, Class: Actinobacteria, Order: Streptomycetales, Family: Streptomycetaceae, Genus: Streptomyces
  misc_feature (308)..(309): n is a, c, g, or t
cgggtgagggtccgtggcatcagccccttcaccaccccgaacgacacgttctaccgcgtggacaccgccctcgtgatcccccaggtcgacgcggactcctggcggctcagcgtccacggcaagggtgtgcggcgggacctggagttcacctaccgggatctgctcgaacgtccgttgatcgaacgggagatcacgctcacctgcgtctccaacgaggtcggcggtccctacgtcggccacgccaggtggatcggcgtccggctcgccggcctgctcagggaggccggggtgaagccgccgtcccgggnngcacccccgtcgaggacgtcatggacggccgggacgcgatgctcgcggtaggcatgaacggcgagccgctgccgttcgtccacggattccccgtgcgtatggtcgtcccgggcctgtacgggtacgtctcggcctgcaagtggatcgaggacatcgagctcaccaccttcgacgactacgacccgtactgggtgaagcgcgactgggcgcgcgaggccccgatcaagacccagtcccggatcgacacccccaagcccttcgggcgcccggaggccggcacggtcatggtggccggagtggcgtgggcccagcaccgaggcatcgagaaggtcgagatccgggtcgacgacgggccgtggcggcctgcccaactcgcggaccaggccaccaccgacacctggcgccagtggtcctacccctggaaggcgacccccggtggccacaccctgaccgtccgcgccaccgaccgcaccggcgaggtccaggccgagaagcgcaccgggaccgtccccgacggcgcgagcgggtggcactccgtcgtggtgaccgtcgactgaccgtcctccagggcccgtccgaggcggggcacttcgccccgcctcacgggccgaagaccctcccgagcgccgacgacagctcccgaaccgtgggaggactcaggcgggcgcccagatacccgtccggccgcaccacgaaagccgtcccctccccggccccgtaccggagcgcgaactcgccgaggccgtcccggtggaaggggaccggagccccgggggcgggcccgtcggcggggaggatccagcgcgtctccatcagaccgtgggtcaactcccgtgccgccgaggcgagatcgcccaccgtgtcgcctgccgggtgggtcccgtacaccagcaggacgtgcccgctcccgcgcaggacgtcgaacagccgcatcggataggcggcgatgtcgcccgtgaggccgccgcagtccggggcccggtcaccggggcccggcatgttccggccgtccggcggaagcggcgtcaccagcgggctgtcccggtaaccgatgagcaactgggcctcgcgcagcagcagcgtcccggggtccgccggatcggcctggacgccctcggcggcgtgccggacggttcgcccgacgacctcctcaccgaccgggcggcgctcggcgtcgtaaccggcgagcaccttgggtcccgctgtgtccccgaccgccagggccagcttccacgccaggttgcaggcgtcctggatcccggtgttcatgccctgggcgccggtcggcggatggatgtgcgccgcgtccccggcgacgaacacccggccccgaccgtagcggtccaccaggcggtggctgatccggaacaccgacgaccagcgcagcgcggacgccgtgaccgtctcgggggccagccggtccagcaccttctggatgtcggccaggaccggtgcgacgccgccctcaagaccgtgggccaccccgtcgccgctcgccggcccggacgcctccgcccgccgcgcggcggacagctcgggcggaaccagcatcgacatccggtagcgtcccgcccccggcagcgggatgcagaccagcaaatcgtcgaccgcgccgtccgcgccccggtgcatcgagcgcaccccgtacccgggcggcagaccccagtccacctccacatcggcgagcatgtactcctccgggaacgcgccaccctcgaaggacagcccgaggcccttgcggaccagactgtgcgccccgtcgcaccccacgaggaaccgcgaccggacctcctcctcgccaccgggcgacgtcgtcagccggctcgtcaccccgtcggcgtcctgggcgaacgccaccagttcggtggcacgctcgatcgcggtgccgtaacgacccaggaactcctccaggacgcgctcggtctcgtactgcggcagcgccgcgaagccgtacggcacctccggcagcacgagctcgatccgcccctccgccaccccgttcacgtacgtcagctggccgcgcatcgggacggccgcgtccagcacgtcccgcacgaggcccatccggtcgaagagctccagggtgcgcggctggaggcccaccgccttcgcgaacggcagccgggccgggagccggtccacgatccggcaggccacccccgcccgccgcagctccgcggccagcgtcaggccgaccgggcccgcgcccgcgatcatcacgtccgtcgcctcgccgcgcaccaccggtgcctcccgccgtgagcccccgggggccgatgccccgcgctcatcgtcgcgcggcggcggatgtccggcacccgggggagcggtccccgcccccggctcgcgggaccctgcggggtgtccgggacgtgcctacggcacccgggccgtccactccggcgtaccgaacttggtgcgtacgagttcctcggcgcgcgccagttcgtcgtccgtcacgcttcccgcggagagaccgtggcgcctgcggaatgattcgatcatgcgttcgatgacggtctggcgggggaggcccgtctgccggcgcagcgggtcgacgcgcttcttcgcggaccgggtgcccttgtcggacatcttctcctttccgatccgcagcacctccagcatcttgtcggcgtcgatgtcgtacgccatggtcacgtggtgcagcacggcgcccggcccgccgtccggcccgaccatccgcttctgcgcggccccggcgatcttgccgacctcggtggcgatgtcgttgagcggctggtaccaggccttgatgcccatgtcggcgagggcttccaggacccagtcgtccaggtaggcgtaactgtcggcgaacgagagcccggagaccagggactgcgggacggcgagcgagtaggtgatggtggagctcggctcggcgaacatcgcgccgccgccggagatccggcgcacgacgttcacgccgtgccgctcgacgcccgccgggtccacctcgttgcgcagcgactggaagctgccgatgatcacggcgggggagtcccattcccagacccgcagcgtcggcggccggagccccgccgcgacctcggcggtgatcacctcgtccagcgccatgtgcagggcgggagactgcggggcctcgtggatcagctgccagtcgtagtcgctccactccgtggcctgcgcgagcgcccggcgcacggtgacggcgactccctccgcgctgagcccgagcatgaccgtggagtcgggcagtgccgcctcgatccgggcagcgagcccggccgtgtcggtgttggccggggcgccctccagcgccgcgtcgatcgcgaggatcgcctcgtcgggttcgaggaagaagtccccggcaacgcggacgttccgcagtgccccgccctccacatccaggtccaccacgaccagcttgccgccgggaaccttgtactcaccgtgcacagccatgcctccgccctcgggtcccggcccgttgtgagccggacacaaacgtccataacgcatacgggggaccggttcatcccgcgcacccctggcatgatcggccggcatgagcgacgcaccacgtcacatcctcgtcatcggcatgggcgccggcgaccccgaccatctgaccctcgccgcggtgaaggccatgcgccgggccgacgtcttcttcgtgctgggcaagggcagggagaaggacgcgctgacccggctgcggcgggacctcctcgacgaacacctgaccggcccctaccgggtcgtcgaggccgaggacccgtggcgggaccgcgcccagcaggacggcggacgctatgcctcggcggtgcacgactggcgccaccgccgtgccgacatctgcgaacgcctgatcatcgaggagctcgcaccggggcggtgcggagcctttctggtgtggggcgacccgtccctgtacgacagcactctcgcgatcctggacgacatccgcgggcggggaacggtggagttcgggtacgaggtgatccccggcatcagcagcgtctcggccctcgcggcccggcaccgcgtcaccctgaaccaggtcggccgccccgtccacatcacccccggccgacggctcgcccaggggttccccgaggactgcgacctcgtggtgatgctcgacggtcacgagagcttcacccatctgacgggcagggggtggtggatccactggggcgcctatatcgggacgccggacgagatcctggtctccgggccgctcgacgaggtggcgggccggatcagccggctgcgcacggaggcccgcgagcggcacggctggatcatggacacctacctgctgcgccaagggccggacgtcgcggacggcacgagcggtgcgggccgcacgagcggtgcgggcgacgcggaccgtacgaaccgctgaaaggtccgcgtcgaggcgcgggcggtccccggccgccgcacctcggcgtcggacctgtgggggtgtcagccccgggactcgtgcgcccggatagcaccgagcccgtgtcccaggctggggcattcggcggtcagatcgctgccgcgcaccaggtagttgtgcacgcggccgtccgtcggccgttcgacggcgcggtacagcgtgccgttcacggtgatcgtccagtcgtcgccgtcctgggcccacccgactgtcttcttcatctggcgttttccgtttcctcggtcggcctcgccgcgggtcggcggccgtgtagtgggaagaagaacggcttgtgacgctctgtggttccgcagtccctacgccattcggttacatctgtgtcactgtcacgtccagtggacgcgcccgacctgactggcggtcagcagcagtctgacgaacagtcgaacgagcggagaaaacgtgtggcccgcggcggtggccacgagggggtccgaaccgaagtcggggagcgctcgcccgtatcccacgtcaccgtacgaagcgtgaactacggtgtgcgcgggccgggcgtccccttgggctgaccggtgcggctggttcaccctcatctgccgcgcgtgctcctcgacgacgaacagcaggcgtgcgagcaggtgttggaggcccggctcgacacccgccgggagagcgtgggggtcccaccccgagtcccgcaccttcctgccgctcgacgccctcgccctggcc

SEQ ID NO: 3167 - DNA, 6191 bp, Unknown
  Kingdom: Bacteria, Phylum: Actinobacteria, Class: Actinobacteria, Order: Streptomycetales, Family: Streptomycetaceae, Genus: Streptomyces
tcgccgggttcgagaaggccacgggacaccaggtgaaggtcacggcgatcttcgacgacttcgagaccaagctccagcagcgcgccgcccagcggcatctccccgacatcgtcatgaacgacgtcacccagatcggggcgatgcacagccagggcctcctccgcgagatcgacctgagcaagatcgaaaacagcggcgacctcatcgagcagggccgggactccggcaagggcgtcgacggcaagcagtacggcatcccgtactccgcccagaccggcgccctgctgatccgcaaggactggcgcgagaagctgaagctcgacaccccgaagagctgggacgacctcgcggcgatggccgaggccttcaccacccgggaccccgacggcaacggcaagaaggacacgtacggcctcgccgccccgctgtcgaccaagcgcggctacgcctcgtggtacttctccaacttcctctgggccgccggaggggacttcatcaccgagacgggcaagggcacgtacaagccgacgatggcctcgaaggagtcggcggaggccgtgcgctggttccgcgcgctcaactgcgagcggaaggtcgtccagcccggggccgtcaccatggacaccccgccgacgaacgagacgttcgaggcgggcaggaccggcctcttcgtcgtcggcccctacctcatgccccgcttcgacacatcgctcggcaaggacaagtacgaggtcgtccccatgcccgaggggccgaaggacgccaccgtgctcgccgagggcggagccgtctacctgatggcgggctcggagaaccgggccgggcaggacgccttcgccggatacgccatctccgccgacggccagaagctcggcatgcagggcgaggagggctccaccgtccaactgcccgtgaacaagacggtcgacgtcgccgaggtgcgccccgacccgcgttggaagacgtacgcggaggtctaccggacctccgggcggtacgcgccgtccgtcccgaactggaccccgatacggcaggcctcggccgagaccctcaacgcgttgatggccgactgctcgctggacgccgacgtggagcttcgcgagctcgacgagaagctcgcccggatcctcaaggaacagggaatcgccggatgacgagcgtcgacgaggtgaagccggtcgcccgccaggcagccggccccgccccccgggcagcgcacggcccggccgctccggcggccgggtccgccgccggccgccgtgtgcggaaccgtcgttcgggccgctggtggacgccctggctcttcctggctccggcgctgatcctcttcctgtacttcaagttcatccccatggccagcgcgctgaccatgtccttccaggacgtgcagccctacctgggcaaccggtgggtcggcggcgagaactacgcgacggtgctctcgtcggacggcttccgcgaggccgcctggcacacgctcgtcctcgcggtcggccagaccgccggatcgatgctgctcggcctcgccctggccctcctgatggaggggcagggccgcaggatcagcttcgtgcgctcggcggcgttccttccggtcgtcgtgccgatcgcggtcgtggccgagctgtggcggatcatgtaccaccccaccgaggacggcatgctcaactccgtcctcggactggtcggactcggcccgtcggggttcatcaacgaccccgatacctccatgggttccatcatgctcaccggcatctggcgaggcgccccctacgacatgatgatcttcctcgccggtttggcgggcgtggaccgcggcctgtacgaggccgccaaggtcgacggcgcgtcgaggctgcagcgcatccgccacgtggcggtccccggactgcgggcggtgctgtccatcctgttcgtgctcgcggccatccggggcctgcgcgtcttcaccgaggtcttcctgctcaccaacggcggccccgacggctcgaccgaggtcgtgatgacggtgatctacaaactgggcctggagcagaaccggctcggcgtcgccgcggccggagcggtcctgctgttcctggcgacgctggtcctcacggtcagcgtccacctgttccgacggaggggtaacgaatgagcgcgccgaacgagaccgcgctggggctgaccgagagcaggggcgtcgccggacgcgtcctgaaggccgtcacctacctgctggtcctgctggtgttcgccgggccgctcctggccctcctcgtcggcgcgttcaaccatgtcaaggacccgacacagctcagcatcgtcccgaacgacccgaccctggagaacttcacggtcgccttcgaccaggacgtcctgacgtacctgctcaactcgttcttcgtcgtgggcttcggactgctgctccaggtcgccgtctccgtcctcgccgggtacgccctggcccggaagcggttcagggggatgagcttcgcgttcgtcgcgatcctggcgacgctgatgctgcccgaggagatcctggccatcccgctgtccgtggtcctctccgacctgccggtcatccacgtcaacctcatcggttcgctggccggcatgatcgtccccctgggcgcgtgggcgttctccatcctcgtcatgaccgagttcatgaaggaggtgccccgggagctggaggaggccgcgcggatcgacggcgccggggacctgcggatcttcgcgcagatcatcctcccgatgtgcaggcccgcgctcggcgtcatcggcgtcttcggcttcacgatgatctgggaccagtacctgctgcccctgctcgtggcgacggactcctcgtcctacacgctgccgctggctctgcgcaccctgcgggtcgaccccctcgtcacccccggcgtggtgatggccgcgtcgctgctcgcgctgcttccgtccatcatcgtcttcctcctcttccagcgctccttcgtccacggtctgtccagcggcgccctcaagggctgacccaccgggacgacaccgcccgcccccggccgtgcggtcaccgacgtacggctgaggaaggacgtccgcgagccgtccctcaccgggcggcagccacccccgctcacctctccgccgaccaccccgacgccaaggaagactcgccatgaccacccgaaccgacaccgcgccgggcgaggctccggcccccgcgccggacacgtcgtggttcgcccacgaccgcttcggcatgttcgtccactggggcctgtactccctggccgcgcgtcacgagtgggtgaagacgagggagcggatgacggacgagcagtaccaggtgtacttcgaccacttcgaccccgaccgttatgccccggccgactgggcgaggaccgcgaaggccgccgggatgcggtacgtggtgctgaccaccaaacaccacgacggcttctgcctgtgggacagccggctcaccgactacaaggtgacccgcacgccccacggccgcgacctggtcgggccgttcgtcgaggcgtgccgcgccgagggcctcaaggtcggcttctaccactccctgatcgactggcaccacccgtcgttccccgtcgacggcacccatccgcggcgtgacgacgaggagttcaaggccgcggcggccggccgcgacatccgcgactaccagcgccacctgcacggacaggtccgcgagctgctcaccgactacgggcggatcgactacctcttcttcgacttctcctacgcgggacgcagcgagtggtggggcggcaagggcccggacgactgggactccccccgactcctcgacatggtccgcgagctccagccgcacatcctggtcaacgaccgggccgggctgcccgcggacttcgtcactcccgagcagtaccagccctccgctccgatgacctccgacggccggccggtcctgtgggaggcgtgccaaaccctcaacgggagctggggttacgaccgggacaacctcgaccgcaagagccccgacctgctcgtccggatgctcgtcgacggcgtctccaagggcggcaacctgctgctgaacgtcggtcccacgggccgcggccacctcgatccgcgcgacaccgccgccctcgcggaggtcggccggtggatggacctgcacgaacgggccgtgcgcggctgcggtccctccccgttcaccccgcccgccgactgccggtacacccagcgcggcgaccgcctctacgtccacctcttcgcctggccgctgcgccacctgcacctgcccgggctcgatggccgtgtgcgctacgcccagctcctgaacgacgcgtcggaggtcgtccgggtccaggtggaccccgaccgtcctgcggtcaacacacagatgggcggccagccggccggcacgctcaccctgcgtctcccggtccagcgccccgacacccccgtgcccgtcatcgagctccacctgacggacccgtccgactgatccgcccgagaaacatccacctcgcccgatcatggaggcacccatgcaacgacgcacgttcctcaccggcaccgctctgggggcggccaccgccgtcctgcccctgtccggcccggcgcacgcacgcgccaccgccggcgtcgctcccgccggccgacgggacctcaccgtcaccgtcgactccctggacgcgctccagaaggcgatcgacgcggccgtgccgggcacccgcatcgtcgtcgcgaacggcgcgtacaccgttccggccggccggtccgtcgtggtccggggggtccacggagccgacggcacgcccgtcacgatcgtcgccgcgtcgcggggcggggtcgtgctgcacggggagcggagcttcctcttcgaggactccacccatgtgaccgtcagcggcttctccttccgccagagcacgacgctggaggtcccgccgagctgctcgcacgtccggctgacgcgcaacgacttccggctcgccgacatcgaggggctgcactgggtcatggtgcgcggcgacgactccgtgatcgaccgcaaccacttccacggcaagaccacgctcggcgtcttcctcggcatcgagggcgcgggcaccgaggccatggcccaacgcgtgcacgtgcaccgcaaccacttctccgaccattccttcgccggctccaacggcggcgagccgatccgcctcggcgtcagcccccgcgccctgtccggcgcctacgcgatcgtggagcacaacctgttcgagcgggccgacggcgaccccgaggccatctccgtgaagagctcccacaacgtcatccggcacaacaccatccggaacagcctcgggggaatcgtgctgcgccacggcaacggcacccgggtcgagggcaaccacctcatcggcggcaaggagggcgtgcggatctacggcaacgaccacgtcgtcgtcaacaactacctggccgggctgtccgggcgggccatggtggtcggcagcggtacagcgcgcgaccacgtacccggcgagtcgcccaccgcccgccggggcaacgacgcccccgaccgtgtcctcatcgcccacaacaccttcctggacaacgcgggcacgctctccggcgagagcaaccggccgcacgagccccgtgacgtgaccgtcgccgacaacctgctggtcggccaggtcggggatctggtcgagatggcgaacacggtgcggttcacctggcagggcaacatcctcttcggagcggcgggcgacgggaacgtgccggccggcggtttcgtgcgggccgaccccctgctggtgccggggtccgacgggatgcaccgtctgtccggtgcgagccctgcgatcggggcggccacgctccggagcgcacccgtcacccacgacatcgacggcgatccgcgtgggacgctgcgggacgtgggggccgacgagtacgcgacgcaggccccgcggtaccggcccctgacaccggccgacgtgggtccgaactcccgctgaccacctccctgcccgtctccccgaccccgaccgctccgcccggaaggccgccgtgaccgagaatcccccgctccccgcgctggaggacgtgcggtgccccgtgcccggcggcgggagctccggggccgcctccctccggctcgggatctgctcggtcacctttcggcacctgcccgccgcggaggtcgcccgccgtgccgccgacgcgggtctggaggt

SEQ ID NO: 3168 - DNA, 2336 bp, Unknown
  Kingdom: Bacteria, Phylum: Actinobacteria, Class: Actinobacteria, Order: Streptomycetales, Family: Streptomycetaceae, Genus: Streptomyces
ctcgttggaggcgcggatcgcggtgctcgccgccgatgccgcggcgtcggcggcgtcggcggcacggccggcagccttggacgcgcgggcggcgtccgcctgagcggcggccgtctccttggcggccttctcggccgcttccttggcgtgcgcggcggctgcgacggccttcgccgaggtctccttggccttcgccgtctccgccctggatttctgaccggcacgcttggccagttcggccagcgccttgacggtcatcgtctcctggtcacgggcccgggcggtgtgctggccgttctcgatgaactcgtggacatcgagagccgatccgctcatcgcgctctggccggcggccttcacctgcggtccgccgagctgcacgatggtgaggagctggacccgctcgtcctcttcccgggcggtgtaccggccctcggcgaggaaatcggtcaaggcctgttcggtattggcgttcagcgcgttctggccggcggttcggaccgcgcggtcaccttcgttcatcacccgtaggacttcgacgcgctgatcgtccgtatagggtgctttccagccattggcaagaaacatgctgagatcgtcgggcgttccggacagcgcctgttgcgccgccccacggactcccgggccggcgttcccgagcattttcagaacagtcacccggccgtcctcttcgaccaagggtcccagctcggacgtgaggaaggtgtggatctgcgcgtccgtgccgatgagcgccttcgcggcggcttccttggtggaatcgccgcccgacttccaggcgttcagcacctggacgcgttcgttctgcgcagcctccgcaccgcgcgggacggctcccgcgtcggccgcagcggtgccgaaggcgccggccaccagggccagggcagtggcacccaccagcgcggcccgcgttatcggtccgccgggggacggggcccgtctcgcccggcccgtccctgtgtccacgtgcatttcgtctcctgatcgcatggccgggcatttcgccggcatagggggtgcggtgcgtcccgagtgtgtgcgggaacggaaagaagtgacaaaccctttgcttcgcaccggatgtgacgccccgcctcgaaccgggacttctgtcctgtcttcgggtgggatgaggcaatggcccgatgcttcacctttgttgtcgctcggcctcggttcgtggaagtcggtcacctcttgggtggtggtgtcggacgccatacgcccgaagatcaaccgaccccggaaaggcccgcagccttcagcgtggggatgatatgaatattcggctcgacatgtgaagttggcgtgccgagtggacgctacgtaccgaggggggcctcgattcagtcgagcggtgcaaaaacgctccttctcgtacgtgccgtgtctgtggtccgactacgagaggctgatgaaacagtgcgagcccgttctttcctttcctgcgcactcgcggcgagcgccgtcaccgggatcttcctgatgggcgctccggccgccggggccgatcccgtcgctccggtcgtcgcggctgccgcggccgacgagttgccgccggtggccgtggaggacttcgtctacccgaacgcggacaagatcttcgccgagcagggcatccgcctcaagcgcggcgatgggcacatcctgctcgcggactgcgcgtccgccaccggactggtcgaggtctggtcccgtgacaagggcaagttctgcttcaaggtcaccggcgccagcggcttcctgtcgctcgaactcccgcaggtctacggggtcaagggcaacgactacacgctccgcgtcgacatggaggtcgcgggcacgggcacggaggcgtccttcgacgtcgccaagaacgcctggaccccggtcggtgagagcgctgaccccgagaaccgcgaccacacgctccttgagctccacgccaccaagtagcagtcggcccgactcctccggaaccagcaagggatccttgtgtctttgagatcttcccgccgtgtgcggggtacggcactgttcgcggtggtcgccgcggccggtgcgctgacggtcacttccccggcgcaggccgtggtcggtgacgcggtcgcgagcggttcgtacgccttcaccgcgaagctcgacatcggtgagggcgacgcgaagcgtgcctgcaccggttcgctggtcgacgcccagtggatcctgaccgcgagcagttgcttcgcggcggcgggacagccggccttcccgcttcccgccggggccccggcgctgaagaccacggcgacgatcgggcgcacggacctgaccgggaccggcggcaaggtcgtcga

SEQ ID NO: 3169 - DNA, 6917 bp, Unknown
  Kingdom: Bacteria, Phylum: Actinobacteria, Class: Actinobacteria, Order: Streptomycetales, Family: Streptomycetaceae, Genus: Streptomyces
gctctccgcggcttccgtgccctccgggccctccggaggtgtggcggtctccccagaggccgtggaggccgccacaggcgcacgctgcggcccggcggcggtctccggctcggactcgacgtccggctcggtctccgactcgacgtccggctcgggggacgcctcctccggctcacgcaccgcggaggagggtcccgccccggactcacgccgggcggcgtcctccggaagccgggggcggaacaccgcggtcgccgtgtcggacgtcgctcccgggcccgcgcccgtgtccgcctccgcatccgcgtccgtgttcctgtccgcgccggggtcacggaacacggcgaagcgcgggtcgcgttcctccgcagccgtccccgacgacttctgctgctccgttttgtcgggggactcgcccgccaccgatgcctcctcatgcgctgcggggtcaccccgcgctgtccgaaccatctaccagtgtcctgtgtgaacccctggccgagctgctagacgagaacgacatacctactggttcccatacaaagcaggcaggcgctctcgacagaccaatgtgagaggggtcaccctgtcagacatccacgcggggaggcatggatgggcaggagccgcagaacaatcccggaggagcttttgctgctcgctctggacccgaccacgggtaccacagcgcagccgcagtcgctcgacctcggcctggccggggcacagctagtggagctggctctggcaggacggatagcccctgacggggatcgtatcgccgtggtgatgccacggccgacaggagatccgactctggactccgcactggaactgctgcgccgtcgtggcagtccggtacgggcggtccactggatcggcggaccccgcctggggctgcgccagatctatctcgctcatctggagcggtgcggcatggttcatgccgtggcgggccagatgtgcggagtgctgccgacgactcgctaccaagcgacggagacggcgatcagccgggacatcaggacccggctggacagtgcgatccgcaccggcgtaccgccggacccgcggaccgcggcgctcgccgcactggcccacgcggtcggactcggcaaacatctgtaccccgggaacgaggggcgctcgtcgcgctcccggctccgggacctgatcaggcacgacccgatgggcggactcgtggcgcacgccgtgatggacgtccagaacggagtggccgtccagccacgccgtacgcagcaggcagcgggagttccgttgcagccgcaagcacaggcccgccgcggcagcatggcgcacaccgccgccggctgaccgcacggacctgaaaacagcacaccgccgtaccgccgtcagtcgtcacaggacccggtccgggagccgcaccacgcacggggcagccggtagtcaccactaccggctgccccgtgcgcttgcgcgccctcccgcgcaccggtgcgtgcgcccccgcgtcccgcgtgtggccgtttcccagcgcggccggggcaaggggtggcaatctgctgagcagtagatacgcacagctacatagccggaggtgccgtttccgtgccgtccaacgtcaatcccactgtcaggcgacgcaggttgggccaggaattgcgccgcctgcgcgaactcaaaggcatgacggccgaggaagtggcggagcggctgctggtctcgcagtcgaagatcagccgtctggagaacggccgccggtccatcagccagcgcgatgtgcgcgacctctgcggggtgtacgaggtcgaggaccaccgcatcgtcgactcgctgatgcagatggcgaaggactcgcgccagcagggctggtggcacgccttcggcgacatcccgtacagcgtctacatcggtctggagaccgacgcggagtcgctgcgcgtgtacgagccccagatggtcccgggcctgctccagacccgggcgtacgccgaggctctgatcaacggcgcgcttcccgaggcccctccgtcggacatcgagaagcgggtcaacgtacggtcgcgtcggcaggaccgggtcaacgcgccggagaacccgttgcggctgtgggccgtgatcgacgagtcggcgctgcgccgggtggtcggcgacaagcaggtgatgatcgaccagctggaacacctcgtcgagcagtcgcacctgccgcacgtcaccgtgcaggtcctgccgttcgacatgggcgcgcacccgggcatcaacggccagtacgcgatcctggagttcccggacgccgcggactccagcgtcgtctacatcgagggtgtcacgagcgatctctacctggagaaggcgaacgacgtgcagcgctacagcgtgatgtacgagcacctgcgggcgcaggcgctgaacgtggagcagacccgggagttcatcagcaggatcgcgaagtcgtacacgagctgacggaccctggggcaccgggcggcaccagcgggatcaggacatccgctccggcgtccgcggcggaatccggggagagttgagtgagcggcggcgggatagtacaccgccgcccactcatcacggaaggcttaccggagaaagaccatccggtcgagtgaacggccatctcatgcgcggggcttggcgagtagcgtcgatcacgccaatcggaatcaggttggtgcgactcacccaactctctgaaccggagtgaacatggcaattcttgagggtgctacggacaagtggacgaagtcgtcgtactccgggggcaacggcgcgtgcgtcgaggtcaagtcccccgtcgctctgtccatcgccgtacgtgactcgaaggccccccagggcccctcgctcaccttcgtccccggtgcgtggaacgcgttcgtgcgcgatgtcgccacgggcacggtcaactcctgacagacacaccacggatgatcacgcaggactgatcgcgcacgaccgcaccacctgatggagccctctcgaccggttcgccgtcctggccgagggggctcggcacgatccggcgccgttccgccgcgtcaccgcagccggtcgacgtaccggtccgtccccggcacggtcggcacgaacggcgcgaccagctcgacccgcccgagaccggtctccgcgaccgccgcgtcgaggccggtgaagcgctcctcccagcaggtccgcggatcctcctggaggaaccacagcagcgtcagccgggtgtcgacgccctcgacctgcttcacgtacgtcatccggtcaccgggcaggggggtcggccggaacaccgtgaccatggccgcgggtgaccccttcagccgcttcggaagatggcgcgagcgcagccactccagcagctccgcacgctgttcggacccctcggcgtcgacgacctggaggacgagacccgcgtacgggtggtcgagcgcgtggaagtcccgtgggccggcggctccgtcgcggtagacggtggcctcgtggtcctggaaggccgtgaacacgtgggtccggtcctggtagacccgaccgtcccggttcagccgcttgttgatggcgacggtccacttcatgtggtcgtcgtagcgcccctcggtcacccagtacgtcgacaggtagcaccccgtgccgaccggccgggccaccgccgactcctccggataccgcagctcctggaggtccttggtggccacccagcgccgaccggcgaacatccacggcatcgccgtcgcacccgcgtagtagtggtcgtcctcgtaccagcggttgtacgcgtactcatggcccggatgcggttcgaccatggtgatcagggcgtgtcccgggcgcaccccgtacggccccgaccccgccagctccgcgtaccgctcgctccccgtcccgccgctctccgtcccggcgcgctccgtcccaccgctctccgtccccctgcttcccgtcccgctgctccccgtgccggcgtcctcggtcatcgcctctgcccgccttcctcttccatcagatcccgcctccacctactctgacgacccgtcagatgaacttccagggccgggaggcgccgatgttgctcgcggggaagaccgtcatcgtgtcgggcgtcggcccggggctcgggcaccgggtcgcttcgagcgtcgtccgggacggcggacgcgcggtgctcggggcgcgcacggcggcgaacctggccgcgtcggcggcggagatcgacccggagggcgggcgcacggcccacctgccgaccgacatcacggacgaggcgcagtgcgaggcactggcggcgctcgcggtggagaggttcggggggatcgacgcggtggtccatgtcgccgcctgggacagctacttcggcgggctccaggacgcggacttcgccacctggcaatcggtcatcgacgtgaacctcctgggcacgctgcggatgacccgggcctgccttccggcactcaaggagcggggcggctcggtggtggtgatcggcacgcagtccgcggtggccgctccctcccaggtgtggcaggcggcgtacgcggcgtccaagggggcgctcacctcggcgatgtactcgctcgcccgggagctgggaccggaccgcatccgggtcaacacggtcctgccgggctggatgtgggggccgccggtgcaggcgtacgtccggttcgccgcgcactccgagggcgtgccggagtccgaggtgctggcccggctcaccgagcggatggcgctgccggaacttgccacggacggggatgtggcggaggctgtcgccttcctggcctccgaccgggcccgagcgatcaccggccagtcactgctggtcaacgcgggcgagctgatgcgctgacacacgcgcgccgctccggcacgagcgtcgtccgcacgcactccctcgcaccgctcacgctactcgcacacgaggcgaccccctctcgacttctcggccgcacgggacccgcatcccgtgcggccttcgcgcgttgccgcgtactcctgacttctctgcacagcctgacgaagtgcccgcccatcgtgtggccgtgctcacgttcgcgacaacgctccacaaggccaagaacaagtaaaatcgttcgccttgttgacctgggttcacatctatgaccgctaggcgaccttgaccgagggccctcactgggggttcaatccccgaagtccccgctcccgcaaggggacaccgctgaacggccgtaccgacgaagtgcgttcccgttcacaaggcggacccctggagggggacatgaacagtctcgactgggctgtactcatcggctacttcggtgtgatggtcgcgatcggactctggtcgcacaagcgcgtggacaacgtcagcgacttcttcacggccggcggcaagatgccctggtggctgtcgggcatctcgcaccacatgtccggctacagcgcggtgatgttcaccggttacgccggcatcgcgtaccagtacggggtcacgtccttcgtgacctggtcgctgccgatcgccatcggcatcttcatcggcgcgaaactcttcgcgccccggctgaaccggctgcgctcgcggctccacgtcgcctcgccgctggagtacctcaagaaccgctacgacctccggacccagcaggcgctcgcctggtcgggactgctgctgaagatcgtggacgtcggcgccaagtgggcggccatcgccaccctgctgtccgtcttcaccggcctctccatcacccagggcatcctgatcaccggggccgtcaccgggatctactgcaccgtcggcgggctgtgggcggacgccctcacagaactgggtcagttcatcatccagttgttcgccgggctggcgatgctgctcgccgtgatgagcgagctcgacggcttctccaccctgtggaccgtctgggacaagctcccggaagggcacgcggacccgaccgccggaccgtacacggtgacgttcctgatggcgttcctgttcatcaagaccttcgagtacaacggcggcatgtggaaccaggcccagcgctacatggcgaccgactcggccgcctccgccacccgctccgcgcggctctcggcgatcctgtggctcgtctggcccgtggtgctgttcttcccgatgtggtgcgccccgctgctggtcgacgcgcagaagccggacgcctccgacagctacgcgctgatgaccgaacagctgcttccgcacggcctgttgggactcgtcatcgtcggcttcttctcccacacgatggccatgtgctcctcggacgccaacgccatcgcggccgtcttcacccgggacatcgccccgacgctctcgaaggcggcgcgcggctggagcgagcgttccgggctgatcgcggcccgctggaccacggtcgccttcctggccctgtcgatggcgatcgcgacgcagatcaactcgcccacgttcaaggacatcatcaccgtcgtgatcaagtgggtcgccgggctgatgggcccgatcgcgatcccgttcatgctgggcctgctgcgccccttccggaggtccggcccgacggcggcgctcgtcagctgggccgcgggcctgctcgccttctggctggtcaactacccgatcaactgggccgtcgagggcggggtcccgctccagtaccaggtgtccataccgctggccgtctcgctcgtgctctacatcctgatcggcttcgtgaagccggaggacaccccggagcgcgacgcggtcctgaccaagatcaacgagggcgacggggacgacggggacggtacggcgacggccgccgtgattcccgcccaggacggaggcccggctcccgcccctcagccgcgcgggtagcgcgccagccagcccggagcgacggccgccgggctgtgcagggcgggaccctgggtcatctccatcgcgaagtcgtcggccagttcgaggagcgtggccc

SEQ ID NO: 3170 - DNA, 17885 bp, Unknown
  Kingdom: Bacteria, Phylum: Actinobacteria, Class: Actinobacteria, Order: Streptomycetales, Family: Streptomycetaceae, Genus: Streptomyces
gaccgccgacgtcgagccggccggcgacaagaaccacgacgaactggccgccgcccggctcgacgtcggcggtcaccggcagacccggtaccaggcgggagaaccggtccaccagccaatccgccgcttcctgggcgtcctgcctggtcggacagcggcccaccatctcccggcctcccttgcgctccagccgggaggcgacagcgatcagcggtgcgggctcgaccacgtacagacggtccggccaggcgatggacaccttgaccgcgcccttgcgcgagttgcacccgcggtgcgcgagccgctcggcgaccttggccttccggtcggcggtccggctgtcgacactgggtccctgcgggtcgttcaccgacttgtcggggtcgaccggttcgtcgcacacccagcaccgccagctatcgcgctcggccacatcattgagaaggctcatccgagcaaactagcccccttgaccgccaccccgtgcaccagggccacggcggagtcccctgtcggcggctacggcggtgtcggaagcatccccgcgggcgcgaggaacaggccccgcgcaccagcggctcccgccgtcgagggaccattcccgtacgtggggacggtgcgccgtcgttggctgcggcagcgacaccgcgtgggccggaagaggccggggacgtacgtgccttttctgcggcacgggccgttaggggtgtcgcggacgcgctgggcgtcccggccgaaaggatgctcgatgttcacgaagcgcgttgccggccgtctgctggtgctgacagccacggcggctgccggtacgggtgcgtggagtggtcaggccctggcgagcacgaacattattgcggccgggaatgacgctcacgacaccacgatgatccatatggaccgtgaggtcggggcggtcggcatgacgacgtacagcagcggggtgggcagcggtctggtccagctgccggtgagcagcgcccagaaccgcggtggtgggggcagcctgctcttttccgatcgtcggctgaagactgaggtcaccgcggtggtctgggagcgatgagtcacgggcggttgaaagcggccctggtcaggatgctgacgtcggcgccggcctggccggggcagcgacagggtggttctgccgcgggtctggcttccggtgccgtgccgggcgcggtgcgcggcagcgacccggtcaacggctaccgggtgctggagcaggtggtgcggttgccggtcagcacctggcggtaccactgggacccgccgcacgtacgtcatctcgggcccatggcgcaggactggtggaaggcgttcggggtcggtgagaacgaccggacgatctgctgcaccgatgccaacggagtcgccatcgtcgccatccaggcactgcaccgggaactgaccgaactacggagcgaggtcgaggccctgcgagcggagagttcacggcaagcgcgatcgaaccgcgccccggcgcggctggatgccgagaaggccgcggaacaggcgcaggagcgtccatgagaccttttttgcctgccacgccggcgacaccccctacgtcttcgagggcccggacgcgtggaagcacttcaccgacgcgcagacgcgtctgtccggcaccatgaccgactactgggcacagttcgcccgcaccggcacgccgaaccggccgggcctcccgcggtggcccgggttcgcgccgtcggacgccgtgccgcacacccagtccctggcgccggacaggatcggtccggtcgactacgcaagggaacaccggctcgacttccggcgccgcccggtcgcacagggaaccctgccgacaacacggccgaccgaggtcaaggagcccctctcatgacggtccccggtgaccgggtcatcaaagcggccctgcggctgcctgcccgcttcaaggaacgcttcggcgtgcgtcccgtgatcgaggaagcggaaggacgcggtgcacgctgctcggtgatgccgccgccggcacccgtgccggtggcggaccttcccacggccgaaggtccctttctggagggtggcgacgtgctccccatggggcgtgacatcctcgtcggcaccggcacagccgcgtccgacgcggccggagcccagtggctggaaaggctgctcggtgacggctatcgcgttcaccaagtgcccctctccgaccgggtgatccacctggacgacggcctcaccaccgtccgcgaaggcctcgccgtggtctgccgggagcagttcaccgacggcctgcccgccccggtcgccgagtgggagctgatcgacgtcagcctccaggacgccgtcaacctccttgcgggcaacagcctggtcctcatgcccggtgacgtgctcgtcgacgaacggctgacggccctggccgaagccctcaccgcgcgcgacgttacggtgcacacgttgccctacgacgccgtcacccccttcgcgggcggcttccgctgttcccaccatccactggtccgggaactcatcggttgaaacggtccgtggtggtccactggatcgcaggccttctacgtgcgacgccgactgagtgacaaatgtcagtgaaaacgatgaggaagcgcaccagttcgtcggcaatgcggttcatagccttccggtaggtgtccacgcgcccgggtgccgtgcgttttacccgcgaaggagatcgccatgccgcgtccggcctcgtcctcaccgagcagcactcgcaggactaccggaatccaccggagaggtgtggtcaccatggggtccgcgctcgccgcaggactggctctgactgccgctcccgccgtcgccgcgtcgccccgcagggcgccgggtttttccgagccgcccgtacggctcgtccttccgctgccgagaggctctcatgcccttggcaccgtggcgctgcatctcagggaccgcagccgccgggacccttgggtcgccgcacggccggaacgggagctgatggttcagctctggtaccccgcacgcgcggcagtcggcctgcccagggcgccctggatgtccggtccggccgccgcggtcttccagcagacgggttatctcctttccgagtacgtcacgctgccggacacgcacgcacgtatcggcgcggcggcggacaggcgtggaggtcgacgccccgtgatcctctactcccacgggcacgggcagcaccgcggctccagcacgacgctggtcgaggaactcgtcagccacggctacgtcgtggtcaccatcgaccacacgtatgacgccgggcaggtcgagttccccggtggccgggtcgagaagtatgcgatgccgcctctcaccggggaggacgacgacccgacgatcctcaaggctgtggacgttcgagtggccgacacccgtttcgtgctggaggagttgtcgcggttcgtccggggccgccgagggccgctcccgcacggactccgcgacgtcctcgacctttccaggaccggcatgttcggtcactccctgggcggtgcgaccgcggcctcggcgatggcggcaggggcgccgatcacggcaggcgcgaacctcgacggcagtctcttcggtcctgtggtggccagggggctgcgcaagccgttcctcctgatgagcgaggatgcggacaacaagccgagctggccggagatctggccccggctgcgaggatggcgtcgccatctccggctgacgggtacccggcacttctcgttcacggactatgagacattcatgccgcaggccgcctcgcggctcggagcgaccgacgagcagctggccgagttcatagggcctctcgacgggaaacgcggtaccgacgtccagcgacagttcctgctcgcctacttcgaccttcacctgcgtggctgtcgcgccccgatcctcgaagggccgtcaccgcggtatccggaggtacgtttcatcggtggtgtcggatgatccgaaaggacacccggcggacggtcgacgagccgggagagatcgcgtgtatcgaccgagcaggccgggccccgacaccgtcagcctgatccctgagttgggcaccgtgggattccgaccccaggcaaccacgaacacctgtctcgttctcagcgtgcggtcaaccggccgtccgtcttccggtcagggagcgcagcgggtcccggcacggggccgaccggccgcggctgccacggtgtccgcggccggaccacgaacaacttctccgaggccgctctcctcctctgcgcgacccaggtgccgtgcggcatgccggtgccggtagtcgcgcatggcttcctcgcgccaggcggcgaaggtggcgtcgcacagctggtcacggaatcggccgattcccatccaccgcagtgcggccccggaccggtccagggggaagtaggtctccccgggcccggtggtgccggcctgtggttgaccgggtggttcaggtgtccatcccagggcggtgaccgtgtccatggaacgcaggtttccgaagatgcccggcatctgacgggcctgccgtcccagatccagatgttccacctgcaccggcccggtgtcgtcgtcggcctccagggacatcgtcaggtccccgcccgactgcccggcacgccccagtacgaccttctcctgcgtcagcaccttgccggtgccgtgcagccggatccgggtgcgacggtgggtggcgatcccgtccgagaccacgaacggcttgcccgcccaggtcaggacggctccgtcgcccacggtggcgtcgaccgtccaggacgacggtgcctcgccttcgtaggcgaccgtgccggtcgtctccacgacgtcgagccaggcgccgggagcgacgtccacctcgatgcggacgtcgtcgccggccagcagcagcgcctgggtggcgagcaggcccactctggccccgtctgcgtcctggtccatgacccgcaccgtcaggtgcccggtcgtgtggtggacgcggctgcggctgcctgtgggagcgacgcataggcgggtcgggcgggtcacgcccgctgtccttcattcgccggtgcgtggtggtgcgggtggccggtgccgtcggcgtgggtgtgcgggtggccgccctcgccgtcctggtcggcgtggaagtgcggggccatggggccgggatcgacaggggtgtgctcgccggtgcggtagcgggtgagggcgtcgcggacccagccggtcagcatccggatggacgctgcgtcgtgccgggacagcgcgaccaccggggagccctggcgggcttcgcggccctcgcgggccatgcgctcgacgtccacgcccacgtattggcccaggtcggtcttgttgatcacgagcaggtcggcgcgggcgatgccggggccgcccttgcgtacgacgtcaccgccgccggcgacgtccaggacgaacagctgagcgtccaccagggccggggagaaggtcgcggtgaggttgtcgccgccggactcgatgatgaccaggtccagcgggccgaagtcggcctccatgtcctcggccgccagcaggttggcggtcacgtcgtcgcggatcgcggtgtgcgggcacgcacccgtctccaccgggcggatccgttcggggtccagtaccccggcactcttgaggaagcgtgcgtcctcgtcggtgtagatgtcgttcgtgatgacacccaggcgcagttcgccggagagcgcctggcacagtgtcgcgatcagcgagctcttgccggtgccgacgggaccggctacgcccagacgcatggcgcgggtgggtgcggtgatgttctcaggcactgaagagtctttctgtggtggtgtcgtgggtctcggcccagcgctcgatgagaggagcgccgtgggccgggatctgttcgggggtgtgcaggtgggcgacctgaacggccatctcgtcgatgtccggcagcaggtccttcacccacgcggcgatgagcagagggtcctgcggatcgagtttgagcagggccgctgtcacggtctgtacgtcgtcgtacccgaccaggcgggccacatcggcaggggtcatcgcggcgcggtgggcgagcaggcccagcacgaccgggcgcgaccaggtgcgtgcgcgggcgtcgaaggggccgggccagagcgcctgcatgacgcgcagatacccgcgtcccaggcgccgcccgttggtcctgagcgcctggctgggggtccgggcggcccaggcggcctcgacctcggcgaggtcgccgccgcccgctgccacggcacgggcaacgacggcggtccccgcttcgacacggatgaccgtacggaggcgggcacgcaggtaggcgggaacctgggctgtggtcgtgccggcccgcagggcgggctccagaccggcggactgcgtgtggcccccggacgggagccgggcgtcacccaggagggcgagcaggagagaggaagcgttcaccgggtacctcagaacatcaggtagcgctgggtgagcggcagggttttcggcggatgcggctggtcgagataccagaaaccagcacggctcctgtgcttggtgaggctgtgattccgcgccgtggcaagacccgggatctccaccgcgatcttgaaggtgctcgggtcgatgtcgatgccgaactgcccgccgttgaagaccatgtccgccttcttgacgtccatgacgggcttggcgcccttcagctcacgccgcagaccgagggtggccttcaaggagtccttgaacacgccctggtctctcaccgtgccgtacgggtcggtgccggagggcgggttcaggaccttgtccgagacgaacgagtagcacagccgggaggcgatcgcgtcggccatcgccgggcgcaggaacgtcggttgcggcgtcgataccgaaccgttggggtcgcccaggttgccgagcaccatggtgccgcccttgatgaccatgtcgggccgtacggcgaagaaccgcggatcccacagcaccaggtcggccagcttgcccaccttcaccgacccgacgtagtcgtcgatgccatgggcgatggcggggttgatcgtgtacttggccacgtagcgcagtgcacgggcgttgtcgccggctccctgctcggtccggtagaagaagttcgcgtcctcgaaggtcttgtggctccactccttcatgacgtgcgcgacctgccaggtgcgagtcacgacctctccgatgcggcccatggcctgggcgtcggaggaggtgatggacatcgcgcccatgtcgtgcagcacgtcctcggcgaacatggtcgtggagcggatgcgggagtcggcgaacgcctggtcgttcttgttgctgaggtcgaggtggtgggcggaggccagcatgtcgatgtgctcggccacggtgttcctggtgtacggcagcgtcgggttcgtagaggcgggcagaacgttctcctcggcggccaccttcaggatgtcgggagcatgtccgccgccggcgccctcggcatggaagacgtgaatgccgcgcccgccgatggcatcgagagtggtctcgacgaagccggcctcgttgagcgagtcggcgtgcagggtgacctgcaggccccactcctttcccgccttcagcgcggcgtccagagccgccggagtggcgccccagtcctcgtggatcttgtaaccgccggcgcccgccagcgcctgctcgtccaggccgtccttgctgaccgtgttgcccttgcccagcagcatcacgttgaccggcaggtcgtcgaagctgcggtgcaggttcaccaggtgctgcgggcccggggtcacggtggttgccttggacccctcggagggacccacaccgccgccgatcagcgtggtggtcccggtggccacggcctccttgacggccgagggggagatgaagtgcacatgggtgtcgacggtgccggcggtgaggatcttgccctcgccggagatcacgtccgtggagggaccgatctccagcccgggcgtgaccccgtccatgacatcgctgttgccggccttaccgatcgcgacgacctcgcgacccttgattccgacgtcggcacgcacgacggcgttgccgtttccccgttcctgggcgggtgcgacatccaggatgatcacgttggtgatcacggtgtcgggggcaccctgcgcactggtggtggtgccctgcagcatcgactcgcggatggtcttgccgccaccgaagatcgcctcgtcgccaccgaaggtcaggtcttcggtgatctcgatccagaggttggtgtcgcccagacggacctggtcgcccacggtcgggccataggatttcgcgtactgctcgcgggtgatgtcagccattgctttcctccagctgggtttacgagggcctgtcagccgagatcggcgtcgccggcctgcttgtccttgcgcaggcccgggacctgtcgcctcccgccgatcggaacgacctcgatcgcgtggctcggcgcgttctcgggactgaaccgcatggagtcccccggagcgatgtcgaggcggtagccccagggggccactcctggcgtcttcgttcgttggtgcgccaactcgcgtgcctcggcgacccgttcagaccgcacgcgctcggggtcggtcaggacggcctcggcagcggttgcggcgtccaggtcggtgaagaacagcaagtcctcgttgacgtcggccagatggatgtgcgaaccgatctggatgtcgcggtcaccgacattgaccacgtagacagtggccttgccctgttcggagttgaggacgtgctccgcggtcgggtccttgacccacactccgcccaccttgtaccgggagaagtcgtggacctggcccggatccagatcggagggcggcaggagttcgggagaggcagagcggtccggccgcacgtccggacacacgatcggcgtgggcttcgctgccagcggctggaagtagggcatgggttcgtcctcagtggatcggggcggccatcggggtgatcttcggggcgcgaatcgggttgtagagggtcacgagcttgcggccgtcggggaaggtcgcctcgatctggaggatgtcgagcatctcggcgacaccctccatgacgtcgaccgtcgtgaggacgcactcaccctcgcccggggtgtcgcccttccgctgctccaggggaacgccggcgtcactcatcatctggtcgacggtgtagttgcccgcccgggcctcctcgatgacccaacagctgatgtaggcgacggcctcggggtagttcagcttgactccgcgctccttgcggtagctggcgagcatccccgccacgctcaacagcagcttttcctgctctgacggaatcaggtgcatccgtgctcctcggtagtggtgttggtgtctctggcccctggtggccccggcccaaggaaggcagccaggacacctccgggcgaaagcccgtaaggcgagcagcacacttgtggtcggggagcgaaatgcctacggcctttcccggattcagcgacgaatgtgagtcagcagcgagagccgggaccaccgggtccaccaactgagccgtaggtgatcatcctgcggtcggccgggaggctgccgcacaatcgcccccgacccctcgaacgggtgctgacacgagcgtttgatcgaaatcggcgaccacgagaaggggtacggattcgttgacccgcactcgacggtgccgccgctgaacaggctggaacaggggatgtcggcgccgatcggcggaagcgcgaacgcgcgtgtctcctcgtgctgctggtttctgcgatggcccggcgcagtcgtacgccgagcaccccgaccaccgtcacgagtggcttccgtaggacccgtcaaagagacagtcccccgttcgccgagggcgaggtgcggcacctggccggcagcggcccgctcctgcgacgtgcggggatcagaggggccggccggctgcgatccaagcaggggtcagcgtgcgcgcccgtcgatgagtgcggccaagccgtccaggatgcgctgcaggccgaactcccatgcctgatcctgcccgtgggactgggctgttgatgcgagggcccctgcgatcgcggggaatcggtcgccgtgtgtgtgcatcagatcgtcaaggatggtgccgagctgggcttcggggtcgcccgccgggcctgctgcgcgggcttgctgggtgatggcgcgtacgtgacccaccaggagcacggcggcgtccatccgctcggcaccgctcagccccgtgccgtccagggccgagatggcttgctccagccaggacagctctccgggtcccgggacccgtggcccgatggtgacgtccagcgcccaggggtgctggcggaacacggtgagcagttggcgagcccattcctccagctgctcccgccagccaccctgcggtgcctccgcctccgggtacgggccgatcgctgcgtccaccatcagagcgaccaactccgccttgccgggcacataccggtacagcgccatcttggtcacggccagttgggcggcgacccgttgcatggacacctcggcgaacccctccgagtcggcgatctcgatcccggcccgcgcgatgcggtccagatcgaatttcggtcggggaccccgcgcggccttggggtgcggaccccacagcagccgcaccagctcggtgtgcttgctcttcatgtccgccacccctcctgccctgaccttgccgaactaactgtatccaaggtacacagtaattatcagtgtcccatggacacagttttagagtggaggaacccgtgaacaggaacgtcctcatctccggcgcgagtatcgccgggccggcgctggcctactggctgggacgccatggtttcaggcccacggtcgtcgaactggccccggccttgcgcacggggggtcatgccgtcgacttccggggtgaaacgcacctgaccgtgttggagcgcatgggcctttttcccgaactacgccgtatgcagaccggcggcagcccggtgcgcttcgttgacgacatcggccggacactgcttcagctgccagccgaattcgccggcggcgagatagaggtgctccgcggagacctggcccgagtgctgtacgaacacagcctcccccacaccgagtacgtcttcggcgactcgatcaccagcctcacggagacctcctccggcgtgcgggtcgacttccggcgcggagccccgcgcgacttcgacctggtcatcggcgcggacgggatgcattccaacgtccgtcgcctcgccttcggcccgcaggagcactatgtgagccacctcggctactacgccgccacctggcaactgcccaacgacctgggcctgggaaagggctcgatcggtcacaacgtcccggggcggttcgcttccgtcggtgccgaccaccgggacccggcgcaggcaggggcgttctttgtcttcgccgcgcctcagctgtcgtacgaccgccacgatcccgaacagcagaagcatctgatcgacagggccttctccggcgtcggctggaaggtgccccgcctgctcagtacgctgtcccaggcccctgacctgtacttcgactcgatcagccgggcggatgtggatacctggtcgacggggcgtgtgtgcctcgtcggggacgctgcctgcggggccaccatcggtggcatgggcacgggaaccgccgtcgtcgccgcctacgtgctggccggcgaactcgcgcgagcccagggcgaccatcggatggccttcacccggtacgagagcaggctccggaagtacaccagggggtgccaggcgggcggcggccgcgtcgggaggttcctcgcgcccggcaccgccgccggcatacggttccgcaacaccgtcctgtcccgccccttgttcctgaacggaatgctgaggctgggggagaaggtcagcaccaccgtggccctgcccgactatcccgccgatcccagccgcgtcatccggtgatcggctgcctcggcgatgccctgagaaatggtgcgtcgaggcgggacaccagctcgcggttggacgttcgggcggttcgaagcggcactctcgtcgtctccgaactggtgacgaacgcgttcgccgccgacgcgggggtgggagccgtgggcgagatcgggatcgagctggtcgtcggcccggcggaccggcaggtcgccctggcggtcatcgacggcgaccggccgctgcccgagtccccggccggcccactcggcgagggtggcggacgcggtctgctccaactggacgctctcgccgacggccacacgaccacgatgggccccgcgcacctgcggcgggaaatgcgtcagggccctgttccggtgtcccgctcggcacagcggtggcgccctcctcgccggatcggccggagtgcgccgatgcctgataccgggctgcggtccgggagcgtgttggcggacccgcaggtagcgtcggacgcgaccgaaggaggcgtcacagcgatgcaggagaacggggagcgcggggaccgccgcgagcagatggtcctgcggctcgtcgaggccgccggagtcgtgatcgaccgggccgggtacgccggtgcgacgaccccggagatcctgcgccgtgccggagtctcccgcggcggcttctaccaccacttcgagggcaaggagcagctcggcgacgcgatcctggaccgtcagcacaagttcttccagaaggtctccgagcaggcggcgtcgggcccggccccgaagatctggctccaggcgctgatcgacgtcagccacctctacaccgccggcattctggaggaccccgtcctgcgggcggctgtgcgcctcagtatcgagccgggtccgtaccagaccgccgaaagctacgcgggcccgctgggagccgtcaccgccgtcctcgaatccgcccgtgccgccgacgagctccaggaccacgtcactccggaggaggcctcccggaccctcgtcggctgctacagcggagtgcagctgctcgcactcgccctcgacgagcgcgacgccctgcaccagcaggtcagcgccatgtgggccctgatcatgcccggcctcgcccggccggccgtcctcacccggctgcgcctgagcgcaccgcccgcagatacagcgcggcggcggtgaaccccggcccgtaggccaccgccacccccggtccctcggccgcgtccccggtcatggcccgggccagcacgtccagcagtgccgcacggccaaggttctccgcccgcgagggagtcccgcgcgtgccgtccggccgcctccggatcgaggccgagaccggtcagggcccgggagatattcctggcgcggcggcgcacccgcacaaccaacggcgcccccgcccgtacgctgccgctccggatctccggcctgcacgcccgtccccgggatgcctggccgcctcgatgagccgagaagggtggcggctaccacttgacctgatggaagtccatcgtgccgaaggtcgtgatgtccatcgcgtaactccacaacgcgtaccgccgctgatcagtacggcgataggtcttgccgaaaccgttgtcgagaatctcggtccagccgtcagcctgtccgtagtgcgcgaacagccggtcattgcgccgcgacgcgtcctctccggactccgccggggtctggtagatcacctcgtgcagccggccgagccagagagtgagaagcagacggcccccgtcgaccacgtatgtgtccacgaccgcgtcgggagcgttcgtgtgagggtccgacgactcgagttcgccggggacccgcacttcttcagcggtgcacagcaactccagcaacggcaggtcatcggtgaggcagtccatgaggggccaccttagggcgtgtccggcggatcgggcccggaatcaggtcgacgcccccttgtggggccgcagatgcgcgtgccaagccccgcgaccccggaaggatccgccggacacccccaaaggtgtattgatcacgagcgttggactgttcatggcaggcggctgctggtcgcacgtgtctgctccggccgtccggtcgcgcacgtagccgcggagacgggcatctcgcgtcccaccgcccgcacgtggctccggcgctggcggtccgagggcgaaagcggcacatcctccgctccagccgcccccgcaggacaccacaccggaccagtgccgcaaccgaagcccggatatgccgcctgcgtcaggaccgcaagctcggacccgcacggctcgggccggtcctcggcatgcccgcctcgacggtccaccgtgtcctgacccggcacggactcaaccgtccggccggcctcccggttcaggtcgcactgggggtgtcccgcggggaggctccgcctactcgaagaacttcaggctgtagcccgcgtcggtcgtgctcccgggaacgttggcgcgccggtaggtcgtgttgttccaccagaccgccgtgccggagtaccagtagcggttggaccaggagtacggggtgcccttggcgaccgcgtggtagagggtggggaagcggtttccggactgcggagcggcgttgacgtcgccccggggcaggatgaacgagtggtggccggggccgttcacgttcacggtgggcgtccagccggacatcagggacggcgcgtgcgagccgaagaggcagccgttgctcttgtaccagtcccagacgtacgtcgggtcgccgcccgcccgcagccgcaggtcggcgatgcagtacttgtcgctccagctgccgttcgcggagtagacgacgtgcagccgcccggaagggtcgacgaccggctgcggagcctcgttgatgtacggattgcccacgatccgttcccaaggctcgcgcggctgcgagatgacgtaccggccgccggtggctgcggtggggctgctcatccgggcgatgtagaggttctgctcgacgttggtgtcgccggaccagcctgaccacacaaaccagcgctgcccgttgtaggtgaagggcgccccgtcgatggcccacttgtcgccgggcaggttcaccttgacggccgcagagtagccggacgtcgggttggcggagccgatgtggtacatccggtgagccgcgcctcggccggcggcgaagtagatccggtactgcccgtcgtggtgcacgatctccggcgcccacacctcacccagaccggcactgtcccgccacacctgatacttgggcgcagtggctacggcctccggggtggcggccgtgcgcaccgcgatcccgccgtccacggccttggccgagacatacaggtcgcccaccttgatcacggtcgggtccgccccgcccaccagggagcggcccagcgtggaaggctgatccgccacggtcgctgccgccggttccgtcacgcgcctgtccgtctcctgggcgcgccaagcggtgggccggtcgccgggctgggcggcgacagcggactgcccgattgcgaggaggcccacgagccccagcggaacggtaccggcgagccaacgggaagagcgcatcagttctcctcgtgtacatgacatgggtgagagcgctctcaagcgttccgtcggcggacagtcatgtcaatagacagagcgacgttgatacgcattaacggctaggtgttgcggtacggaacgtcggtgacgcggacctaggcggactcacgcactcgggtcccgtttccgtgctgactcgatgatcccggccagcagggttcctgcccggagaagggcgagcgtgcgcaccgcgatggtcgcgagtcgcgcctcgagcgcagcggccgtgtggctcacctcattgagctctcggaccgctgtgatcgccgtctgtacgtctgggatgcggtagccacctgctcggagggcagcagtgatgcgtgcctcgcggatagcggtgagtgtgtaccgtcgcgcggtgcctgctcgcgtagagacccgctcgggggccaccaaaccaacctcctcccagaagcggagcgttgatgccctgacgccgagtgcctgggacagctccgtgatggtcatcgagtcactctcgacaggttctccctccgtggtcgcctcggaacggatggtttccagagcatgacgggccgcgagtgcttgtgcgcgctcatcgttgagcctcgtgtggaactcggagatcaacgctgctccctgcccggcaggcagggtgtggaggtcccgcatcgcttggcgggcttcaacgggccccaccgcgtctgcgagacctcggtaggcacgaactgcgttgacgtgcttggcggagaactgtcgatacccgttggtcgacctcgtcgcagcggggatcacgccttgtgcctccaggtcgcgcacctgctgcacggagtatccagacgcggccgcgacggcggcggtgttcatgtgtgggggcacttcggccgctcggttcaccataaccctccataagcacttcaagttcatgcttgaaccatgagtatggatgacttccttcaggcgatccgatcgttcgacggcgtcctcgaactcgcccccaccgagggcagcggcttcccggagatcgcttggggcgaccacttcttctacttcgctcccgacggtcaagtgcctcagcgcgagcagccgtacgccaccatcgtgactaaaaactaccccgacgacgccctttgcgacctcgatcttcccggtcgctggcggctgaacatccacgtcgggacggacgcattcgtagagctcacgggcgagcatccccgagctgaggcggcatcgtggaactacacgctctctgacacggtgcttccccacccgttgtaccgcgcacaaggctgggtgtcgatcgtcaaccctgacgccggcacccggaagctggcagctcagctcctccgccaagcacacgaggatgccaagcgccggacggggcgccgccgctgcaatgcgcatctcgacggtgacgtggattccggtggtgatcgatgacgcaccgtaacgcccctctctcggtcgaaggcaggcggcggcttgtcgagcgctgggagagtcgaccgactgcgcacgttgcggcggagatgggtatctcccgcgtctgtgcaagcaagtgggtcaaccgttggcgacgtcacggcgatgccgggctcctcgaccgttcatcgacgccacaccgcagacccaacgtgacccccggctgggtcgtcgagaagatcgagacctggcggcgcgaacacacgtggtccgcgcggcgaatcaccgacgaactcgcccacacggggttcaggatcgaccgccgcactgtcacccgacacttgaccaggctcgacctgagcaaaaaggcgggtctggtcggtgaagtcttggtccgtgtcgggccagcgcgtccgcagcatggcggcgatccggcggacccaccctgcaaggtgcggcagggagccgcagcccagggcggtgcgggccgcctccagcgttgccaccagctgcaagcggctgttgtcgccctgcacgcgagcgtccagcgcggatcaccgcccacgacaggcacgcggctgccagcccgcggccgaacagctggtcgtcctccgcctgtggaataccacgtgccagcgcgcggcggtgctggccggccaggccggatgcgaccggatcgccgacactcaaccagcccgggccgggcacatacaggcacaccgcatcggccagcgcatgggtgaagccggcggcctcgaagtcgatgacccgggcatcggccgggccgctggcatgcaccagcaaattgttggcctccgcatccccgttgctgagcaccataaatgggcccggctcgctcagctcggtcacggtttcagcgagttcggtcaacacccggccgctgggcggcactccgagggccgcagcctgccgtaccccctcctcccggcagggagcgaagcggccggccgcttc

SEQ ID NO: 3171 - DNA, 1997 bp, Unknown
  Kingdom: Bacteria, Phylum: Actinobacteria, Class: Actinobacteria, Order: Streptomycetales, Family: Streptomycetaceae, Genus: Streptomyces
acgccggctggctgctgcaccacctggcgctcaccctgcgctggatcgggaacgacctgccggacgacgtggccgcgctgctccggtacaagctgctgatccaggggcgtcgcctgtacgacttcgcggtggcgagcgagggccgctggtggtcgtcctcgtactggcagaaccacaactggatctgttacgcgggtctggcgaccgccggctacgtactgggcaaggaaaagtggaccgaacgggcgaagtcgaacctcgccacggtgctggacgtgatgcccgaggacggttcgcacgcggagggggtcgtctactggcgttacggagtcccgttcctggcgatccacctggacctgctggcggaggccgagggcgtcgactggtgggaccggggaggcttcatggcgaacaccttcgactaccggctgcaccagagcgcgcccggcttcgcgttcacgatcgaccacggcgactgccacgaccggcgcagcggccacagcgccgggctctactaccggctggccgcgcagtacggcatcggcgaggcgcagtggctgggcgacctcgcctcgggcgagctgctccaggcggaggcggagcacagcggggtgcggccgggcatcctgccggaggcgtacctggaatacctctggtacgacccggccgtcgtggcggcccggcccaccgcgacccgggccttcttcccggacctggggctgctcacggcccgcaccggctgggacgccgacgccaccgcggtgtcgttcaaggcgagtccgggcggcggccaccgggcctgggagacgagcgcgaagcaccgggcggagctgggccacgagacgctgaaccagggtcaccaccacccggactcgggctccttcgtcctgctgtcgggaggcgcccacctcgccgtggacgacggctacagcaaccgtaagcgggctgaacaccacaatctgctgctggtggacgggcaggggtacgcggacgaggaccgctaccacgtctacgaggggattcccttcgagcggcaggcccggcagcgggacgtgctggtgggagacgaggaggggtgggcgcacgccacggcggagatcgccgcgatgtacgacccggccctcggagtccgtcggctggaccggaccctggtcttcaccccggcggggcgcctggtgctcctggacctggcggagtcgcaggagccgcgggagtggacgttcctgctccggacggaccggccgacggaggaacacggcgacggcagccggctgatcaggtccggcgaggccaccgcccgggtacggcggctggccccggacgaggcgtcggtgcgcatcggggtcatggaggtcgaggccaatccgacgtccagcactccggaactgcggctcacccgcaccctgcacacgctggacgtgaccaccgcggcctccggcgcgggtctgttcctcaccaccatcacgccggacgccgcatgtccggtcgccggggcggagttggccgagggccacggcgtgcggttcgcggacggtgaggagagcgtgttcctctcccccaccgaccgccgcatccggggtgaggggctctcggcggacgccgccgccgtcctgctcaccgccgcgggagtcccgtacgtcgtggcggcgacccggctggagctcgcgggccgggtactcctggacgtaacgaatccgtacacaggaaaggtcgggtagaccatggggacccctcttgccggggcggtggcgtcgccgcccgttccggaagccaccccgtcgggctggccgacgctgctgcgccggctggagttcgtcgcctacccggccgccgccggggccgcgttcaccctgctggcgctgggcatggtgacctggctgccggcgctcgccgcgatgggcagcgcgctccaacggtggcgggtggacggggacagccgctgcttcaccaacacgctggccgccttcggcggctactggcgcgcgctgtggcggcac

SEQ ID NO: 3172 - DNA, 4126 bp, Unknown
  Kingdom: Bacteria, Phylum: Actinobacteria, Class: Actinobacteria, Order: Streptomycetales, Family: Streptomycetaceae, Genus: Streptomyces
ggcggcccgggccgcctccgtggccgccgctgcggccgttttcgacgccttcttggccgcgctcttcttggcggtgctcttcttggcggcgggtttctcgccgaccgccgccttctgcgcaactgtcttcttggcggcggccttcttcgccgtcgtcctcttggccgccgtcgtcctggcggcggccttcttcgccgtccccttcgccggcgcgggcgcctgctcggccggtgactcgtgagcgccgtcgtgctcggccgcggtctcttccgccgtcttcttcgccaccatggccgcggccccttcacatattgtgatcttgctcgcgaatcgtgctgggacgataaatcgactccagccccgcggcaacggggcacgccgccttctcgcccctccccgtatccggtcgtggcgcgcctgcatccgttgttcccagctccccgtccggtaatccggccgccgggccccgccgggaagtccttctaccccgtcccgccactcgggtcacgcccgcgcgccgccgataaccggtcggccgtcgcccgtacgggcccgtacactgggcccagcgagaggcttggatgggacgagtagcgccgtacgcagccagtagcgacccggggacggtgggagcccgggggcgagcgcgtcgtgaagatcaccccggagccgccggaagaacgtcttgcgcagggggctccgcccaccggcgcaaggccactagacccggcatcgcgaccccaatgagggggccacgggcctgcgccctgggccaaggagggtggtaccgcgggagccgagacgctctcgtccctccgacggaagtggaagacgtccgccggaggaagccgcacatgacatcgccgcagtaccgccaggtacccgctcaggtcgacctgcccgcgctcgagcacgccgtgctcgacttctggcgcgagagcaaggtcttcgccaagagcctcgaccagtccgagggccgccccgagtgggtcttctacgagggcccgcccaccgccaacggcatgccgggcgcccaccacatcgaggcccgcgtcttcaaggacgtctttccccgcttccgcaccatgcagggctatcacgtcggccgcaaggccggctgggactgccacggcctgccggtcgagctcgcggtcgagaaggagctgggcttcaacggcaagaaggacatcgaggcgttcggcatcgccgagttcaacgccaagtgccgtgagtcggtgacccggcacaccgacgcgttcgccgagctgacgacccgcatgggctactgggtcgacctggacgacgcgtaccgcacgatggacccggagtacgtggactccgtgtggtggtcgctgaaggagatcttcaacaaggacctgctggtccaggaccaccgcgtcgccccctggtgcccgcgttgcggcaccggcctgtccgaccacgagctggcccagggctacgagacggtcgtcgacccctcggtcttcgtccgcttcccgctcacctccggcccgctggccggcgaggcggccctcctggtctggacgaccaccccctggacgctggtctccaacacggcggtcgccgcccaccccgaggtccgctacgtcgtcgcgacgaacggcgaggagaagctcgtcgtcgccgagccgctgctggagaaggcgctgggcgagggctgggaggccaccggccagtcgttcacgggcgccgacatggagcgctggacctacgagcgccccttcgccctggtcgacttcccggcggaagcgcactacgtggtcaacgccgagtacgtcacgaccgaggacggtacgggtctggtccaccagtcccccgccttcggcgccgacgacctcgtggtctgccgctcctacggcctgccggtggtcaacccggtccgccccgacggcaccttcgaagaaggcctcccgctggtcggcggcgtcttcttcaagaaggccgacgaggcgctcaccgcggacctggacgcgcggggcaagctcttccgccacgtcccctacgagcacagctacccgcactgctggcgctgccacacggcgctgctctactacgcgcagccgtcctggtacatccgcaccacggcgatcaaggaccggctcctccaggagaacgagaagaccaactggttccccgactcggtcaagaacggccgcttcggcgactggctcaacaacaacgtcgactgggcgctctcccgtaaccgctactggggcacgccgctgccgatctggcgctgcgaggacaaccacctgacgtgcgtgggctcacgcgcggaactgacggaactcaccggcaccgaccaatcggggctggacccgcaccgccccttcatcgacgagatcaccttcacctgcacgcacgagaactgccagctggaggcgtaccgcgtcccggaggtcatcgacgcctggtacgactcgggttcgatgccgttcgcgcagtggggttacccgtacaagaacaaggaagtcttcgagagccgctacccggcgcagttcatctcggaggccatcgaccagacccgcggctggttctacacgctgatggcggtaggcaccctggtcttcgacaagtcgagttacgagaacgtcgtctgcctgggccacatccttgccgaggacggccgcaagatgtccaagcacctggggaacatcctccagccgatcccgctgatggaccagcacggtgcggacgcggtgcggtggttcatggcggcgggcggctccccgtgggcggcacggcgcgtcggccacggcacgatccaggaggtcgtccgcaagacgctcctcacctactggaacacggtcgccttccaggccctgtacgcgcgcacgtcgggctgggccccctccgaggccgacccggccccggcggaccgcacggtcctggaccgctggctgctgagcgaactgaacgcgctggtcgaccagatgaccgtggcgatggagggttacgacacccagcgcgccggcaagctgctctcggcgttcgtggacgacctctccaactggtacgtacgccgctcccgccgccgcttctggcagggcgacaaggcggcgctgcgcacgctgcacgaggtcgtcgagacggtgacccggctgatggccccgctgaccccgttcatcaccgagcgggtctggcaggacctgatcgcgccggtgaccccggacgccccggagtcggtccacctgtcctcctggccgaagccggacctggcggcgatcgaccccactctctcctcccagatgacgctggtgcgtcgcctggtggagctgggccgggccacgcgcgccgagtcgggtgtgaagacccgtcagccgctgtcccgcgcgctgatggcggcgacgggcttcgaggcgctctcccccgacctgcgcgcccagatcacggaggaactgaacgtcacgtcgctggcctcgctctcggaggtgggcggctcgctggtcgacacgacggcgaaggccaacttccgtgccctgggcaagcggttcggcaagggcgtccaggcggtggccaaggcggtggcgaacacggacgcggcggccctgtccctggctctgcgcgagggcacggcatcggtggaggtcgacggcgagcacgtcaccctctcccccgacgaggtcatcatcacggagaccccgcgcgagggctggtcggtcgcctcggactcgggcgcgaccgtcgccctggacctggagatcaccccggaactgcgccgcgcgggcctggcccgtgacgcgatccgcctgatccaggaggcccgcaagaacagcggcctggacgtcgcggaccgcatcgccgtccgctggacctcgacgtccccggcgacggtggaggccctcaccgagcacacgccgctgatctccgaggaggtgctcgccctggactacgcggagggcgaggccgacgagacgtacggcgaggtgttcgaggacgagggcctggcgctgtcgttccgcctgcgtaagcagtagcccgcacgttcacggggcccggccgggaggtttccggccgggcccttcgacgtacccctgttcctcaaccgccggactggctgggtgtatcaggccctccggcgcttgagaggagcggggtccggggc

SEQ ID NO: 3173 - DNA, 870 bp, Unknown
  Kingdom: Bacteria, Phylum: Actinobacteria, Class: Actinobacteria, Order: Streptomycetales, Family: Streptomycetaceae, Genus: Streptomyces
cggcgctcgaagccaccgctcggacggccaccgcggtcatcacgctgctgaccaccgcggtacccaccacggtcgtcatcccgacgaggcccacgatcacggtccccaccacggttgtcatcccgccggaacccaccaccggaaggccgactgtcatcacgacggaacccaccgccggatccgccaccacggttgtcatcacgacggaaaccgccgccggagccgccaccacggttgtcatcgcggcggaagccgccaccggtcggccggctgtcgtcacgacgcgggccacggtcgcggtcccggtcgtcacggcggaagccaccgccagtgccgccaccggtaccggcgccggaaggcctgttgtcgtcacggcggaaaccgccgcggtcgttgtcgcgtcgaggtgcgccggaaccggaccggtcgtcacgaccaccgcggtaaccgcccctgtcaccgccgtcccggcgacgcggttcgcgctccggacgatcgtcgggagagttggtggacatgggtgtgactcctgtcttcgggtaccacagacattctcgcgcagccggccagtcgacgcgcttcaggaaaacaaaaggacccctggtcccagcatgaacgctgggaccaggggtccttgaaaaattgttcggcggcgtcctactctcccacagggtcccccctgcagtaccatcggcgctgaaaggcttagcttccgggttcggaatgtaaccgggcgtttccctaacgcaatgaccaccgaaacactatcgggttctagcgaacaagcacactcttcaattaagtagtgaaactgttcaaccggtgcgataactgttcgcaacccgggaacaacacagtggacgcgagcaa

SEQ ID NO: 3174 - DNA, 3423 bp, Unknown
  Kingdom: Bacteria, Phylum: Actinobacteria, Class: Actinobacteria, Order: Streptomycetales, Family: Streptomycetaceae, Genus: Streptomyces
gcccgcgcccacccgtgctcctccaccgccggggtgagctcagcggctggtcacagccccggcgcaccccacaccgggaaccaccgggacagatccttctccacccggaggtcgtccccgaggactccccgcacctggagttccagctggttgtcccgcttctcggcgccgccgggcagcggggcgaacggatagaacgtgccgcgcttgtagaggtacaccagggccagcacccgcccctccgcgtcgcggaagccgatcagggagcagagcagatgcgggccgaatccgccgtcctggagcagggtgttgaccgcgtggaggtcgttgaccagggcggcggagtcgtcggcggggtggcgggcgagcagccaggtgtagccgtacgcgtcgcggctgaactccaccggtacgccgccgcgctccgtgtccgcgtccagcagttcgcgaacgtcctcctggagccgggcgaagccgccgccctccacacccgcgaagcagaccgagcccaggccggtcggcgtgaagccggcggcggcctggagggtgagggcggcggaggggacggcgaagagctggtcgaggtcggggcggaccggtttgctccggccgaggatcgcgtcgagaaggcccacggacgtcactcctccctctcagcgggacaggtcggcggagatgcgggacagctggtccaggcgctgctccagcgtcgggtgggaggagaacagccggcccaggctctccttcgcggagaacgccggcatgaagtagaaggcgttgtacggctccgccttccgcaggtcctcggtcgggatgcgggccatctgcccgctgaccttcgtcagggcggaggcgagcgcggagggccgcccggtgagcagggcggcggcccggtcggcggacagctcgcggtagcgggagagcagccgggtcagcaggaagctgatcgcgtacacgacggcgctgatcagcgggatcagcagcaggaggatgcccgccgggtcgttgcccggcctgctgcgggcgaagccgccccacagggcgatacgggtgatgatgcccgccagcaccccgaggaacgaggcgatcgtcatgacggccacgtcccggtgcgcgacgtgcgacatctcgtgggcgaggacgccttccagctcctccggctccagtctgcgcagcagacccgtcgtcgcgcagaccagcgccgtcttctcgccgcggccggtggcgaacgcgttcggtacgtcgctgtcggcgatggccaccctgggcttcggcatgtccgccagcgcgcagatccggtcgatggtgccgtgcagctcgggggcctgttcgggggtgacctcgcgggcccccatgccgtacgcggcgatgcggtcgctgaaccagaactgggcgatgaacagaccgcccgtgatgatcaggatgatcggccaggaaccccgcagggccgcgaggagcacgcccacgaagacgacgtagagcagaccgatcaggaacatggtggtgaccatgcggccggtcaggccccggtcgggggcgtagcgcgaacgggctcgtggcatcggtgcctcccaacggctcacctctcgcctgcctcccatagtgcccctttgcggtgagaaccggataaaaatgctgtctgccccggtccggggcgggacggttcgggggccgcccgcgccggtcacggccagagcagctcgcgcgtccagccgccgtcctcccggcgccggtagcgcagccggatgtgccggcgccgggcgtcgccctggaagaactcgacctcggccggctcgaccacgtaccgggtccaggtcgcggcctccgcgtccggttccgcccgggcccggtcccaggcggcgtccgccgcccggtgcagctccgccacggagccgacgacctcgctctgcgacccggtcagcgcggcggcgagcgcccccgtggaccgggcgtgcaggtcggcgtggctctcggagggcgtgcagcggacgaccgggccccggacccgtacctgccgtccccgcacgggccagtagaagccgatcgcggcgtacgggcgggcggcgagctggtgacccttggcgctggtggcgtgggaggcgaagtgccagccccgctcgtccacgtcgtgcagcatcagcgtccgtacgtccggcagcccctcggcgtcggcggtggcgaggctcatcgtgtgcggctcgggctgcccggcggccacggcgtcggcgaaccaggcgtggaagagggggaccggtgcgggtggggccggccccggatcgaaggacggcagctcggcgtcccagacgcgctgggcgtgcaggaggtcgcggaaggcggtggaggggagcgcggtggcggcgctgtcgtcggtcatgggggccattggaccccaagggggaacccgggtgcgggagcaggccgcgtccgagcgccggccgctgtcacccccgccccagcaccaccgtccccgccgagcagaaccagccgcccgtcccggaggcaaccgccagctccggtagtccgccccccggccggcgcacctggcgctcgccggcctccccgcgcagttgccgtaccgcttccaccaacaggaacagtccccgcatcccggggtgacaggcggacaggccgccgccgtccgtattcaccgggagcgcgccgcgcagcccggtgcggcccttctcgacgaacgcgccgccctcgcccttcgcgcagaaacccaggtcctccagggtcaccagcgtcatgtacgtgaacgcgtcgtagatctcggccaggtcgatgtcggcgggccgcacccccgcccgttcgaaggccaggcggccggagacggcggcgggggagaccgtgaagtcctcccactcggacatcgtggagtgcgagacgtgctccccggtccccaggatccagacgggatccttcgccgtgtcgggtacgtactcctcggtggccagcagcaccgcgcagcccccgtcgctgcggacgcagcagtgcagcttggtgaacgggtccgcgatcatcggaccggagaggacgtcgtcgaccgtgatcgggtcccggaacatcgcctccgggttcgccgccgcgttcgcccgcgccgtcaccgccacctcggcgagctgttccagcgtggtgccgtacgcgtgcatgtggcggcgggcggccatcgcgtacttggcgatcagcgagtgcccgtacggcacttcgaactgcgacggcccccgcgccccggacgacaggttcgacgtgcggcggcgaacccggaggcgatgttccgggacccgatcacggtcgacgacgtcctctccggtccgatgatcgcggacccgttcaccaagctgcactgctgcgtccgcagcgacgggggctgcgcggtgctgctggccaccgaggagtacgtacccgacacggcgaaggatcccg

SEQ ID NO: 3175 - DNA, 5954 bp, Unknown
  Kingdom: Bacteria, Phylum: Actinobacteria, Class: Actinobacteria, Order: Streptomycetales, Family: Streptomycetaceae, Genus: Streptomyces
cgccgcgcagcacgaggcggcgtccggcccgtccggcccggcggtgggcccccatgatgacgccgagtccggtggcgtcccaggaatccagctcggtcaggtccagcacgaggtcgccgactccgtcgtccacggccgagtgcaggaccgtacgggcgtccgccgcgcttcggacgtcgaggcggcccccgacgaccagctcggcgtggtcgcccctgatgtgcatatgcgctccccggtcatgctccgtagaaggtccgtctgtctgtttctgtcgtcggctccgccgtcggccctgtctccgcccacgagtggcggtgtctctgccaccactgactgccgcgacgacagggaagttgccgtctgtaagcgaaccgataccgaattcactcggtggagtgactccggttcgtcggaatccggtccctgccgggtaaaatccccggctcccccggcccggacgacggcgggccgacgggccggaggaggcggatccggtcagtacgtgtagaagccctgcccgctcttgcgcccgatgtcacctgcgtcgaccatccggcgcatcagttccggggcggcgaacttctcgtcctgcgactcggtgtagatgttgccggtggcgtgcaggaggatgtcgacgccggtcaggtccgcggtggcgagcgggcccatggcgtgtccgaagcccagcttgcaggcgatgtcgatgtcctcggccgacgcgacgcccgactcgtacagcttggcggcctcgacgacgagcgccgagatcagccgggtagtgacgaagcccgccacgtcgcggttgacgacgatgcaggtcttgccgaccgactcggcgaactcccgggcggtggcgagggtttcgtcgctggtcttgtagccgcgcaccagctcgcagagctgcatcatcgggaccggcgagaagaagtgcacgccgacgacgcgctccggacgctccgtcacggccgcgatcttggtgatcgggatggcggaggtgttggacgcgagcacggtgttctcaccgacgaccttgtccagggtccggaagatctcgtgcttgacttccagcttctcgaagacggcttccacgacgatgtccgcgtcggccacggcgtcgaggtcggtggtcgtggtgatgcgggcgagcgcggccccggcgtcggccgcgtccagcttgcccttggagacgaacttgtcgtacgaggccttgatgccgtcacggccccgggtcagcgcggcgtcggtgacgtcccgcagcacgacgtcccagcccgcctgcgcggagacctgcgcgatcccggatcccatgagtccggccccgatgacggcgagcttcctggccacgttcgcaccccttggtttctgttcgcccgtgcgcttctgttcacggcggttcacatgctctccggcggaggttagtacccgtcgggcgcgctggggcggtgaagagatgcgcgtcacgtctcagatgacggacatcacaccgggacgcgtcattcggctccgcgccgcgcgtagttgaggacctggtcgccgagcagcccctcgatgtcgtcgaggacgccgagggcgtcgtgggagacctcgacggccttgcggcccttcatcatctcctggctgacatagccgacgagggcgccctcgatccaggcgatctggccgccgacgaggagcggcagcgggtcgtcctcgctcgcgccggtgtcctcgcgcagggtggcgacgacggactggagcacctcctgctggagataccagaggcgggccttgagggtgggggcgtcctcgatgacgcgcatgaagtcggcgaagccgtccatcagtccgaactccggggagacggcgacgacggcggcccgcacctcgcgcaggacggcctcggcggccgactcgcccgggtcgcgggcgcggacgtaccgggcgacgcgctgggtgacgcccttcatccggtcgaggaagaggtcctccttggccgggaagtagttgtagacggtgttcacggagacgtcggcgaggtcggcgatctcggcgacggtcaccgtgacgaagccgtgctggaggaacagcccggtcgccatgtccgagatgcgctgcttggcctggcgcttcttgcgttccctgagtccctcagccatgcccccatcgtaggacgggaccaacgatcatggtgtcggtgaatttttggagtcattgcaattttaggttcactctgtttttctgaccccatgaccgtcatcagcacctccgggctggcccggaccttcacgacgccgagcggcccggtggaagccgtccgttccatcgacctgaccattcgcgcgggggagatcgtcggcctcctcggacccaacggcgcgggcaagacgacgacgctgcgcatgctcaccacgctcctcgcgccgaccggcggcgcggccaccgtggccgggcacgacctgcacaccgaccccgcggcagtccgcgcggtctgcgggtacgtggcccagtccggcggcgtcgacccgtatctgaccgtccgggaggagctcgtcacccagggcaggctgtaccggctgagccgggcggaggccgccgcgcgcgccgaggagctggccgccgggctcggcctcgacggcctgctcgaccggaaggcggcgagcctctccgggggccaacggcggcggctcgacatcgccatgggcctcacccaccggccggccgtgctcttcctcgacgagcccaccacgggcctggaccccggcagccgggccgacctgtgggacctggtgcggagcctgcgcgacgaccacggcaccaccgtcgtcctgaccacgcactacctcgacgaggccgacgcgctggcggaccggctgatcctcgtcgacggcggcacggtggtcgcggaaggcaccccggccgagctgaaggcccgttacgccggctcccccgacgcctccctccaggacgcgttcctggccgccaccggccgtcccgtcacccctgccgactccgcccccgcagccgtataggacccccgtgctcttccacgacaccgcgatcatcttcgggcggtacgcccggcagaccctgcgctcccgcttccagatcttcttcggcatgctgatgccgctgctctacctcttcttcttcggcccgctgctgcaggacctgccgctcggctcccgcgccgactcctggcaggtcctcgtgcccggcctgcttctgcaactcagcctgttcggcgcgtccttcgccggcttcgcgatcatcgtcgagaagtccacgggggtggtggagcggatgcgggtgaccccggtcagccggttggccctgctgctgggccgggtgctgcgcgacgccctgctgttcaccttccaggccgtcctgctggtgctcgccgcgctgctcatgggtctgcgcgcgccgctggcgggcatcctcatcggcttcgcgttcaccggagtgctcgcgctctcgctcgcctccctctcgtacgccctggccatgcgggtcaccaccccgcaggagttcgggccggtgatcaacgcggtgacgatgccggccatgctgctctccggactgatgctgcccatcaccctggggcccggctggctggacgtcgtctcgcacttcacgccgttccgctatctggtggacgcggtacgggacgcctacaccggctcgtacgccacgacgcacatgctctacggggtcctcgtcgccgcgggcttcgccgccgcggccgtgacagtgggcacacgggtcttccggcgggccggagcgtaactacgctgggcccatggtcaatctgacgcgcatctacacccggaccggcgaccagggcaccacggccctcggcgacatgagccgcaccgccaagaccgatctgcggatctcggcgtacgcggacgccaacgaggccaacgcggcgatcggcgcggccatcgcgctggggcagctgcccgaggagctggtgaaggtcctcgtacgcgtccagaacgatctcttcgacgtgggcgcggacctgtgcaccccggtggtcgaggacccgaagtacccgccgctgcgggtcgagcagtcctacatcgacaagctggaggcggactgcgacaccttcctggaggagctggagaagctgcgtagcttcatcctccccggcggtacgcccggcgcggccctgctgcaccaggcgtgcaccgtggtccggcgcgccgagcggtccacctgggcggcgctggaggtgcacggggagtcgatgaacacgttgaccgccacctacctcaaccgcctctccgacctcctgttcatcctggcgaggagcgcgaacaaggaggtcggggacgtgttgtgggtaccgggcggcgagcggtaggccctagaagcggtcggccggctcgcggtccgtcaccgcgtccttgggggcctgcttcggccacaccgtgtagccgcccgcgatgatcaggttgatgccgatcacccagcccatcttctgctgccagttccgcaacgagctgatctccccgccggcaccgacgtaccagatcgccgcctggagcaggcccgccgcgaccaccgcggccaggatccagcgggcggcggtgcgccactcgtggacggcgcgcgccatgccgtacttcggcggcttcaccggcggcggaccgccgaaccagcggtgggcgacccaggcatccaccttcttgatggtgtggtggcccagtcccaccgtgaagccgatgtagacggcggccaggccgtgcttccagtccggctcggccccgttcttcaggtcgatggccgtcaccaccagcagcacgacctccagcagcggttcgcacagcagcacggccgcgccgagcctcggcttcctcgcgacgtaccgcagcgcgagtccggctgccagcagcacccagaacgcgacctcacagagcacgaccagtagcgcgatcacagtctctctcctcccgttctcctccagccttccgtccggcgggcggagaagcgtcgtcggcaatgacgaaacgggactgcatccttcgatgtagccgcacatcggtcctcgaagggaggcccggcggcggcgctgcgtgttggatggaggagtgctcaccgcgatccgcccccaccgcgacgacgtggccctcgccgcctccggactgctcggcgggctgctcctgtggctgctcggcctgcacacccaggccggccgccctttcgcggccccctgggtctccctcgtaccgatgaccgtgatggcagcgatggagctgctgcgccgcagcgctccgcggacggcgctggtcgtcggcacggtgatgctggtcgcggaccagttcacccggggaaatctggtgaccatcctgatgttctcggacatcatgtacgcggccgtgctgtacgggaccccggccgcggcccgccggatcccggtgaccacgctcctgatcaccgtcgcgagcacaatcggtttcctggcgtggttccgcaggcccgaggcgctgctgatcggcgtcgtcacgggactggtctccttcatgcccgcgatcaccggcgtcgtcgtgcgcaaccaccgcgtcgccgccgatgccgcccggctggccgcccgccagaccgcgcggctcgccgagatggaccggacgcaggcggtggtcgccgagcgcgcccggatggcccgggagctgcacgacatggtggccaaccacctctccgccgtggcgatccactccacggcggccctgtccatcgacgaccccaacacctcccggaacgccctgaaggtgatccgggagaacagcgtcgaggggctggcggagatgcgccggctgatcggactgctgcgggagcgcggcgaggacgacgccccggctgcggccccgacgctcgcctccctggacgcgctggtcgggcagacgaacgtcaacggggcctccagcgggctggtctgcaccctggagggcaccggggaggcggtggcc

SEQ ID NO: 3176 - DNA, 6555 bp, Unknown
  Kingdom: Bacteria, Phylum: Actinobacteria, Class: Actinobacteria, Order: Streptomycetales, Family: Streptomycetaceae, Genus: Streptomyces
gtcgcccgaggcggcggagcatgtgcaccacggctgcaccagtcaggacgtgctcgacacggcgaccgtcctggtggccgcccgggcgctgcggtacacggacgacgccctggtcaggacggcggacgcgctggcgctgctggtggcggtcggcgcggcggtacggctcaccggctgggtcctgctgcccgtacggaccctggacgcggccacccacgacatcgccggcggccgtatgcgctcccgggtcgccgcctccgccgggccgccggaactcagacgcctggctcgttccttcaacgagatggcggacaacgtcgaggacgtgctggaacagcagcgcgccttcgtcgccgacgcctcgcaccaactgcgcaacccgctcgccgccctcctgctgcgcatcgaactcctcgccctggagctgcccgaggacagcgaggagatcgcggccgtgcgcaccgagggaaagcggctggcccgggtcctcgacgacctcctggacctcgcactggcggagcacgccgaggcggacctccagctgatcgacatcgtcccgctcgccgccgagcgggtcgcctcctggcgcccgatggcggagcgggagggcgtggacctcaccctggacggggccccggcggccaccgcctgggccgaccccgtcgcgctctccagcgccctggacgcggtgatcgacaacgccctgaagttcacccccgccggagaggacgtcaccgtcaccgtcgccgccggagccctcgtgacgaccgtcgtggtcgccgaccggggtcccggcctcaccgaagcggagctggagcgcgtcggggaccgcttctggcgcagcacccgccaccagaacgtcagcggatcgggcctgggcctctccatctcccgggtgctgctcgcggctggcggcggctcgatcgggtacgagcaccacgcaccgcacggcctgcgggtgaccgtctcggtcccccgcgacctgcccggcggctgagccgaggagccgccggggtcggggccgtcgggcctcaggagcggcggggcctcacggcttcaccgaacggtagtagtccttggccccgtcgtgcacgtccagcgggtccgtgtagatcgccgttcgcagatccaccaactgcgccgcgtgaacctcgcggccgatccggtcccggctgttgatcaccgtccgggtgaaggcctcggtcatggccgcgtccgtacggtcggtcgtgacgagcaggttggcgacggcgaccgtcggcaccgcctgaccctgctgggcctgcggataggcgtcggcgggcatcatggccgaccggtagaagcgggtgggaccggtcgccgcctgcaacttcgcgaccaggccggcctccagcggcaccagccggatgtcgaagcgctgcgacagctcctgcacggccgcggtcggcagcccgcccgaccagaagaacgcgtcgagccggccctgggtcagccgtacgggcatggtgtcgatgcccaccggcaccggtgtgacgtcgtcggccggatcgaggcccgccgccgccagcagccggtccgcgacccgggccgacgcgccgccgtcgtccaggtcgcagtagtcgcggcggaaactctcgtacgcgtcggcgtgccgggccgccagcgaccccgtgtcgcgcagcgcctgcgccacctcgtccgtcgtgaccagcagcggcccgggggcgcgggaggtgaagtcgaagtagaagccgcgcagggtgtcgcggtagtgctccaggtcgtacgtgaagaagagcatcggccgcccggagtgcgcgaagtcgaacagcaccgaggagtagtccgtgatcagcacgtcggcgatcaggtagaggtcggcgatgtccgggtagtacgtgacgtcgtagacgaagccctgtccggcgccggggatggagtcgaggaccttgtggtgcttgcggtagagcagcacgtggtcctcgccgagctcactgcgggcggcctcgacgtcgatcttgttgtcgagcttgaagcggcgcccgccgtagcgctggtcgtcgcgccaggtgggcgcgtacaggacgaccttcttgcccgcggggatgccgagcttctcccgtacggccgcggcgcgcttgacacggtcgggggcgtggaagacgtcgttgcgcgggtagcccgcttccaggacctcgcactggaggcggaaggagttggtcatgatcggggtggtgaaggcgttcggcgtgatgaacaggctgtactggcgcgagcgctgcggaaggctcgcgatgtaggccaggttcgccttcggggtgccgagcaggtcggcgccgatgcgcttgagcggagtgccgtgccaggtctggacgacgacctggccctcgcggcggacgaaccactcgcggatgccgccgttggtgacgacgtaccggctgcgggcgagtgcctcgtaccactccttgctgccccactcgacgccgcggacgccgggcggcaggacgacctgctggtcgtggaccatcgcgatgtgctcgacctcggtgccgcggcgcttgagctcctcgtagaccgcgcggggcgagtcggagaactgcttgccgccgaagctgttgtagagcacggcctcgcgcagcggcagcttgcgctgctcgggggtgtagacgtcgcgcatcagccgctggcggtaggcgccgcgcagctccgggtcgaggaccggcccggactccacgaagatccggtcgaagtcgagccgctcgacggtgtacgtgcggtgctcaccccggtgggccagcggcagcgtgtccacgaggtcggggcggatcgtgacgggaaggtcgtgggtgtggtcccactcggtgcgcaggcgcaggcgcggcatccagcggccggcgcgcagcggcacggtgccctcgtaggtgggcatggtgtccgggcgcaggcgggcggtgaagcggccgtcggcgaactcgacgggcaggggacggtcctcgttgcggccggtgtggcgcaggaccatcttcatctgctcggcggggccggtgtagacgccggagaggaccagttcgccctccgcggtccactcgacgctgtcgacgaggggctggaccgtgcggacctgcggcgtgaagttccccgcgccgtcggtgaggatcgcgaactcgcgtccttcgggcagcgggtggactccggtgacgggcttcgcgccgcccgtggcacggcgggtggtgccgtcggcgaagacgatcaacgcgcggtacttgacggccttcccggggcgtacgccgtcgacggggaggtccgcgaagtccaggcgggcggtgtggcggagccagccgtcggccccggtctcgccctgctggagcgggaggtcggtggcgaagccgctcggctcgtggtcgatgcgcagggcggtggggtacttgcccgcgggggtggtgacgcgggagcgcagggtgacggtgagggtctcgccgtcggcttcctgggcgatgatctcggccgggacgacgtccacggagagcttgagccggttgcggtcgaagccggcgacgaggcggacgccgtcgtccaggacccgggtgtagctgtggccggccgcgcccgcgttgttcttggtgatgctccccacggacatgccgccgggtcgcgggatgccgatgcccaggcgccaggtgccgggctgccactggccgcgtacgcgcagccgggacgggtcgatgccgatctcgaagccggaccagtcgtaggcgtgcagggcgcccttggcctcggcggtggcgcggggctccaggacggtgcgcatccgcagcgggagggtggagcggctgccctggcggcggaggacggcgacgcgcagcgagcgcttgccggtggccgaggggacgttggggatgtaggcgtagcccttgacgaggagcttgccgtcctcccagcggaggtcgaggagcttgccccgtacggggagttcgctgcggttgaagttgcgcaccgaggaggggagcgaggagctctcgacgccgggcagctcgatgcgggcgcgccgcaggccgcggacggagaaggctcccgggttctcgcgctcgtagtgcagcaggtccaccagctcgtcaccgcggccgctggccgccaggtgccacttgacccgggccatcggggagaactgccgtacgaccttgggggcggcacgggccaggaagtccttggccgctcggtggaattcggggcgctcctcgaccggagtctccgggaaatacttcatgagccggctgagctcgtcggggatcgcttcgagggacgccacgggtggagggcctttccggggggacgtgcagatgatgaaccccaggaggacggggcgttaatgagacgtctccaaccgtctcatggttgccccacagtatgacgtgacacctctcacaggacgaacccgccccgatcgtcgccggggcggggagatgtggtccgggctcccccggaggtccggttcagacgcggtgggcgcggggggtgcgcagggcgctgagcaccgtgcggcgggccttgcggacgacgcgccgggcgagggagaggcgaggcttgtcgagcggcgcctcgatccgccgtccaccgacccattcggtgacggtcacctcgaaggcccggtcggggagcacggagctctcgccgaagtgcgggtaggcgaggtggagacggggcgggtttccccggcggacgagttcgggctccttcttgtcgcgcaggaaggccgcgatgtccaggagcaggtcgagccggccctcggcgaggcacatcagccgcagtcgttcgttcaccttgaggttccggccgagctccggcgtccagtacgccttcatcaagggggcggcgagcgccatcttccgctcgcggacctcggccttctgcttcaccagtccggggccgaactggggcagcagcgtgatgacgaagggccgcaccatcagggcgtcgcgccgggggccggggggcacgtactcggcgatgagccccatgagggcgcgggccgagtcgaagcggcgtcggtagctgcccttcttggtcatctggttgcggtcctcgcggccgaccaggtagtagcaggtgtagtcggcgacgacggagatcccgttgccgcggatgtacgcctccatcgtgaacagggcgtcctcgcctgtcttcagcttctcgtcaaaggtcatgccgaggcgtacgaggagatcgcgccggaacagtttctgcgcgctcaacgtgaatttgacgttggaggaatacaggtcggcgtgctcgacggtctctttccacatcgacttcgcggcaccgcgattgacgccgacgatcttcccgagtaccacgtccgtgcccgcccggtcccccatggcgatcatgcgttccagggcttcctcgccgaaatagtcgtccgcgtcgagaaagaagacgtaccggccgcgggcgagaccgaggccacgattgcgcgggccgctgggcccgccggaattcgcctgccggacgactctcatgggaatcgctgtccgggcggcgaattcctccaggcaggcgccggtgccgtcggtggagccgtcgtcgatcgcgacgatctccatgcggtccgcgccgatggtctgcgcctcgacggactccaggcaccggaccaggtagggcatcgcgtcataagctccgatgatcacactgacatcgggctcgtcgttcttcctgggcatgtcggccatgtgcacctgtcgatttgatcacgaaagaaggcagattgcccgactctgcactctttcatgcatcaccatgccgaacgacccgtacatccctccctccggagagacgtacgggtcgcgatcggggttgcctgcttttcagccagttcgatcggatgtgcggcgctcggcagtgtgtcgcccattcggccgcacgtcgctcagcgcacggacgaggacccctcgacgagggcggtctccgcgtcggactccggcgcgtcggggtccgccgtggcgtcggcctcggccaccgcctgcgggtcgcctgttccgacgccgctggtgacggcctcctcgtccggcaccgccacggcctggtcgccgagccgctgggcgacgcccaggttgcgggcctcggccttggcggccagcgcccgtacggcggcgttgaactgctccatggaggtcggctcgtccggccccaggaggtaggtcttcagctcgcggcgggcgtccgccagcgtgtccgccgccgggtcggccaccgcggccagcagcgcgtcgagctcctcggcaccgttggacaggatgaccgcggcgcgcaccgcggtgttctgccgcttgaactcctcggcaccgagcgcggcggagtcggtgaccgcgtacggcttgccgctcgcgatgaagtcggagaccacactggagatgtccgaaaccatggcgtcggactcgttgaagcagtcgtacagcttgggctgcgcgccggtcaccgtacggtgctcccaccagccgaaggagcgccagtaggcgtcgttccactcggcccgcagccgggcggtctccgcctcgcgggccgagtggaacgacg

SEQ ID NO: 3177 - DNA, 16436 bp, Unknown
  Kingdom: Bacteria, Phylum: Actinobacteria, Class: Actinobacteria, Order: Streptomycetales, Family: Streptomycetaceae, Genus: Streptomyces
agggcggcgcgaggctgtcgggtgggcagcgccagcgcgtgtccatcgcccgcgcactgctgaaggacgctcccatcctcatcctcgacgaggccacggccgcactcgaccaggagaacgaggcgttgttcgccgatgccgtgcgcgccctggccgaccgtaaaactctgctggtcatcgcgcaccggctgagcaccgtcgtccacgcggaccagatcctggtcctggaggacggtgagatcaccgaacgaggcacgcacgacgacctgatcacggcgggcggcacctacgcgtccttctgtcagcgccggacccgggcccacggctggcgactggaggcggcgcggccatgaatccccaccacgcaccagcgatccaccggacacagccgcagcgccagagagaggacacgacaccatgagcaccggcctgaggaagacctgggacgcgtgggcgggtgccgtcccgcgactggcgcgctcaagcaccctggagccctgcgacgatcccgcggccgcggccacccgcctcgcccgagccgccctcgccgaccagtacatggtctacgaggcggcagcaggtgtctggcacttcgccgcgggctccgccgagagcctcaccgcgcacgcggccggcatcacggcgcgagcggcggggcgcacctggacgtctcccacccacgacaggccgctgacggttttcgacgacgcactgagcgccctctccgcggcgcacggcgcgcatgacagcgaacgccacttctacggctgggccgccttcgaactcgcccatctcctccacgcggatcccgaggccaccggtgacggaccgcttctgcacgcactgatcccgtccgtcgaggtgaccctcaccgggaacggcaccgtgatccgcgcggtggacgaggcgtggctcaacaaggtctcggccctgctggcggagccggcgacgccacatcgcgctccggacgggacgactcccgaggtgtccgagcggatcatcgcggccggcacggacgcctatggcagcgcggtgtcccggacggtcgaggacatccgcgccggtctgctggagaaggctgtcgtctcccggaaggttccgttgcccgccgctccatccgtggacttccccgcgacctatctcacgggccgtcgggccaacaccccggcccgctcctacctgttggaactcgggggctaccgggcggccgggttcagcccggagaccgtcctggaggtcggcgaggacggccgcgtcagcacccagcccctcgcaggcacccgcgcacatgggacggacccggcggagaacgcgcgcctgcgcgcggaactgctcaccgaccccaaagaggtgcacgagcacgcggtgtccgtacgcctcgcctgggacgagatgacggcggtgtgccggcccgggtccgtcgcggtcgaggagttcatggccgtccggccgcgcggttcggtgcagcacctcgcctcacgggtgacaggccgactccggtccggcgccggaccgtgggacgccttcgcctcgatcttcccggcgatcaccgccaccggcgtctccaaacgctccgccctccaggccctggcccgccacgaggaggggccacgcggcctgtacggcggcgcggtcttccgcgggagcaccggcggtgccctcgacgccgccctcgtcctgcgcaccctcatcggcgatggcgacgagacgtggctgcgcgcgggcgcgggagtcaccgctcagtccagccccgaacgcgagatcgaggagacctgtgaaaagctccgcagcgtcgccccgcacctgaaattcgcccttcagcagattccggagtggacaggggaaacccgagccggtgaaatgaattctccggcatagcaccgataatcgttatcgatagcacgctgggtaatgagcctggttgccgacgcgtgttcgctgtggcagcctcggccgcgagggtagaaacaggaggacgttgaaaggtgccgccacgaaaagggcggtggtctgaattcatggagatgagtgaagtggcgacatccctgcaacatcagccgcacaccggtcatgaccatgcgcacgccgcgggctgcgggcacgtggcagtccctcacggcgatcacgtcgactacgtgcacgacggacatctgcaccgggagcacgacggccacgcggacgagtgcgagatccgggagcaccaggagcattccgaacacgcccacgcccacggcgagggctgcgggcatgtggcggttccgcacggtgaccacctggactatgtgcacgacggtcaccgccacgcggctcacgacggacactgggacgaccactgaccgcttcgcgtaccatccgagaaacgcggaatgcacccctgttctcaggggtgcattccgcgtacttctgtattcgcgcagagaaatcctgcgcagaggtgagcggccgattctcacctgatcgaatgcggcacgagcgccgccgcatgtccctttttgagtacggacaccgcttgcgggccggtgaggcgcggatggccggcctctcctgggagggtatgcaccgggccggacggtgacgtggctgcgaccaccgcccggcccggagtatcagtgccccgccacggtggtgagggggtcgtgctcatgcgcgcacagctcgtcgaagccgtaggtgtcccaggccgggaaggggtcggccgccggctgggcctcgtcctcccgcatgagacagtcggtcaacgctgcccgcagccgcgccgccttgagctgggttccgatgaagacgagttcctggacgtggaggctgtcggtgtcgcgagcggaatagggctcgaagcgcaccaccgaacccgcctgggaccacagtcccgtcacatgggagcggccggcgagggtgaagaaacccttcgacctgaggatctgtccgtacatgccgctgtccagttcctccgtcacgaacgaccacagtcgcccggggtggaagggcgaggccgaacggaagacggtcgaggagatgccgtactcctccgtctcggggacgtggtcaccgttgagttccctcacccagcccggagcctgctgcgcccgctccaggtcgaacctcgcggtgcccaggacctcaccgaccggcacgcggccccgctcggcggacacgacacgggcggcggggttgagccgcgagagggtggctcggagcagggcggcggaggcggtgtcgacgaggtcgagcttgttgagaacgatgacgtcggcgaactcgatctgatcgatcagcagatcgctgacggtacgttcgtcgttctcgtactggtccaggccgcgttgggtcagctcgtcacctctcaccagttcgggcaggaagttggcggcgtccacgaccgtgaccatggtgtccaggcgggccaggtcgccgagggtggcgccgtcgtcgcgggcgaaggcgaaggtggccgccaccggcatgggctcggagatgccggaggactcgatgaggagatagtcgaaacgcccttcgcgcgccaaacggtcgacttcctccagcagatcgtcgcgcagggtgcagcagatgcacccgttcgtcatctcgaccaggcgttcctcggtgcgcgacagggcggactcaccaccgcgtacgagggcggcgtcgatgttcacctcgctcatgtcgttgacgatgacggcgacacgcatgccctcgcggtttccgaggacgtggttgagcagagtggtctttccggcgccgaggaaccccgacaggacggtgacgggcaggcgcggcgagggtgcgtcaggcatgcggcgtcagctttcggggcggagcaggccgcgctcgtacgccttggcgagccgctgggggacgagttgcggagtgccgtccaccgtgaccgtcaccaaccggggtggcgtggccttccactgcgcgcggcggtgcctggtgttgctgcgcgacatcttgcgtttgggtacggccatggtgacctccgggtgcgatcggtgagcgaggcagacgatacatgaaaatgaatgtcattacgatctgtgtcgcccagtcgcgctgaaccccgtgcggcgcctcccgaggtggcggcgggcaacgctcaggcccgccggcggacgatcagacgctggagcacgatgaaggcgagcaggagtgcgccgatgacgatcttggtccaccaggaactgagggtgccctcgaaggagatcaacgactggacggtgccgaggaccagcaccccgaccacggaacccaccaggtagcccgtcccgcccgcaaggagggtccctccgatgacgacggcggcgatgacgtcgagttccattccgacggcgtgcagaccgtagccggagagcatgtagaggctgaagagcaggccgcccagggcggagcagaagccgctcaccacatagacgccgaccttggcccggccggtggccaggcccatcaggcgggccgaggactcactgcctcccaccgcgtacacggtccggccgaagcgcgtcaggtgcaggacgtacagggcggccaggaccgcggccagcgcgatcacgacgctgtaggtcagtgtgacgccgcccggcaacgtgatggccccgcccgcgaactcacggaatgcgggctcggtgatggagaccgactcgacactgatgaggaagcacagcccgcgggccaggaacatgcccgccagcgtgacgatgaagggctggacttcgaagtggtggatgaccaagcccatgagcaggccgagggtggcgcctgatccgaggacggtgatgatcgaaagcagtggaggccagcccgcgtcgagggtggccgcggcgatcatggtcgagagggcggcgaccgcgccgacggagaggtcgatgccgccggtcaggatgacgaaggtcatgcccaccgcgaggacgatgaggaaggagttgtcgacgaacaggttcgcgaccacctgccccgatgcgaagttctcgtagcggaccgacccggctccgaaggtgaccacgaacaccgcgaaggtggcgaccacgggcaggaaacgctggggaaagcgtgcggaggaaagagccaaggtgctcatccggcggccacctcctgggagcgggacgtaggagttgcggtcttgcggcgggcgcggagcatttctgccgtccggggcgactggagcaggcagacggcgatcaccacgacggccttgaagaccagagtgacgttggtcgggacgccgatggtgtagacggtggtggtcagcgtctggatcaccagagcgcccaccatggtcccggcgagggagtaccggcccccggccagcgaggtgcctccgatgacgacggcgaggatggcgtccatctcgatccacagaccggcgctgttggcgtcggcggcgttcacgttggaactgatcatcaggcccgcgacacccgcgcacagaccggcgaagacgtagaccgtccagatgatcgtgcgggagcgtacgcccgcgagctcgcctgccttgggattgatccccacggcttcgacgagcatgcccagagcggttcggcgggtgatgagggcgactgccgtcaggacggcgaggctgatcaggatcgctatcggcaggatgaggaagcctgagccgatctgccggtagagcggatccttgacggtgatgatctgaccctcggtgagcagcatggcgccgccacggcccgcggtcatcagcaccagggtggcgatgatcggctggattccgaggacggagaccaggaagccgttccacagcccgagcaggacgcacacgcccagagccagcaggaccgcggacgccgcgtccccgccgccggatatgtaggtgcaggcgatcgcgccggcgatggcggcgacggctcccaccgagagatcgatgccgcgggtggcgatgaccagggtcatgccgacggcgatcaggagcgtcggcgctccgttgcgcaggatgtcgacgatgctgccgaagaggtgcccgtcctggatccggagttccacgaaggagggctcgacggcgatgttgaggacgatcagcgcggcgagggcgacgagcggccacagcaggcgcgagcgcgtcatgacgccaccgccgcggtgtggttgtcgctcggagcggcgatagcagacatgatcttgtccaccgagacgtcctgcccggtcagttcggctactttgtgtcgatcgcgcaggacgacgacccggtcggacacgcgtaccacttcttccagttcggcggagatgaacagcacggccattccctcggccgcgaggtcggccacgaccttctgaatgtgcgccttggcgccgacgtcgatgccccgggtgggttcgtcgaggatgagcagccggggccgggtgaccagccagcgtgcgagcagaactttctgctggtttccgccggaaagggtgctcatgatggcgtcggggtcagccggacggatgtccagcttcgctatgtactccttcaccagagcgtcggaggtgcgtcgcgggacggggcgtgcccacccccgggcggcctgcagggcgagcacgaggttgtcgcggatactgagatcggcgacgaccccttcggccttgcggtcctcggagcagaaggccacgccctgggcgatcatcgtccgggggctccgggggcggtgttccctgccgtcgaacgtgagggttccggtatgcgcgcggtccgcgccgaagagtacgcgggccagttccgtgcggcccgagccgagcagaccggccaggccgacgacctccccggcatggatctccaggtcgacgggtgcgacagctcccgtgcggcccagggcgacggcgctgaggaggggtgcggcaccgggagcccgagcctccgagcgccgttgtacctcctccagcactcccagttcgcgcccgagcatcgctgcgacaagttcgatgtggttcatctcggtgggcaggtattcgccgacgagtgagccgtttcgcaggacggtcatgcggtcggcgatctcgtagacctggtcgaggaagtgggagacgaacaggatggcgactccgtcgtcgcgcagcacacgcacgatgcggaagagttcggcgacctcgtcggcgtcgaggctggaggtgggctcgtccagaaccaggacgcgtgcgtccacgaccagcgccctcgcgatcgccaccagttgctgcacagcgatcgggtgggagctcagtggagaggcggggtcgatggacaggccgacgcgggtgagcagttccttcgcccgcgcgcgcatggctcgtccgtcgatgtgtcccagccgacgtggctcgcggcccagcaggatgttctccgccaccgagaggttcggcaggagattgacctcctggtagacggtgctgatcccggcttcctgagcctgaccgggcgcgtcgaaagcgaccggttcgccatgcaggcgtatgacgcctgtcgtcggagggtgcacgccggtgagtgccttgatgagggtggacttgcctgccccgttctcgcccatcagagcgtgcacttcaccggggagcaggcggaagtcgacacccgagagagccttgacgccggggaactcgacgctgatgtcgcgcatctcgaccaccggggcgccggtgagcgctgaggaatcggtcatgaccagtgctttcgtcgtgggtacagtccctgccccgccacgaggggcgcggtgcagggaccggagctcttcgatcagtactgccggtcgggcagtgcgctcttcgcctgctcgggcgtgaaggtggtctcctcggtgaccacccgcttggggaccttctcgccgtccacgaccttcttggcgaggtccatgagctggtcgccgaggagcgggttgcattcgacgatgtagttgatctccccgtcggccagcgcctgcattccgtccttgacggcgtcaacagtgatgatcttgatgtcctcgccgggcttcttgccggcggccttgatggcttcgatggcacccaggcccatgtcgtcgttgtgggcgtagacgacgtcgacgtcggggttggagcgcaggaaggcctccatgacctgcttgccgccggagcgggtgaagtcaccgctctgagaagccttgatcttgatgtcggggcgtgcggcgatcttctcctcgaagcccttcttgcggtcgatggcgggagcggcgccggtggtgccctgcagttccaccacggtgacggggcccttggtgttctcgacgagccactcgccggccttctcgccctcctcgacgaagtcggagccgaggaacgtctcgtacagggtgtcgtcgtcggagtcgaccgcgcggtcggtcaggatcacggggatgcgggcccgcttggcctccagcagcaccgcgtcccagccggtctccaccaccgggctgaaagcgatcacgtcgaccttctgctggatgtaggagcggatggccttgatctggttctcctgcttctgctgagcatcggagaacttcagctcgacacccgcgttcttcgcggactgctggacggacttggtgttggccgtacgccagccgctctcggcgccgacctgggcgaagcccatcgtgatcctgccggccttgccgctgtcgccgccctcgctcgaggtgctgcccgagccacacgccgtcagtgtggcgagcagcagaacgctggcacctgtggcgatcttcttcaacactgcttcctccgtgctcaaccgtgctcactcggggtggcgagcttcgcgtgaccggagtcactggtgcatcagagtgagcgctcacatctacctagtcaacccctgggacaccgcaatgttgcgtgcctggggcaaggggtgagggtgcgctatgttaacgctcattgtttgagcgcttccggaaatcaccgggctcggagcgcctcgcgtccggattcggcggacgcggggaggggggcgctggctgtcggtcccctggcctggttaaggttcgaggtggcgcgtcctgcgtggtcccacacaggtgtcgggcaggtggaaacggtggagtcaggagatgcaggtggaggacacctcggcggctacccgggtacgcgagccggcgatgacggatgtggcgcggctcgcaggggtctcccaccagacggtctcccgcgtcctcaacgggcaccccaatgtcagggagcagacgcggctgagagtgcgtgccgcgatcaccgagctgggataccggcccaaccgcgccgcccgcaccctggtgaccggccggtcccagcagatcggcgtggtggcgcagaactcgaccctgtacgggcccacctcgatgctggcggccttcgaactggctgccgcggcccaggggttcgcggtcagcgtgcgacgggtgcgcgtccttgaccgctcctccatcgccgcggcggtggaacaccaccgcgaccagcgggtcgccggcatcgtggtcatcgctcccacggcatccgccgacgaggcgctggcggagattccggccgacgttccgctcgtggccgtcgacggcgaccccgaccggggtggagcgctggtcacggtggaccaggaggcgggagcgttcgccgccacccggcacctgctggacgcggggcaccagaccgtgtggcacatctcgggcccaccggactggttcgacgccgcgggccgggcgcgcggatggcagcgtgctctacaggaggccggtgcggagattccccccgtcagctccgcggactggagcgcctcctccggctaccgcgcgggccagatgctggcccgcatgccggatgtgaccgcggtgttcgcggccaacgaccatctggccctcggtgccatccgcgccatggccgagcggggccgcagcgtcccggacgacgtgagcatcgtcggtttcgacgacgtgcccgaggccgagttcttctcgcccccgttgaccacggtgcgcccggacttcgacggagtggccaccgagaccctcagccttctcctgacccggatcgagggtgagtcggggccttcgctgcgcacgctcaaccccacgctcatcccccgggagagcgtcgcggctccgcgaggctgagcccacccgctcggccgatcgccctgttcctatctgggcacgctcacatcgagagactttcctgtcggtggatgccttgacgggcagattgttagcgataacacttcgggtgtccttcgacgaacgatcaaaggtggctacatggccgacgaacctgactccctcgtagtcggtgtcgactacggcacgctgtccggacgcgcggtagtggtgcgggtccgggacggtgccgagctcggcacgggtgtccatgcctaccgtcacggcgtcatcgaccggtccctgcccgcgacgggccggagcctgccgccggactgggcactgcaggttcccgaggactatctcgacgtcctgcgcatcgccgtaccggccgcgatcgcggacgccggagtcgacccggctcgagtgatcggtatcggcaccgacttcaccgcctgcacgatggtgccgaccaccggggacggaaccccgctgtgcgacctgcctgaactcgccggggacccgcacgcgtacgtcaagctctggcgccaccacgccgcccagccgcaggccgaccggatcaacgccctcgcgcgggcacgcggagagaagtggctgccgcggtacggagggctgatctcctcggaatgggagttcgccaaggcgctgcagatgctggaggaggcgcccgaggtctacgccgccatggaccggtgggtggaggccgccgactggatcgtctggaggctcaccgggacatacgtacgcaatgcctgcagtgccggttacaaagggatgcgccaggacggtgaataccccgccgcggacttcctcgccgaactgaaccccgccttcgccgacttcgtgagggagaagctggatcagcccatcggccggctcggcgaccgggtcggcggtctgagcgccgaggccgcgctctggaccgggctgccgcagggcatcgcggtcgccgtcggaaacgtcgacgcacatgtcaccgccccggcggccggggccgtggagcccggtcagctggtcgcgatcatgggcacatccacctgccacgtcctcaacggcgacaccttgcgcgaggtccccggcatgtgcggcgtggtcgacggtggcatcgtcgacgggctgtggggttacgaggccggacagagcggagtgggggacatcttcgcctggtacgtcgagcaccaggtccccgagggctatcacctacaggctcgggaacgcggcctgtccgtccatgaactgctcaccgaactggccgcgaaccagaaggtcggtgagcacggactgatcgccctcgactggcacagcggcaaccgctcggtgctggtcgaccacgagctgtccggattggttctggggcagaccctctccacccggcccgaggacgtctaccgagctctgctcgaagccaccgcgttcggcacgcgcacgatcgtggagaccttcaccaccgcgggtgtacccgtcgacgaagtcatcatcgccggcggcctggtgcgcaacccgttcctgatgcagctctactccgacgtcctcggtctgccgctgtcgatcatccgctccgtacaggggccggctctcgggtcggcgctgcatgcggcggtggccgcgggggcgcaccgtgatgtccgaaccgccgcagctgtcatgggctcggtcgaccgggccgtctaccggcctcgccccgcggaagccgccggctacgaccggctgttcgccgagtacgtcaccctgcacgaccacttcggccggggcggcagcgacgtcatgcgcagactgcgggccatgcgccgctctgccatcgaatcgaaggagaagtgatgagcgccgccgacagcgtgaagaacctccggcagacggtcgccgagctgcaccgcgaactgacgcgctacgggctggtgatctggaccgccggaaacgtctcggcccgcgttccgggagaggacctcatggtcatcaagccctccggcgtgtcctacgacgacctcagcgcggacaccatggtcgtgaccgacctccacggcaacctggtggagggtgacctggcgccttcctcggacaccgccgcccacgcgtacgtctaccggcacatgcccgaggtcggcggggtggttcacacccactcgccgtacgccaccgcctgggccgcgcgcggcgaacccatcccctgcgtcctgaccatgatcgccgacgagttcggcggcgaggtccccgtcggccccttcgcgctcatcggcgacgactccatcgggcgcggcatcgtggacaccctccgcgacagccgctcgcccgccgtcctcatgcgcagccatggtcccttcaccgtcggccgcgacgcgcgtgcggcggtgaaggcggcggtcatggtcgaggacgtggcccgcaccgtccactacgcccaccagctcggtaccccggacgccatcgacgcggccgccgtggaccggctctacgagcgctaccagaacgtctacggccagtgagcccacgaggggaagaccgatgaacaccacaactcagccgcagatctggttcctgacgggaagtcagcatctttacggtgccgagaccctgaaccaggtcgcggagcagtcggccaggatccaggagatgctggccgactccggacggatcggcgccgacatcgtgggcaagccggttctgaccgaggcctccgccatcaggcggacgctggaggccgccaacaccgatccggcctgtgtcggggtggtcgcgtggatgcacaccttctctcccgcgaagatgtggatctccgggctcgacgcgttgcgcaagccgctgctgcacctgcacacccagctcaaccgggaactgccgtggtcgtccatcgacatggacttcatgaacctcaaccaggccgctcacggcgaccgggagttcggctacatacagacccgcatcggggtggcccgcaagaccgtggtgggccatgtatcggatccggaggtcgtcgggcgggtcgacgactgggtccgggcggccatcggcttccaccgcatgcgcaacctccgcctggcgcggttcggtgacaacatgcgcgacgtggccgtgaccgagggcgacaaggtggaggcggaactccggttcggcgtcagcgtcaacacgtacggtgtcaacgatctcgtcgaactcgtcgacgccgtcaccgccggcgagatcgacgaactcgtcggcgagtactccgaacattaccggctggcaccggagttgatgcgaggcggcgatcgccactcctcgctgcgcgatgcggccgccattgaggccggtctgcgtcggttcctggaacagggcggcttcggcgcgttcaccaccaacttcgaggacctcggcggactgcgccagctccccggcctggctgttcagcgcctcatggccgacggctacggcttcgggggtgagggtgactggaagacctccgcactgctcgccgcagccaaggccatgggcccgcaggcctccttcatggaggactacacctaccacttcgggcccggcacgcccaagaccctcggtgcgcacatgctcgaagtctgcccctcgatcgctgacacccagccgtcctgcgagatccaccccctgtcgatcggagggcgtgaggaccctgtgcgcctggtgttcgacgccgcccccggtcccgccacggtgatcggcctggccgacatgggcgaccgtttccggctcgtcgccaacgatatcgatgtcgtgctgccggacgagccgttgccgtgcctgccggtggcgcgagcggtgtgggagccgcggccctcgctgtccacctcggccgagtgctggctgatggccggcggtccgcaccacacggtcctcaccacggtgggatcggatgtgctgcgtgacttcgcgcagatggccggcaccgagctggtgatgatcgatggcaccacgacggcccatgacttcgaggaccgtctgcgctggaatcaggcgtaccaccggctggcccagcggatgtgacccgaaccggagcgtgatccgcccctctcttgtggaggaaccccgtcccatgggggcggggttcctccacaagagaggggcggatgccggattccgccgcgggtcgtctactcggtggagtaggtggcgtcggcccggtccagcgcggagttcaccggctgcaaccgcagaaggctgtcgtagtgccgcaggtagcggcccgggtagttgaacgactcgaaggagagaccggccgacgcgccggccagacctggcctgcggtggtaggaggcgtcgcccgggaagagagaggatccgtcgttcctctccagccagacctcgaagcccttgtgccgcaggtagtggccggggaagttcgccgactccagggagacggtgccgtttccggccagtccgctgacgatgcggaactgtgagtcggcgaggtcggcgacgttcgcctccacccgggcgcggagaccggagtggcggatgtaccggtcggggaagttgaacgaggagaagcggacgggggtgggaccttcggcgacgggtatgccgaagttgggagtgccgtcgctgttccagtacagcttctgcatccgggtctgccggttggggtcgttcaacgggtcgccgttgatgtcccggtaggtgcgggagtggtagaccatgatgtccgacgcaccgtcctcggagacggtgaaggagttgtggcccggaccgtactggctcgtcgccgtgttgctggtgaagacgggggtgggcttcttggaccacgaagcggggttcagcagatcggacgtccggtcggccgtcaggagtcccaggcagtaattgctgtcggtggcactggcggagaaggtcatgaagaccttgtctcccttgctgatgaaggcaggcccttcattgacccggtggcctcgggtctcccacgcgtgggtgggggaggcgatgcgggcggggcggccgctgatggtccaggggttggacatccgggcgatgtagatgcccgtgccgtcgccgacagcgggatcggcctgtgcccagctcaggtagcggacgccgttgtggacgaacgtggtggcgtccagggagaacgtgttcaggggcagaccgatcctccccttctcgctccaggcgccggtgagcggattggcggcacccgactccagtacgtacggacggatcgcccacgggtcgtcggcgggggccgcggcgaagtagacgtaccacttgccgtcgatgaagtggatttccggagcccagatgtgcgcgcccatgtctccgccggcgtgcttggtccagatcgttgtctcgggggcgttcgacagcccctgcagcgtggtggcgcggcgcaggacgatacggtcgtaggcgggaacggtcgcggtgtagtagtagaagccgtccgtgtgcttgtggatgtgcggatcggcgcgttgctgggcgatcggattcacgaacgttgccgccggagtgggcggagccgctgctgcgggagcgggtgtaccggccgacaacacggccaggacggccgacgcggtgagcaggccgcgactgctgagcctcacgggaatctccttcgtcgatgatgcgaggacggcggcggatcggtgtccatgcgttcgctccgggcgggagaagtgcgggcggggcggccatgtccgcgcgtgggaaagcgggagggaccgggaaggctgtgcccgcgaaccgtgcgagcgtcctcggcggtcagaacggcagtggctcttcgaggacggtgcggtcacgaaggaccttttctgacgacacggctcctcccgagaacgcgtagggcgggtgcgtggtggatcggccaggccatcaccgatgagcggtcgaaggaggctcgatcggtgtgaacgttaacagcgctcgttcgtcggctcaatccctcggaaacaactccttgtgtgtcggcggtacttgcggcgggtgactcccgctcgccgggcgtgcctctggtcggctggtcgcggtccccggtcagctagaaacattggctctggcgcctccggcgacgaggtggcgtgacggaggagcgcgttttcgcgactcgtccgcaccagcgtcggcggaagtgaactcccggccaccgcacgagtgttatcgataacagaaggggttgtcgcaggcgggcgtgtgagctacgttacgtgctgctcaccgccgccggaccggcgttcgcgtccgaccgcgcgcaagctgctcacgaggagtgttcgcggttaccgcgtcggaccggtccgggaagccgtcgctgccgagcggcggacaccgagcgccttctcgacggtcgcgagaacgatgggcccggatcggcggagcccgaaagcaccgctgcttcgcggcatcatgccgcgcaccagcatgatctcctcgccctgcctgcctgcctgcctg

SEQ ID NO: 3178 - DNA, 4245 bp, Unknown
  Kingdom: Bacteria, Phylum: Actinobacteria, Class: Actinobacteria, Order: Streptomycetales, Family: Streptomycetaceae, Genus: Streptomyces
gcggccggcgccggccgcctcggcacgcagttgctccagccgcttgcctgccgtggcgagcttgttgtgggccttcttgatgacccagtcgctgagcgcctcgcgggactgccctgccatggcgtcgagctgggcctccagctcgtcgagggcgtcggccaggtcgagcgcctccttggcgtcggggttgaccaggtgcagtacctcgcgctcgacggtggggcgctgggccggggagtcccacagcacgtgggtgagcacggccaggtcggtctcggcgaccgccgggcgtccgtcgaggtacgcggaggcctggagcagccccaccgcctgccgccagcggcggtcggaggcgacgagttccttgcggcgcagggccgcccgcagcgaacacacggcgtccacgatggcgtcggggacgtccacggccgggacggatccggtcaccgcgtcctgcaacgcggccagctcgacggtggtgcggaccggggccgccgggcggctgacggcggagcggaccagcgcggcgaagttcgacgggtccgccaggtatccgacctcgatccgcaccagcagccggtcgtagatcgcggccgtgtcctccccggtcggcagttcgttgctcgccgtgatggcgccgatcagcgggcagcgaatcggctccccgccgctctcggggtggtagatccgctcgttgaggtagcccagggtctcgttcagcgccgccgtggagcacttgaagatctcgtcgatgaacgcgacatgcgcggtcgtggcgcggccctcgtacacctggcggtactccccgcgggccagcgcggcgacgtcgacgggaccgaacatcctcgtcggcgcggtgaacttcgacagcaggatctcccagtaggccgccccctggaccctgccggtgagctcccgggcgatctcggacttcgccgttccgggcgggccgaggatcagcgagtgctggccggccagcagcgccaccacgagcgtgcgcaccacgtcggcccgctcgtagaaacggtccgacacctcgtcacagatcatccgcagccgagctgctgtggcctgcgcgtcctctgctccttgcacgtctgtacctcgcacgtcctgcattgtgccctgcgggtcccgctcccccatggccggctccgggcctccgccgctccccgggaacgggagcgggcccggaggcgtagccggcctccgggccctgagtgtgccgcccatcgggcacgccggcacgtttaaggatccgggtcagtctgatgtcgtcgcgtcctgcctttggaccaccgcagatcgaagctctgcgggccggacttgaaccggcatttcgacgcgcgcgggcccgggcccgttcgatccggcgatcggcggcgaatgctgagtctggagcaatagtctgagattgacggcggtctgcctctgcctgcttgggctactccggcccgtgccggagggaggagtcgaacctccactggaaccgcgccttcacgacaagcttcagtttcagcttgcgctcctcgcgcaccccggcccccgaagacggcggccggggaatccatggtcggtcacccgaagaggtaaccgaataccgcatcacccacccgctggtcggtgacctcagcgccgttggcctcctcgcgggcgaacttcacggcctgctggagcttctccacccggtccagcagttcgttgacgcgtcgcgccggaagcgccccggagaacttgaccgtcgtccagtacccgatcgggatgtcctcgtagtacacctcgacctgcgccgggtgcttctcggtggcctccgccttcacgtggttgcggggcaccttcttcgtgcggaccgtacggaccggctcggtcttccaggagtcggtcgaggggtcctgcacccaggcctcggccgcgtccagcacgggcagcttgcggacgaaggtgttgaggtcggtcagctgcttctccagaaagagcagatacgacaccggcacctcgctcaccagcacccggccgtcgaccttcacatcggccctggccgtgcagttcgcccagtccttcgtggcggtcacatcgaagagccgggtcagggtgaccgcggtgtcccggtcgaactcgctgtcgccgatggttgcccgtgcggtctgcgccgcctcagtcgctgcctgtgccatggcatgcacggtacatcgacctccctactgagcggtagctttttggggagccggatcaccgcaccagcggcgagaggccctaggtggccgccgaaccctcctcggcgcgtgcggaggaccggttgtacgcgcggggcgcgcgccagtggaagcgcagtgccagcagccgcagcacgaacgcggcgatcaccgccaacccgctggtcagggcgttgagggtgtcgaagcggatgcacaggacgaccatggccgcgccgacgatcgcgggcaccgcgtacaggtcgcggtcccagcgcagcagcgagggcacctcgttggccagcacgtcgcgcagcacaccgccgccgaccgcggtggccaggcccagcgccgccgacgcggtgagcccgaggccgtactcgtacgccttgaccgtgccggtcacgcagaacaggccgagccccgccgcgtcgaagacgttgacgccgacctggatgcgctccacgtgcgggtggaggaagaagaccaggacggcggcgaacagcggggtggtgaagtagccgaggtcggtgaaggcggcgggcgggatcgcgccgatcatcacgtcacggaacagccctccgcccagcgctgtcacctccgcgaggaccgcgatgccgaagacatcgaagttcttgcggacggcgagcagggcgcccgagatcgcgaagacgaagatcccgacgagatcgagcgcgtgctggacggagggcgtgaacagttcggtgagcaccgggcaattgtgccggtcctacgccgtggggctgtcctccgtctgttcggtggcgtccgcgtcggcctgggccggtacggtcgcgggctccttctcggaggcctcggcctccgcggtctccaccgcttcggccgccaccgtttccgtgccgatgaccgcctcgatgcccgtggccagggtctgcttcaccgtcccggcctcgatctcggccgtgaagtggcaggccaccttgtgcccgtccccggtgtccagcagcggcgggcgctccgtggcgcacttggtctcctgcacccacgggcagcgggtgtggaaccggcagccggtcggcgggttcgccggggagggcaggtcgccgtggagcaggatccgctcgcggcggtcctcgacctcggggtcgggcaccgggaccgccgacatcagcgccttggtgtacgggtgccggggtcccgcgtacagcgcgtcgctcggggcctcctcgacgagcccgccgaggtacatcaccccgatgacgtccgagatgtgccggaccacggcgaggtcgtgcgcgatgaccaggtaggtcaggccgagggactcctggagctcctccagcaggttgatcacctgcgcctggaccgagacgtcgagcgcggacaccggctcgtcgcagatgatgacgtccggctccagcaccagcgcgcgggcgatgccgatgcgctggcgctggccgccggagaactcgtgcgggtagcgggacatcgcgttggacggcaggccgaccttggcgaggatgtcctcgatcttcttccggcgctccgccgcgtccttcccgatgccgtgggcggccatgccctcggcgaggatggactcgatgttctgccgggggttgaggctgcccagcggatcctggaagaccatctggagccggcggcggaaggcccgcatctcctcggagggcagcttcgccaggtcggtgccgtcgaagacgaccccgccctcggtgatgtcgttcagccgcaggaccgcgcggccgagcgtcgtcttgccgcagcccgactcaccgaccagcccgtacgtctgaccggcctcgacgctcagcgagacgccgtcgaccgcgtagacgtggcccaccgtacggtcgaagaggaggcccttcttgaccgggaagtggactttgacgccgtccagttcgagaaggctcatgccgggacctccgccttgggcaggaccgggttgacgcagcgcacctggtgtccggccgtgcgtggttcggtcagttcgggagtgccggtgaggcactccatcgtgtagtggtcgcaccggggtgcgaacgcgcagccg

SEQ ID NO: 3179 - DNA, 5517 bp, Unknown
  Kingdom: Bacteria, Phylum: Actinobacteria, Class: Actinobacteria, Order: Streptomycetales, Family: Streptomycetaceae, Genus: Streptomyces
  misc_feature (406)..(407): n is a, c, g, or t
ctgccgaccaagaaggaagcctgggtcgtcacccgctacgacgacgtccgcgaactgctctccgacccccgtgtcagcgctgacatccgccgcccgggcttcccggccctcggcgagggcgaacaggaggccggggctcggttccgtcccttcatccgcaccgacgcccccgagcacaccaagtaccggcgcatgctcctgccggtgttcaccgtgcgccgggtccgggagatgcgccccgccgtacaggcacgggtggacgagatcctggacggcatgctcgccgcaggcggaccggtcgacttcgtctccgcatacgccaacgccgtctccacctcggtgatctgcgaactcctcggcatcccgcgcgagaacctggagttcttccgggacgtcacccggatcnnctggaccggccggagctgaaggacgaactgcgccgcgacccctccctcatgcccgccgccgtcgacgaactcctgcgcgtcctgtccgtcgccgactccatccccctgcgcgtggccgccgaggacatcgacctctccggccggacgatccccgccgacgacggcgtcatcgctctcctcgccggggccaaccacgatcccgagcagttcgacgagccggagcgggtcgacttccaccgcacggacaaccaccacgtcgcgttcggctacggcgtccaccagtgcgtcggacagcacctggcccggctggaaatggaggtcgccctggagacactcatccgccgggtccccaccctccgcctcgccggtgaccgggacgacgtcgccgtcaagcacgactcggccaccttcggcctcgaagaactgagggtgacctggtgaccgcgtcctcctcaccgaacgtgtcgttccagcaacccgcccagcacttcccccggccctccgcacgcgcagtccgagccgacagcccctggatcaggcggtggagcggcgggcccgctccccgcttcacgctcgtatgcctgccgcacgcgggcggaagcgcgggcttctaccggccctgggcggccatgatgccccccgaggtcgaactcctcgccatccagtaccccggccgcgaggaccgtttcgaggatcccggggcggccgacatgggggagctggtcagtgcggtggcggacgcactcgaaccgctgctcgaccggccgtacgctctcttcggacacagcatgggctccgccgtggcttgggagcttgcccacgagctcaccggccgccgaaacctcgccccgcagcggctgttcgcgtcaggcagggcggcccccggcaccgccgtgaccgggcaactgcaccgccagaacgacgacatcctgagcgccgaactggcacgcctcggcggaaccagccgagagatcctggacgaccccgggctgcggtccctgatcctgacggccgtacgtcacgactaccggatcatcgagacgtaccggccggcggagcggccgccactggcctgcccccagcacgtcctgaccggcagcaaggaccccgaactcggggaggaacgcagccgcgacggggcagccggctgggcggacctcaccaccgcccgcaccgaagtccgtgtcttccccggcgaccacttctacctcaccccccgacgccgcgaggtcgtcgccaccgtgctgcgccgactggacccctcgctgaccatcggcggcgcacacacctggccgagcaccccgtgagccgagaccgcaccgccagccgtatacgacccaccacgcccgaccccacccggagcacgccgtgatcgactactactcgacctcggccgagttctacgaactcgtcgccacccggcacaccgccagcagcggcccgccgctgacccgcgtcctcatgggtctggacacatcccacggacccgtcctggagatcggggcgggcaccggacgcgtgacggaggtcatcgcctccgccctgcccgaggcggagatcctcgcggccgagccctcggccaccatgcgcgccatgctcacctcccgggtcgcccgcgacccggacctgcgcaagcgcgtgaccgtggtggacggcgccgcccaggacctcgtcctgcccgaacggctctccgccgtcgtgatcttcggcgtggccggtcacctcaccgtccccgaacgcgtcgcgctgtggaaacggctcgcggaccgccttccggacggcgcgcccatcgtcgtcgaactcatgggagtgacctcgccccgcgtcatcccacccgtcatgtccctcagggagaccatcggacgccagacgtacgagtggtggatcggcggcgaacccaccgacggcgacgccatgcggttcaccaccacatggaaggtgctgcgcgacggccgcaccgtgcgtgaggtctccgacacctacgactggcacaccttcgacgtcgcccggctggcccgcgaggccggcatgaccagccgccgcatcaccgaggccggcggcaggcccatccccgaaatcggagtactcgtcaagtgaagtcacaaccgcccggggccggtcaggccccggcagccgcggacaccgctgccgatggcacgggcccccgccccactccgcctccgctccgcgcgctcgccgagccggtccgcggacgactggccctcgccacgggcctccaggccgtcgccgccctcgccggtgtggtccccttcatcgccgtctcccgcatcgccgaacgcctcaccgctgggcccccggccgatggcgacgccctctggccgctggtggtcctggcctgctcctcgggcttcgtcgccctggtatgcggcacggcggccggagccctcgcccacatcgccgacaacaacctccagctcaccctccgccgccggctcgcccgccacatcggacggctgccgctcggccggctcaccgaccgaggcatcggcgaggtcaagcaggccgtgcaggacgacgtgagcgcgctgcacacgctgttcgcccacaccctgctcgatgtcgtcgcggtcctcaccgccccggtactggcactggcctacctgttcacggtcgactggcgtctggccctcgtcagcgtggtgcccctgctgctgggcgtgtacctgttcagccgggccatggcgggcgcggcgggacagatggccgagttcggtgccgccctgggacggatatccgcagccgcggtggagttcgcctccggcatcgccgtgttcaagagcttcgggcgcgggagcaaggcccacgagcgtttcgtgcgcgcgaccgagggcttcgccgacttcttctccggctgggtccggtccaccctggtgacctccaccgccgcgatcctggtggtggcgccggccgtggtcctgctgctcctgtccgtccttggcgcggtgttcatcacccaggactggatgaccggcgccgaactcgtccccttcctcctgctcggccccgccgtcgccgcccccatgggtgtggtgggcccccgcatccagcagatccgtgccggccaggccgccgccgtacgcatcacggcactgctgcacgcccccacgctccccgagcccgcagaccccgccctgcccgacggccatcacgtttccctgcgtggggtgtcgttctcctacgacggacgggccgatgtcctcagcggcgtcgatctcgacctcgcgcccggcacggtgaccgccctggtcggcccctccggctccggcaagtccaccctggcgtcgctgctgccccgcttccacgacgtcaccgccggtacggtcaccctcggcggcgtcgacctccgcgacatccccgcggccgagctgtaccgccgggtcggcttcgtcctccaggacgtacggctgctgcgcgcgagcgtcgccgacaacatccggctgggccgtcccgacgccaccgacgaggaggtcgagcggtgcgcccgcgccgcccgcatccacgaccgcatcacggccctgccggacggatacgccaccgaactcggcgcggccgtcaccctctccggtggcgaggcccaacgcctctccatcgcgagggcactgctcgccgacgctcctgtcctcgtcctcgacgaggcgaccgcgtacgccgaccctcactccgaggcgctgatccaggacgcgctgtccgagctcgcggccggccggaccctcctcgtcatcgcccaccggctgtcgaccatccgctccgtcgaccgcatcgtggtgctggagcacggacgcgtcaccgaacagggccgccacgacgagctcctggccgctcagggccgctacgccgcgctgtgggaggcccagcggaccgcgggcccggacgagagcgatggcataccgcaccaccggtccgcacccgtgggggccgaccgcagagcggacgatatccgagaaggaagttcacgatgatccgtcagctctaccgcgtcctgggaccggaaggctcccgcccgctgaaccggctgctggtcctccagtccggtgcggccgtactgcaaggcgtcgctttcgccctcctcgtgccggtccttcaggccctgctcggcgcggaccccgacgacgtctggccctggctgacggcgttctccggctgcgtactcggttacgcggcgctgcagggcgccgctctgagcggcgggttcaccgtcggctcccagctttcccgggtgctgcaccgccgccttgccgatcaggccctgcgcctgccgctgggctggttcaccgccggccgcacggccgagttcagcagactggccggacagaacgtcatccaggtgatgagcacaccggcccacctgctgcgcccgttcctcacctcccttctcaccccggtgacgctggtcatcgccaccttcttcttcgacgtccgcaccgccctggtgctcctggtctgcgcgcccgtgctgttcgccgtccagttggccggcgccgcgatgatgcgccgactcgacctcggtcgcgacgccgcggccggcgagtccgcggaccgtgtgctggagtacacgcgcaaccagccggtcctgcgggcgttcggccggaccgccgagggttacggagcgctggacgacgcgttggtggccgaggcacgcgccgatcggcggctcatcgcgcgcggcctccccggtctggtctcgttcaccttcgccacccgactcgtgttcgccctgctgctcgcactcggggtctcctggcagctcgacgggtcgctcaccgtccccaccctgctggccctcctggtcctgctggtgcggctcatcgacagcgtgtcgtccgcagccgaggccggggcgggcatgcgtatggcccgtaacaccctggaacggctcggcgccgtcctcgacgagccgccgttcccccagccggtcgagccgcagacaccccgtgacgcgagcgtggagttctccggggtcggcttccgctacacccacgggacggccgacgcagcttccgcacgcccggtcctgaacgacgtgacgttccgtctgcccgagcgcagcatgaccgcactggtcgggccctccggcgccggcaagaccacg

SEQ ID NO: 3180 - DNA, 4474 bp, Unknown
  Kingdom: Bacteria, Phylum: Actinobacteria, Class: Actinobacteria, Order: Streptomycetales, Family: Streptomycetaceae, Genus: Streptomyces
tgcggggcgagcggtcgacggcggtgacgcggtgaccctggcccgcggcgagcagggagaggctgccggtgccgcaccccaggtccagcacatcggcacgggtgccgggcagccagctctccagccgtccggcccaggcgtcgcgcaccgcggggtcgaggagcccgtggtcgggctcctcgtcgaaggatccggcagccgcgtcccagtcgatcgtggtcatggagccgatgctctcagccgccaccgaccgtgcgggactcctctgccgttttccggccaccgcgcagccgcgggacgagccggctgatcagcggccacgccacgatcagcaccacgatcgcgtagaccgtgacggagaacggggtgttgaccaggccggacacgctcccgtcgctgatctggagcgcgcggcgcaactgctgttcggcggccgggccgaggatcaccccgatgacggcgggcagcaccggcagtccgtagcgccgcatcccgaacccgatcagcccgatgatcaaaaggatcaccaggtcgagggactcgccgccgaccgcgtacgcgccgacggcggcgaagaagaggatgcccgcgtacagatagggacgcgggatccgcaggagcttcgcccagacgggggcgagcggcaggttgagggcgagcagcagcaccatgccgacgaagagcgaggcgatgaggccccagaccagctccggttcgcgttcgaacagaaggggacccggctggattccgtactgctggaaggcggccagcatcacggcggccacggcggtggtgggcagtccgagcgtgagcatcgagacgagggttccggcggcggaggcggaggcggcggcctcgggaccggcgacgccttcgatggcccccttgccgaactggtcgcggtgcttggagagccgcttctcggtgacgtaactgaggaaggtggggatctccgcgccgcccgccgggatcgccccgaaggggaagccgatgacggggccgcgcagccagggcttccaggtgcgcttcaggtcggcgcggccgagccacggtctgccgacggggatcggctttccggtggagcggcgcagatgcgcggcgacccagagcgcttcgccgatcgcgaagagtccgaccgcgacgatgaccacgtcgacgccgtcggccagttggagcgatccgaaggtcaggcgctgctggccggtcatctggtcgaggcccaccagtccgatggtgaggccgatgaggagcgaggcgatgccgcggatgcgggaggcgccgaggacggaggtgacggcgatgaaggccagcaccatgatggcgaagtagtcgggcgcgccgatcccgatggcgagggaggcgacggtcggggcgaggacgaccagcaggatcgtgccgatcatgccgcccgcgaagtgaccgatcgcggcggcggcgagcgcctgggcgccgcgtccgcccttcgccatcgggttgccctcgatcgcggcgaccacggccgcgctctcaccgggggtgttgaggaggatcgaggtggtggatccgccgaacatcgcgccgtagtagatcccggcgaacatgatgaacgcgccggtcgggtcgagtccgtacgtcaccgggagcagcagcgccacggccatcgccgggccgatgccggggagcaccccgatcgcggtgccgagcaggacaccgatcgcggcccacagcaggttcatcggggtgagcgcggtaccgaagccgtcgatgagggagttgagggaatccatcggtcagagcacccccatcagcgggccgcccggaagggggacaccgagcaggttgtcgaagacgaaataggtggcgagggagatgccggccgcgatgagcgggtcccggccgtggtgccggctgccgagcgcgtaggcggagccccagaagagcagggccccggcgatcgggaagcccagggggccgatcaggacggcggcgccgaggaagaccccggtgagcaggagaacggtgcgccagtcggccggttcgtcgaggtcgacgtcctcgccgccctccgcctcaccgcgtccgccgcgcaggacgtctccggcgagcaggacggagatgaggaggaagagaccgccgatgacgaacgggaccgtccgtgggccgacggggccgcgctgggcgaggtcgacgctcatggtgaaggcgtcggtgaggacgagcacgccgagcgcgaacagcaggacgcagacgccgagttcggagtgctcgcgcagccaggagaggacggtgctctcctcctgtgcggcttcggcgctcggctgtgccgcggagccaggggtttcggtgggttcggtggtcacagccccagctccttgagaacggtggcgacccgctggttctgctcgtcgaggaagtcgccgaagggttcgccgatgaggagggcgtcgtcccagccgttcttcttcagcgactccttccactgcttcgagccgtggagttcgcggatcaggccggtgagcttgtcgcgttcggccggtgagaggccgggcggggcgacgatgccgcgccagttggtgaactcggtgtcgagtccggcttcgcgcagggtgggagcgtcgaggcccggcacccgctccggaccggtcacggcgagcagccgcagctcgcccgcctcgatctggtcgcggtactcgccgaggccggagaccccgaagccgaccttgtcgccgaggatggaggcgaggagttcaccgccgccgtcgaacgggacgtagttgaccgtcctcggggcgatgccggccgcctgcgccatgagcatcggggcgaggtggtccgggccgccgggcgaggaaccgccaccgaccgggacgcgggccgggtccttcttccaggcggcgagcaggtcggtgatggtccggtacggggagtccttggagacgacgacgatgtccggctcctcggtgagccgggcgatcggagtcgtgtcggccagcgtgctcggcgacttgttggtgtggacggctccgacgacgccgagacccatggagagcgcgagcttgccgttgccgtgttcgccgacgagccgggtcaggccgaccgttccgccggcgcccggcaggttgaacacctcgatgttgtgggtgagtccggcgtcctcggcgttcttggcgagggtgcgcgcggtgatgtcgtagccgccgccgggagtgttggggaccatgaagcggagcccgggaatctgggtgccggtgtcggaaccgtcaccggtggacagcaggggtggccccaccgccaccagcaacgcggccccgaacagggcgaggggagtgcgcagtcgcacaggttccgcctttcgctgtgaagtggcccacatgttgcctgcgcgttaagaagctgtctctcttccggtatcaacggacgttgtggtcattgcggtcgccgcttagcgtggcggcgtgacaactgtgctggtggtggacgacgacttcatggtcgcgaaactgcacagccgctatgtgtccgccatggacggcttcgcggtcgtcggggtggcgcacaacggcgccgacgccttgcgggcggccgagcggctgcgccccgatctggtgctgttggacatctacctgcccgatatggatgggatcggggtgctgcgcgccttgcgtgcggcggaggagcgggacgcctcgcgccccagtgcggacgccctgttcatcacggcggcccgggacgcgggggtgatccgggcggcgctgcgggccggggccctgcactatctgatcaagccgttcagccggtccgcgctccaggagcagatgcgccatgtcgcctcgctgcgcacccgcctggacaggttgggcgaggcccgccaggaggacgtcgaccagatcttcggcacccgcccgcccggctcccgcgagctgccgaagggcctggccgcccccacggccgacctggtggaacgcaccctgcgcgaccaccccgagggcctgtccgcttcggagtgcgccgaggtgggagcactgtcccgggtgagcgcgcgccgctacctggagtacttcaccggaacgggccgggccgaggtcaccctgcgctacggaggcacgggacggccggagcgccgctaccgctggacggggtgagacggcgcgggtgtcgtccgcgcaccgcgatccgcacgacgaccgcggcaccgcccgcacggcggaggtcgcggaggggaccgggatgcgcagggtgaggccgcccgcgtcgtggtcggccccgaggggccgatgcgcatcggcatcgtgcgacacctcgcaggttcgagctgtcgccacccatgcgctgcactcacctggttgcaccatgtcgtccggtggacgacaatcccgatgtcatcgttttgctgacacctgagggaggttcccgtgaacgcagcagaccagccgtcaccggccagtaccgtggccaccagcccggcgtccttcatcgccgccgcggcggcgatgaa

SEQ ID NO: 3181 - DNA, 22993 bp, Unknown
  Kingdom: Bacteria, Phylum: Actinobacteria, Class: Actinobacteria, Order: Streptomycetales, Family: Streptomycetaceae, Genus: Streptomyces
gtgcgccgtcagggactcgaaccccggacccgctgattaagagtcagctgctctaaccaactgagctaacggcgcctgctgactcgaaaataatacctggtccggaagagtgctgatgacacccctcgtggccccgacttccggggccccggaggcgcgggccggccgtgccccgcctacgccgtcccgcgggcggccaccgcgtccgggatcagcggaccgatccaggcggcgaaggcgtcccccagctcggccccggccgcacggacgaccgcgttggggtcctcggcggcctccagaccgaaacggtcgcgcagccaggcccggaacgcggggttctccgggcaggggtcgtatccgaccccctcgtccccgtcctcctcctcgcgctcgtcgtagtagtccaccctgtcccactcgcacatcggggaccagccggaggcgaggacgcgcagcagctcgggcagctcgcgggcgacgacatggacgcctccctcgtcccccaggaggagcacgggcagcgtggcgaggtcggcgcggtcgtccagcagccagatcgcgtacgtcgagccggatccggtggcccgggcgaagggccggatccggtcggagagccgcgggtatccgccgtcgtcctcgccgaaggcgatcagctcgaagccgggcgtgaagtagtcctcgacgccgtcctcgaactccttgaggaggttcagcgcgggtatcggtgcgtacatggcggtgacgctacctcccccatgagcaccggccccggccgctacagcgccagcgacagcaggaccggcgccgcccggcggctgagggtttcggccgccgcccgcagccggtgcgcgtcctcgatcggcagcgacagggcgaggcagcccgcggcggatccggccgtcagcggcacggccgcgcagacggtgcccaccgcgtactcctggaggtccagcaccgggaccgtggcggactgggcgtccagctgggagaagaggatcttctcgctggtgatcgtccgggaggtgagccgcgccgtccggtgccgggagatgtggtcacgccgcccgtcgtggtcgagctgggccagcagacacttgccgaccgcgctggcgtgcgcggaggagcggaagtccacccactcgttgaccgccggtgtcagcggtccgtccgcgacctgctccacgctgacctcgccgtcgacatagcggctgagatagaccgccgcgccgacggagtcgcgcagctcggtcaggatgtgctggagacggtcctccagggcctggcggcgggccgccccggagccgagcagcagcagcgaggcgccgatgacgtacgcgccgtcgctgacctgctccacatatccctcgcggcgcagcgtgaggagcagggaggcgaggtggccggtcggcagccccgtctcgcgggagatctgggcatcggtcacaccgttgccgtgcttggaaaccgtttcgagcacgcgcagggcgtactgaaccgagtggaacggcgcggtcggctcgggcttcaacgccacggtgtccccctaccaggttgtgaccgcaagctttcgccccacgatagccgccggaaggcccctgcggggcggcagttgacgggtcggtgggcgcgccccggagctgccatctggggcgcacccgcctggcatatgccaccgtcatgacccggaccgcaactgcgaggtcacagcaccgcgttgaggaactcgcgcgtacgttcgtgtgacggatcggagaagattttttccggggatccggactccacgacccgtcccgcgtcgaacatcagcaccttctccgagacgtcgcgggcgaagttcatctcgtgggtcacgcagagcatggtgatgtcggtgttccgggcgatgtcccccagcagctccagcacgcccgccaccagctccgggtcgagcgccgacgtcacctcgtccaggagcaggatctccggctccatcgccagggcgcgggcgatggcgacccgctgctgctggccgccggagagctgcgaggggtgggcgtcgaccttcgcggagagcccgaccaggtccagcagctcccgcgcccgcgcctcggcctcctcgcggctcctgccgagcacgctgaccggggcctcggtgatgttctcgatcaccttcatgttcgggaagaggttgaactgctggaagaccatcccgatcttcttccgggactcgcgcagctgcttctcgccggcgggcctcagcgaaccgtccggggcgcggacgtgggtcagcggcgagccgtcgacccagatcaccccgccgctgaccttctccagcgtcatcagcagccgcaggatcgtggtcttgcccgagccgctgggcccgatcagggtgacgtgttcgccgcggtccacggtgaagtccagctcgtccaggaccacatggtcgccgtagcgcttcaccaccttgtcgaagcgcaccagcggctcacccgtgcgcccggtggccggggcggcgtcctcgggggatccggccggccccggcgactccgtcttcttcagggggaggggttcagtggccaaggcgcttctccagctttctcatcaacagcgacgtgggatagctcgcgaccaggaagatcaggccggcgagggtgaacacctcggtgtacgcgaagtgctcggccccgtacttccgggcctcgaagaccatctcctgcaccgtgatcacggcgaggaacggcgtctccttgaacatcgagatcgcgtagttcccgagcgcgggcagtacgttgcgcaccgcctgcggcaggatcacggcctgccaggtgcgccggggggacagcgacagcgcgcggcacgcctcccactggcccttcggcacaccgtcgatcccggcccggtagacctcggaggtgtacgcggcgtagtggacgcccagcacggcgatgccgatgtacagcggctccacggtgttgaacagggctgccgcacccaccagttggaccagcagcggggtggagcggacgaactccgtgacgagccgcaccgggaccgtcacgagcttgctgggcgcgcgcccggccatcgcgacggccagcccgagcacggccgccaccagggtgccgagcaccgtggcgagcagggtgacctggaacccctccagaaggaggggcagggactccccgacggcgttccagtcgaagccgttcaccgggtacctcccacggcggtcgtggacgcgctgcggctcttgaacaggctcttcgcgccggtgtccagtccgagccgccgcttggcgctccgctccagcagattcatcagcatcgtcagcgcgtacgccaggacgaagtaggcggccagcagggtcagataggcggtgagggtctcaccggtacggtcgcgcagctgctggatcaccgtcatcagatcggcggcggagatcagccacagcagcggggtcgccttcagcagctggatcaacaggttggtgaaggaggggatcatctgcacccaggcctgcggcaggacaaccttccacagccgcctggtcggactcaggttgagcgcgatcgccgcctcgtactgcccgcgcggtacggagttgatcgcaccccgcaccacttcggccccgtaggcaccgaagttgaggccgaacgcgaccacgccgcagatgaccggggtcagttcgtagccggtcagcagcggcatcgcgtagtagagccagaacagctggatgtagagggaggtgccccggaagaactccacgaccacccgggagaacccccgggccaggagcagccggctgcccgccatcaggccgagcgcgaaggcgaggaccccggccagcagcgcgcccaggaccgtggcctgaagcgtcacccacaggcccgagcggacccgggggaactcctcggcgaggagggagaagaagtcactcatgcgtgcgcgtccgccccgtcagcccttgcacagatccgcggtcttcaggtcggcgggcgggatctccgtctccccgaacccgaacggctccagcagctgcacatagcgggagcggtccgacacgatcttcttcagctcgcggttgaaggagtcccgcaggtcctcgttgcccttgcggaacaccgcgccgccgggggagaactgctccttgccgtccagctccggcaggaacgcctcggtgacctcggtgtccgggttggtcttcgccagccagcgcagcgagataccggtgagcaggaaggcgtcgatccggccgcccttgacggcgtcggctccgtcctgcggcttctgcaacgtcttgatcttgtcctcgggtatgcccgcgcccttggcgtaacttccctcgaccgcacccgacatcacgccgacggtgatccccgcctccttcgcggaggccagatcggtgatcttcttcgggttgcccttcttcaccatcagggcggtcggcgagatgaactccggctcggagaagatcgcgttgccgcagcgctccggggtgatggccatgcccgcgctcaccacgtcgtacttgccggcctggagcccggggatcagcccgtcccactcggagagcgtcggcttcagctcgtccaccccgagcgccttgaagatctcccggtgcagcgtcggtgcctcgcccttgagttccttgccctccaggtacccgtacggggcctcgttcgcgtacgccacccgtacgaagccctgtttacggagcttgtccagggcgccctcgccggtcgcggagccggagtcggtcttgctgcacgcggtgaggaggccgggaacgacgaggaggccgcccacggccgccgatccgttgaggaagccccggcgggacaggttcgggaattcagccatggttcgcaatctcctggaggtcgaacagtccggacagactgagcccctgcccgatcccgtacgtctatgcgggaagccggaggcatgtaacccaacagtggccggaaggtgaccttcccgtgcccgaaggggggcggagcgcgaaccgtgcggggcgtgttcccccgccggaccggttcatgacagcgagtcagggagaagcgggtcacgccgtgcggcgcctcagcgcgcggcgccgtcctcgaagaggtcggtcgacggaacgtaaccgagggtcttgtcgaccgtgttcggcaacggcaggccgcgcgaccactgttcgtacatcgccacgaaccgctcgcccagccggtcgcgccagcccgcggtgttcccgcccaggtgcggtgtcaggacgagccccggggtctcccacagcgggcttccggggccgggcggttcctcctggaaggtgctgagcgccgcccccgcgagccagcggcggttcagcgcgtccaccaggtcggcctcgaccaccgtcgccgtgcgtcccgcgtcgatgaaccgcgccgacggctggagcagtccgaagaaccgggtgtcgaacatcccgcgcgtcgactccgtgagcgggaccgccgcgatcacccagtccgcccgcgccgccagccggtccagatccgccaccccgtggatcgtgcgccgggccgtccgtcccaccagcgccaccgtgacccccaggccgtgcagcagccgggtgatctcccggccgatcggggtgaggatccggcggtacgtccaggagacgggggcgacgagcagcgtcatgaccagccaggcgagggcgatgcccagcccgcgtccggtggccgcgatcccccgcccgacctggcccagcatccaggccgtgccttgccacagcttgcccaggacccaggccgtgccgaggccgagaggggtgaggacggccccgtacagccacaccaccgggacgatcaggccgtagcgcaccaccgggacgatcacacagcgccacagacccgcgaccggcaggacgatcagagtggcgaacagccaggtcaggcccgttccgagaccgcgtgccgccggggccagcagggcggtgccgatccatcgcaggccgtggcccagcggggtgaggacggccccgtacagccacaccgccggcgcggcgatcccgtagcgggcgacggggacgatcacgtaccgccacaggccgatccagggccagaggaggagcgcgacggccagccaggaggcggccttgcccagcggtgtgaggacccacgtgtacagccagttcagcggggtccgtacgagggtgtcgaggagccacgccagggcccggcccagcgggcgcagcaggacacggtcggcggcgtgccagagggcggtgagcgcgtcccagaccatgcggacgggcaggacgagcaccaggaccacgatccgcaccgggatcctgatcagcgtggtcagaacgccttcgccgggctcgtacccctggggggcctggtgcttgccgtggtccatgccgtcaaggacgcgtcaggcccggtccggggttgccggccgggcctgacgtcaccgtgttgtcacacggaacgcgcgagggctacttgttgacgacgctgagcggcaggagcttcttgccggtcgggccgatctggatgtccaggtcgagctgcgggcagacgccgcagtcgaagcagggggtccagcggcagtcctcgacctcggtctcgtcgagcgcgtcctgccagtcctcccagagccagtccttgtccaggccggagtcgaggtggtcccagggcaggacctcctcgtaggtgcgctcgcgggtggtgtaccagtcgacgtcgaccccgaacccgggcagcgtcttctcggcgcagttcatccagaggtcgtagctgaagtgctcgcgccagccgtcgaagcggccgccggactcgtagaccgcgcggatgacggagccgacgcgccggtcgccgcgcgagaggagtccctcgacgatgccgggcttgccgtcgtggtagcggaagccgatggagcggccgtacttcttgtcgccgcggatcttgtcgcggagcttcttcagccgggcgtcggtgtcctcggcgctgagctgcggggcccactggaagggggtgtgcggcttggggacgaagccgccgatggagaccgtggcgcggatgtcgttctggccggagacctcgcggcccttggcgatgacgttgaccgccatgtcgccgatctggaggacgtcctcgtcggtctcggtggggaggccgcacatgaagtacagcttcacctggcgccagccgttgccgtacgcggtggcgaccgtccggatcaggtcctcctccgagaccatcttgttgatgaccttgcgcatgcgctcggagccgccctcgggggcgaaggtgaggccggagcggcggccgttgcgggtcagctcgttggccaggtcgacgttgaacgcgtcgacgcgggtcgagggcagcgagaggccgaccttgtcctcggtgtagcggtcggcgaggcccttggcgatgtcgccgatctcactgtggtcggcggaggagagcgagagcaggccgacctcctcgaagccggtcgccttgaggcccttctcgaccatctcgccgatgccggtgatgcttcgctcccgcacggggcgcgtgatcatgccggcctggcagaaacggcagccgcgggtacagccgcggaagatctccacggacatccgctcgtgcacggtctccgcgagcgggacgagcggctgcttggggtagggccactcgtcgaggtccatcaccgtgtgcttggagacccgccacggcacgccggaccggttgggcacgacgcggccgatccggccgtcggggaggtactcgacgtcgtagaagcgcggtacgtagaccccgccggtcttggacagccggaagagcacctcgtcacggccgccggggcggccctcggccttccaggcgcggatgatctcggtgatctccaggacggcctgctcgccgtcgccgacgaccgcgcagtcgatgaagtccgcgatcggctcggggttgaacgcggcgtggccgcccgcgaggacgatcgggtggtccacgtcacggtccttggactccagcgggatgcccgcgaggtccagggcggtgagcatgttggtgtagcccagttcggtggagaagctcagcccgaagacgtcgaacgcgccgacggggcggtggctgtccacggtgaactgcggcacgttgtgctcgcgcatcagcgcttcgaggtccggccagacgctgtacgtgcgttcggcgaggacgccttcgcgctcgttgagcacctcgtagaggatcatgacgccctggttggggagtccgacctcgtaggcgtcggggtacatgagggtccagcggacgtcgcagctgtcccactccttgacggtggagttcagctcaccgccgacgtactggatgggcttctgcacatgcgggagcagagcttcgagctgtgggaagaccgatgcggcagacatctcgcgaaccttcgtgagccggcaggggtgaccatccagcgtaccccggtactcaacgcttcagatccgcgcgcagtccgggggcgctcgcgcgggcccagacctcgggcagctcgcgctcctgagcctcggccgcggcctcctcctgtccgtacaggagcccccaggtgaacgcggtctcccctgccgcgtgcgactggatcgcgagcatgcgcagggcctcgcgggcgacgacgctgtcctggtggtcgccgaggaccgtctgcacggccttcacgcgcttggagaagcgtttggctggcttgccgagcgccggccgggccgcctcgcccgcgtaccgggcgcgtttggcggccttgcgggcctcgtgcagcgccgcgtcgcgctccggtccgggcggctgtccgagcgcgtggccgacgcgggtggcgaggcgttcgtagtccttgagcaccgcccggggcagggccttgccgggcgcgcggccggcggcgggacgcaggggcgggtcggcgctcagcgcgtcgagggcgtccaggaggtccagataccgcttcccgtccagtacgtcgatgatcctgcggcgcgatccggtgcggcgggcggccgaccaggcgcggaggcggccgcggaccggaccgagcgtcagggtggcgggcagggcctcgatgcgggagccgaggcgctcgtccaggacctcctggtcgcggtccaggcccagttcggcggcgagccacttgagctccacgccgatggggtcggtgacgtcgcgatcgaggatcttgcggtgcgtcttgaaggtgctgcgcagcctgcgggtggcgacgcgcatcttgtgcaccgagtcgggcagatcgcgacggacggcggggtcgaggcggacgatcgcggcgatctgtttccgtacgtaggcgaggacgtggtcgcccgcggtccggggctcgtccggttccggtcgcttcccctggtgttcggggtccgtctcggccagggcccgggcgagcttggaggcggagtgggcggggcgcacccccgccttccgcagccgcttctcgacggcgtccaggatcgcgggatcgccgtcgtcggccaactcgacctcgatctcggtccaggtggcggtggtgccgctcccctcccccgcgaggcgttccgtgagcaccttgtcgacgctgacctcggcgaggagggtcccgtcggcgcccagcaagtggtggacgtcccgggaggagagcagccggacgacgggggcgatctccgcgtggcgggcccgggagcggagcagggccgccagcgagggcggcacggcgtcggagagcggctcgtggatctcctcccggacgccgacggcgacggggaacttcgcgtgccagccctcgtcctcccctccggtcctgcggcgcagggtgagggagtcggcggcgaggcggaggtcggcggtgtcgtagtagacggcgtcgagctcggtcacgccgcggtggaccgtccggtcgaccccggccgcccgggtcaggtcgggcagccgggtgtcgtcggtggcttcgtacttccgctcgatctcgcgcttggtgtccgccatgtacggacacctacccggcgtgcgccgggttcaggcggacatcggccgttgcacccggatggactgcaacagcccgatcgccacccagacggcgaacatcgaggatccgccgtaggagacgaagggcagcggcagcccggcgaccggcatgatgccgagcgtcatgccgatgttctcgaaggactggaaggcgaaccaggcgatgatcccggcggcgacgaccgtgccgtacagctcggtggtctcgcgggcgatccggcaggcgcgccacaggatgacgcccaggagcaggaggatcagtcccgctccgaggaagcccagttcctcgccggcgacggtgaagacgaagtcggtctgctgctcgggcacgaactgaccggtggtctgggtgccttcgaagagtccggtgccggtgagtccgccggagccgatcgcgatacgggcctggttggtgttgtagccgacgcccgccgggtcgagcgcggggttggcgaaggccgcgaagcgggcgatctggtagtcgtcgaggaggccgagctgccagacggcgacggctccgcccgcgcccgcgccgaggaggccgaagacccagcggttggaggcgccggaggccagcaggatgccgaggacgatgacggccatgaccatcaccgaaccgaggtcaggcatgagcatgacgatggccatggggatggccgcgaggcccagcgccttggcgacggtccggtggtcggggtgggcctggtcgcccgcgtcgacgcgggccgccagcagcatcgccatcacgaggatgatggtgatcttggtgaactcggagggctggatcgagaagccggcggggagcttgatccacgcgtgggccccgttgaccgtggtgccgagcggggtgaggaccgccaggaccagcagcaccgagatgccgtagaggaccgggacggccccgcgcagcgtgcggtggccgagccagatcgtgccgatcatcagagcgaggccgatgccggtgttgagggcgtgcctcaggaggaagaagtacgggtcgccctgggtgaggtggtcgcggttgcgggtcgcggaccacacgagcagcgagccgaggaacgagagcgcgagcgcggccccgagcagcggccagtccagccgccgtacgagggagtcgcgggccgtcagcttggcccaggatccctggtcgggtccgtaccgggagacggagaatccacctgccatcagggctgcctccccgtcgacgccggtgatccggtgagtccgggctggcctccgggcggcaggggcaactggggttcctgtcccccgggctgcttctcgggctcggccggagtggggtcgtagggcttgaccttcggcgcgtagatcgagccgtcgggctggatcttcggcagtgccttctggggcttcggcagcaaggccctcttcttgtcctggttgccctcggcgtcgaggccgtagagcgcgtcgtagatcttgcggacggcgggtccggcggagccggagccggtgccgccctgggagatcgtcatgacgatcgtgtagtcgtcggtgtaggtcgcgaaccacccggtggtctgcttgccgtacacctgggcggtaccggtcttggcgcgcatcgggatcttgtcctgcggccagccgccgaatcgccaggcggcggtgccgccgggctcgaccaccgagcgcagccccttgtcgaggtccttgatggtctgggcgttgaccggcagcttgccgctgaccttgggcttgatctcctggacgctcttgccgtcggggctgatcacggccttgccgacggtgggctcgtggatggtgccgccgttgctgatcgcggcgtaggcggtggccatctggatcggggtgacgagcacgtcaccctggccgatcgcgtagttgatgctgtcgtaggccttgagctggttgccttcgaggcagctctcgtaggcgatctgctggacgtaggtgccgcccttcttgccctccttgcaccaggcgtccttgttggccttccagaagtcctgcttccactggcggtccgggatgcggcccttgacctcgttgggcaggtcgatgccggtctcggcgccgagcccgaagtcgcgggcggtgcggtagaaccagttcttggcgtccttcttcggctttatgccgccgtcacgcgcccactcctcgtggcccaggcgatagaagacggtgttgcaggagtacttgagcgcgtcgccgagggtgatggggccgtggccctgggactcgaagttcgcgaaggtctggttgccgaggctgtaggagctgctgcactcgtagaggtcgttgaagtcgtggccgccgcgcacggcggcgctcgccgacaccaccttgaagatcgagccggccggggcctggccctggatgccccggttgagcagcgggtagttggacttcttgctcgtgagcttggcgtactccttgccggagatgccgccgacccaggcgttggggtcgtagtcgggctgggaagccatcgacacgacgcggcccgtcttcgactccatgacgacgacggcgccggagtcggcctcgtacttgcggccggtgatcttgtccgtctcgccccggacggtcttcatcgcctgggcgagctcgtactccgccaccgcctggacgcgcgcgtcgaggctggtgacgaggctggagccggccaccgccgggtcgttctccgcctcacccatgacgcggccgaggttgtcgacctcgtagcgggtgacgcccgccttgccgcgcagttccttgtcgtacgtgcgctccaggccggagcggccgacctggtcggagcggaggtagggcgacgggccgtcctgcgccttctggatctcctcgtcggtgacgggcgagaggtagccgaggacctgggcggtcttcgccttgccgggtgccgcgtagcggcgtacggcggtgggttcggcggtgatgccggggaagtcctcggcgcgctcgcggatctggagggcctgctgggtggtggcctcgtcggtgaccgggatcggctggtagggcgatccgttccagcagggctggggggtcttggagtcgcagaggcggaccttgtcccggacgtcctcggccttcatgtccaggacgtcggcgagacgggtgaggacgccgacgccgtcgtccttcatcttcagcagctcggtgcggctcgcggagacgacgaggcgggtctcgttgtccgcgagcggcacgccgcgggcgtcgaggatcgagccgcgcacggcgggctggacgacctgctgcacaccgttgcccgcggcttcggcggtgtactcgtcgccgttgcggatctggaggtaccacagccgcccgccgagggtgaacagcagcgagaagacgaggacctggatgacgatgagccggatctggacccgctgggtccgcccggtctccggaatgttgctcacggggttcccccggcgatggtccggctgggggtacgggggtcgtcccccgggaaatacggcctcacaggcgcttgacccccttgatcctgcccgcgcgagcggcgcggttgcgggcggccttgacgcgcaggccgccgcgctggttgccgatccgcagaccggtgcccgaggcgagccagccggcggcgacgtcgttgccgccggacgaggcctcggcgagcgggtcgttctcggtgcgtctggccagcgccatgatgagcggcaccgtgaagggagccagcagcagatcgtagatcgcggccgtgaacagcaggctgcccaggcccacatggcgggcggcggtgtcgccgacgagcgcgccgacacccgcgtacagcagggtcgagccgatcgcggcggcgacgaccacggccatcggggcgaaggccgacttcagttgcccgttctccggccgggccaggcccgcgaggtagccgatgacgcagagcaccagggcgtagcgcccggcggcgtggtcggcgggcggggcgaggtccgcgagaaggcccgcggcgaagccgatgagggagccgctgaccggcccgtacacgaaggcgagtccgaggacggtgaggagcagcaggtcggggacggccccggggagctggaggcgggcgaggacggagacctggacgacgagggcgacgacgaccaggacgatggagagcagagtccggttgatgcgcatggggatcagctctactcctggtcgttggccgcgttgtcgggtagggcgttgccctgctggtcgcctgccgcgtcaccggcggcgtcgccgcccggcttctcgttgatgttgccgacgaccttgccggatccgtccaccaggtccccgttgggctggaccgtgacggtgaccgtgggggtcggcttcggcttcgtcttgacgggctgcttgggcaggaccgtgtcgcgcgggtcctcgcggggagcctggacgacgaccccgacgatgtcgagcttggtgaacccgacgtacggcttcacgtagacggtccgggtcagcgcgccgccggaggggtcgacgcggacgacctcgccgaccggcacaccgggcacgaagggcttgtccttgctggagccgaaggtgaccagccggtcgccggccttcaccttggccttgccgttgaggaactgcaccgacagcgggcgcgagccctggccggtggcgaagccgagctcgtcggtcttctccatccgggtgccgacggtgaagtcggggtcgttggcgagcaggaccgtcgcggtgtggggaccgacggtggtgacccggccgaccagtccctccccgttgaggacggtcatgtcgcggcggatgccgtcgtcggcgccggcgtcgatggtgaccgtccaggagaagccctgggccgctcctatggcgatgacctcggcgcccttgatgccgtactgtccggcgcccgcgttcttcagcatggcgtcgagctggcggacccggctgttggtgcggtcgtcgctgccgagcttggccttcagcgcggcgttctcctgctccagggcggagatccggtcgtgccggttgccggagtcccgtaccgcgcctatggcgttgcccaccgggtcgaccgctgccgccacgccgttctcgaccggcccgaagacggtggccgcggcctgccgcgcaccgtcgaccggtgactcctcgccgcctcggatatccaccgtgatcagggcgaatgcgatggcgatcagcagcaccaggagcagccggctctctcgtgtgtccctcacgtgcggcggccgtgccttcctcgtcggaatattcgtgcctgtgtgtacgtcgctgtacgtgcgtccgcgtcgatgtgtctccgcggcggtacaggtacagcaacgatctatatcaacgatccggcgggcggagcgtcagcgtccgctcaccggatcgggtggtgtccccggagggacaccacccgaagcgctctaacggcggggctgggcgtccagcacctgctggagcgcctcgaactcctcgacgcacttgccggagccgagcgccaccgagtccagcgggtcctcggcgatgtggatcggcatacccgtctcgtggcgcagccgctcgtccagaccgcggagcagcgcgccgccgccggtgaggacgatgccgcggtccatgacgtcgccggacagctcgggcgggcacttgtcgagcgtcgtcttcacggcgtcgacgatcgcgttgaccggttcctcgatggccttgcggacctcggcggccgagatgacgaccgtcttgggcagtccggagaccaggtcgcgccctcggatctcggtgtgctcgtccttcttcaggtcgaacgccgaaccgatggtgatcttgatctgttcggcggtccgctcaccgaggaggagcgaatactccttcttgatgtgctggatgatcgcgttgtccagctcgtcaccggcggtacggatcgactgggcggtgacgattccgccgagcgagatcacggcgacctcggtggtgccgccgccgatgtcgacgaccatgttcccggtggcctcgtggaccggcaggccggagccgatggccgccgccatgggctcctcgatgatgtgcacctggcgcgcgccggcctgcgtggacgcctcgatgacggcgcggcgctcgaccccggtgataccggagggcacacagacgacgacgcggggccgggccaggtagcgacgcttgtggatcttgaggatgaagtagcggagcatccgctcggtgatctcgaagtcggcgatcacgccgtccttcaggggccgcacggcaacgatgttgcccggcgtacgcccgatcatcttcttggcctcggagccgaccgccagaattccgccggtgttggtgttgatggccacgacggacggctcgttcaggacgatgccgcgccccctgacgtacaccagcgtgttggcagtcccgaggtcgatagccatgtcacggccgatgaacgacattgagttccccttgttccccatgaggatgcgtcgggccttcccaggtagcgaagatggcttgttctggtaggcgaggttggcgctgcgggcgtggaagcttccatcgtagtgccgtatgcacggacacagcgcgagggtccttcgccattgtgagcggaacgggtgcccgttctacccatggtgacgttacgtcggaaggatgcgttcccgcgatcccaaaccctatgccgaggggcgaccgaattacttcggtcgccccaggcgtacagcgctgtttggccgatcgggtcaggaaagtcccggaaagaaaagcttcagttctcgctctgcggactcctccgagtccgaggcgtggatgaggttctcgcgggtgatcgtgccgaagtcaccacggatggacccgggcgcggcggcgatcgggtcggtggggccggccagggcgcggacaccctcgatgacccgctcaccttcggccaccagggcgacgacggggccggactgcatgaactccatgagcggctcgtagaacgggcggccctggtgctcgccgtagtgctgctccagcgtctcgtggtccagcgtgcgcagctccagcgcggtgatccgccagtccgccttgcgctcgatgcggccgacgatctcgccgatcaggccacggcggaccgcgtcgggcttgagcaggacgagagtgcgctgagtcatgtacggctccttgcaaggccaggcatacgggtgcggtgagggcgagattacaggggttcggggacgggtctgcgcccgggttcacccagggtcaccttcgggccccggttttccggggctcgaaggtgcgagccgagcgtgtcgggcgggcccgacgatccgggcatccggacgagaggcccggctcagggcctcaggccgtggcctcttcggcttcctgccgggcggcccagccggccttggcctcgtcgatcttgcggccgtagtggatcgaggcccaccacaggccgccgaaggccaggcccaggacgaacatcatcgggaccacgaacccgctcagcaccagtgcgacctggagcgcccagcccagctggacgccgccgggccgggtgatcattccgcacagcagcacggagagggccatgccgatgccgcacaccgtccagaccacggccatggaggcgtcgtccagcttcatcgcgacgagaccggcgaagccgatcacgaagaactcaccgatcagcgtcgaggcgcagagcgtccgcatccttcttctcagccccttcccagcagcagccgggcttcgccgaccgtgatcacggatccggtcaccagcaccccggcgcccgcgtactcgtcatcctcctcggcgagcgtgatcgccgcctccagcgcgtcgtcgagccgcggctcgacctggacccggtcgtcaccgaagacctcgacggcgatcgcggccagttcgtccacgtccatcgcacgggcggtggagttctgcgtgacgacgatctcggcgaagatcggctcgaaggcctccagcagcccgcgaacgtccttgtccccgctcgtgccgaccacgccgatcagccgggagaagctgaacgcctcggagatgccgtccgccgccgccttggctcccgccgggttgtgcgcggcgtccagcacgacggtcgggctggagcgcacgacctccaggcggccgggcgagagcaccgaggcgaacgccttgcggatcgcgtcgatgtcgagggagcgggcctgctcggcgccgatgccgaagaacgcctcgacggcggagagcgccaccgcggcgttgtgcgcctggtgggccccgtacagcggaaggaagatgtccgtgtactcgccgcccagcccgcgcagcgtcagaagctgtccgccgaccgcgatctcgcgggaggtgacaccgaactccatgccctcgcgggccacggtggcgtcgacctcgacggccttcttgagcatcacctgtgcggcgtccaccggctgctgcgccaggatgaccgtggcgccctgcttgatgactccggccttctccccggcgatctcggcgggcgtggtgccgagccggtcggtgtggtccagcgagatgggggtgacgacggcgaccgtggagtcgatgacgttcgtggcgtcccaggtgccgcccatgccgacctcgacgaccgccacgtcgacgggcgcgtcggcgaaggccgcgtacgccatgccggtgaggacctcgaagaaggagagccggtagggctgctgggcgtcgaccatctcgacgtacggcttgatgtcctcgtacgtctcgatgaagcgctcgggctcgatcggggagccgtccaggctgatccgctcggtgatcgactggacgtgcggggaggtgtagcggccggtgcgcagctcgaaggcgttgagcagggcctcgatcatgcgggccgtactggtcttgccgttcgtaccggtgatgtggatggaggggtaggcgcgctgcggctcgccgaggacgtccatcagcgcggcgatgcgcgtgacggacggctccagcttggtctcgccccagcgtccggcgagctcctgctccaccgcgcgcagcgccttgtcggtctcgggatcggccgggcgggccggggccgcttcgccctggggctgacccgagtgggcgcgcagtgtgcggctcccggcctcgatcaccgccaggtcggggtcgcgctgggtcgcctcgtcgacgatctcctcgaaggtgtcgtcgggatcgggcgcgtcgtgccggtctgaagggcggggctcactcacgcgcccagtctacggatgggcgccgacatcgcgcgcagcgcccggcagactgtcgcccgacggtacggcgaagcccctgctcccccggtcggtcgggggtgcgggggcttcggtctcagaacatcagctctgcggaagagccgccagctgggcgccgatccgctcgatgtcggcctcggccttggagagccggccgcggatcttgtcgaccacgttgtccggggccttggccaggaaagcttcgttgccgagctttccggtggcctgggccttctccttctgcgcggcctccaggtccttcgtgaggcgcttgcgctcggccgccacgtcgatggtgccggacaggtccagggcgacggtggccccggcgaccgggagcgacgcggtggcctggaagccgtcgccggcgggctggagccgcaggagctgacggatggccgcctcgtgcggggcgagctccgtgccggtcagggtcagctcggccgggaccttctggccgggctggaggccctggtcgttgcggaagcggcggacctcggtgacgacctgctggaccagctcgatctccttctcggccgcgtcgtcgcggaagccggagtcgcccggccactcggcgatgacgatcgactcgcgcccggtgagcgcggtccacagcgcctccgtgacgaacgggacgatcgggtgcagcagccgcagcatcacgtcaaggacctcgccgaggacccggcccgagacctcggcctggcggccgcccgcgaagaacgtggtcttggacagctcgacgtaccagtcgaagacctcgtcccacgcgaagtggcgcagcgactcactgatcctggcgaactggaagtcgtcgtagaacgcgtcgacctccgcgaccgtcttgttcagacgggacaggatccagcggtcggtgacggacatctcctcgaccgggggcagctcgccctcgatcgtggcgccgttcatcagggcgaagcgggtggcgttccagatcttgttggagaacttcgccgaaccctggacccactcctcgccgatcgggacgtcggtgccggggttggcgccgcgcgcgagggtgaagcgcagggcgtcggagccgtacttgtccatccagtccagcgggttgacgacgttgccgaaggacttcgacatcttcttgccgtgctcgtcgcggaccatgccgtgcaggacgatggtggagaacggcgggacgccgtcgttgacgtacaggccgaacatcatcatccgggcgacccagaagaagaggatgtcgtagccggtgaccaggacggagttcggatagaacttcgcgaggctgtcggtccgttcgggccagccgagggtggagaacggccacaggccggaggagaaccaggtgtccaggacatcgctgtcctgggtccagccctcgccggtgggcgcctcgtcgtcgggtccgacgcagacgacctcgccgttcgggccgtaccagacggggatgcggtgtccccaccagagctggcgcgagatcgtccagtcgtggaggttgtcgacccagtcgaagtaccgcttctccatctcctgcgggtggatcttgacgctgccgtcgcggaccgcgtcgccggcggccttggcgagcggggcgaccttgacccaccactggagggagagacgcggctcgatcgtggtcttgcagcgcgagcagtgcccgacggagtggacgtagggccgcttctcggcgacgatccggccctcggcgcgcagtgcggcgacgatcgcggagcgggcctccagccggtccaggccctggaaggggccggggacggtgatgacggcacgctcgtccaggaccgtgaggaacggcaggtcgtggcgcttgccgatctcgaagtcgttcgggtcgtgcgcgggcgtcaccttgaccgcacccgtgccgaactccgggtcgacgtggtggtcggcgacgacggggatggtgcggtcggtcagcggcagcttgatctgcttgccgaccaggtgctggtagcgctcgtcgtcggggtggacggcgacggcggtgtcaccgagcatcgtctcggcgcgggtggtggcgacgacgatggtctcgtccccgtccccgtacgtcatggagacgagctcgccgtcgtcctcctggtactcgacctcgatgtcggagatggcggtgagacagcgggggcaccagttgatgatgcgctcggcgcggtagatcagaccgtcgtcgtacatctgcttgaagacggtctggacggccttggacaggccctcgtccatggtgaagcgctcacgggaccaggcgacgccctcgccgaggcggcgcatctggccggagatctggccgccggactcgttcttccactgccagacgcgctcgacgaaggcctcgcggcccaggtcgtggcgggacttgccctccttgccgagctcgcgctcgacgacgttctgggtggcgatgcccgcgtggtccatgcccggctggtacagcgcctcgaagccctgcatccgcttccggcggacgagcgcgtcgatcagggtgtgctcgaaggcgtggcccaggtggagggacccggtgacgttcggcggcgggatgacgatgctgtacggcggcttgtcgctgtgctcgtcggcttcgaagtacccgcgctccacccagcgctcgtacaacttcccctctacgtcggccggcgcgtactgggtcggcagttcggggttgctggcgcttggctgctgagtgttctcggtcacgggagacagtttagggccgtcacaggtctgcactgaaacgggttagttcagtaacggtgtccgacccgatcccccatgtcagggcggcttccgtcaggatgttcgcaacgcataaggaattctggaggggacaccgcaatgagctacaaccagccgggcccgtacggcgggcagccgccgcagggccagcccggaccgtacggacagcagccgggcccgtacggagccccgccgccccagggccccccgcagggtcagcccggctacggctacccgcagcagcagccgatgccgcagtaccagcaggctccggcgcagcacgcgccgatgcagcccgcccaactgcagcacgcgcccgcgccgtacatcccgcagcagccctcggcggtccgcggttatccgcagcagccccagccgccgcgccccgcgcccgccaccgggtacgagtcgatgcgcccggcctcgccgcggcccgttccggcgcagtcgccgtacgaggacccgtacaaccgcccgtaccagagccgggggtactgaaccgcgactccgtgcgacgaggtacgccgggggacgcaccgggcatcagccgcatccggggcatacgggtgccaatgatgcccagaagaccgcgcgtacggggtcagggggtgctggcaggatggacgcatgagctttcccgtgctccgttccgcccacgtctatccggtcaagtcgcttgccgcccgcgcctgcgacacggtcgccgtcgagccatggggacccgacggcgaccgccgctggatgctggtcgacaaggcgtccaaggccgtcacacagcgtcagcagccgtccatggcgcggatcacggccgaaccgctgccgggcggcggcgtgctcctgtccgcgccgggctttccgtccctgcgcgtcgaggggccggaatccggacgtctgctcaccgtggagctgcaccgggacaccgtggtgctggcggaggcgcccggcgacgcccatgactggctgagcgcggtcctcggtgcggaggtccggctcgtgcatctcgacgagccggacctccgcacc

SEQ ID NO: 3182 - DNA, 6860 bp, Unknown
  Kingdom: Bacteria, Phylum: Actinobacteria, Class: Actinobacteria, Order: Streptomycetales, Family: Streptomycetaceae, Genus: Streptomyces
gcgccgagaggcaggagccgttcggcgcggtgagcgtgcggctgggcggcagacgccggcttctcctggaactggaggccggcgcggacggccgggggacgcctgtcgtgcgggtggcggaggcggccccggacccgggtgcgtccgcaccaccggtgctgccggacgcggccacctgggtgctgcccgacctcgacctgctccgtaccggggcgatcgaggccggtcagctgcacccgctggtcgcgcgggccctcctgccggatatgccgccgcccgctccggcatcgcatcgtccgggtggcggcgaccgggcaggagcgtctcgcctcgtggcatgccggggagagcaacaccggatcggcctggtcgacggggtcctcgccccgctggaccacgatccggccgaggtccgccgcgaagaactgctggtcgccctgaccggcacgccgctgccctgcctccaggccatcgacgaggcgcaccggcggccggactgcctcaccggtgtgcgagaacgtctcgatcacggggacatcgccggtgctctggccgtcgtcgaggggctgctcggtcctggagcagtgctgcgcgacggtcctctgcgggacgaactggaagccgccactcaacggcggatcacctacggactgttccgggccgacctgctcggtcccggccccatccgccgccgctccgacccgcgccgacccgtcgacccccgtcctccccgggcccggcgaccgcgccacgcagtcgtccgctgacctcggggccgccgggctgtcggtcaccgcaccgcgaccgcccgcgcccacctctccccgtcaccttcgtactcacccccgcacattcgccctctcacatacctcaggtgatcacccatgctcacgaacaccccgtccgttgcgcccgcacccttgtccacggtctccgctcccgtgtccacggactccgctcccgtctcccaactggtcgtcgccgacgcgctgatgagcctgctccgcgacaccaccaccgagccgcgtcccgacacccaactggaggcgctgaccctggcggtctccgccgacctgcccgtgctgctctggggagagccggggatcggcaagaccgcggccctcacccagctcgccgcctccctggacctgccgctcaccacggtcatcgccagcgtgcacgagccgtccgacttctccgggctgcccatcgtcggcgacgaccccgctgaacagggagtgccgatggccccgccggactgggccgttcgcctcgtacgggcaggcaaggggctgctgttcctcgacgaactctccaccgcacctcccgccgtgcaggccgcactcctccgcctcgtcctggaacggcggatcggagcgctgcaactcccgcccggcgtgaggatcgtggccgccgccaacccacgctcctccgcggcggacggctgggagctgagtccgccgctcgccaaccgcttcgtccacctccagtggacccacgaccacgaggtcgtcgtacgcggactggccggtacctggccccgcgcgacactgccccgcctcggccccgaaaagctgcccgaagcggtggacttcgcccggcgcgcggtgtgcggactcctctccgcccggcccacgctcgtccaccggctgcccaccacggagacacggcggggcggcccgtggccctcgccgcgcagctgggacatgacgctgaacctgatcgccttcgcgaccgccgccggatcctcccgggacgtgctgtccctgctggtcaggggcacggtcggggacggcgcgggtcttgagctgctggcgagcctggaccggatggaccttccggaccccgaggacctcctcgccgacccggcgggcgccgtcctgcccgagcgcggcgatctccggcaggccgcgctggacggggtcgtcgcggcggtccgtacccgcccggaccgggcccgttgggacgccgcctgggcgctgctcgtccgggcgctggaggccggagccccggatctggtggtcgtcccggcgacgaccctcgcctcgctgcgccaggaggactgggacgtgccggcctccatcgaacagctggcaggcgtcgtgtccctgtccgggcgcgcggaccgggcggcggcccgggtcacggcgaaggcgaaggcgacggcgggccgatgacgacgacggacgcgccgagcgcgctcgacctggacaaactcttcgccgcccgcctgcaggcagccagggtccgtccctatctggcgaccgcgctgttcgccctgcacaccgtggagtcacggcaggtcccgaccatggccgtcgaccggcactggcggtgctacgtctcgccgtccttcgtggcccgtacccccgtcgaggagctggccggggtctgggtccacgaggtgtcgcacctgctgcgcgaccaccacggccgcagcgaccgggtcgcccggcagcgcgggctgaccgggcccggcgaccggctgcggatgaacatcgccgccgactgcgagatcaacgacgacgtgtacggcgacggcctggcccggccgaagggtgctgtctacccggcgacgctgcaccttcggcccggcgaactcatggaggactacctgtaccagttccgcctcggctcccgcacccagaacctcgcctggctggactgcggaagcggcgccgacggactggaaagagcatgggagctggggccggacggcgcgcacgggctcagcgcgcacgaacaggacgcggtccgcttccgggtggcgcagggcatcaccggacggccggggaacgcctcgaagggatggaaacggtgggcggaggaggcgttccatccgccccagccctggcgggatctgctgggagccgccgtacgttcagccgcctcgggtcccggcgcgggggaggactacacctacgggcggccgtcacgccgctccaccggactgcccggcgtcgtcctgccgagcctgcgccgcagaccgccccgggtctccgtcgtcatcgacacctccggttcggtcagcgacgccgaactgggcagcgccctcctggaagtcgccgccatctcccgtgcggtgggcggccgccgcgacctggtcaccgtcctcgcgtgcgacgcggcgacccgggtcgtccacccgttgtgccaggcggagggcatcccgctggtgggcggtggcggcacggacctgcgtacgggcttcgccaaggcgctgcgggggcatccccgtcccgacgccatcgtgatcctgaccgatgggcagaccccctggcccgccgcgcaaccggcgtgccggacggtcgtcggcctgttcccgagggaccacaggcgccgctcctgggacgaggacaaccccgactacgtccctcgccgaccgccggcatgggcgcgggtggtggagatcgggtagccggccggcagccctggggaaggtgtgagtccgcccgagcccgatcaccccgcctccaggacctccaccagctccgccagcgccccggccagcgtgtggagacccggccccgccgggccgcccggctcgctcatgtacgtgtcgcggcggatctcgatcatcagcgcggtgacccggcggtccgttccgtagtgctgaagagggacgtacgtacccgcgaacggggtgtcgcgctcgatgccgccgcgaccgacgcggcccccgaacgcagcctccgccgccgcgaggagctccggcggggtgtggaacgggtcggtccccaggcagaccggcggccgggggccggtgccgtgcagctcgtaggggaggggtgcggccgggtacgagtggacgtcgatgatcaccgcgcgaccggccgcggcgagtcgcgactcgaccgccgccgccatcgcgtcggcgtacgggtggaagtacgtctccagcaggggacccgggtccgccgactgggggcggagaggttcgcggtgggtggtgcgggtgtagacggcgcccatgccgacggcgagcatctcctcccgctcgtccgggaagcgttccgggtcgacgaccagccgggagaggttgttgacgaagcgccatggggcggccgcggcgatctccgtggccacggccgccagttcggcggtatgggcgtcggtgatgtggtcgagttcgcgctccagggtggcgtcgtccagggtgatcccttcgcgcacctgccgggggatgcggcgggacccgtgcggcacgtgaaggaggaccggtgagccggcagctcccgggaggagcgtgaacggctgcggatcgcgatacatgggtactccccttcggtgtggttcgttcgctcccgcaccagcttcccggaccgtgcccggaaggcagcggacggccgcccggttctcctggcagcccgtcagcgcgcgggcccggcggctaccacgtgagcagtggcgcttcgccgacgcgtacgactgcttcgacgaggcgcacgccgcgtccacctggccgcgcaggggtgccccggcgtcgagtcggggagcggtccggagaggtcggcgatgtgcgcatcgggatcgaggctgtccacaggcgcgggccccgaggagtacgggggtgccgaggcgcacaagcgccggccacgatatatcggcaggagccggggtgacgcgccgtcccctccggcgtcgggcggaggggacggcgacgtgctggttcggctactgggcggagccgatcaccgggtagtggtccgagaggttcgtgtacgtgtagttcttgccccagctggagaccgtccagggggcgctctgctccttgatcacgtcgttcttccagcccgacggcttggcgtggcccgcgcggtgcaggacgtggtccaggtcctcgcgcgggtcgtcggggtagcgctcggaggctatggagttgtcgcgggtgtcgaaggagtacgggtgacccgtccgggactccggtgcgctcaggccggcgtcggagaggaacgaggcgtactccgccgagtgcccgtcgacgttgaagtcgcccgccacgacgacctgttccgaggccgggatgttcttcccgtcgaggaacgcgtccatctgcttgaactgccggctgcgcatctgcgcggcctcgcccgccgagcagccggggtcggtcgactgggcgtgggtgccgacgacgtggacccgggcgccattgacgttcagcaccgtgtaggcgaagcccttgttcgagaaccagtcgccgccgcacgcgtccttgaacacgaactgctccttgcgcacgatcggccacttgctcaggatcgtgacgccgccgtcctccggtgtcgccgcggcgtacgagccgcccgtcgcgtcccagccgctcttgctccggccgaccaccggggtctggtacgggtactgggacgcggagttccgcagcagggcgtcggaggccccgttgtcgaaggcctcctggatcaccacgacgtcattgccctgaaagaacgacgtcttcgggatctcggccgctcggtggtcctggccccagttcgggtacagggtcttgctgaagatgaacgcgttgtacgagagcacccgcagtgacggggtctcggcagcggccgcctgcggcgcgttcacggcgagggtgacggtggcgagggtggcggacagggccacgccggtcaggcggcggaacgcggtgttcggcacgaggtctcctgcggtcgagtggggggcgtaccgggcgacccctatccaagcagcgggagttacccacgggtagacatcgggtggcacgagtctgtccggccagctgccatccgtcgccgaccggtcgcactgccgaccgccgcggtggcgggccatagtctcgaccgtgacatcggtacccgccgcgtccaacggaacaggggaatcccatgcccgcttacgtcatcgtcaacgtcgatgtgctggacgacgaggcgggcctggcctacgcgtcggtggcccggaagtccgtcctcgaccacggcggccgttacctgatcgcgggctccacgcccgagcccgtcgaaggcgtctggaactcctcccgtgtcgtggtcatcgagtttcccgacatggaccggatccaggagtggtacggctcccccgagtaccgaagggcccgggagatccgtgaaggcaaggtcagggtggggatgctgttcgtcgagggtgtgcctcccgagggattctccgtcccgggccgggtctcctgacccgcggggttgccacggctccgggtgggccgtcgctcgcgggattcccctggcggcgaccgctttcagccgagggcgccgtacacgatgaggttgtcgaccggatggccctcggcgtcgaactccccgtcgcaggtgatgagccgcagggtgctgtccttcgtcgggccgtagaccttctcggtggggaaggccttcttgccgaccgtttccttgcccgtgaccgtgaagcgcagggtcttgcccgctgcgtcgcggaccagcacctcggcgcctctgcggatcttcttgaggtcgtggaaaacggctcggccgaagcgggtgtcgttgtggccgatcagtacggcgggccccggcgccccgggcgggacctccaccgtgccgtccgcgttgagccccagctccatgagggcgctccgcacgccgatcgaggggatggagacgtgggcgggagccggctgatcctgctcgtcggcgttggatgatcccgtcgatccgctcgatccggatgccgccgcgcccgctgcggaagaggcggaggcggaaggcgcgcccgacgcggcgggggacggcacggagggctcggcggacgagcaaccggccagtgcgacgcaggccgcgacggcggtcaacagggcggtggtccgccggaaacggtggggcgtacgggat

SEQ ID NO: 3183 - DNA, 7220 bp, Unknown
  Kingdom: Bacteria, Phylum: Actinobacteria, Class: Actinobacteria, Order: Streptomycetales, Family: Streptomycetaceae, Genus: Streptomyces
gtctgggggcgcggcagcggcgggcgaatctggccggcgcgctggagctcacggcggggggagggcgactcctccggcacgagctcctccagcacggacttctccggctcggcggggtgatcctggtcgacgatctgttgacgacaggatcgacgctggcggaggcggcgcgagccgtcggcgaggcgggcggcgtcggtcgggagtccttcgcgcacggagtgtgccgggcggcggtcgtcgcagcctctcccaccgccttcgaaataaaccggaactgaccgagaacccgcatcgttgcaggtaatgagagggcaataccccctgaacggaggtacgtgccagtagcgggtgccgagacccaggtgtgcaggctatgttcggttgtgaggaacggtgaatgccggacctcgatgaatgcaccatcaggtttcgggcaggtaactcaccggtaggagaagcacgcaagtcggtggggttgcgacccttccgacgggggaggaggaggcgaaagccaccgagtccgaggccctggtgatctccggggcctggtgcaaaagggagatgctccgccgctgagcggagcgatccgggaacggagttctgcgtggacatcgtcgtcaagggccgcaagaccgaggtgcccgagcggttccgcaagcacgtggccgagaagctgaagctggacaagatccagaagttcgacggcaaggtgatcagcctcgacgtcgaggtgtccaaggagccgaatccccgtcaggccgaccgttccgaccgagtggagatcacgctccgctcccggggaccggtcatccgggcggaagcggcggcgggcgacccttacgcagcgctcgacctggccaccggaaagctggaggcccggctgcgcaagcagcacgacaagcgctacagccgccgtggcaacggccgtctgtctgctgccgaggtcggggacgtggtccccggcgtcgcttcgttcgacgaggacggtgagctggtcggcgaccagccgtcagagcccgtccccaccacgaagatcggctcgctcgaagtacagggcgaagggccgctcgtgatgcgcgagaagacccacaccgccgcaccgatgtcgctcgaccaggcgctctacgagatggaactggtcggccacgacttctacttgttcgtcgactccgagacgaaggagcccagcgtcgtctaccggcgacacgcctacgactacggcgtcatccacctgaggaccgacccgctcgccgcggacgaagcaggcggcgcgggcggtgcgctcggcggctgagaccgcgtcgtcgggtgcccccggggcgttttcgcgccaccgggggcacccgcgcacgggcacaggaccactgtgccgggggccgggcatggaatcatggcggcccgagccaatcggtgttccgcgaagtgccgttggcgaacgaccgacacttcaggccgtggccttcagggggaggaacgatggcggacaccttcggtcccgtgcgcgatgcgaatgactccgacgccgccggtgcgtgcaccggcaccgacgcgagcggcgcttcgcgcaaggagcccatcagggtcctcgtggtcgatgaccacgcgctcttccgcagaggtctggagatcgtcctcgcccaggaggaggacatccaggtcgtcggtgaggccggggacggctccgaggcggtcgacaaggccgccgacctgctgcccgacatcgtccttatggatgtccggatgcccaagcgcggcggcatcgaggcctgtaccgccatcaaggaagtggcccccagcgcgaagatcatcatgctgacgatcagcgacgaggaagccgacctctacgaggcgatcaaggcgggcgcgaccggatatctcctcaaggagatctccaccgacgaggtcgccacggccattcgcgcggtagccgacgggcagtcacagatcagcccctccatggcctccaagctgctcaccgagttcaaatcgatgatccagcgcaccgacgagcgccggctcgttcccgcgccccggctcaccgaacgcgagctggaagtgctgaaactcgtggcgacgggcatgaacaaccgggatatcgccaaggagttgttcatttccgagaacacggtgaagaaccacgtccgcaatatcctggagaaactgcagctgcactcccggatggaagccgtggtctacgcgatgcgggagaagatcctggagatcaggtagcggccggccatggtcagcggtgggcgcgctggagcgcgtggccgatctccgtcctgagcggctcgcgcagctccggggcgtccacccggtccacccggatgtccgtgcagcccacccaggccgccgcctccaccagggcctcggccatcggcgacaccgccttcgggccggtcagcgacgcctgccgggcgaccagcgtggtgccctcgcgtgcggggtcgacccggccctggagcttcccgcccgacagcaacggcatcgcgaagtagccgtggatccgcttctgcttgggcacgtaggcctccagccgatgcgtgaagtcgaagatccgctccgtgcgcgcccgctcccagatcagggagtcgaacggcgacaacagcgtcgtacggtggcgtccgcgcggctccttggcgagggcctccgggtccgcccaggcgggcttcgcccagccctccacagcgaccgggaccagccccgagtccgccaccacggcgtcgaactcctcgcccttcagccggtggtagtccgcgatgtcgctgcgggtgccgactcccagggacgtgcccgccagcgccaccagccgccgtcggcactcggcgtcgctcaaatcgtcgtgcagcaacgcatccggaatggcccgctcggccaggtcgtagacccgcttccagccgcgccgctcggtgcacaccacctctccgtacatcagggcccgctcgacggcgaccttggacgccgaccagtcccaccactcgccgccgttcttcgcgcctcccagctcggtcgccgtcagcgggccctcgtcgcgcagctgcttgatcacggtgtcgtacgcaccgtcgggcaggtcgtggccccagtgcgggcgggagcggtaggcgcggcggcggaacgcgaagtgcggccactcctcgacgggcaggatgcacgccgcgtgcgaccagtactcgaaggtccggccgcccgaccagtaggcgtcctccaccgtccggcggctcaccgggcccagccgggcgtaggggatcagctcgtgcgagcgggccagcaccgagatcgtgtccagctggaccgcgccgaggtgccgcagcactcccggcacccctgcccggcggtccggagcccccaggaagccctgggcgcgcagcgcgatgcggcgggcctggtcggcggagagttcgactgcgggagggggcacaggcgtcatacgtggaaccctagacggcgccactgacagtccggccccggatgccttacgcggagcacgtgggtcaccgtccgggatccggggcgccgccgggcctcggggcctgtcgttcggggacgtacggatgggtgcccgcgagccccaggtcggacgggagcagggccgccgtccaggcgtcgcgacgcacccccttgttgagcagcccggaccgctggtcgccctccagccggaaccccgcccgcagggcgacggcccgcgaggccaggttgccgatctcggcccgccactccagccggtccgccccgagggaggagaaggcccagcgggcggagccgagcacggcctcggtgacgtatccgcggccgcggtgctccttggcgctccagtagccgacctcgtacgttcccggccggctgcggcggtcgatgccgagcgcaccgacgagcgccccggtctcccgcaggaccagggcgaagccgtaggcggagtcgtcctgccaggccgcagggcagagcttcgtggtgaagacctccgcgtcggtgaggcggtacggggaagggatcaccgtccagcgctggatgtccgggtcctggcaggcggcgtgcaccgggtgggtgtcctgcgggccgaagggccgcagcaacagtcgttccgtggtgagagtgatcggctccatgggccgattctcgtgagcccgcttcctcgatgcgagcacttttggggcttcccggcaccttccgtgcgtttggaccgttgtcctataagggtgcggcgaggtccacgcgacggcagccctcccgacgcggtggtgtcctcgcttacgatggccgttgcggtggggcccacctgccgtgcccgcgccagagtccattacacgacccagtgccaggcccgaccggcaaggagaccagcctcagtgtccgtcttcaacaagctcatgcgtgcaggcgaaggcaagatcctgcgcaaactgcaccgcatcgcggaccaggtcagctccatcgaagaggacttcgtcaacctctccgacgccgagctgcgggcgctcaccgacgagtacaaggaacggtacgcggacggcgagagcctggacgacctgcttcccgaagcgttcgccacggtccgtgaggccgcgaagcgcgtcctcggacagcgtcactacgacgtacagatgatgggcggagccgccctgcacctcggatatgtggccgagatgaagaccggtgagggcaagaccctcgtcggcactctgcccacgtatctgaacgcgctctccggcaagggcgtgcacctgatcacggtcaacgactatctcgccgagcgtgactccgagatgatgggccgggtccacaagttcctcggtctgagcgtcggctgcatcgtcgccaacatgacgccggcccagcgccgcgagcagtacgcctgtgacatcacgtacggcacgaacaacgagttcggcttcgactacctccgcgacaacatggcgtggtccaaggacgagctcgtccagcgcggccacaacttcgcggtggtcgacgaggtcgactcgatcctcgtcgacgaggcccgtacgccgctgatcatctccggcccggccgaccaggccaccaagtggtacggcgacttcgccaagctggtcacgcgcctcaccaagggtgaggcgggcaaccagctcaagggcatcgaggagaccggcgactacgaggtcgacgagaagaagcggaccgtggccatccacgaggccggtgtcgccaaggtcgaggactggctcggcatcgacaacctctacgagtcggtgaacaccccgctcgtcggttatctgaacaacgccatcaaggccaaggaactgttcaagaaggacaaggactacgtcgtcatcgacggcgaagtcatgatcgtcgacgagcacaccggccgtatcctcgccggccgccgctacaacgagggcatgcaccaggcgatcgaggcgaaggaaggggtggacatcaaggacgagaaccagaccctcgccacgatcaccctgcagaacttcttccgcctctacgacaagctctccggcatgaccggtacggcgatgaccgaggccgccgagttccaccagatctacaagctcggcgtcgtgccgatcccgacgaaccggccgatggtccgcgccgaccagtcggacctgatctaccgcaccgaggtcgccaagttcgccgcggtcgtcgacgacatcgccgagaagcacgagaagggccagccgatcctggtcggcaccacctcggtcgagaagtcggagtacctctcgcagcagctctccaagcgcggtgtccagcacgaggtcctcaacgccaagcagcacgaccgggaggcgacgatcgtcgcccaggcgggccgcaagggcgccgtcaccgtcgcgacgaacatggccggccgaggcaccgacatcaagctcggcggcaacccggacgacctcgccgaggcggagctgcgccagcgcggcctcgacccggtggagaacgtcgaggagtgggcggccgcgctgcccgccgcgctggagcaggccgaggaggccgtgaaggcggagttcgaagaggtcaaggagctcggcgggctctacgtcctcggtaccgagcgccatgagtcgcgccgtatcgacaaccagctgcgcggtcgttccggccgtcagggcgacccgggcgagtcccgtttctacctgtccctgggcgacgacctgatgcgcctgttcaaggcccagatggtcgagcgcgtcatgtcgatggcgaacgttccggacgacgtcccgatcgagaacaagatggtcacccgtgccatcgcctccgcccagtcgcaggtcgagcagcagaacttcgagacgcgtaagaacgtcctgaagtacgacgaggtgctcaaccggcagcgcgaggtcatctacggtgagcgccgccgcgtcctggagggcgagaacctccaggaccagatccggcacttcatggacgacacgatcgacgactacatccggcaggagaccgccgagggcttcgccgaggagtgggacctggaccggctgtggggcgccttcaagcagctctacccggtgaaggtcaccgtcgaggagctggaggaggcggccggggacctggcgggcgtcaccgccgagttcatcgccgagtcggtcaagaacgacatccacgagcagtacgaggagcgcgagaacacgctcggctccgacatcatgcgtgagctggagcgacgcgtggtcctctcggtgctcgaccgcaagtggcgcgagcacctctacgagatggactacctccaggagggcatcggcctgcgggccatggcgcagaaggacccgctggtcgagtaccagcgcgagggcttcgacatgttcaacgccatgatggagggcatcaaggaggagtccgtcggctacctgttcaacctggaggtccaggtcgagcagcaggtcgaggaggttccggtgcaggacggcgccgagcgcacctcgctggagaaggagagcgccgctgccgccccgcagatccgcgccaagggcctggaggccccgcagcggccggaccggctccacttctccgctcccacggtggacggggagggcggtgtcgtcgagggtgacttcgccaacgacgacgacgcgcggtccggttcctcggacggcatgacgcgtgcggagcgccgcaaggcccagaagagcggcggcggcggtcgccgtcgcaagaagtagcaccagcggtaccgcggcaggggccggacaccagggagtgtccggcccctgccgcgg

SEQ ID NO: 3184 - DNA, 7625 bp, Unknown
  Kingdom: Bacteria, Phylum: Actinobacteria, Class: Actinobacteria, Order: Streptomycetales, Family: Streptomycetaceae, Genus: Streptomyces
  misc_feature (4473)..(4474): n is a, c, g, or t
gtcgtcgcctcgaccgtgccgggggcggccggtccgtcctgccctcggtgctggggggcgccgtggccgtcggcctcggacgcgggggtggggttcacggcgttcttccttgtggggattccgggttcaggtggtcggcccggcggtggtccgacggtgcggggagcgtgtcgcggctgccagcgcgtcggcgagacggtcgacgacggcactcgcctgctcgtcggtgagggtgaggggcggcaggaggcggaccacggcgtcgtggcggccgcccagttcgacgatgaggccgcgccgcagacattcctgctggacggcgagggcgagggccgggtcgggcggcggggccgggtggtcgtcgccggcttcggcgggcaggggcgcgcgctcgggatccaccagctccatgccgatcatcagtccccgcccccgtacgtcaccgattcccgggtggtgtgcccgcagctccgtcagacgggcgagcagccgggcccccaggaccgccgcgcggtccgccagtcggttctccctgacgtacgcgagcgtggccgcgcccgccgccatggcgagctggttgccacgaaacgtacccgcgtgggcgcccggctgccaaagatccagttcagcgcggtagacgatcacggcgaggggcagcgagccgccgatcgccttggagaggaccatgacgtcggggacgatgccgctgtgctcgacggcccagaaggcgccggtcctgccgaccccggtctgcacctcgtcggcgatgagggggatggagcggtcctcggtgatccggcgcatgcggcgcagccaggagtcgggggcggggttgacgccgccctcgccctggaccggctccacgatcattccggcgggggccgggaccccgcccttgcggtcgtccagcaggtgttcggtccagcgggcggcgagtgcggcaccgcgctctccgcccgtgccgaacgggcagcggtagtcctgcgggaagggcagccgggtcacccgtacgtcgggggcgccgccggatgcctccagggccccggcggtcatgccgtggtaggcgccggtgaaggtcagcaggccggtgcgcccggtcgcggcgcgaaccagtttgaacgcggcctcgacggcgtccgtcccggcgggtccgcagaactggatacgggcgttgtcggcgaactccctcggcagggtggcgaacagctcggtggtgaaggtgtccttgaccggggtggcgaggtccagcacgtgcaggggtgcgccggagtcgatgaccttccggatggcttcgagcacgacggggtggttgtgcccgagcgccagcgtgccggcgccggacaggcagtcgaggtagcggcgtccgtccgcgccctcgatggtgagcccgcgggcgcgcaccgggacgatcggcagggaccgcgcgtaggtgcgggccgccgattcgcgcaggttctggcgacggagaatgccctcgtgtgcggagggtggcgccaccggagcgggttcagtcacggacacggctcttgatcctcctgcggtaacagttgcgttgcacgtcggtacgttttcgcgcggacgcaccgagggcgtgaacgctgtcctggtgtcccccgtacgtaccaacgacgccgtccgcgatggatcacgggtatatcggaacatcctcgcggcgacggaaccgcggacctgccgcgtaccgtcaccatcggcaccggcatagtgggggccgcacagggggcgcggaagcacctgctccggcgtccgacgtgtccgcgatacagcacgagtaccgagtgacgaagtcccagggggatcacgagatgcgacccattcgcccgaccgataccgcacggcgcgggaggcgcgcacggcgcatgccctccaccgcgctcgccgcgaccgccgtcgccgccgtgctggcgctcaccgccaccgcgtgcggtccggaggaggacagcgcgggcggtacgcccagcgcctcggccgaccagtcgtccgacggcaaggtcgccattccggacgacctcaaggaccggctcaaggagcacggtatcgaccccgacaagtggcgggacggggagtggaagaactgggacaaggacaagtggctgcgtgaggccaaggacttcgtcaacccgatcatcgacggtctgtgggacccggaccggatgcgggaggccgacaagcccccggagatcccggtcgacaacgacatctccggcgacgacggcgtgacggacccgacaccggccccggtccaggccgccggtgtcgccacgccgtaccacgacaacgccccggagtccggaaagctgctcttcgacggcccgcaggggtcgatggtctgttccgcgaccgtggtgaaggacccggcgaaccccggcaagtccaacatggtgtggaccgccgggcactgtgtgcacgcgggcaagaagggcggctggtaccgcaacatcgccttcgtcccggcgtacaacaacgacggcctgtcgctcgccgagctggagaccgcgcccaaggagaagatcgctccctacggcgtgtggtggggcaagtgggcccagacctccgagcagtggatcgcccagggcgcggccgtcggcggccagggcgccccgtacgacttcgcggtgctgcatgtgacgccggagaagggcgcgggcggcaagtcgctggaggagacggtcggttcggcgctgccggtcgagttcaacgctcccgccgtgccggagatcgccggcatgacggccacgggttacccggccgcgccgccgttcgacggtcagaagctgctccagtgcaaggacaagccgggccggctctccgtcttccaggaccagcccacgatgtaccgcgtcggctgcacgatgaccggcggttcctccggcggcggctgggtcgcggcggggcaggacggcaagcccgccctggtctcgaacacctcgatcggcccggtcaccgcgggctggctggccggaccccggctcggcaaggaggccgagggcatctaccgcgcggtgagcgagaagtacgcgggccagtaggtcccggccttcgacgacggatcctccgcacgagagctcgatcgcggcccccggtacggcagtcgccggccgggggccgcgctcggtccccggcggggccccggagtcatgcatgacaagcgcatgacagaatgcacgaccgcgcacgcgtaccaccgcacgtccgcgcaggcgcacaaccgcacgactcaggtgttcagggggatctcttccatgcgatcgatacgtccgctgctggccgctaccggcctcgtcgcggcgctcacactgacggccacggcctgcggaccggacgaggacgccgccgccaagccgtcggccaccggtccggcggcggagaaggaccccgccgccggtcttcccggtgatctgggcgacgccctggagaagcacggggtggacccggagaagtggaaggacggggagtggaagaactgggacaaggacaagtggctccgcaaggccgaggacttcgtcaacccggtgatcgacggcctgtggaagccggaccggatggcctctgccgacgaacccgccaagacgatggcggccggtgacctctccgccgggcaggacgtcagcgatccggagccggccccggtgcccgcgaagccggagaagctgccctaccaccggcacgccgccccggtcggcaaggtcttcttcgactctcccgagggctccatggtctgctcgggcacggtcgtgaaggacccgaagaaccccgggcggtcgaacctcgtctggaccgccggacactgtgtgcacgcgggcgcgggcggcggctggtaccgcaacatcgtcttcgtgccctcgtacaacgaccagggcaagaacgcggcgcagctgcggaccgcgcagccgcaggagatcgccccctacggcacgtactgggccgactgggccgcctcctccggcgaatggatctccggcggcggcccgacgggcggagcgggcgcgccgtacgactacgcgatcctgcacgtgaagcccgagagcggcacgaagtccctggaggagacggtgggcaacgcgctgccggtctccttcgacgctccggagatccagcagatcagcggcatgggcgcctggggctacccggcaggcccgccgtacgacggcctgctgatgcaccagtgcgtcgaccggcccggacggctctcgatcgccccggggaccccgaccatgtaccggatcggctgcacgatgaccggcggttcctccggcggcggctggttcgtcgccgggccggacgggaagtcgatgctggtgtccaacacctcgatcggcccggtcacttcgggctggctggccggaccccggctcgatgacgacgcccggcgcaccttcacgatgatgagcgacaggttcgccggccggtagctccggccgccgaccgcacgccgaaggcccggcccttcccaannttgggaagggccgggccttccggttgtcgtgcggtcccgcggccgtcagtgcgcggcggggacgaaggtcccgagctccgcggccagctcctcgtggacctgggccttgagcagggtgccctcggcggtgtgctcctcggagagcacctcgccctcggcgtgcacccgggagaccagagccccctggatgtacggcacgagcacctcgatctcgacggacggccggggcagctcggcgtcgatgagcgcgagcagctcgtcgattccggcgccggtcctggccgagaccgtgatggcgtacttctcgttgcgcagcagccgctggaggaccagggggtccgccgcgtccgccttgttgatcacgacgatctcgcgtacgtccaccgcgccgacgtcccggatcacctcgcgcaccgcggcgagctgctcctccggcaccgggtgggagccgtccaccacgtggaggatgagatcggactcgccgacctcctccatggtggagcggaacgcctcgacgaggtggtgcggcaggtgccggacgaacccgacggtgtcggccagggtgtagatgcggccgctcggcgtctcggcccggcggacggtcgggtccagggtggcgaacagggagttctccaccaggacaccggccccggtcaggcggttgagcagcgaggacttgcccgcgttggtgtatccggcgatggcgacggaaggcaccttgttgcgcttgcgctcctgccgcttgatctcgcggccggtcttcatctccgcgatctcccggcgcatcttcgccatcttctcgcggatccgtcgccggtccgtctcgatcttggtctcaccgggaccacgggtggccatgccgccaccgccgctggaaccgccgccgcccatctgacgggagagcgactgaccccagccgcgcagccgcggcagcatgtactgcatctgggccagcgagacctgcgccttgccctcgcgggacttggcgtgctgggcgaagatgtcgaggatcagggcggtccggtcgaccaccttcaccttgacgacgtcttccaggtggatcagctggccggggctcagctcaccgtcgcagacgacggtgtcggcgccggattcgagcaccatgtcacgcagctccagggccttgcccgagccgatgtaggtggccgggtccggcttgtcgcgccgctggtacaccgcgtcgagcacctgtgcgcccgccgtctcggcgagtgcggcgagctccgcgagggagatctccgcgtcgtgcaccgtccccgaggtccagacgcccaccagcaccacgcgctccaggcgcagctggcggtactcgacctcggtgacgtcctcgagctccgtggagagacccgccacgcgtcgcagcgcggcacgctcggagcggtcgagctgatcgccgtcccgcgctccgtcgatctcctggctccaggcgacgtcctcttccatcagggcgtcggcccgaaggctctcggtgaggctctcggtggtgttctccgtggcgctctgcgcgtcctgcgcgtcctggggaagggaagaagaggaggtcattggatccttacgtcgatagaagtctttacgtcagtcacaacgtgtgatcttcccggatgattccctgccgggacctccggtgcggtccgccgcgccgacgcgtcgatagtggcacggccccaccgggcccgtcacgcgggtttcgcgctggtccagtcggggtggccgggcatcggcggggtcttcttcccgtacagccagccgtcgaagaaggcggacagatcccgtcccgcgatgccggacgccagccgcgtgaagtccgcggtggtcgccgtggagtcccggtgcacccggacccaggtgcgctccagccggtcgaaggcggcctcgccgatctcctggcgcagggcgtacagcaccagagcgctgccgtcgtacatgaccggccggaacaggctgagcttctgccccggggccgggccgtccgggtgtgccggagggccgccgtccgcgcgccagccgtcggagagcttgtacgcctcccgcatccgccgctccagggtcccgccgccgttctcctcggcgtatcgggcctcgtaccaactggcgtgtccttcgttgagccacaggtcggaccagctcgcgggagagacgctgtcgccgaaccactggtgggccagctcgtggatcatcaccgattcgacgtaccactccgggtagccgggctccgtgaagaaggacttcccgaacagcgacagcgtctgggtctccagggcgaagccgatggggctgtcggcgacgagcacaccgtacgtctcgaaggggtagcggccgacctgctcctccatccaggtcagctgggccggggtcttctccagccagggctccagcctcttgcggtcggcggccgggacgacgtcgcgtaccggcagtccgtgcgggccggtgcggtgcaggacggcggagctgccgatggagacctgggccagctcggtcgccatggggtgctcggtgcggtaggtccaggtggtggtggccccgcgccgggtcttccccgcgggcaggccggccgcgaccgccgtcagcttctcgggggcggtgatccggaaggtgaagtacgccttgtcggacgggtggtcgttgccggggaagacccggtgggcggcgtcggcctggttggccatggcgagaccgtcggcggtgcggacccagccgccgtcgtccccggatccgctcgggtcgctggtgtgccggacggtgatgttcagcggtacgcccgcggggaggcggtggggggcctggacgaccaggtcctcgttcctgctgccgaagtcggcggccagtccgttgacctccactccgtggacggctccccgggcgaagtcgaggttgatccggtccagcggggcggtggtgcgggccctgatcttcgtgaccgcgtccagaggcttggtgttgccgccgtggtacgtgaaggcgatgtcgtacgcgagtacgtcgtatccggggttgcccagctcggggaagagccggtcgccgatgcccaggggctcgggggcgggcagggtggcggcgacgagggtggccgaggcggtcgccagcagggcggcgcgcaggcggcgggaaaggagcggcatggactacc

SEQ ID NO: 3185 - DNA, 5194 bp, Unknown
  Kingdom: Bacteria, Phylum: Actinobacteria, Class: Actinobacteria, Order: Streptomycetales, Family: Streptomycetaceae, Genus: Streptomyces
tgtcgagctgccgcggcagccgcggcccgaaggcctcggcgcgggtgggtcccccggggtcgggctgcgcgagcgccatggctccgtgtgccttccgggcgtgccgatcgatggcaggtggcctgccggcggggtgtcgtgggctggacgaatcgacggacgtcggcagcaactccccgacgtctcaacagtgttgtcaccgcatcggaccacccgcaaacggcgtatcaggcaaacagcccgggtatcaccgatatcgggcagaggaatcactccatctgccgtgcgggtgcgaggagttcggggatgatgcactggttcgaagggccactggccgcttttgacacggagacaacgggcgtggacgtcgagcgggaccggatcgtttcggccgctctcgtcgcgcaggacaccgcgggcggtcgcgtccgcgtcacgcgctggctggtcaatccgggggttccggtcccgccgggggcgaccgggatccacggtctgaccgacgatcaccttcagcgcaacgggcgttggcccgctccggtgatggacgagatagcccgggcactcgcggagagctgcgcgacgggccggccgctggtcgtgatgaacgctcccttcgatctgacgctgctggaccgggagctgaagcggcatcgggcgtcgtcgctggccgggtatctcgacggggtgccgatgcgggtggtggacccgagggtgctggacaagcatctggaccgctaccgcaagggccgccggacgctcacggatctgtgcgcgagttacgaggtggtgctcgacggggcccatgacgcggcggccgacgcgacggcttcgctggagctggtgcgggcggtgtgccggcgcttctccacccggctggagcggctgtcgccggccgagctgcacgccttgcaggcgacctggcacgcggcccaggcgcgtggcctggaggcgtggttcgcgaagagcgggacgccggagagggtggatccggcgtggccgctgcgcccggaactgcctgcggcggcatgaggggtcgagggggtgggggaatgcgaaagccggtccgcgtgatgctggcggaccggctttccccggtgggcgatactgggttcgaaccagtgacctcttcggtgtgaacgaagcgctctcccactgagctaatcgcccgggaacgggttgaaccatacagggctccgcgggcttcgttcaaactccttccggtcgggctctactcagggcgctgcggccgggaagtgagtatccgagcgcatgtacgggttgcgtggccggggccacactcccgtacatggaacacgtgcccccgcccgccgaggaactggcccgcctcgaccgagaactggccgagctggacgcccgcagggcccagctgctgacccggcgcgcctggctgctcgccgcgctgcgaccacccgcgccgacggccgccccgggctggaacccgtcggcctggggcgcgcctccgcccggtccgccgggtgctccggcgcagccgtggggttatgtgcccaagcagccgtccgccccgcgcagcgcgcagaacgtcctgctgacgctgggcggtctgctgctgacgatcgcggccgtcgcgttcacgctggtgagctggggttcgatggggatcggcggccggtcggccgtgctggccgcggtgaccctggcggcgttggtctcgccgacggtgctgctgcggcggggcctggcggccaccgccgaggcgctgacggccctggcgctggtgctgacgctgctggacgtctacgcggtgcgcgacacccagttgcgttccctgctggaagtcctcgcggggacggcgggcggcgggggttcgggctggtggcacgcctaccgggggctgatcccgccgcagtaccgcgacttcatcagcctggagtcgcaggccagcacggtccggacgctggagacctcggtggtgccgggactgctccagaccgccggttacgcacgcgccgtgacccgcgcctcgctggacgggttaccggacggccggctcgactccctggtcgaggtccggctcacccgccagcgggtgttgcgcgcgagtccgccgctgcgcttcaccgccgtgctggacgaggcggtgctccaccgcgaggtaggcggaccggaggtgatgagggatcagttgcaccatctgcgacaggtggcccaactccctcaggtgcgactgcagttgctgccgttctcggtcggcggctacgtcggactcacctgtcctttcgttatcttctcctttccgaacatttctgatctggatgtggtcgttcttgaccacttgacgagtagcctctatctggaacggaaagaagacctcgaggcgtacagctcggccttccgttccttgcaggcgcacgcgctgtcgcccgagcactcgctggacctcatcaccgcgatcagccgcggctagcggagccggcccgtccggccgggttccgccggaccgtccgactgcccgagggggccgccatgcccgaccgtcccgcaccgccgttcgcaccacccgccgcgccacccgcgccgttcgccgcacagtggcggcgcagcagccgctcgaccgggatgaacaactgcgtggagaccgccctgttcggcggcgcactcctcgccgtacgcgactcgaagaacgtggaccggccgccgctgcgcttctcggcggcggcctggagcacgttcgttgccggactcggcccgcgcggagccgatccgcacggaaccggcccgtaccggatcagctgacccgggtgtccgcctgccggggagcggcggcgaggaccgtggccaccgcggtcgtgatctgctcctcggtcaggtcggcccgcgcggtcagccgcagccgggagacgccgtccggtaccgacggcgggcggaagcagcccaccgccatcccggccgcgcggcagtcggccgcccagcgcaccgcctcctccgccgagggagcccggacggagacgacggccgcgtcgggccggaccgccctcagcccggcggcggtgagccgtccgtacagcgaggtggccacttcccgggcgcgggccgcccgttcgggctcccggcgcagcaccccgagggcgccgagcgcgccgccgaccgccgccggggcgagtccggtgtcgaagatgaacgtacgggccgtgttgatcaggtggtcgatgacccgggcgggccccaggaccgctccgccctggctgcccagggacttggacagggtgagtgtggccacgattccgtcgccgcccgccagccgggccgcggcgagcgcgccgcgaccgccgtcgcccagcactccgaggccgtgggcgtcgtcgaccagcagggcggcgttcgcggagcggcagacctcggccagtgcggggagcggggcggcgtcgccgtccacggagaagaccgagtcggtgaccgcgagggcacgcccgtcgtgctcccgcagggccttctcgaacgcctccgggtcggcgtggggcacgacggcggtcccggcgcgggagagccggcagccgtccacgatcgaggcgtggttgcccgcgtcggagacgatgagggagccgcgcccggtcagcgcggtcagcgcggcgagattggccgcgtacccggaggagagcacgagggccgcctcgaaaccgcagaacgccgcgagctcccgttccagccgggcgtgcaggacggtggagccggtgaccagccgggaccccgtcgcccccgccccccagcgatgggcggcgtcggccgcggcggcggtgacctccgggtgccgggtgaggcccaggtagtcgttgctcgcgagatccagcagctccggctcggaaccgcgcggacgcagggtgcgtacgagtccggcggcggcccggccgcgggcctcggcgtcgatccagtcgaacggggcgaaggacatggggcggtcccttgggtaggcgggccctcggcgggcggctccgcgcggacggtccggtgcggacggtccctttgtaggcagccaacagaccctagccgggtgcgcagcaggtcagggtgtggcaatacacacaccctcacccgggtctcctgtctggttcctccttggctggagacggtgccgtaagccaggatcatcttccatggacctgctgaacacgctggtggacaaggggctgcggcgcgaactgccgacccgcgaagaagcgctcgccgtactggcgacctccgacgacgagctgctcgacgtggtggcggccgccgggaaggtgcgccgtcagtggttcgggcggcgcgtcaagctcaactacctggtcaacctgaagtcggggctctgccccgaggactgctcctactgctcgcagcggctcggttcgaaggccgggatcctcaagtacacctggctgaagccggacgaggcgtccagggccgccgccgccggagtggcgggcggcgccaagcgggtctgcctggtcgcgagcgggcggggcccgacggaccgggacgtcgaccgggtctcgaagaccatcgaggcgatcaaggaggagaacgagggcgtcgaggtctgcgcctgcctcggtctgctctccgacgggcaggccgcccggctgcgttcggcgggcgccgacgcgtacaaccacaacctcaacacgtccgaggagacgtacggggcgatcaccaccacgcacacgtacgcggaccgcgtggagaccgtgcagcaggcccaggccgccggactctcggcgtgttccgggctgatcgccgggatgggcgagagcgacaaggacctggtcgacgtcgtgttcgcgctgcgggaccttgacccggactcggtaccggtgaacttcctgatcccgttcgagggaacaccgctcgccaaggagtggaacctcaccccgcagcgctgcctgcgcattctggcgatggtccgcttcgtctgccccgatgtggaggtccggctcgcgggcggccgtgaggtgcacctgcgctcgatgcagccgctggcactgcacctggtcaactccatcttcctgggcgactacctgacgagtgagggccaggccggccagaccgacctggacatgatcgcggacgccggtttcgaggtggagggcgcgggcacgacgacgctgccgcgccaccgggccgacgccctcggtggcggctgcggcacgcaggacgccccggcggaggccggctgcgg

SEQ ID NO: 3186 - DNA, 1368 bp, Unknown
  Kingdom: Bacteria, Phylum: Actinobacteria, Class: Actinobacteria, Order: Streptomycetales, Family: Streptomycetaceae, Genus: Streptomyces
ggtgtgcgcccggtacggcgcagtcgggttcggggcaggcgcagccgaggccgccgctctcgccgcgcgggccggcctgcgccgtccccactccggggagcacgggccattgccatacggtggcgcaggtcagggccgcgtcgagccgggcggtcccctccttgcgccggagccggagcctgcgtcgccttccgaggatctcgcgcatgagcgctcgttcctttccgttgaacgccgagtccacatgacaccacgcgtgtgtgacaccacgtgcgtatctcttcgctgtgcgtacgtgctcatcagttctgcggtacgggcgtgccgtcgataccgcgcgtgagccgagccgagccgagtggaaccgatccgaatagaaccgatctggggtggaacagagccgaaccgagcagagtcgagcggtgtcgaaccgaacggggtcgaactgcccgagcggagtcgtgctgccctggcggagtcatgcgggtcgaaccgagcgggtcgagccgagccggtgatcgctgggcgtgggcggcatgcgcctcgcctgccgtccctggtgcgaaccccgccgtccggagcgggagcgtcaccttcacgggtaaggacgcccgaacccgctgccgggttcctgggcgatcacaaccgcacccgcgcatcaccgtttacgtacccagcatgcccggaatgacgctcctccggcgacttgacccggaggcaccccctgttgagcagccccagtcgatcgcaaatagcgtccatagggtgcaattttcggccaagttaaccgacactgggagagcacgaatcacccggcccccgaagggacaatgctggacatcgggttacttgtgcgtgtacatgtggatgcattgatagtggcgcagaatcacatgggggtttgcgatgctattcgacgaatcacaccggtcggaaagctggctgccatgagcgccccacacctgccgaaagtggctggaatcgatccagaagttccggtttcaacgcacacttccgctcccctggcggaggttccgagaccgcccggtccgttcatccaggaccggctcgcgggctgggtctcggacctcacgaccctgcacgaactcaccgagcggctggccgggacgcgcaccctcgaccacgccctgaacgagctgttgcaggccggagccgccctcgtcggggcccgccgcggacttctcgttctggaaccggcgaacggcgaaggcccctccgccaccctcggcctcgggctcagccacgccgagctcggccacatcgagaccgtgccgcgcgcggccaccgcgctcggccgcgtcctcgacgggctgccggacacggccgacggggtcaccagccccgacc

SEQ ID NO: 3187 - DNA, 4305 bp, Unknown
  Kingdom: Bacteria, Phylum: Actinobacteria, Class: Actinobacteria, Order: Streptomycetales, Family: Streptomycetaceae, Genus: Streptomyces
tcgtcacggcagggcccagctgcccagcgccagcccatgccgcccgcggccgggcggcgggccgcccggccgcgggcggcatgggctggggctgggcagctgggtcctgctgtgacgaactcgacgccagagtgcggctgcggacccggtagagcccggtgtcgaggtcgtcggccttctccaggtggaccttgatcggtcccatgaaggtgtagcgctgctgcttggcgtagtcgcgcaccaggccggagagctcgtcgcccagctgacctgagtacgggctgagccgctcgtagtcgggtgtgctgagctcgacgatgaagtcgttggggacgacggtccgctcacggttccagatcgtcgcgttgttgtcgcactcccgctggagggcgccggcgatctcgacgggctgcacctcggacttgaagaccttggcgaaggtgccgttgaccagcccctcgaggcgctgctcgaaacgcttcatgacccccatggggcacctcctccgttgtcatcgtccctgtactgcttactgatcgtatccacgcgtcgggaaatcggctggttccccttgtctggcctgtggatgagtgtcacccctcacacggatcgtagagggggcctcctcacagtgtcccgcacccgggacgcactctggaggagtgggggcgatggttcggggttcccgcttcccctcccggagccggcgaaacaatggatgtgaatccaccctgtccagcgtgctaatcttccgtttgtcgccaggcgatcaccccaccgggtgagagtctgaaaacaccacttatgcgcgagtggcggaacggcagacgcgctggcttcaggtgccagtgtccttagggacgtgggggttcaaatcccccctcgcgcacaacggacagttgcttgtgactgtcaggttggttcgacagaacccccgcttcggagagatccggagcgggggttcttcgttgttccgcgtttcgatgtcccggcgtcggtggtgtgggtacctgtggtgtccgtggtggtcttcgcgttcttcgcgttcccgccggtccgtgtttttgacggacgggcggggtacggacaggcgggtaaggaggaggcggcagtgggtgtccgcgggcggtgatccaccgggtgtgggcacggtttccggacagaccgatggccggtgcaacggcgcacttgcatacgctggtcgcagaggttggatcgacggcgactcggcggtgaagggctgagcgcacagaacgtcccggaggcaggaaatggcgaagcaggctcgcgcggtccagacgtggcggtcgatcgtggatgccgcggcgagcgtcttcgacgactacggctacgagcgtgccgccatctcggagattctccgccgcgccaaggtcaccaagggggccttgtacttccacttcgcctccaaggaggccatcgcgcaggcgatcatggacgagcagacctccacggtggagttcgagcaggaggggtcgccgctccagtccctggtggacggtggccagcagttcgctttcgctctgcgccataactcgatggcccgggccggcaccaggctctccatcgagggcgtcttcctcggcggaccgcatccttggggtgactggatcgacgcgacggcccggatgctggagctgggccaggagcgcggcgaggtgttcccacagatcgacccgatggtgtcagccaaaatcatcgtcgcttcgttcaccggtattcagctggtctcggaggccgactccggtcgggccgatctgcgcgagcaggtggcggagatgtggcgccacatcctgccgtcgatcgctcaccccggcgtcatcgcccacatcaagccggagggccgggtggatctggcggctcaggcgcgcgagaaggcggagcgtgaggagcaggaggccaggatcgccgcggaggccaagggtgccggctccgaacccgactcgggctcccggtcgggcggggcgggcctgcggggcggtggatccggtcgtggtccgcgggccggggagaccggcgacgagggcgacgaggagcccgcaggcgcgggggtggcggccggaggggtcgtcgcctgatccgctcggagcgtgctgtgtttcacgtgaaacgcccgattggtcatgatcatcatacggtgggccgcaaggccgctggaggccccgcgaccccgccggtgttcaccgaatggctccttacttttagtaagccatcaaagagtggcccagtactctggggaaatggcggatcacggcgagcaggcctgtcggcgcgttgacggggggatcagtcgcgtcttcgcgttgttcggcaagcgctggaccggcccgatcgtctccgtgctgctgcagcgaccggtccacttcgccgaactgcgacgggcgattcccggaatcagcgagcgcatgctctcggaccggctgaccgaactcggtgcggccggtctggtgatccgcgaggtcgacgagggaccgccgctgcgcgtcgcgtaccggctcaccgaggcgggtgccgcgatggagcccgcactcaaggagctggggcggtgggcggacacctatctgacgcgggacgacgccgccggctccgggaccggctgctgacctcgtccggccggtccggggtgacctcgtccggccggtccggggtgtgccgctgtcgtccacaggggccgccccggcgtctgtccacagggcccggcgggtgccgggcatcggcggtaccgtcgtgctcggccgctggtggacagggccgctgaccggtcggacagccgggcagccggaagcggtacgagggtgggggaggcgacgctccatgagcggaaccgaggcgacgacgggaattgaggcgaccgcgggagagagtccgcgcatcccggtggtgcccgggttcgcccggcgcggtgccgcgagttcaccgaaggcggcgggcaaggccctccgtgaccgggtgccgcggtcctcgcacgcctcgctggccctgccgccgggacggccggacgccgtgcgggcggtcgaggagtcgaaccggggccgcgtgccgggcctgacgccgatacgggtgggccggatggcggcgacgccgttcgccttcctgcggggtgcggccggactgatggctcacgatctgaccggcagcccggtcaccggggtgggcgcccagctctgcggcgacgcgcacgcggccaacttcggcctctacggcgacgccaggggcagcctggtcatcgatctgaacgacttcgacgagaccgtcttcggaccgtgggagtgggacctcaagcggctcgccacctctctggtgctcgcgggccgggccgccggggccgacgaggacacctgccgccgcggtgcgcacgacgccgtcggcgcctaccggcgcacgatgcggctgctggcccggctgcccgccctcgacgcctggaacgcgatcgcggacgaggagctcgtctcgcacacggacgcacgtgacctggtcggcaccctggagcgggtctcggagaaggcccgcaacaacaccagcgcccgcttcgccgctcgctccaccgaggagtgccccgacggcggccgccgcttcgtcgacgcccggcccgtgctgcgccgggtgccggacgccgaggccgcggtcgtggccgccggtcttggcggctatctctccaccgtctccgaggaccgggtgccgttgctggcccggtacacgatccatgacgtggcgttccgggtggtcggcaccggcagtgtggggacccggtcgtacgtggtgctgctgctcgatcaccggggtgagccgctggtcctccaggtgaaggaggcgcgcccttcggtgctcgccccctatctgcccgcggtcggcttcgacgtgccggaggtggcgcacgagggccgccgggtggtgctcgggcagaagcggatgcaggtcgtcagcgacatcctgctcggttgggcggacgtcgacggcaggcagttccaggtccggcagttccggaaccgcaagggcagtgtggaccccgccgcgctcgccgccgatcaggtggacgactacggacggatgaccggagcactgctcgcgcgggcgcacgcgcacagcgccgacccccgcctgctggcgggctactgcggcaagaacgacgagctcgacggggccgtggccgctttcgcggtgacgtacgccgaccgtacggaagcggatcacgccgagctggtgcgggcgatcaaggcgggcaggctggccgccgagttcggcatatgacgggtccgtgaggcggtggtccccggccggggaccaccg

SEQ ID NO: 3188 - DNA, 1138 bp, Unknown
  Kingdom: Bacteria, Phylum: Actinobacteria, Class: Actinobacteria, Order: Streptomycetales, Family: Streptomycetaceae, Genus: Streptomyces
cctgggccccctcggcggtcccgcccgcgacgacggcccggccggacccggagccgagcaccgcgccgccgcgcgtcctgatgcgtacgggatccgagaacgagcgggtgcgggaactccaggcccggctccgccagatcggccacttcgggcgcaatcccaccggctactacggctccgtcaccgccgacgccgtgcggtcctttcaggccaaacggcggctgccggtcaccggaagcaccgacgcggtcacctggcagcggctgctggccatgacccgggtgccgacggccgccgaactggacccgccgaccgagcggccggtggccgcgccggacgaacggtgcctgaagggccgggtcctgtgcatcagcaagaagagccggaccctggcgtggatgaacgacgggaaggtcgtctccgcgatggacgtgcgcttcggctcggagtacacgcccacccgggagggcgtgttcgaggtgttctggaagtcccgggaccatgtgtcgacgctctacgacaccccgatgccgtacgccctgttcttcagcggcggtcaggcggtgcactactccgccgacttcgcggccaacggctacggcggcgcctcgcacggctgcgtcaacgtgcgggacaagaagaaggtcgcggcactgttcgaccaggtgaagaacggcgacaaggtcgtcgtctcctggtgatccggcgctcacgggtgatccggtaccggtgatccggcgtacggccggtacgagcgaggagagggcgcgggcgggaccgggggaacgtgtcccgcccgcgccgatgcgctgagccgaaggtacggggggaaccccggctcgtcgcgcggccgatgaccagtcggctcactctctactgcgcccggcctccgaaaaacgtcacacctggccgtccgggccgtcgacggagggcctggaaccgcaggtcagcgggtgagtacggaggccacgccggtgctcttcgggcgcggcgggacctcggtgtccgctccgggcccggtctccggggccacgccggagcgcggtacgggatggaaggagacgggcggcagcgagccgccgtcaccgtcgcccggcccgctctgaccaccgtcgtcgtccccgccaccggagccgcc

SEQ ID NO: 3189 - DNA, 12344 bp, Unknown
  Kingdom: Bacteria, Phylum: Actinobacteria, Class: Actinobacteria, Order: Streptomycetales, Family: Streptomycetaceae, Genus: Streptomyces
cacaacgaccacacccacctcgccgggcctcagatgccgcagctgggcgcggaccagaagcggccgctgcccccggcgaggtgggtgtggtcgttgtggccggggtagcccgggccgaggatctcggtgaagccgtggttgcgtgccgcctgggcgagaccgcagaagccctgggagcccgcgccgaggtccgccgcgtgcccgtacatgtggcggctgttggtggctccgccgaccgcgctgttgcaggacacgctgcggaagccgccgttgacggtgatgggccggtcacccatcgcgtgccgcatggcctggagcttccacatggtcaccagggcgttggcgcgcgcggtggccgcgctgaccttgccgccggaccagtcggagttgcagcggttcagctcggcgtaggtgaagttgaccggggtgcagtcgtcgtcctgcaacgcgtagatcttgctgaacgtctgggagcccgcgatgccgtcggacgccagcccgtacgcggactggaagcgcgcgacggccgccttggtcgccgggccgaactggccgtcgatggcgatctggtttccgtagcccggatagcccgcgacccggatctggagctggcgcaccgcttcgccgctggagccctctcggagcgtgccgctccaggtgtaacacgcgtcggccgtgccgacgttcccggtcggggcggaagtaggggccgagggcggggtcgcggaggcggctgcggtgccgccgaacgcgagggccgcgcccgcgagggccgagaggaggaatccgacggggcgtgatcgcatgggtctgcacctcattgtcgtcaagctgtccacggggttccgagcctcgggcgcggagccagatgtgtcaaggtcatgtcaacttgctgccaagggggtcggcctcgtagcggggtggcaggatgcgagtatggcgataaatcgaccgtgggcgggacttcacggtgacctgcgggcagcgaagtcgtcggtgtacgacccgagtggtttcacctgctcgcagccggtgcccgaaccggagagcgccgactacgcggctcacgggttcacgctcgacgggcggatggtcgtctttcgcgtggccagaaccaccccggccaaggccggtcagttcgtcactgtgtggcagcggtccgcggagggcccgatccggccgtacgacgccgatgacgggatcgacctcgtcgtcatcggcacccgggacgcgggccgttttgggcagttcgtgttcccgctcggcgtcctgtgcgagcgcggcatcgtgtcccgtgacggtgcgggcggtaagcggggcttccgcgtctacccgccgggtgcggtcacgaccggccgacaggcgcctgccactcaggcgtggcaggtgacgtaccacctggacatgggggagggcggacgcgggcccgtcgatctggcgcgggcccgggctctctaccacccgtagtgcacggggtcccggtgcgccgcgggccccgcgtggcgcaccgggcttccatggtgcgccgccgcgacgggattcctccggcgcgggctgacctcactcaccggcctccgcccgtaccctgccgtacgacatcgagggaggaccgtgtgctcacagcacagcaatggatcgacgctctggggctcgaaccgcatgtggagggcgggtacttccggcgtaccttccaggcggaccaccgcccgccggtgcggaccccgcgaggcgaacgcctcctgctcacctccatccactacctgctcaccgaggaatcccccatcgggtattggcatctcaaccggtcggacatcctccacttccaccactccggtgctcccctcacctatcacctgatccaccgggacggccgtgcggagtcggtcctcctcggccaggacccgcaccaggggcaggcgctgacccttgccgttcccggcggcgtgtggaaggccacctctctcgacggcggggaccacgccctgatcagcgaggcagtggcacccggcttcgactacgcggacatgacgctcggggaccccgacgacctgaccgcccgcttcccccggcacgcggcgctgatccggcgttactgccgcccggaggccccgcggggggcctccggatcacgccggaggcgaagcgccgatgagagccgcactgccgggccgccggtgtcaggtgaaggggacgaatgagtccagcgactcgggcagggtccggccgccggcgagcgtccgcacacgacgcacccggtacgtagaagacggccggccgtcggagcggcgggaggcgcggaactgggggaggttcaatccgtgggaggcaggccctggtcccagaccagggtgtaccgccagaacagccgccgacgcagccgcgcgccgggcagcacgcggcgggcctcgcgaacgatgtccggaaaggtcgtggtcgccggtcgggtcggtgcggtcatggcgacggggcacggcgctctgcggcccttgttcttgatccaggccatggcgacattcgacggaacggccacggcgtcgatcacgtggtcactccaggactgcggtcggtagaggccgatgacgatcagggtccccccgggcgccaggtgccggcggaagagtgtgagcgcgtcggccatcggcatgtggtggagggtggcgacgcaggtgatgacgtcgtagggcccggacggcacgtcctccagcgcgtctccgacggagaaggtcaccgggaccccggacgcggtgcgttcccgcgcgcgatcgacgatggagggatcggcgtcgatgccgtgcaccgctccggcccgggaggccagcagcctggcgaggtcaccgctgccggagccgacgtccagggcgtcggcgaaacgtccggggagccggcgcagaatccaccggtggtagtgggcgttgtgatcccacgggtgggtggcgtggaactgttcgagggctcgcaggacgcgggggagcaaggctgtcatgaggtgagtccgtcggagcggccgggcagccgtcgcccgtggcacgggagcgccgtcagccgctcggccggggtgtccgggccgagcggcgtcgccgggcgggtcagacggtgtcgaagtccccggccttgacgcccgtcacgaaggcggtgaacgcggtggcggggacgccgagggcggggccgcccgggttcttcgagtcgcgtacggggacggtgccggtggtggccgcggtggtcggggcccactcgacgcacgatccgctgttgctataggaggacttgacccactgctgggtcgtggattcggtcgtcacggtgtgccctttcgatgctggtggatcatgtccacggtatctgtctgcgacagagacacagcctgcaactgatggtaggccctcaccatcgggatgacggagctgagttcgcggtccagattcccctgcgtctcggactcgacgtaggagaccacggaccggtcctggagcgtcagcagattcaccagccgatcgaaggggcgctgctcgccgacgctgaacggggcgatctgcagcatggtgtgggactgggaggcgaagtcggccaggtactgcaactgagcgtccatcacggtggggccgccgatcgggcggcggatgcagctctcgtccagcaccgcgatcagcatcggtggcaccgtgcgtaacagtgcgccctgacgttccatgagtaacgagacgcgctgatcggcctgttcgggtgtgatgacgcctcgatcgacggccccgctcgccagcgcctgcgcgtactcccgggtctgcaacagccccgggatgacgccgacctcgaacagccggatctccgccgcccggccctccaaagccacgtactccgggaatccctgcaacagcaccccgtgcttgatcttgcgccactcgcgctcgaacgaatcagcggttcccgtatagctcatcgctacgtcaacggcgatcgagaacttgcgagttggggacttgtggcacaattccacgcccgaaacatgtcgccctgtgtagccgatgcgcgcgccgaggtcgtcctgtttccagccccgtgcttcgcgctccctacgcagacgtgctccgtaggccgcctccgggcccccgtcagggttcacttctttgcggttgaccaacgtatcccccagcttcgaaacgttgaagactccttcacgctaggccacgctgagtctccctggtagtcatacggctacagagaggagcgatcggtgtacggcgagaacgtcagctcgaatacggagccatccccacacgtcccggaccccgggaccctcctcgcggacaccagtcgcggtgaccgcgtgggggagttccggggtgtcgccggtccgtactggtccctcaggccggtcgccggtgggcgcgagtgggaggtcgaaccgcgctacgtgcggcccgcgttgctcatggaacagcttcgcgcccgcaccgcgcggctcaacgcgcgcagtcggggagaagtgctgtgatgaatgcggcgcggtcggccccgggccgtgtgagggtgctggattacgtcgcggccgtcacggtgaaggccggcgggcgggctctcccgctcggcggagtcgccctgccgaaccgccgactcgtcctccgctggttacggcggcaggcgttgcgcctggcggacgggcatgggcggtacctgcccccggcgggcccgtggctcggggcgggggacgtccggccggtgaccttccacggttccgacgcccccgaggcgctccgggcgtgggcgggtgaccacggcagccaggaccaggcgataagcgcgctggaatccggccgacccgccctgctcaccgtcgtcgaccccttcgtggggctgcgggtcaccctcggcgcgtggcccgtggacctgtgcgggtgggcggcggaagcctcggtgaatcacgcggccccgtcccgtacggaaggggactgatcgcatgctgcaatgcaccgccgtgacccaagtcccgtacgccgagacgctgctggcgctcgccaccatggagggtgggcccgagcacccgcccgacgtcatggagccggaggacttcgtcctgtgcgagctggccgaccacgacgagtcggccgagcacgccgcgcacctgtggacggcggacaccccggacgaccgggacctgtggttcctctggtcgggaaccggagcccaccgggtccaccggctcgacacactgcggctgtgccccgccgtgctccgcgaactggccacccgcaccgtcacgacgtgtgcgttcttcgaccaccaccccgggccgcactccttctccgtgaccgacccgctcggcgacctcatcgccgagcacgtccacagcgaggtccggcgactcgtctccgaggacgacgctcccgaggtacccgaccccgacgcgccctgacggcgaccggaggatttccacccccatgaaccagtgcaccgccgtaaccctgctgccgcccccggagttcctgatccggctcaccgctcctggcggtagccggccggatgccgggtacctcctctgcgagctcgccgaccaccacgacggcgaccacgcgatggcgttgtgggaggacgacgcgaaccgcaccgccgtctgggcccattggagcggcagccgggcgacgttggcaccgctggcctggtgcggcgcgatcgactcccggggtgaggacgcgtgcgggctgttcgccggccacccctccgcccacgactgggacgtggtcgatccgacgctcgcggcggtggacgcggtcctcgcgggcgagcgcccgggggagccggccgagccggccgagtgaagaccgtcaggcgtgtgtgggcgccgccggcctcagcagaggcgcccggtcgcccttcgcgtccggctgcccgaagggccgcagggctcctggggtgcggcccaggacgggcggaacctcagatcgagaaccgctcccgctccagcagcggtcgcacccgggaccggaaaccgcccgtgcggaacggttgctggagcaggccggggcgcagctcctgggcgagggccgcgacgatcattccctggtccagggcgagcatgaagtcgctgacccggcccgtggacacgttcaccgagtcgcggaagccgagcccgtcctcgtacgcgccgaagtcccgctccagggcccgcaggttggccaccgcctcccggccggcgtacggcagggccaggaaggaggcgtgcggggtgacgacgccgttggtgaacgccgagggcggcggcaggggttcgccgtccgccgtgtgcgtgcggtcggtgttggaggcgtatccgtcgaccgccatgccgagcgcgtcgaccccgtactcctggtagccgtcctcggggatgttggagggggagaagccccagtagccgtactccgcctcccgcagaccgtggtcgatctggccgcgtacgtagcggtggtgggtcacgccccacgcgcgcggcgaccactgctgctccggcacgaacagcggcaccatcagcgcctcgaacatggaaccgccccagctggggaccaccttgcggccgcggtgggtgtagtggccgttccacacccgtacgccgtcgacggtgacgtacccgccgccgggcttctgctcctgctcgtgctccggcagcatcgtgcgcagcaggtgccagtagtggtcgccgggcagcgagccgtccgcgatgccgaggtaactggccatgcggggctcggtgttgagcgctccgtagtggtgcggggtcggttcgtccgtgtcggtccagacgccgccgcgcagctggccggggcccgcgaccgggtcggcggggtcgtagggggtgtagaagtacgaccagtccgccgtggccaggacgcggtggatgcgcggccgcagcgagggcgcggcgtcggcggctgtccgcaggcccgtcaccagccaggcgttgtcgacggaggacaggaacgggcggaccggatcgccggttcccggccaccgggtgagcaccgaaccgtcgtgcgcgtcgtaccagttgagccagaaaccgtgatggcgttccagcttctcgacggcggcgaccgtccgggtcagggcccggagcatcgtgctctcgccgatcacgcccaggcccgcggcggcgaccgtcgaccacaggccgcagccgatgttggtcggcgaggtctgggaggactggacgggggcgccggggccgctgaggtcgatcttgtcggtgacgaggccgaagtcggtcgtcatcgcctcgatcgagcggtatgtgtcacggaaccaggtcttcagcaggcgtgggtccgcgggggcggcgacggccgccggggcggttacggctccgagcgacagggccgcggccccggtccctgcggcggtgagaaacgtgcgacggtccatcgttccggctcctggtggcagaagggggagggggagggcgagtcgtggtgttcggccgtgcgggatgtgcgaggtcgtgcggggtcgtgcgggggatgcggagtcgcgcgatggtgcgcgtgaaggcttggagcggtgggccgggtccggcggtcgtcaggatccgccggacccggcccacccgagggagccgtcaggtggctccccgtacagggggcagctccgaggccgaatcaggctgccgtgcgcgggagttcgcgggtgcggccgagcgagcccagccacttcgccgagtcgcgcggggtgcgctcgaaagtctcccagtcgatggcgatcaggccgaacgtggccttgtacgtgccccattcgtagttgtccagggcgctccacgccaggtagccccggatgtcgaggccgtcggccagcgcggaggcgacctcgttcagcgcacccgcgtagtagtcgacgcggcggctgtcgtcgtcggtggcgatgccgttctccgtgacgatcagcgggacgtcgcccaccacctcggccgtgtggcgcagcgcctcgccgaccgcgctcgggtagtactcccacgtcgtcagcgtccgctcgacgtcgtcggccgtcgggatcggtccgtcggggccgatccgcgtgcgggtgtaggactgcacgccgatccagtcgtcgccgcgcgccgcctcgatgaagacgtcctcgcgcgggtggcggtaggcggcggtgacgtcctccgcgccggggagcgcctggtagacctggttggcgatggtccagccgacctggatacccgcgtccagtgcccggacctccttgacggccgcgtggtgggcggcgatgacggcctcggtcgtctcgtcgtcgggggtgggcagaccggccggcgggaagctgttgtcgccgcgcttggcctggcccgccatcacggcgaccatgttcggctcgttgatcgtgcagacgtggctgacgccttcggagatgacgggcgcgcacgccgcgacgtaccgggcgaacagctccaccgcgccctcggccgtccagccgccgcgcgcctcgaaccactgcgggacggtgaagtggtgcagggtcaccatcgggcggaggccgcgctcgatcgcgccctccaccatccgccggtagtgcgccagttcggcgcgggagaagtgaccctcgaccggctcgatgcgagcccattcgagggagaagcggtagtcggtgaaaccgagcgaggccagcaggtccatgtcctcgggccagcggtggtagctgtcacaggcgtccaggctcggctcctggatgtgggtgcccggggtgtgctccttgacccaccagtcgctgttggtgttgttgccctcgatctggaaggcggccgtggaggccccccagaggaagccctcggggaacgggacgggggtcttctggtccgaagcgggggtgtgtgtcatcgcgacatgtctttctggtggtggtgaggggtgtggccgcgctctgcgaaggggtggggtgcggcctcgtacgtggagtgccccggcggaagcgctacttcatgcccgccgtggcgatgccctgcgtgaagtgccgttgcagcgcgatgaagacgaccagcaccggcagcacgatcaggaaggccccggccatcagcatcccgttggagccgccggccttgttggggtcggtggcgaaggtggccagggccaccgggagggtgtacttgtcggggtcgttggtcgcgatcagcggccagacgaagttgttccaggaacccaggaacgtgaagatcgacagggtcgcgagggcgggcttcaccagcggcatcacgatccgccagaagatgtaccactcgctcgcgccgtccatccgggccgcttccagcagctcgtccgggatcgactgcatgaactggcgcatcaggaagaccccgaaggccccggcggcgaacggcagcaccagacccgcgtagctgtcgatcagctggagcttgctcatcagcacgaacagcggcagcagcatcaggttgccgggcaccatcagcgcgccgagcaccaggccgaagatcttgttgcggccgacgaagttcagcttggccagggcgtagccgagcatcgagcagaagaccaggttcgagacggtcaccaggaccgccacgatcaccgagttcatgaagtacagcggcaggtccagcttgtcgagcagttgccggaagttctccagggtccactcggtggggatccacacgggcgggctggccgacagctcgctctgcgtcttgaaggcggagagacccatccagaggaagggtgccgacatgaccagcaggccgagcgagagcaggacgtagaccagggggcgcgagacgcttcgcttcccgccgttgttcctcgtcccgccgtcgctcttcttcccggcggcgttcttcaggggttcgaccgccgcgttgctgctgttggcgctcatttcgtgttgtccttcagcagtcggagctggagcaccgtgatgcccatgatcaccacgaagaggacgtacgccatggcgctcgcgtagcccatgtggaagaagttgaacccttcgcggtacatgttcagcgagaccgtgagggtcgagtcggacggtccgccctgggtcatcacgaacggctcctcgaacacgttgaggtagccgatcgtcgtgatcaccgtggcgtagaggagggtcggacgcaggagcgggaccgtgatgccccggaactcctgccagacgctcgcaccgtcgagcttcgcggcctcccgcacctcggtggggatcgcctggaggcccgcgatgaacagcaccatcaccgtgccgacgttccgccagaccgccatgacgatcagcgacggcatcgccagcgtctcggagccgaggaagtccggtgccgtccagcccacttcggagaagaggcccgcgatcagtccgtcgctcggatcgaggacgaaccgccagacgacggccaccgcgacgatggtggtgaccaccggggcgtagaagccgacccggaagaaggtccgagcccggtcgatgccgttgttcagcagaacggcgacgaccagtccgatgccaatggtcagcggcacgccgacgacgacgaagtagcccgtgttgaagagggacttgaggaacttctcgtcgctgaagaggttgacgtagttctcgaacccgatgaagttcgcttcccacgggcgcgtcacattgcgcagcccgaagtccgtgaagctcatcaccagcgtggcgaggatcgggaacgccatgaagacggtgaacaggacgaggaacggggtggagaacagccagcccgccgcgttctgcacacccatcgacggcttacggcctcggctgcgcccaggggccggggacggtgcggccccggccttccggggccctcgggccttctcggtcgtggtgctcatggctactgcttcacgaggccttcgatctcggactgcgcggtcttcagcgcgtcctcggcggaagccttgccctgcgtcaccttggcgatggcctggtccaccttgtcggtgatctcggtccagttggccagggacggcgaggacttggcggtgtccatctgcttcttgaagatctgcaggtcggcgtcgtcggcgagcgccccggactcccacgcggaggtgttggcgggcaggtccttcgtccgctcgtaccagtcggcctggcccttggtgtcggtcaggtacttgatgaactcggtggccgcggccttgtgctcgctgtccttggagacgacgagggaggagccgccggccatggaggtggaggaggcgtccgccggaacgttcgcgatggcccacttgcccttgatctgcggctgaccctcgttgagcagcgtcacgtgccaggggccgccgaagaacatcgggacccggccgttgccgaagtccttcaccacgtcgtagccgggctgcacggacttgttggagaggcccttgtcgaagtacgagccgtactccttgagcgccttgacggcctccgggctgtcgacgacggcctcgcccttgtcgttgacgatctcgccgcccgccgagtacaggaaggagtagaagttctgcacggtgtccaggccgctgggctggatggacagcccccacttcgtaccggccttctcctggtacgcgcctgccaggtccttcagcgccttccagtcggtcggagccttggtcacgcccgccttctcggccaggtccgtgcggtagtagaggacccgggtgtcgacataccacggcacgccgtaggcggtgccgtccacctcgccctgctcccagcccgccgggaagaagtccttcttgtcgaagaccttggtgtccaccggctccagcacgccgagttcggagaactcgcccatgtaactgccgcccatctgcgcgacgtcgggcagggtgcccgccgccgcagccgagacgagcttctggtgggcgacgtcccagccgatcggggtcaccttgaccgtgatgttcgggttggccttctcgtagacctcggccacgtcggcgagcttctcgccctcggcccccatggcccacacggtgagtgtctgcttctcgtccgatgcgacgtcgtcgccggaggagccgcaggcggaaagggtcacggcgagcgcgagtgctacgccggcgggagcggttctggcgatgcgggacatgggagggctcctccttgagcaatccggatgctgcgctatgtatgcgctgcctgtaagcgcatacatcactctgcgccagtcgttcgggaatccgcaagagggtgctgggtcacactcgtgcaacgtgctcgacatcctggcgccttgtagttgaaccgtaaacgcactgtttgtggaacaacaggcgatgtgaccgattcgtcgtccggagccgggtgacctggggtcctgggtcctgggacgctcgggaggttcgtgagccggagggggccggggc

SEQ ID NO: 3190 - DNA, 2360 bp, Unknown
  Kingdom: Bacteria, Phylum: Actinobacteria, Class: Actinobacteria, Order: Streptomycetales, Family: Streptomycetaceae, Genus: Streptomyces
gtcgtagccggccgccagggcgtcctggagcagctccaggtagccggtggcggagccggggagggcgttgcggtagcgggcgaggtcggcgaggaggaacgctcgcagccgacccgcctcgccggccgcctcgtccacggagccggcgagccgcaggcagtcctggacgtcctcgtcggacaggggcatggggtggagggcgatggcaagggcacgtcggagcacccgcagctcgtccgcgctgaacgccatgccgcctcgtgaaccgtagggcgtgggcataacgcgacaatacgtgctaaatggacaaaatccgtttaactggtcgtcggtggcgcggcgcaccccggtggcgtccccggcccccgcccccggccgttcccgcaggtaccgcccggttcggcgggagggccgctacgaccgggagacgttccgctcgtacaccaggcgcagcccgatgagcgtcagccacggctcgtgctcgtcgatgaccgaggactcccccaacaccatcggagcaaggccgcccgtcgcgatgacggtgacgtcgtccgggtcggcggccagctccttcttcatccgggccaccaccccgtcgacctgacccgcgaagccgtagacgatgccggactgcatggcctcgacggtgttcttgccgatcacgctgcgcggccgggccagctcgatcttgcggagctgggcgcccttgacgccgagggcctcgaccgagatctcgatgccgggagcgatcaccccgcccgcgtactcgccgcgcggggagaccgcgtcgaaggtggtggccgtgccgaagtcgacgacgatcgccgggcccccgtacagctcgacggcggcgaccgcgttgatgatgcggtccgcgccgacctccttggggttgtccatcaggatcggcacgcccgtcttgacgccgggctccaccaggacggcggggacgtcaccgtagtagcgccgggtgacctcgcgcagttcgtgcaggaccgaggggacggtggcgcagatcgcgatgccctcgatgccgtcacccagctccatgccgagcagcgggtgcatgcccatcaggccctggagcaggacggccagctcgtcggcggtgcggcgggcgtccgtggagatccgccagtgctcgacgatctcctcgccgtcgaagaggccgaggaccgtgtgcgtgttgccgacgtcgatggtgagcagcatcaggcgtcggccccgtcggtggcatcggcgtcgcggaagtccaggccgatgtcgaggatcggcgaggagtgggtgagcgccccgaccgcgaggtagtcgacgcccgcgtcggcataggcgcgggccgagtcgagggtcaggcggccggaggactccaggatcgcccggccgtcgaccagggcgacggcctcggcggtctcggccggggagaagttgtccagcaggatcaggtcgacgcccgcgtccagcacctcgcgtacctggtccatcgtgtcgacctcgacctcgatgggcagctcggggaactcggcgcggacccgcttgaacgcctcggcgacgccgcccgcggcgatcacgtggttgtccttgaccagggccgcgtcggagagcgacatccggtggttgacgccgccgccgcagcgcaccgcgtacttctccagcgcgcgcaggcccgccgtcgtcttgcgggtgtcgcggaccttggccttgctgccctccagcacgtccgcccaggcgcgggtggcggtcgcgatgcccgagaggcggcagagcaggttcagcgcgctgcgctcgccggtcagcaggtcgcgggtgcgggtggtgacggtcagcagcttctggccggggacgatccggtcgccgtcctcgacgtgccgctcgacctcgaactcctcggtgcagacgatcgacaggaccgcctcggcgacccggagcccggcgaccacgcccgcctcgcgggcggtgaagtcaccggtgatcacggcgtcctcggggaccgtcgccacggtcgtgacgtccaccccgccgtcgaggtcctccaggccggggaacgcggtgaagtccgggagcgccgtcccgttgccgatgatcacgagccgggtgggccggacgtcctgcatggcgaccgacgccagcagcgcctcgaccgcctgcgggcggtcccccatggtcacgatggatacgccgatgcgtggtgcggacaagttcggtactcctgggctcggctgccgtgcggctgctggtcggctgcggtgcccgcgatcgtaacgcctcggtgttcagtgtgcggttaccgcccggccatccatgggcccgtcggtgttcaggagggcgtacacggccatgtcccgccgccggtcgcccacctg

SEQ ID NO: 3191 - DNA, 8666 bp, Unknown
  Kingdom: Bacteria, Phylum: Actinobacteria, Class: Actinobacteria, Order: Streptomycetales, Family: Streptomycetaceae, Genus: Streptomyces
ggccgcagtgctcgggctcgacgtcgcgaccagcggcgccgccatccgggagcgggtggggtacatgcccgagcacgactgcctgccgcccgacgtctcggcgaccgagttcgtcgtgcacatggcccggatgtcggggctgccgccgacggcggcccgcgagcgcacggccgacaccctgcgccacgtcggcctgtacgaggagcgctaccgtcccatcggcggctactcgaccggcatgaagcagcgggtgaagctggcccaggccctcgtccacgacccccagctcgtcctcctcgacgagcccaccaacggcctggacccggtcggccgagacgagatgctcggcctgatccgccggatccacaccgacttcggcatctccgtgctggtcacctcgcacctcctgggcgagctggaacgcacctgcgaccacgtcgtcgtcatcgacggcggcaccctcctgcgctccagctccaccagcgacttcacccagaccaccgcgaccctcgcggtcgaggtgaccgacagcgacacccaccccgacggaacgggcgcgctgcgcaaggtcctcaccgacgccggggtcaccctcatcggccacgacggcatcgacacggaagggctgccgggcgcgggccacatcctgctgatcgagtcggccggcgaggacacgtacgacctggtccgcgacagcgtcgccgggctcgggctcggcctggtccgcatggaacagcgccgccaccacatcgccgaggtcttccgtaccgaacagggcggggcgcacagcaccgccgtcccggccgccaccgccggggccgtacagcagaagggaagcggtcgcgatgagcactgagaccgggaccgcggccgggcgcgacgcctcccggatccacaacatcggctaccgctcctacgacggaccgcggctcggccgggcctacgcccgccgctccctgttctcgcagacgctgcggggctccttcggactgggccgctccgccaagtccaaggtgctgcccatgctgctgttcggcgtgatggcgctggtcgcggcgatcctggtggcggtctccatggccgccccggacgccagccaactggtggtcaagtacacctcgtacgcgatctacctccaggccgtcatcggcctgttcatcgccgcgcaggcgccgcaggcggtatccagggacctccggttcaagagcgtccccctgtacttctcgcggccgatcgaacgcgccgactacgtgctggcgaagttcgccgccaccgccgccgcgctcttcatcctcaccggcgcgccgctgctcatcctctacgtgggttctctgctcgcgaagttcgacttcgccgatcagaccaagtggttcggccagggactggtgtcggtggcgctgctgtccgtgctgttcgccggtctcggcctcgtgatggccgccctgactccgcggcgcggcttcggcgtcgccgcggtgatcgccctcctgaccatcacctacggcgccgtctccacggtccaggccatcgcctgggagaccgggtcggaaggggccgtgcagtggctcggcctcttctcgccgatcacgctgatcgacggcgtccagaccgcgttcctcggcgcttcctccgccttcccctccggggagggccccggcaccggcaccggcgtggtctatctgttcgttgttctcgcgctcgtcgtcggctcgtacgccgttctgatgcgccgctaccggagggtcgggctgtgaccaccatcgagatcgaccacacctcgcgctggttcggcaacgtggtcgccgtcaacgacgtctccatgaccgtgggacccggcgtcaccggacttctcggcccgaacggcgccggaaagtccaccctgatcaacatgatgggcggcttcctcgccccctcgacggggaaggtcacgctcgacggccggccgatctggcgcaacgaggacgtctacaagaagatcggcatcgtcccggagcgggaggggatgtacgacttcctcactggcagggagttcgtcgtcgccaacgccgaactccagggtttgggaggggccgaggcgcagaaggcgctcgccacggtccagatggagtacgcgcaggaccgcaagatctccacgtacagcaagggcatgcgccagcgggtgaagatggcgtccgcgctggtccacgagccgtcggtgctgctcctggacgagccgttcaacggaatggacccgcgccagcggatgcagctgatggaactgctgcgacggatgggggacgaggggcgcacggtcctgttctcctcccacatcctcgaagaggtcgagcagctggcctcgcacatcgaggtgatcgtggcgggccgtcacgccgcgtccggagacttccggaagatccggcggctgatgacggaccggccgcaccgctatctggtgcgctccagcgacgaccgggccctcgcggccgcgctcatcgccgatccgtccacggcgggcatcgaggtcgacgtgaccgagaaggcgctgcgcatccaggccgtcgacttcgggcggttcaccgaactgctgccgagggtggcccgtgagcagggcatccggttgctcaccgtctcgccgtccgacgagtccctcgaatcggtcttttcctacctcgtagcggcctgagtagtggcctgaaaggagctgtgcaccgtcatgtacgaccccacagtcgcccggctcacctaccgggccctgctcggccggcgccgggccgccatcctgttcgtcctgcccgcactgctgctggtcatcgccgcggccgtgcgcatgttcgccggagccgatgaccagatcgcctcggacgtcctcggcggcttcgccatcgccacgatggtgccgctgatcggcgtgatcgcgggcaccggcgcgatcggccccgagatcgacgacggctcgatcgtctacctgctctccaagcccgtgaagcggcccacgatcatcttcaccaagctgatcgtggccatcgcggtgaccatggtgttctccgccctgccgacgcttctcgcgggcctgatcctcaacggcaacggccagcaggtcgccgtcgcctacacgatcgcggcgctggtcgcctcgatcgcgtacagcgccctgttcctgctgctcggcacggtcagccggcacgcggtcgtcctcggcctggtctacgcgctggtctgggaggccctgttcggcagcctggtgcccggcgcgcggacgctcagcgtccagcagtggtccctggcggtcgcccagaaggtcgcgggggacggcgcggtgacctcggacgtcggcctgccgctcgccacggtcctgctggtcgccgtcacggtcgtcgccacctggtacgcgggccagaagctgcggacgctgaaactggcgggcgaggagtgagggcgcgcctctgagatccgccccctggatccccggcacacgcggctcccgcccgggacagggtgggagccgtctgtcgtacgaccggacgaccggacgacagccatgcgtgacgttgtgtttatcggtcgatgggcagggtgtgtggaggcaacgggaatccgtggcgtcgtagcgaccgtgaaatcggggaatgccggcaccgggtgaggcccagcccaccggacgggtcgtcgagtgaatggcgaccgtgagcgtcctccacccctgaagcccggggtccacaggcggccacgcaacggcggctccacgctcgccgtaccgtcctcaacgtcgccatgcttcttcgcgacagcgacatcgcccgatgcgtgcgtacgtatctcctcgacgccgaggagtcgctgcacacccggtacgcctcacctgtcgcaggacgtcgtccgcctggacaggcggctggactccttcgcccggcggctgaaggatctgcgccgccgtagcgggcagcgctgagaccggcggcccggcaccgtgggaaacggtgccgggccgctgtcgcgctgtccggtggcggacgcgcgtgctacagcacgggcaccgagcggagcagttcctccagcaccaacgcgatgccgtcgtcctcgttggacgccgtgatctcgtgggcgacggccttcaggtcgtcgtgggcgttggccatggctacgccgtggtgggcccagccgaacatcgggatgtcgttcggcatgtcgccgaaggcgatcgtgtcggccgccttcacgccgagccggcgggcggccagcgagaggccggtcgccttgctcaggcccagcggcaggatctcgaccacgccggccccggccatgaccacgtcgaccaggttgccgaccgccgcccgcgcggcgaaggccagcgcgtcgtcgtccagctccgggtgctgtatgtagaccttgttgaggggagcggtccacatctcggtggcgtcgtccacgaagacgtacgggagcgggccctcctgcacctggtagccggggcccacgagcacctcgccgtccagtccgtcgcggctggccgccaggtgcagcgggccgacctccgcttcgatcttggacagcgcgagaccggcgagctgccggtccagggtcagcgaggtcagcagcttgtgctcgcccgcgtggtagacctgcgcgccctggccgcagaccgcgagtccctcgtacccgaggtcgtccaggatgtgccgggtccaggggaccgcacgtccggtgacgatgatgtgcgcggctccggcagccgtggcggcggccagagccgcgcgggtgcgctcggagaccgtgtcgtccccgcgcagcagcgtgccgtcgaggtcggtcgcgacgagcttgtaggggaaggtcacttggcgaccggttccaggacctcgcgcccgcccaggtaaggacggagcacctcggggacgcggaccgagccgtcgggaagctggtggttctccaggatcgccacgatcgtgcgcggtacggcgcagagcgtgccgttcagcgtggccagcggctggaccttcttgccctcgcgcatccggacggacaggcggcgggcctggaagccgtcgcagttcgacgcggaggtcagctcgcggtacttgccctgggtcgggatccacgcctcgcagtcgaacttccgcgaggcggaggcaccgaggtcaccggtggcgacgtcgatcacctggaagggcagttcgagtgcggtgagccactgcttctcccagtccaggagcctgcggtgctcggcctcggcgtccgccgggtcgacgtacgagaacatctcgaccttgtcgaactggtggacgcggaagatgccgcgggtgtccttgccgtacgtgccggcctcgcggcggaagcacggggagaacccggcgtaccgcaggggcagcttgtcggcgtcgatgatctcgtccatgtggtacgcggcgagggggacctcggaggtgccgaccaggtagaagtcgtccttctccaggtggtacacgttctccgaggcctggccgaggaagccggtgccctccatggcgcgggggcggaccagcgccggggtcagcatcgggatgaagccggcctcggtggcctgcgcgatcgccgcgttgacgagggcgagctccaggagcgcgccgacgcccgtgaggtagtagaaccgcgagccggagaccttggccccgcgctccatgtcgatggcgccgagcgcctcgccgatctccaggtggtccttgggctcgaagccctcggcgccgaagtcccggatggtgccgtgggtctccaggacgacgaagtcctcctcgccgccgaccggcacgtcctcgtggacgatgttgccgagctggagcagcagccgcttggcatcggcgtcggcctcgtcctgggcggcgtcggccgccttgacgccgaccttgagctgttcggccttcttgaggagttcggtgcgctcctcaggggtggccttggggatcagcttgccgagggacctctgttcggcacgcagttcgtcgaagcggacgccggacgacctgcgcagctcgtcagcggagagcagggcgtcgacgaggtcgacgtcctctccacgggcgcgctgggaggcgcgaacacggtcggggtcctcacggagcaggcgaaggtcaatcacccctccaggctaccggtgcgcggatctcgcactcgaaccgatattgccgagcgtgtcactttgaccgaattgccgggattgatatttctgaggggaatctctgaggggaatctctgagggaatcgccggggcgcggaagccggcgtccatgccgacacccgtgtcggcgtcgatgccgatgtcgagccggagtggggaagggcgtcaatggcggcgggtgactcgcctgaacagggcggaaggtgtggtccgccttgacgtacccgccttgggcggggcgggagttggggggggtcccgccaccgttgtccacaggggcccttcgcatcggaatagttatccacaggctgtgtggaagttctgtggatgccggaggacattgttccggaactcggacgaagccccgtggaatccccacgcaaacccgacccgcgtgctcgttcgggtgggaattcgtcgccctaaagagtcgatcaagggaattggggcgacgcgggtgcctcgcaccacctcgtggctctgtggatggctccagggcagctgggttgatttgtcgacgatgtcgcattggggtgtcgacttgtccccaggtcgagaaccctcctgtggataactatccggagtacgtgactatctgtagatcgcaccgctgcggagagcgcaaggaaaccgccccgggtggccttggcgccgggacctctcctgcgcttccgtcagatccggccgtcctggctgcgcgccagccagtcggaggcttccgtgaacgccgtgtccgacgtgcccgcccgcagcggccgcacctcgtccggggagacgcccgcccgcggatacgagccgaggaaccgcaccttcgggctgatccgcttcagccccatcagagcctccccgacccgccggtccgcgatgtgtccctcggcgtccacggcgaagcagtagttgccgatgccctcgccggtcgggcgggactggatcagcatcaggttgacgccgcgcaccgcgaactcctggagcagctccaggagggctccgggatggtcgtcgcccagccagatcaccacggaggtcttgtccgcgccggtcggtgcggagggccgggcgggccggcccaccaggacgaaccgcgtctgggcgttctccgcgtcgtggatctccgtcaccagaggctccaggccgtaggtcgcggcggcgaactccccggcgaacgcggcgtcgtaccgcccctcctggacgagtcgggccccgtccgcgttggacgccgccgactcccacagggcccccgggaggtgggtcgccatccagttgcgcacctgcggctgggcggccgggtgcgcggtgaccgtcttgatgtccgacagcttggtcccgggccgtaccagcagcgcgaaggtgatggagagcagcacctcgcggtagatcatcagcggttccccgccggccagctcgtccagcgtcgcggtgatgccaccctcgacggagttctcgatcggcacgagcgccgccgccgcctcgccgccgcgtacggcgtccagggcggccggcacggacaccatcgggacgagctcccgggtggcggcttccgggagcgtgcggagggcgacctcggtgaaggtgccctcgggaccgagataggcgtagcgcgtggctgacatacggtcaccctaatgcgccccgagaggcctgccgcgctgtttcagaatgcggtcgggagggcgcggcccgagcacttcccggtcgcagccggcgggcacaggcgtccctacggctccagcagccgctgtcccacgtactcgccctctgccgccccgcccgggaccgcgaacaccccgctcgcctcgtgccggaggaacggcgacagcgcgtcgccccggtcgagcttgcgctgcaccggcacgaaaccgcggaacgggtccgcctgccagcagacgaagaggagcccggcgtccggagtgccgtcctccgcgatgccgtcgtggtacgagaacgggcggcgcagcatggcggccccgccgttcttctcgggcgaggagatccgggcgtgggcgttgtcggggatcacgagcctgccgtccgggcccgccttgtcgaggtccatctccgtggtctcggtccccccgctcaggggtgccccgtccgccttgcgccgcccgatgacccgctcctgacgctccaccggaagcttctcccagtcgtccaggagcatcctgatccggcggacgaccgcgtacgaaccgccctccatccactcctgcggctttccgggtgacgcggggacgaagacgcgccggtcgaagtcctcatcggccggcttcgggttgccggtcccgtcgatctggcccatcaggttgcgggcggtcatcggccgggccgtcgcgccgggggtgcggttgaagccgttcatctgccaccgcacccgtgccgtgcccgcggcctccttctggagggcccgcagcgcgtggaaggcgaccagcgcgtcgtccgcgccgatctgcacccacaggtcaccattcgaccgcccggcgtcgagggcgtcggcggagaacgcgggcagcgggtcgagcgcggcgggcaggcgggcggt

SEQ ID NO: 3192 - DNA, 4621 bp, Unknown
  Kingdom: Bacteria, Phylum: Actinobacteria, Class: Actinobacteria, Order: Streptomycetales, Family: Streptomycetaceae, Genus: Streptomyces
accctgctgaacgcgctggccaaccggctggtgcggctcctgggcgtcgagcccaccgccgaactggcctccgcacgcaccccgggcgagctggtctccctggcccggcactccgccgaggccggagccctggaacaggacaccgccgacctgttcgtccggaccctctcgctggccggcctcaccgcccagcacgtcatgaccccccgggtgaaggtcagcgccctgcactcctccgcgaccgccgaggacgtcctcaacctcacccgcgccaccggcctctcccgcttcccggtctaccgggaccgcatcgacgaggtcatcggcatggtccacctcaaggacgccctcgccgtccccgccctcgaacgcctgcgcaccccggccggacggatcgccgtccccccgctgctggtacccggcacgctgccggtggaggcgctgctgcggcggctgcgccacgaacagccgatagccgtggtcgtcgacgagtacggcggcaccgccggcgtcgtcaccctggaggacatcatcgaggagctcgtcggcgaagtccgcgacgagcacgacgccgagggcgcgggccgtcccgagctgatcgccgccctcggcgaacagggcctcatcgacgccgacgggaactgggccgcgggcaacgcccggctgtggttcctcggcgacttcaccgaccgcggtcccgacggcatcggggtcatcgacctcgtcatgcgactctccgccgaggcggcggcggccggcggctactgcaaggctttgatgggaaaccacgagctgctgctgatcggcgccaagcggttcgccgacacccccgtcaactccggggccggcaccgccaccttccaggccgcctggctgctcaacggcggccagaagaccgacatggagcgcctccaggacgtccacctccagtggatgtcccggctcgacgcggtcgtcgaggaggacgggcatctgctgatgcactccgacacgacggcctacctcgactacgggtccaccatcgaggacgtcaatgacacgatcacggccattctcacgcgcaatgacgccgacgagtgctgggacctcttccgcaagctcaccaagcggttcgcgttccgggacgagggcggcgcgcaggcggtgcgcgagctgctgacgacgtacggcggacagcgcgtcgtccatggtcacagccccattccgtaccttctgggcgaggtcggcacggaggagggtgaggacagcgccgggcccgtgatcaacggcccgcacgtgtacgcggacgacctcgccatcgccatggacggcggagtgaccatggccggaaagctattggtggttcagctcccgctgcatgactgaccgtcggcggggaaggcgcttcaggttccgcctgcgccgacctcgccgatcaacgggcccgtcaccgggcccaattctggaaacaccctgtcaccccgtgccgtgagcgctctaccatcggcgtatcagtggcaggctctcctccgtttccgcccgatcgcccggtccacgcgggcagccgggcaccgacggagcatcgggggatgcagatgacaagcgctccgcacctgctggccgaggacggacccgagtacgagcggatcctgggcgacgcactgcgccacgctcatgaacgcccggacctggagggcgtcggggaccggctcaacaccgaacagctgcgcaccatggcgctcagcgccacggcgctgatcaccgcggccgcggccaccgagtacgagcactacgtcaaggcccgcggcgagctgcgccgcgcggcgaccgcagaagggaccgacggcggcccggccccggacgggccgcagagcacggcggccggatcgggcgccggcataggcgcggtcatcacggtcctgaccccgctgctggccggctccgcggccgtcatcttcctgctcgtcggctacctgctgaaggcggtcagtccatcggtgaccttcggcggctcgctggtcgcggccgggtggttcttcgcggcggtcgccgccgcggcgatcctggtcgcggccgtcgggctgctcatcaccgcgctccgcaacggcgcgacgtcgctggccgcggagaacgaggagcaggagcttccggaggacgtcgcacgggccagggaggcgtggcgccacgccctgctggagcgcggcatcctccccttcctccgggacgccctggccgaccccaccgcggggcccgccgcacggaccccgcaccgctcgcccaaccgcatcccgaaggtcgggtacagcaggccggacttctccggcccggacgacggtccggcggccggtccccggccgaccttcaccagtcccgatttcacgagcccggacttcggcggccccgagcaccagccggactgagatcccggacccgggcacaggctccgggcacgcttcccggctaccgcgccgccggccttcgcgcgcacgggctctgccacggccccggacacaccgcgggccgggtgcggcaagtgccgcacccggcccgggtgatgctccggacggaccggagcggtggatcagacgccctgcggagccagcttcgggttggcgccgtgctggttcgcctccggcttgccctccgaggcgaggaagacgatcaggatgatgaagccgaccagcgggacgaacgagatgaagaaccaccagcccgagcggccggtgtcgtgcagacgacgcaccatgaccgcgagcgacggaacgatggtcgcggcgaggtagaggtagtacgggatctgcgtgctgatcgccgcgccgatacccgaaagcaccaaggcgatgatgaagttgaagagcacgaacatccagtactccttgcggcgcgcgcgtccgctgaagcctgcgtagttcttgagtacgtccaggtaccagttcactgtgattccctccccggcccccgttccgagggcacaccaatcaagccaagcaagccggaaagtaagccacagataaggaaggggtcaagcgcgtgggagctgcgggccaaacgtacatagagctgccacacgactgtgtccatactgtcgcttaacaagtcaaccaatcacgccaaagaccagtgaactgacgcaagttacccattgaacgcaaaccgtccccggccgccgaggacgatccggcggccggggacgggtcggtcggcgatggacgggtcagtcggcgatgggcaggtagacccggttgccggcggccgcgaactccttcgacttctcggccatgccctcctcgatctcctcccgcgagccaccgtgctgacgccggatgtcctgggagatcttcatcgagcagaacttcggcccgcacatcgagcagaagtgcgccgtcttcgccggctcggcgggcagcgtctcgtcgtggaactcccgtgccttgtccgggtcgagggccagattgaactggtcctcccagcggaactcgaaccgcgcgtcggagagggcgtcgtcccactcctgcgcacccgggtgccccttggccaggtcggcggcgtgcgcggcgatcttgtaggtgatgacccccgtcttcacgtcgtcccggttcggcagtcccaggtgctccttgggcgtgacgtagcagagcatcgccgtgccccaccaggcgatcatcgcggcgccgatgccggaggtgatgtggtcgtaggcgggcgcgacgtccgtcgtcagcggcccgagcgtgtagaacggcgcctcctcgcagatctcctgctggaggtcgatgttctccttgatcttgtgcatcgggacatgcccggggccctcgatcatggtctgcacgccgaatcgcttggcgatcgtgttcagctcgcccagcgtgcgcaactcggcgaactgcgcctcgtcgttggcgtccgcgatggacccgggccgcagtccgtcgcccagggagtaggtgacgtcgtacgtcgcgaggatctcgcagagctcctcgaagtgctcgtagaggaacgactccttgtggtgggcgagacaccaggccgccatgatcgagccgccgcgcgagacgatgccggtcttccggcgggccgtcagcggaacgtacggcaggcgcacaccggcgtgcaccgtcatgtagtccacaccctgctcggcctgttcgatgacggtgtccttgtagatctcccaggtcagctcctcggcccggccgtctaccttctccagcgcctggtagagcgggacggtgccgatcggcacgggggagttgcgcagcacccattcacgggtggtgtggatgttgcggccggtggacaggtccatgaccgtgtcggcgccccacttcgtcgcccaggtcatcttgtccacctcctcctcgatggaggaggtgacggccgagttgccgatgttggcgttgaccttcaccaggaaccgcttgccgatgatcatcggttcgatctcggggtggttgacgttggcgggcagcaccgcccggccttccgcgatctcctcgcggacgacctcggccgccacgttctcccggatcgccacgtactccatctccggggtgatctccccccgccgggcgtacgcgagctgggtgacggggcgtccgtcgcggctgcggcgcggctggcgcgggcggccggggaa

SEQ ID NO: 3193 - DNA, 4346 bp, Unknown
  Kingdom: Bacteria, Phylum: Actinobacteria, Class: Actinobacteria, Order: Streptomycetales, Family: Streptomycetaceae, Genus: Streptomyces
gggctggccgagttcagcgaggtggaggtggtggaggcggcccggcgagcagatgggcccggtccaccgtgatccggtccgccgcctcggccgcctccaccagcgctcgcggctccatgcacgcctccgccgccgccagcgccggggacgacaccggccacagcggctgcgcctcggacagcagcgccacggtctccggaccggccaggacataaccgatccgcagcccggcgagcccccacgtcttggtgaggctgcgcagcaccacgagccccgggatgtccgtccggtcgcacagcgcctcccgctcgcccggcacgacgtccatgaacgcctcgtcgaccaccagcgtccgtcccggccgcgccaaccgctccagcagcgccgccgggtgcagcacggacgtcgggttcgtcgggttgccgatcaccacgaggtccgcctcctccggcaccgcctccggatcgagccggaagccgtcctcggcacgcagcagcacccgccccaccccgtgcccggccgcccgcagagccgcctccggttccgtgaactgcggatgcaccacgaccggacaacgggccggaagagcacgggcgatcaggacgaacgcctcggccgcacccgccgtcagcagcacccgctccaccggcagcccgtgccggccggcgaccgcggcgcgggccgaggacccgtccgggtaggcggccagcgaagtgagcgacgcggctatccgctcgcgcagccactccgggggagtgtgggtacggacgttcacggcgagatcggtcagattctcgccgcgcacctccgcgtcgccgtggtggcgcaggtcgggccctgcgctctcgaagttccgcgtggggggattcatggcagccatggtgaacgggcgggagccccccgtcaccggtgaggtggaagttttcctcccggaaacctcgaaagtcccggcgacggccggaagccggcgggccaccgcacacgtcgccatccccccggccgaggcgttcccgcccggggcgcgggtcttcggcaccaccagttcgtccgcctcgatcagcgccgccgcctccgcgaccgacggagtccccaccgccgcgcccaccgcgcccgaggggtgcggcacgcggaccgcggccagcgccccggccggatgggtccgcaccggcacccccagccgggccgccgcccctacgatccccggctcgtcccccttggcgtcgaccgtcgccacctccagcacgtccgccgcgtccagccccgccccgctcaacaccgcctcgatcagggcgaacaccacatcgccggggacaccacggcgcgcgccgacccccaccaccagactgcgggccccggactccggtccggtgccgacggatgctccggtcatcggcggagtcctgcctttcagatcaaacgtctcggtggtgcgggggaggaggcggggccgttccgtatacggaaacgggcggccggcaaggcgcggcggacgccgccggtaaggacaccctgagatgcggagagaggcctcgatcggctagcaaggccccatggcggtgttcgtcgcgctcggcgcgttcctgatgactctggccggcggctgggtcgcacaacgcgtcaccgaccgccgtcacctggtgctcggcctcgcgggcggcctgatgctcggcgtggtcggactcgacctcctgccggaggcgatcgaggccgcgggcacaccggtgttcggggtgcccgccgccctgctgctgttcgtcggcggcttcctggcggcccatctggtggagggactgctcgccgtacgccaggtggcacacggggcgggcggcgaacgcgtcccgcaggtgggtctgacggcggccgccgcgatggtcggacacagcttcatggacggcatcgcgctcggcgccgccttccaggtcagcggctccatgggcgtggccgtcgcgctggcggtgatcagtcatgacttcgccgacgggttcaacacgtacaccctcaccagtctttacgggaacgcccgccgcaaggcgctcctgatgctgttcgcggctgccgcggcgccggtcgtgggcgccgcgacgacgctgctgttcacccttccggaggaactgctcggcggctatctcggcttcttcggcggagcgctgctctacctggccgctgcggagatccttcccgaggcgcaccacacccatcccacccgctccacccttctctgcaccatcgggggcgtgggcttcatctggctggtcgtcggcatcgcggagtgagccccgcgtacgcccgagcacttcgtcacgacggccgcgccccctggaccgtggttcaccgcgcccggcagtgctcgacgaaccgccgggccaccccgggcgacgcggcccagtgggtgtgcagatagctggcgtgcacgccccgctggacgtacccctcgacccgccgctccggctggtgcataccccaggcgggcgtggtccccgcccccggctccagcaccgtgcgatggaactcatgaccgcgcatccgggtccccgccaccgccagcgcactgtccgacacggccaccgcctgccggtacccgagcgtgaggcgctcggacatccgggcctcggcgtccagcaccccgcacatgggtttgccgtccagctcccgcgccagatacagcagccccgcgcactcggccgccaccggggcaccgctcagggccagttccgtgaccccccgccgcaacggctcgttggccgacagctcgggcgcgtacatctccgggaacccgccgccgatcacgagccccgccgtacccaccggcagcttctcgtcccgcaacgggtcgaagaccacgacctccgcacccgccgccgtcagcagctcggcgtgctccgcgtacgcgaaggtgaacgccgcccctccggccacggccacgacgggccgcacggaaccggtgaccggggccggcgtcggctcccacgcggcgtccggcagggccggcgcggtccgggccagcgccatcagcgcgtccaggtcgcacccggcgcgcacccgctcgcccatcgccgtcacggcgtccaccgctgcggatccccgctcggccaccgggaccagtcccagatggcgcgagggcgtcgccacctgcggagcccggcgcagcacacccaggaccggcagccccgactcgtccaacgcgtcccgcagcagcgcctcgtggcggtccgaggccaccttgttcaggatcaccccgccgatccggacctcggggtcccaggaggcgaacccgtgcaccagggccgccaccgaacgggactgcgaggaggcgtccaccaccagcaccacgggggcgcgcagcaacttcgccacctgcgcggtggacgccagctccccctggccggaggcgccgtcgtacagccccatcacgccctcgaccacggcgaggtcgcaccccgccgacccgtgcgcgaacagcggggcgatcagatccgtcccgcacatgtacgcgtcgagattgcggccggggcgtcccgtcgccagcgcgtgataacccggatcgatgtagtccggccccaccttgtgcggggagacggcgagcccgcgcgcggcgaaggcggccatcagaccggtggcgacggtggtcttgccgctgccggaggccggagcggcgatgaccagacggggcacagtcaccactcgatgcccctctgacccttctgccccgcgtccatcgggtgcttgaccttcgacatgtcggtcaccaggtcggcggcctcgatcagcgcgtccggcgcgttgcggccggtgatcaccacatgctgggtgccgggccggttccgcatcacctcgacgacctcgtcggtgtcgatccagccccagtgcatcgggtacgcgaactcgtcgagcacgtacagcttgtacgtctcggccgccagatcgcgcttgacctgctcccagccctcgcgggccttctcctcgttgtccagctgaccgtcgcgctggacccaggaccagccctcgcccatcttgtgccagtcgacggtgccgccctcgccgctcgctccgaggaccttcagcgcgttctcctcgccgaccttccacttcgcggacttcacgaactggaacaccccgatcggccagccctggttccaggcccgcaacgccagcccgaaggccgccgtcgacttgcccttgccgatgccggtgtggacgaaaaggagcggacggttgcgccgctgacgggtggtgagcccgtcgtccggcaccgatgtcggctgtccctgtggcattaagcggccctcccggctgcggtgacgtccttgacgagcccggcgatcgagtcggcccgcagctcgtccagc

SEQ ID NO: 3194 - DNA, 3788 bp, Unknown
  Kingdom: Bacteria, Phylum: Actinobacteria, Class: Actinobacteria, Order: Streptomycetales, Family: Streptomycetaceae, Genus: Streptomyces
tgccggggcccacgcgcgcaggacgtttcgaggtcagagccgctcgggcgtccggatgcccagcagcgccatcccctggtgcagggtccgggcggtcagctcgaccaggaagagccggttctcgacgacctccggggcgttgtccgggctgagcacctggcactggtcgtagaacgtggtcaggtgcgacgccaactggtagagatacgcggccagcttgtgcggctcgtagcccgtcccgacctcggcgaggacctcgccgaactggtccaggtgcagaccgagcgcccgctccgccggggccagctccagctccgggtgggcggccgggaccgcgtcccccgccttgcgcaggatcgactggatccgggcgtacgcgtactggaggtacaccgacgtgtcgccgtgcagcgccaccatctggtccaggtcgaacttgtagtcccgtacggcggaggtcgacaggtccgcgtacttcaccgcgccgatgccgacgtaccggccgttctcgacgatctcctcctcggacaggcccaccttgtcggccttgtcccggacgaccgccgtggcccgcgtgaccgcctcgtcgaggaggtcctccagccgcacggtctcgccctcacgggtcttgaacggcttgccgtccttgccgaggaccgtgccgaacgcgagctgcacggccttgacgtcctcgttcagccagccggcccgccgggccgtctcgaagaccatcttgaagtgcagcgactgccgtgcgtccaccacgtacagcagggtgtccgccttgaggtcctgcacccggttccggatcgcggagaggtcggtggccgcgtagccgtagccgccgttcgtcttcttcacgatgagcgggaccctgttgccgtccgggcccttcacatcgtcgaagaacacgcacagcgcaccctcggagcggacggcgacacccgtctcctccaggatccggcaggtctcctccagcatgtcgttgtagccggactcaccgacgatgtccgggtcgtcgatcaccatgtcgagcttgtcgaacaccgagtggaagtagatcttcgactcgtcgacgaagcggtgccacagctccagcgtctcggcatccccggcctggagggccaccacccggtcccgcgaccgggccttgaactcctcgtcggagtcgaacaggacccgcgactccttgtagacccggttcagcgtcgacatcgccgcttcgccgtcgctcgcgccgccctcgtgcttcagtgcgcccgggtgctcgatcagatactggatgagcatcccgaactgggtgccccagtcgccgatgtggtgccgccggaccacgttctcgccggtgaactccaggatcttgaccacggcgtcgccgatgaccgccgaccgcaggtggccgacgtgcatctccttggccacgttcggctgggcgtagtcgatgaccgtcgtcccggcgtcgtccttcagcggcacgccgagccggccctcgccgtccgccgcccgggcggccagcgtctcgacgatcgcccggtcggtgagcgtgatgttgaggaagccgggcccggagacctcgatgtccttgatcggcccgcccgccgggagggcggcggtgacctgggcggccagctcacgcggattgcccttgagcttcttggcgagcgccaggatgccgttggcctggaagtcggcccggtcgctacgtcgcagcagcgggtccgcggcgccggcatccggcagcgctgccgtcagggcgtccgccagctgctgctggagcgtggaagcgagggaagggaccgaggccatggctggctgccgtttccgtagggggtacgaggggtcctcttgggtgtccaagggatctccccagtatcccatggggcgtaaagccgttttcgcgctgcggggggtagctgggagaatggtcgggaccccatcgggaaacgacagacgagagaaggacgtgccgaccgtggccgagagtcagaccagcaccgagaccgactgggtctcccgcttcgcggacgatgtcatcgccgaatcggagcgtcgtgcgcctggcaaaccggtcgtcgtcgcctccggtctgtccccgtcgggcccgatccacctcggcaacctccgcgaggtcatgaccccgcacctggtcgccgacgaggtccgccgccgcgggcacaccgtgcgccacctgatctcctgggacgactacgaccgctaccggaaggtcccggagggcatcccgggggtcgacaaggcgacctggggcgagcacatcggcaagccgctgacctcggtgcccgccccgcccggctccgcgtacccgaactgggccgagcacttcaaggccgccatgacgcaggccctggacgagctgggcgtcgagtacgacggcatcagccagacggagcagtacaccgccgggacctaccgcgagcagattctgcacgcgatgaagcaccgcgccgacatcgacgccgtcctggaccgctaccggacgaagaaggacccggcggccgcccagggcaagggcggcaagaagccgcagcagcagaagaaggtcgacgaggccgagctggaggccgccgagggctccggcgccgccgccgaggacgacggcagcggcaacacggccggctacttcccgtacaagccctactgcggcaactgcgagaaggacctcaccgtcgtcacctcctacgacgacgacaccaccgagctgaactacacctgctcggcgtgcggcttcgccgagacggtccggctcaacgagttcaaccgcggcaagctcgtctggaaggtcgactggccgatgcgctgggcgtacgagggcgtgatcttcgagcccagcggcgtcgaccactcctcgcccggctcctccttcgtggtgggcggccagatcgtccgcgaggtcttcgacggcgtccagcccatcgggcccatgtacgccttcgtcggcatctccggcatggccaagatgtcctccagcaagggcggggtgcccaccccggccgacgcgctggagatcatggaggcgccgctgctgcgctggctctacgcccgccgcaagcccaaccagtcgttcaagatcgctttcgaccaggagatccagcggctgtacgacgagtgggactcgctgggccgcaaggtcgccgacggcacggtgctgcccgccgacgccgccgcgtactcccgtgccgtccgcaccgcggccggggagcttccgagcaccccgcgcccgctgccgtaccggacgctcgcctcggtcgccgacatcaccgccggcgccgaggaccagacgctgcgcatcctcagcgagctggacccggagaacccgctgacctcgctggacgaggcccgcccgcgcctcgaccgggccgagaactggatcaccacccaggtcccggccgaggcccgcaccatcgttcgggacgagcccgacaaggaactgctcggctcgctcgacgaccagggccgcgagtcgctgcgcctcctcctggagggtctggacgcgcactggtcgctggacgggctcaccacgctcgtctacggcgtgccgaaggtactggcgggactggagccggacgccaagccgacgccggagctgaaggccgctcagcggtccttcttcgcgcttctctaccggctgctcgtcagccgcgacacgggaccccgcctgcccacgctgctgctcgcggtgggggcggaccgggtgcgcaggctgctgggcgcgtagcgccgtatccagggcggagggccaccacccggatttccgggtggtggccctccgc

SEQ ID NO: 3195 - DNA, 4024 bp, Unknown
  Kingdom: Bacteria, Phylum: Actinobacteria, Class: Actinobacteria, Order: Streptomycetales, Family: Streptomycetaceae, Genus: Streptomyces
cgtcgcggcggtgcagcgcgaggtggaacgcgtcgagtgggccggctggcgcgatgccgtacgcgtcgaactggacgcggtcgagagcagcaggatcggtccgtgggtacgcggcccccgcgcccgcgccgtcgccgccgtccagctcgcggccggactcccgctcctgctctggggcgcccgccgccgcagcggcggctgggcggcggccggagcggtgctgctggcgcagggtgcgctgggactcgcgtacgagcgtgccagggcgggtgcggacccttcctaggacgtgcgggtcacgcgtcctcgtcgtcctcgtcgtccagccgtgccagccaggtcgcgaggcgctcgaccggcacctcgaagtcggggttgagatcgacgaacgtccgcagctgctcggcgagccactcgaaggtgacctcctcctcgccgcgccgcttctccagttcctcgatgccacggtccgtgaagtacatacgcacaggatatcgaggcgcggacgcccaccggaacgccggatacggcggatacgccaggggcccggctccgcggcaagcgcggaaccgggcccctgtgacgtaccgactgctcgtacggctgcgtggtcctgggcctaggcctcgaagacctcgttgaccagctgtgtctgctccgcctggtgacgcttggccgagccgaccgccggggacgagccgtgcggccgcgagatgcggcgcaggcgctcgccgtgcggcacgtccgcgccgaccgcgaggtccaggtggtcgatcaggttgagtgcgatgaacggccacgcaccctggttcgccggctcctcctgggcccacaggtacttctcggcgttcgggtacttcgcgatctcggcctggatctccgcacccggcagcgggtacaggcgctccagccggatgatcgccgtctccgtgtcgccgcgcttctcccgctcggcgtccaggtcgtagtacagcttgcccgcgcagaagacgaccttgcggacgttctcgggcttgaccgacgcgtcgccgatcaccggacggaagccgccggtggtgaactcctcgatggacgaggccgcggccttcagacgcagcatcgacttcggggtgaagacgatcagcggcttgtggtgcgggttgtgcacctgccagcgcagcaggtggaagtagttcgacggaagggtcggcatcgcgaccgtcatgttgtcctgcgcgcacatctggaggaagcgctccgggcgggcggagctgtggtccggaccctggccctcgtaaccgtgcggcagcagcagcgtgacgccggaggtctggccccacttctgctcggccgaggagatgaactcgtccacgacggtctgcgcgccgttgacgaagtcaccgaactgggcctcccagatcaccagcgactccggacgggccaacgagtagccgtactcgaagcccatcgccgcgtactccgagagcagggagtcgtagacgttgtaccgggcctggtcgtcggccaggtacagcagcggggtgtagtcctcgccggtgacctggtcgaccaggaccgcgtggcgctggccgaacgtgccgcggcgggtgtcctggccggcgagccggaccggggtgccctccatcagcagcgaaccgatggccagcgtctcgcccatgccccagtcgatcgtcccgttgtccaccgaggccgcgcgacgctgcatctgcggcatcaggcgggggtggacggtgatcgagtccgggatgttgacctgcgactcggcgatccgcttgacgacctcggcggagacggccgtctccacggtcaccgggaacgcggcctgcggctccgggacatgcggggcggcaggctgcgaggtggcctcgcggacctccgcgaacaccttctccagctgaccctggaagtcctggagcgcctgctccgcctcttccagcgtgatgtcgccgcgaccgatgagggactcggtgtacagcttgcgcaccgagcgcttcttgtcgaccagggtgtacatctgcgggttggtgaactccgggttgtcggtctcgttgtgaccgcggcgccggtagcagatgaggtcgatcacgacgtccttgttgaacgcctgccggaactcgaaggccagccgcgcgacgcggaccacggcctccgggtcgtcgccgttgacgtggatgatcggcgcctcgatcatgcgcgccacgtcggtggcgtacatcgaggagcgcgaggactccggggcggcggtgaagccgacctggttgttgatcaccacgtgcacggtgccgccggtgcggtagccgcgcagctgcgacatgttgagcgtctcggcgacgacgccctggcccgcgaaggccgcgtcgccgtggagcgcgaccggcaggaccgtgaagtccgtgccgcccttgttgatgatgtcctgcttggcgcgggcgatgccctccaggaccgggtcgaccgcctccagatgcgaggggttggcggccagcgagaccttgatctgctcgccgtccagaccggtgaaggtgccctcggcgcccaggtggtacttgacgtcgccggaaccgtgcatcgagcgcgggtccaggttgccctcgaactcgcggaagatctgcgcgtacgacttgccgacgatgttcgccagcacgttcagccggccgcggtgggccatgccgatgacgacctcgtcgaggcgggcctcggcggcggagtcgatgaccgcgtcgagcagcgggatgacggactcgccgccctccagcgagaaccgcttctgaccgacgtacttcgtctgcaggaacgtctcgaacgcctcggccgcgttcagccggcgcaggatgcgcagctgctcctcgcgctcgggcttcggacgcgcgcgctcgacccggtcctggagccacttgcgctgactcgggtcctggatgtgcatgaactcgatgcccgtggtgcggcagtacgactcacgcaggacgccgaggatgtcgcggagcttcatcatcgtcttgccggcgaacccgccgaccgcgaagtcccgctccaggtcccacagggtgaggccgtgctcggtgatgtccaggtcggggtgcttgcgctggtggtactccagcgggtcggtgtcggccatgacgtggccgcggacccggtaggagtggatcagctcgaagacccgcgcggccttggtgacgtcgtcgtcgtgcgaggcgtcgatgtccttgagccagcggaccggctcgtaggggatccgcagcgccttgaagatctcgtcgtagaactcgttctcgccgagcagcagctgggacaggacccgcaggaactcgccggaggcggcgccctggatgacccggtggtcgtacgtcgaggtcagcgtcatgaccttcgagataccgagcttgttcagggtgtcctgcgacgtgccctggaactccgccgggtagtccatcgcgccgacgcccatgatgaggccctgaccgggcatcaggcggggcaccgagtgaacggtgccgatgccgccggggttggtcagcgaggccgtgacgccggtgaagtcgtccatgccgagcttgccgatgcgggcgcgccggacgatgtcctcgtacgcctgccagaactcgaagaagttgagcgtctcggccttcttgatggccgcgacgaccagctggcggtcgccgttcggcttcaccaggtcgatggccagacccaggttgatgtgctccggcttgaccagggtcggcttgccgtccttcgtggcgaaggagtagttcatcgacggcatggccttgagggcctgcaccatcgcgtacccgatgaggtgcgtgaaggagatcttcccgccgcgggcgcgcttgaggtggttgttgatgacgatgcggttgtcgaagagcagcttcaccgggaccgcgcggacggatgtggccgtcggcagctccagcgaggcgttcatgttcttcgcgacggcggccgaggggccgcgcagcgtcacgtactccgggccggccggggcctcggtggagtcgtccgccttggccgtggc

SEQ ID NO: 3196 - DNA, 4466 bp, Unknown
  Kingdom: Bacteria, Phylum: Actinobacteria, Class: Actinobacteria, Order: Streptomycetales, Family: Streptomycetaceae, Genus: Streptomyces
gccgaccgcgacgaggcggaacggacgctgctgacgctgcccgggatcggccggcgcaccgccgccctgatccggatgcgggcgctcggcgaccccgacgtggacccgtacggaacgccgggcgcggagcggtggcggccctggcgctcctacgcggtacgtcatctggaagcggaagcggcggggacggcggtcctgagctgaccccggccgctgagggcgctccggtcagccccagagcaccgtccccagccaggcgcccgccaccagcaggcagcagaacagctccaccaggaccgcgtagcccgtcgcccgcatgaccgagcgcaccgacgtccagcccgcgccgcggctccccagccgcagccgctccgcaccgaagatggcccccacgtacccgagcacccccccgaccacgggcatgacgaagaagcccacgatccccgcgaccccgccgatcatcagggtccggcgaggcgccccggactcacccgggcgacgtggcggcagcagcggtttgagggcctggttcagcaacagcagcgccgtcgcgccgatcaggacgccccaggcggccggcgtcatgtccgtcagcgcccaccacagcaccgccgcccagacgatcgcctgacccggcacacccggcaccagcaccccgaccaggcccagcagcatgaccaggcccacggcgacgagctgccacacactcatctgaccagcctgccggagagtgccccgctccgcccgtcagcgcccccccggcccacccgcgtcgacctgcgccgacgccgtctcaggccggctcggtacgggccacccagccacgctcgtacgcatgccagcccagctggagccgcgtcgagaccccggtcagctccatcaggcccttgacgcggcgctgcacggtccgcagccccagatccagctgcttggccacactggcgtccgtcagccccgccagcagcagcgacaggatctccaggtccgtcggatccggaccgaccccgtcctcgcgcaccccgccgccgccctcgcccagccgcagcggcatcgcatcccgccacaccgcctcgaagaggcccatcagcgactccagcagaccgctggcgtgcacgaccagagcggcgggctccgcaccccgcccggtcagcgggaccatcgcgaggctcccgtcggccaccaccagcttcgtcggaacccggtccaccacccggcactgctcgtcccggctcagcgccgccgacagctccaggatcccgaacggcgtcgacagcacctcgcgctcgaccaccacccggtaactcaccccgcgcgaggccgcccgctcctcggactcgttctccatcccggtcaccgcgatcggcttgcccgtcaccagggcgcacacctccgacaccgctcccagctgcaactggtggaagcgctgggcgactgcgctcgctcccgtcaccacctccaccaggtcgtgcaccgccggttcgctcgcctcggcccggtactcctcggccagcagcgcggacgccagctccgcctgctccagctcgtgccgctgctggatcagcagcgcgccgagcgccacgcccggcggcgccgccacccagcggcccggccgggccgaggactgtgcggccaggccctgctgctccagccgccgcagcacccgttcggtgtccgcctcgggaagcgccagccggtgcgcgagatcggcgagctccgcggctcccgccgcgacgagcgcgcggtacgcggtttcctgtctctcgtcgagacctatggcccccagcattctccgacctccccgggtgtggtgatcgcgcatcgaggcgcccctgcggcgggtcccgggtggcgggaagaggccacggcgtaaacccgccgcccacatcatcccctgtacccccggcccctctgccactgtggcgccaccgcagtaccaacaacctccgggatgccgcctcttgggctgcttcgttccggaatgacctggggagagcgatgcgcccgatatcgcgtacggcaatcggagcggcgaccgccgccgtgctcgccgtcacggtgatcgcgccgtcggtggccgcgccaccggacgagcgggacccgaacagaccgatcaccgggagcgcggccgccgtcgccgatgccccgaagcccgtcaccgtgacgctcgtcaccggtgacacggtgctggtgaccacggacgcctcgggtgcgtccgccgccaccgccctgccccgggcggacggcagcgtgccgctcgtgcagacccggcagtccggccaggacctgtacgtctaccccgagtccgccgtgtccgcgctcgccgcgggcaccgtggacgaggagctgttcaacgtcaccgggctcatccgccagggttacgacgacagccatgccgacgccgtcccgctgatcgccacctacaccggcgacaccgcccgccgcgctccgctcaccccgcgcggggccgagcgcggagcggccctcgacgtcatcgacggactcgcgctgaaggccgacaagaagcgggccgccgagttctgggccgagctcaccgcaccccgctcccggtcgggcgccgggctcaagaagctctggctcgaccgcaaggttcaggccagtctcgacaagtcgacgaaacaggtcggcgccgacctcgcgtgggccgccggctacgacgggaccggtgccaaggtcgccgtcctggacaccggggcggacgccgaacaccctgacctccagggccggatcaccgcctcggagaacttcaccgactccgacagcaccgacgaccgccagggccacggcacccatgtggcgtccaccgtcggcggctccggcgcggcgagcggaggaaagaagaagggcgtcgcgcccggcgccgacctgatggtcggcaaggtcctgaacgacagcggatccggcgctgcctcctggatcatcgcgggcatgcagtgggcggtcgacagcaaggccgacgtcgtctccatgagcctcggcagcgccgaacccaccgactgcgccgacccgatgagcctggccgccgaagaactcggcaagagcaaggacaccctcttcgtggtcgccgccggaaacctcggcccgtccctgaacaccgtctcctcgcccggctgcgcacccggcgtgctgaccgtcggagccgtcgaccgcgacgactccaccgcgggcttctccagtcgcggccccgcgatcgtctcgcacacgctcaagcccgagatcgccgcgcccggcgtcgccatctccgccgccgcggccggcggccggggctcggaggcgtaccggtccatgtccggcacatcgatggcgaccccgcatgtcgcgggcgcggcagccgtggtgaagcagcgtcaccccgactggaccgcccagcagatcaaggcggccctcgtctcctcggcacggagcgccgtccccggcgacgtacgggagaccggaggcggccgtctcgacgtcgaccgcgccgtgcgcacgcccgtactcggcgcaccggccgtgcagggcggcaccttcaactggccgcaggacaagagcgatcgcaccaccgccgccgtgccctacaccaacacgagcggcaagccggtcaccctctcgctgaaggtcgcgggcgtcaccggaaacgacggctcggccgtccgctccacgatcgcctcgctcggccgcaagtccgtcaccgtgcccgccggggcgaccgtcgaggtacctctcgccctcgaccccgacgcccggctgaccgccgcccagtacggtgacgtcaccggccgcgtcctcgccaccgccaccgggggagtgcaggtctcgaccccgttctccctgtacgtggcgccggagaccgtcaccctgcgcgtcaagctcgtcgaccgcacgggcaagcccgccgacggcgtctcctccctcgacctcatcggcaccgacaccgcctccggcgaacgccgcttcaacgagggcgccaccgatcagacctacgaggtccgccccggcgcgtacttcgtctccagcttcatcgcctcgcccgaccccgccgacgcgaccggtcaactcgtggaatccgtcggctatctggcgcgcccccagctgaacgtcaccgaggacaccacgctcgtcctcgacgcccgcaaggcccaccggctgaaggtgaggaccgaggaccgggtcgccgagacacgcggcgcgaccctcgcgttcgggcgctcgtgggacgacacctggctgcactcgggttccatcgccggcaccgggctgatcaaggactacctggtcgacgtccagggcaaggcacgtgacggggacttcgagttcgcctccgtctggcgcgcctacgcaccgcagatccagaagttctccctcgtcggcggagcggccctgcacccccggcccgccaccaccggctcggtcaacctggacggcaccggccgcgccgaggtcgtcgacgccggtgccgtccaggttga

SEQ ID NO: 3197 - DNA, 6635 bp, Unknown
  Kingdom: Bacteria, Phylum: Actinobacteria, Class: Actinobacteria, Order: Streptomycetales, Family: Streptomycetaceae, Genus: Streptomyces
ccgccgtggtgcgccgcgcccgcaaggcccgccgccgcatctgagcgcctagggcgcccagagcctgtaggaggctccaaaccggccggccggccgccggaagatctggcaattccgggatgtcggagccgtacggcacgatgggagcatggcacccacccacgaccatcccggcgagcacgcggcggccgaccccgtccggctgctggcgatccgggactccccgctctccgtcgacgaggtcttccgcgccgtcggcgacgacgcggcgggcggtatcgcgctcttcgtcggcaccgtgcgcaaccacgacgcgggacaggacgtcggcgcgctcggctattcctgtcacccctcggccgaggacgagctgcgccgagtggcggagaaggtcgtcgccgacttcccggtccgcgcactggcggccgtccaccgagtgggtgaactggaggtgggcgacctggccgtggtcgtcgccgtcgcctgcccgcaccgcgccgaggcgttcgaggcctgccgcaagctcatcgacgacctcaagcacgaggttccgatctggaagcaccagcgcttctcggacggcacggaggagtgggtcggagcctgctgagcgcaaaccggaccggggcgcatcagccccgatttgcgtaaccgcccccccgccatgagcgttggtcttccggatcgttaatctgctgatcgggcatccggtcgctcatggggtagggaggtcgtgatggcggcactcgcttggctgttgattccacttttcgctgctgtcggtggtgcgatatgggcaagttgggctgcccgcaatcgcacgaccggcgatgtcaccgaactcgccggctacgccaggttccgtgacgcgatggagaaatcgcactccggttccggggttctctgaagaccgacgcacgccgcgtgaccaccttccgccgcgttccggcctcctcgtacggaccggccccggcggtgcactgacaggcccttcccgtactgtcgttccatgccacgccgcaccgcgacgatgctcgcctccgccctcgtcctcatcgcgctgctctgcgcaggcgtgctgatcaaagtgccgtatgcggagatgtcccccgggccgacggtgaacacgctgggcgacgcgcgtggcgagcccgtcctgcagatctccggtcgcaagacgtacccggcatccggacatctcaacatgacgacggtccgcgtcaccggggcggactaccggatgaacatcgccgaggccgtctacggctggctggcccacgacagcgtcgtggtgccgcacgacacgctctacccggacggcaagaccgaggagcagtccacccaggagaacgccgaggagttcagccagtcccaggagagcgccaaggtggccgccctcaaggagctggacatcccggtcgccacgcaggtcgtggtctccacggtggtcaaggacagtccctccgagggcaagctgcacgccggcgacgtgatcaaggccgtcgacggcaccgtggtcaaggagcccggcgacgtggcgaagctcgtcaccgagcaccgccccggtgaggacgtcaccttcaccatcgtcccggcgaagaccgccgccgcggccgagaaggccgggcgcgcacccgagggcggcgagaagatcaccatcacgaccgcgaaggctcccgccgcggagggcgacggcgaggagggcgggaaggaccgggcgatcgtcgggatcagggccgggacggaccacacgttcccgttcgagatcgacatcaagctcgcggacgtcggcgggccgagcgccggcctgatgttctccctgggcatcatcgacaagctcactccgggagacctgaccggcggcaagttcgtcgcgggcaccggcaccatcgacgacgcgggcaaggtcggcccgatcggcggcatcaacatgaagctggtcggcgcccggaacgcaggcgcccgctacttcctcacgcccgacgacaactgcgcgtcggccgccgccgacacgccggacggactcaccctcgtgcgggtcaagaccatcgaggacgccacgaagtcgatggagcagatccgtgcggggaagaccgccggcctgccgagctgcttgactggctgacggccgcgccgcccgggaaccgtacgacggccccgggcagcggccggatcaggactcgaacgtcgccgcgagcgcctcggcgaggccgggcaccagaccggcaccggtcagcacctcggtgggggagtccttctcgcgcagccgtacggcggactcgcgggcaccgtcccgcaggacggccacggtcatccggacctcctgccggtcggggtgtttggcgacccactgggtcagctgcttgtcgttcagaccgtccggcacggaggcctcggcggacggcggcagcatcagccgctccaccgtcatggcgcagccgaccacggcgtcgggccaggcgatcgtgccgaggaagtcgtcgagcgcggtgcccgggggcaattcgtcctgctcgatcggggtgagcgcggcgacggaggagctggggtcctcaaggcccagctgagcggcgagaccgggctcctggacccgcagctgtgcggtgtcgaccagggcgaacagccgggcgggctgctcccagccgaggttggaggcataggcgtcgatttcgagtacggcgacggtgagcggactcgcggccatcggaggtcctgcgggggaaacgttgggcatgggcaatatcctgcctccttccgccccgggaacgggaactaggtaaagcctcagtaagttgcataggtgggctctaggatcgctgggcctgttcacacgaccgcgaactacgaggtgcgcacgttggctttccagatgccggaccgcggcggaggcccgaccgggccacggatcagagtcggccgcccgtcccggcgcgcccgtaccctgctcatgactttgggtgtcctggcggttctcgccatggccttcgtcatgttcgccgggttctggacggactggctctggtacaggtcggtcgcgtattcatccgtcttcaccaccaccctgtggaccaagatcgggctgttcctcgtcttcggactgctgatggcgatcgccatcggtgtgaacatctggctcgcgcaccggctcaggccgccgctgagcgcgatgtcgctggagcagcagagcctggaccgctaccggatgagcatcgctccctacaagaagtgggtgctgctcgccgtcacggcgctcgtcgcactgatcggcggagcttccgcctccggccagtggcgcacgtggttgctgtacgtcaacggcgtgccgttcggccagaaggacccccagttccagctggacgtcgccttcttcgccttcgacctgccgtggtaccgcttcctgctgggcttcggcttcgcggcgaccgtgctctcgctgatcgccgccgcgctgacccactatctgtacggcgggctgcgtatcaccagccccggcgctcgtgccaccggggcggccaccggccacctctcggtcctgctcggcatcttcgtctccctgaaggccgtggcgtactggctcgaccggtacgggctggcggtgaagtccagtgacttcaaggccgcggacaactggacgggcctgcggtacgtcgacgccaacgcctacctcccggcgaagaccatcctgttctgcatcgcggccatctgcgccgtgctgttcttcgcgacgctgtggcgccgcacctggcagctcccggtcatcggcttcggcctgatggtgctctcggcgatcctgatcggcgggctctacccggcgatcgtgcagaagttccaggtccagccgaacgagcaggccaaggaagcggagttcatccagaagaacatcaatgccacacgcgacgcgtatgacatcgatgacgcccgggtggacgactacgagggccaggcgacgacggaggacgacagcaaactgcgggcggcggccaacacggccgccagctaccgggtgatggaccccaacgtcgtctccccggccttccagcagctccagcagcggaggaactactaccagttccccaagacgctggacgtcgaccgctacaaggacaaggacggcaaggagcaggacaccgtcatcggtctgcgtgagctgaacatccagggcctgcccaagcggaactggatcaacgaccacttcacgtacacccacggctacggcgccatcgcggcccggggcacgaccaccgggacgaacccgacgggatccccggacttcaccgagtcgggactgccctccaccggtgagttcgacaagtacgagcagcggatctactacggcgagaagaccgagcagtactccatcgtcggcgggccccagaaggagctcgactacgaggaggacggcgagaagaccaccagctacaagggcgacagcggggtcagtctctccaacaccttcaaccgtgccgcgtacgcggtctccttcagcgagccgcagatcatgtactcgggagccatcggtgagggctcgcggatcctgtacaaccgcacgcccaaggagcgcgtcgaggcggtcgcgccgtggctgaccatcgacggcgacgcctacccggcggtcgtcgacggacggatccagtggatcgtcgacgcctacaccacgagcaacggctacccgtacgcgtcccggaccacgctcggtgacaccacggccgactcgctgaccaccaaccagcgcgcggtcgtcgcccagcagaaccaggtcaactacatccgcaactcggtgaaggccaccgtcgacgcctatgacggcaaggtcaagctctacgagtgggacaccaaggacccggtcctcaagacctggcgcaaggcgttcccggggacggtcgagtcccgcggggagatcccgcaggagctcatggaccacctgcggtatccgcaggacctcttcaaggtccagcgcgagctgctcacccgctatcacgtcgaggaccccgcgcagttctacagcggcagtgacgcgtggcaggtgccggacgacccgaccaacaaggagccgggctccgttccgccgtactacctgagcatgaagatgccgggccaggacgagcagcagttctcgctgaccaccacgttcactcccagaggacgccccaacctgggtgccttcatggcggtgaacgcggacgcggccagcaaggactacggcgagatgcggctgctgcgggtcacctccacggtgaagggcccgggccaggtacagagtgagctcaacggcaacgacgacgtcgccgagttcgtgagaaacctcaagggcaccgactcggacatcgagtacggaaacctgctgacggttccgctggagggcgggttcctctacatcgagccggtctacacgcgcggtggcaaccagaactacccgctgctgcgcaaggtggccgcctcgtacggttcgaagatcgtcttcgagaacagcctcggagaggcgctcaacgccgtcttcggggtcgaggacgacggtgccacgacgccgcccgatcccagtgagccgccgggcgagaccgatgaacccccggccaccggcagcgcagcgctcaagaaggccatcgcggacgcccagaaggcgtactcggacggtgagaaggcgctggaggagcaggactggccggcttacggcaaggcccaggaggctcttcaggacgcgctggagcgagccgccgccgcgcagcccaaggcgggcagcgagggggacaaggccgacggagccgagaagccggcgggcgacgccaagccggacagctcggccgagcccgcgtccgccgggaaaccggcggacgcggacgaggcggatccggcgaggaagccggatgcggccgaaggggccgagaagggctccgaccagggcagctgagaagagtccaccccgcgtcgtggtacggtttgaacacaacgacgcggggtggagcagctcggtagctcgctgggctcataacccagaggtcgcaggttcaaatcctgtccccgctactgaaagacgaaggcccggatcccttgggatccgggccttcgtcgtgcctgttggcgtgcaggccgtgtcggtcccaagctgtgggcgtgaagtgcggttcgctgggcagcagttgcttccggacgtgtttgacttgtctccctgtgggcatgtcgacaaaacgctgtagtgacctcactggccgcgatataccaggtgtacgcgggttacaggtggtgcgacgatggtatttatgggggacagggcaactctgttggagacagggcggtttgtgcagcagcgcggccaagatgctgaaagcgcggtagacgcggctttcgccgctgccatcgccgggacgggcgcaccggtccagcggaccggcgccatcgacgcgagcgccgtggtgagcacgtccgacgaggacaccacggacgcggtcgacgccgcggacagtgccgagagcgaggcacgccaccggcgcgccgccgacgcgggggacaccgcgtccatgagcgtcctgggcgcgctgctgctgcgccggggggagctggacagcgccgagcggtatctgcgcgccgccaccgccgacggggaccgggccgccgcgaacaacctgggcgtcctgctgcac

SEQ ID NO: 3198 - DNA, 800 bp, Unknown
  Kingdom: Bacteria, Phylum: Actinobacteria, Class: Actinobacteria, Order: Streptomycetales, Family: Streptomycetaceae, Genus: Streptomyces
ccccggagcaggccctgcgcggccgccccgtccccgaattcaccgtcccctcccgccacacggtcctcggcaacccgctggtgggcccgtacccggagggtctggaggtggcggacttcgcgctgggctgtttctggggtgccgaacggaagttctggcagaccgagggcgtctggacgacgctggtcggctatcagggcggctacaccgagaacccctcgtacgaggaagcctgctcgggcctgaccgggcacacggaggcggtacgcgtggtcttcgacccggccgtcgtcccgtacacggagctgctgaagctcttctgggagtcgcacaacccgacccagggcttccgccagggcaacgacgtgggcacccagtaccgctccgcgatctacacccactcccccgcccaggcagcggccgccgacgcgtcccgcgaggcgtaccagaaggtcctgacggcgtcgggccacaaggagatcaccacggagatcctcccggccgagggccgcccgttctggccggcggaggcgtaccaccagcagtatctggacaagaacccgggcggctactgcggcatcggcggcacgggtgtctcctgcccgatcggcgtggccccggtcgagggctgatcccggctccctacgactccccggtttctacggctccccctggccgagcatcgccggaagcagtcgccgcagcagccgtacgaacagggcgtcccggtcggccgggggcggtgcgcccgctgcggtgagggcggcgagcagatgcgggtggcggccctcggcggcgac

SEQ ID NO: 3199 - DNA, 4948 bp, Unknown
  Kingdom: Bacteria, Phylum: Actinobacteria, Class: Actinobacteria, Order: Streptomycetales, Family: Streptomycetaceae, Genus: Streptomyces
gtcctcgcccagcagatacaccccgcccccgatggcggcgagcaccaccgcgccgaccgtcacaccgacgccgacgcggatcccgcggcgccgcgccgcgccgggcgacgcgcggacatggccggtccactgcgctccgtcccaccagcgttcctgagcggggccattgcctgagtacccggggtctggatgccagccgggcggggtcatctgggtcacgggggcaccctatgcggaccgggtgagaatcacatgaactgcccggccctcgatccggtggggtcagggttcgatcagcccggcgcggatcgcgtagcgggtgagctccaggcggtcgcgcaggccgagcttctggagcaggttggcgcggtgccgctccacggtcttgacgctgatgacgagcagctcggcgatctccttcgaggagtggccctcggcgaccagcttgaggatctcctcctcgcgctccgtgatggcccgcgcgggcagatcctcgccgtccttggcccggtcgaggaagttgcggatgagcgcggtcaccgcgcccgggtagaggaacggctcgtcgcgcatcgccgcccggcaggcctccaccaggtcccggtccgcgaccgacttgaggacgtacccggccgcccccgccttcaacgcctcgaagaagtactgctcgttgtcgtacatcgtgagcatcagaatgcgcagaccgggcatgacccgggacagctcgcgcgccgcctggagcccggtcaggcgaggcatcgcgatatccagaatgaccaggtcgggccgttcggcgcgggccatctcgatggcctcggcgccgtcgccggcctcggcgacgaccgtcaggtccggttcgccgtcgaggatcagccggaccccgcgacgcacgagcgcgtggtcgtccgccagcaggatgcgggtcggagcggtcgcgcccctggcaggcgtggcgacggacggtgaggtgggcatggtcacttgcttccgttcgggacgggcacatcgaggcgtacttcggtgccgccctgcggacccggaccgaggaagacctcggcaccgatcagcagagcgcgttcgcgcataccgcgcaggcccgccccctccggggcgtcccccaggccacggccgtcgtcgcggatgcgcagttccaccccgcccgggctgcgccgcagcgagagttcgagccgggtggcacgggcgtgccggaccgtgttggtgagggcttcctgcgcgatccggtagacgaccagttcggcctcggcgcccaactcgggcaggtcctttcccgtccggcggcggatcgtcagcccgtccggcgtcggagtctcggtgatcagcgccgtcagcgcgctcaccaggcccagttcctccagcacgccgggccgcagcctgcgcgcgatccggcggatctcgtcgagcgatccccgggtgatctcctggacctggcgcaactccccgcgcagcggctccggggcgtggtcggcgacccgcttcagctccagcaggaccgcggtcagcgtctgtccgacctcgtcgtgcagctcctgcgccacacggcggcgctcggcctcctgcgcggagagggcgcgtgcgctgctggtggcgcgctcggcctccagccggtccagcatcgtgttgaacgtttcgatcagcgcggcgatctccccgtgccccgcgacctcgggacgcgggctcggacgcagcagatcggtggtcgtcatcgcacgggtgacccgctggagcgggaagaggccgagccggagcagggccgcgttggccgcgagcatgaaggcgatgccaccggtcaggatcatggcctcggtcagcaggaccggggtggagatggtgatgggtccgagcagcagcagggcgccggccgctaccagcacggcggcattgagcaggaagatccgccagaacagggacaaggtcgaacggctccttcggaggtcgggtcgtgcgggcgcgctgacagcctccactatcgccgctgcgcgggatgggaggcggccgtccccgcccggacctgcccctgcggcaccgcacgcgcgtccggtctgcatggtgcgcacccccggatatgggtgctgtccccgatggtccccgggggtcttcgccgacgaccatgaggacggggccccggggcccctgccccgtgccgcaccgcgggggccggggcttctggagccgagagggtttccgtaccgggagggagacacgatgcccacgtacgacgagcggctgcgtgacctggaggagcaactgcgtcacgacgatcccggattcgccgaggcgatgtccggcgggactccgcgcaccccgcgcgagtaccgccgccgcgccgcctggctgtggctcgccgtcgggctcgccgcactgggcgccggcatcgccgtgggccacggtctcctgatcgccgccggtctggtcgtgtccggagcggcggcccacctcttcgacccgcagcgcggacgcctgcacgggcgtgacatcctcagcacccgctgacccgcgccgcttctcccggcggtgcccgcacgcaccgcgtccccaccggcccccttccggccggcgtcaaggcctcgtccggacctccggcggggccttcacgcgtacgagaggaagaacgatatccgcgaggccggaccacaggttccgaggcgggaccactggttccgaggcgggaccacaggctccgaggcgggaccgctggttccgaggccggaccactggttctgagccgaccatatcctctgaggtccgaccacatggtcggtgtgacataggctgcatgtccggatccggccgaggcagggagtgacggatgcccgtcgaatggcagcccgtgcggcagtcccgcacccatgagctcgtgctccgcagtatcgaggaacgggtcttcgccggagagctccgtgccggtgaccggctgccgcccgaacgggaactggctccggtgctcggcgtcagccgctccgccctgcgcgaggcgctccgggtgctggagaccatcggggtcctggtggcacagcccggccggggacccgacgcgggggcccgcatcgtgcgcaacccggacgacgccctgggccggctgctccgtctccacttcgccctcggcagctacagcctccaggacgttctggaggcccgggtggttttggagcggtccagcttcgaggccgccgcctgccacgcgccgccggatgatctcgacgaggcggaggagctggtggcgggcatggcggaaccgggccttggggtgagcggcttcaacgatctggacacccgcttccatgtgctggtcgcccgcagctccggcaacgcactgacgtccacgctcacctccgccgtacgggagtccgtccggccgctgatcctgcgcgccctggaagccgccgaggactggccggccaccgctcgcgccctcaacgccgagcacgggtccctcctcgcactggtacgggaaggacggggcggagaagccgcggacctggtggagcggcatatccgggggctgcacggcacgttggtggagaaccccatcacgccgtagcagtccgagtgggacccgtacggcccgcaccgccgggtatcgggcgccgtacgacgcgtttcgcggacgttcccctcaagggcctgcgcctagtatggtccgaccatagaaacctcatagtgaaacgcgacggacaccgaccgccgcgaagaacccgaccggggaggctccatgcgcatcggactcttcgccacctgtctgggagacaccctcttccccgacgcggtgaaggcaaccgcgatcctgctcacgcgcctgggccacgacgtggtgttcccgccgggccagacctgctgcgggcagatgcacatcaacaccggctaccagcgcgaacccgtgcccctggtacgcaacttcgcggacgggttcggcgacgcctcgatcgaggcggtcgtgatgccgtcgggctcatgcgccggttccgtccggcaccagcaccgcatcgtcgccgaccgttacggggacgccgcactccgcgccggagtggacgccgtcgcggcgaagacgtacgagctctccgaactcctcgtggacgtcctcggcgtcacccgggtcggcgcgtacttcccccaccgggtgacgtaccaccccacctgccactcgctgcggatgctcggggtcggggacaaacccctccgactcctgcgcgaggtcgaggagatcgacctcgtcgagctgccgggggccgactcctgttgcggcttcggcggcaccttcgcgctcaagaacgccgagacgtccaccgcgatgctccacgacaagacggcgagcatcgcggccaccggggcgcaggtgtgcaccgccggggactcctcctgcctgatgcacatcggtggcgggctctcccggatccggtccgggacccgcaccctgcacctcgcccggatcctcgccgcgacccgcaccacgcccgacgtcctgacggaggcctccgtatgagcacgttcctcggcatgcccgcaccgccgccccgctccccgtacggcaccggcaacctccgcggcgagaaggcctttccccgcgccgcccacgacgaactgggcaacgaccaactccgccgcaacctcggccgcgccaccggcaccatccgcgccaaacgcctgaacgtcaccggcgaactgcccgactgggaggctctgcgggacgcgggctccgccatcaagaccgacgccatgaaccggctgcccgaactgctcgaacaactggagcacaaggtcaccgagcgcggtggcaccgtgcactgggcgcgcgacgccgccgaggccaacgagctcgtcgcccggctcgtgagggccgcgggcagcgacgagctcatcaaggtcaagtcgatggccacccaggagaccggactcaacgagcacctggagtccgtcggcatcaccccgcacg

SEQ ID NO: 3200 - DNA, 3871 bp, Unknown
  Kingdom: Bacteria, Phylum: Actinobacteria, Class: Actinobacteria, Order: Streptomycetales, Family: Streptomycetaceae, Genus: Streptomyces
tgcactgtgtgggacgccggggcccgccgctcgtgacgtacgccgccgcctgagggcacggcgacgcgacgacggcagccgccactccccacacacgtactcacggagaacgatcatgagcaagcgcaacacccatgcgaacaaggcagcggcccgcgagcggctgcgcgccgaacgcgaggcccaggccaagaaggacaggacccgcaagcagctcgtcgtggccgtctcggtcgtcgcggccctcgccgtcatcggcggcatcagctacggcgtgatgcagttgaacaagccggacgcctgggaggcggccgccgacgcgaagaacgtcaccgcgccgaagaacacctcgggcgacgacggcaccaccgtggtgatcggcgagtcgagcgcgaagaagaccctggaggtgtacgaggactcgcgctgtccggtctgcgccacgttcgagcagggcgtcggcgagaccgtctcgaaggacgtcgaggccggcaagtacaaggtcaagtacgtcggcgcgactttcatcgacaacaccgacaacggcgagggctccaagaacgccctgagcgcgctcggtgcggccctggacgtgagccccgaggcgttcatggagtacaaggccgcgctgtactcggccaagttccaccccgcggagagcgacgacaagttcgccgaggacagctacctcatcgagatcgcggactcggtcgacgcgctgaaggggaacaaggacttccagaaggacgtcgaggacggcacgtacgacgcctgggccatgaagatgtccaagtcgttcgacaagagcggtgtgcagggcacgccgacgctgaagatggacgacaagaagatcacggccgagggcagcgagaacgccccgatgacggccgacgagttcacgaaggccatcgacaaggcgctcaaggcgtaacgccgttcgtcttccgtgacacccggcgcagcgggcgggccgaccgcccggacgcgccgggtgtcacgcgtttgtccagggtgaccagggcgaaggggtggcctggtctacagggtcgccaggaagccgagcgcgaccttccaggtctgctcggcggccgcctggtcgaagtcgtgcagatcggggtcggtgaacaggtgcccggcccccgggtagcggtagacctcgacgtccgcgccggtgcgctgcatctggaggtaccagctgttcagccagtcgtgggactcgaagggatccgggtccgcgacgtgcagctggacggggagctcgtccaccgaggcgttctcggcgatgtccgaagtgccgtggaacagcagcagcccgcgggccttcgcgtcaccgagcgccagggtctgcgcggtcgccgccccgagggagaagccggcgtagacgagcccctggtcggagtagggcgcggcggccagcacggcacgcttcagcagctcctccttgccgatcccgtccttgtaggccatgccctcttccaccgtgtcaaaggtgtgcccctcgaacagatcgggcacgcgcacctcgtggccggcgtccctgaggcgcgcggccgcggcgtgcacggcgggcctgagcccgtacgtcgagtggaaaagcatgatgttcatgaggcccatggtgccatttgtgccccgagggccgccctacagctgggaggacgagggaatggagagcgcgctgcgcccgctgatcgtcatcggcggttccgtggtggtcaccctgctggtcggctggctggtcgacctgctgctgcggcgggccgacagccgtcaccacgagactccgctgtggggactgctgcggcgttgccggcctccgctgcaggtggtgatcatcacggcgctgctgcgcggcagctaccgccagtcgggcatcgcctgggtctgggaccaccgcgccgggatcggccagatcctgaccctggtgctgatcggcgcgtccgcctggctgatggtgcggatcgcggcgacggtcgtggaggccagctacgcccggtacgcgacggccacccgcgacccggcccgggtccgccgggtccgtacgcaggtgacgctgatccagcgggtggtcatcgcggtggtgatggtggtcgccatcgcggcgatgctgctgacgttccccccgatgcgggcggtcggcacgtcgatgctcgcctcggccggtctgctcggcatcgtcgcgggtgtcgccgcgcagtcgacgctcggcaatctcttcgccggattccagatcgcgttcggcgacatggtgcggctcggcgacaccgtggtggtggacggcgagtggggcacgatcgacgagatcaccctgacgttcctggcggtacggacctgggacgagcggcggatcacgatgccggtctcgtacttcaccagccagccgttcgagaactggtcgcgcggcggagtgcagatgaccggcaccgtcttcttccacctcgaccactccgccccggtcgccgcgatgcgcgagaagctgcgggacctcctcggggacatcgccgcctgggacggccgcgactggtcgctggcggtcaccgacaccacgccgaccacgatccaggtgcgggcggtggtcaccgcgaaggacgcggacgacatctggacggtgcgctgcgcggtgcgtgagcagctgatcggctggctgcgcgaccaccacccgtacgcgctgccgcggatcgccacctcgcccgcggtgctgccgccgggcgagcagtgggcggagctgacgggtgccggataccggccgggcggcgacaaggcggcggccttcgacggggacggctccaaggccccgcgcacgggccgaggctgaggctgccccgcgacggccttcagcgcagcgagcggacgtccagatagcgcagcacccggtccacgacctccgggtcggagccgggctcgctgcgcgcggagagcacctcgtggcgggcggccgacatcatctcgcgctggacgcggccgatcgccttgaagcgctccgcgcgccgggcataggcctcgcgccgctcctcgtcgaccatgtccgggctgatccgggcgccgatgtcgtacgcggcgcgctggagccgctccatgacctcttcggggaactcctcgacctcctggatctccttgaggcggtacttggcggccttggcggcccggacggcgagctcccgctccagcgcctcttcggcgtcggtgtcggcgcggaccctcagcctgcgcaccagccagggcagggtgagcccctggaagaccagggtggccatgatcacggcgaacgcgatgaagatgatctcgtcgcgtccggggaagggctgcccgtcatcggtctccagcgggatcgccagggccagggcgacggaggccaccccgcgcatcccggcccaccacatcacgacggtctcccgccagctggtggggatctcctcgctgacgtcgcggcgggtgtggagccgcttggccagccaggtcgcgggcagcagccacagcagccgtacgccgacgacgaccgcgacgatcgcgagcccccagccgaccatctccagggcgtgcccgtcggcggtgccgaacacggtgtgcagctccaggccgatgagtccgaaggcgacgccggtgaccagggtgtcgacgatgtcccagaaggtacgtccggtgagccggcccagcacgtcgtcggcgtcggcggtgtgctcggcgaggaacagcgcgacggtcaggacggccagcacgccggagcccatcagctcctccgcgaggacgtaggcgacgaacggcaccagcagggtcagcccgacctggagggtggcgtcgcccagcaggttcatcagcttgatggtgagccagccgagcgcgaggccgacggcgaccgcgacgacggcggaga

SEQ ID NO: 3201 - DNA, 1162 bp, Unknown
  Kingdom: Bacteria, Phylum: Actinobacteria, Class: Actinobacteria, Order: Streptomycetales, Family: Streptomycetaceae, Genus: Streptomyces
accggagagcgacggctccgcccgccccccggcggccggagccgtcgctctccggtgactcggccgcggcggccttcttgccctggctgcgggcccgcagcacctcgatcacgatcggcaccacggagatgagcacgatcaggatgaggatcatctcgatgtgctcgtgcacgaagtcgatcttgccgagcatcgcgccgagcacggtgacgccgacgccccagaggatcgcgccgacgacgttgtacgtgatgaaggagcggtagttcatccggctgacgcccgcgatgatcggcgtgaaggtgcgcacgatgggcacgaagcgcgccaggaccagggacttcgggccgtgcttctcgaagaactcatgggccttctccacgttctcctgcttgaagaggcgggagtcggggcgcttgaagagggccgggccgaccttgcggccgaagagatatcccacctggtcgccgacgatcgcggcgacggcgaccagcgtgcagacgagccagagcgggtacttcaactgccccgtggtcaccagcagccccgtggtgaacagcagcgagtcgccgggcaggaagaacccgatcaggaggccggactcggcgaagacgatggcaagaaggccggggagtccgaacgtgttgagcagatagtccgggtccagccagctcggtccgagcgcaagcgtattcaagggtccgggctccaggatgatgtgtgcgatggcggctctgtggctgccccaagctatcaacgcccggccggtgtccttggttccagtggcgcacagcgggaatgcgcatcccctggagcggcccgaagctgatcacaggaggtgccacaaacatgggcattgaggaattcggcggtggccaggcggcccaggcggacgtgctggtcgtcaccacgaacgacgtacccggccatcaggtgacgcaggtcatcggcgaggtcttcggactgaccgtgcggtcgcgtcacctcggcagccagatcggcgccgggctgaagtcgatgatcggcggcgagctgaagggtctgaccaagacgctggtcgagacgcgcaaccaggcgatggagcggctcgtggagcaggccagggcccggggtgcgaacgcggtcctgatgatgcgcttcgacgtcaccgaggcggccgacg

SEQ ID NO: 3202 - DNA, 6229 bp, Unknown
  Kingdom: Bacteria, Phylum: Actinobacteria, Class: Actinobacteria, Order: Streptomycetales, Family: Streptomycetaceae, Genus: Streptomyces
gcggtgcgccgggcggtgcgctgtgtggctgacgtgcggcggagcggcgaacggacccctgtcgggcgtgtgctgggaccgaagggcggaccggacgcggggcagtggcggccgtgcgcacgccggaggccgccgtcacgcggcggagcggtcggacggcaaccgttcttgcaacgttgaaaatcaggtgtccggcggtatgacagcacggcgtcggacgggtgtccagaccccgcgcagagcctttgccgaagggcgagttgctgacctcggacgcgccccggtggtctgtcgacactttttggaaacgcatcgacatcgctcttgccgcccgtgccgcaccgcatatataacgttgtaaaccgagccgccgacaggccgcgcaggctctcacgaccgctgttcccgcaggacggagcagggatgtgaggaatgcagcggcaacggccgcagagcggccgatgcctcgtcccgcatgcccgaccgcacgccgatcggcgtgccgtcaacccgccaaggagcgttccgcgcatgatgatccagcgtcgatcccgtaccctcgccgtggcctgcgtcctcgccgccaccacgctggccgccgccggctgcgccaagtcggagacctccaacaacgcgggcggcgacagcagtcagggagcgcaggaggccaagtcccccgattcctcgtccggttcgggctgcaagctggagacctacggcgcgccgaagctggacctgaaggacgccgtggtcggcttctcccagtcggagaaggaggccaacccgttccggatcgccgagacccagtccatcaaggacgaggcgaagaagatcggcgtcaagaagctcctcaccaccaacgcccagtcccagctgtccaagcagatcagcgacatccaggacatgctgtcccagggtgctcagttcctcatcgtcgccccgctcaactccgacgggctggaacccgcgttgaaggcggcggccgccaagaaggtccccgtcctcaccatcgaccgaaaggtcaactccaccgcctgcaaggactacgtggccttcctcggctccgacttcgtcgagcagggcaagcgcgccgccgacgcgatgatcaaggtcaccggcggcaagggcaaggtcgccatcctcctcggcgcgtccggcaacaacgtcaccaccgaccgcaccaagggcttcgtcgaccaggtgaaggccgaggcccccggcctggagatcgtcgcccagcagaccggcgagttcgcccgcgacaagggccagcaggtcatggagcagctcatccagtccaagcccgacatcaccgccgtgtacgccgagaacgacgagatgggcctcggagcggtcaccgcgctgaaggccgcgggcaagaagcccggcaaggacgtcaagatcgtctctgtcgacggcacccgcaacgccgtccaggccctcgtcaacggtgagtacaacgccgtcatcgagtccaacccccgcttcggcccgctcgccttcgccaccgcgcagaagttctacgccggtgaggagatccccgagaacgtgatcatcaccgaccgcgagtacgacgaggccaacgccaaggaatcgctcggcggagcgtactgaccccctcggacggccggccgccgccgcgacgcccggggcacccccgaggcgcccggcggcccggccccactcccgtaacaccggaaggccaggattcatggcaccaaccccagcgacaccccggctcccggagacctccggggccggtgccgccgccgtggcggaccccgtgctcgaagcccgctcggtgagcaagcggttcccgggcgtcgtcgccctggacgacgtctccttcgccctgcgcgcgggtgaggtccatgcgctcgtcggcgagaacggagccggcaagtccaccctcatcaaggtgctcaccggcgtctaccggagcgacgagggcgaggtgcgcgtgagcggcgaacccgtccgcttcgcccgcccgttcgaggcgcagcaggccgggatctccaccatctaccaggaggtgaacctcgtcccgctgatgagcgtggcgcggaacatcttcctgggccgggagccgaagaaccgcttcggactcatcgacttcgcccggatgaaccgcgagaccaccgaactcctcgacgggttcggcgtccgcgtcgaccccaagcggcccctgcacacgctcggcatcggcacccagcagatggtcgcgctcgcccgcgccgtctccgtacgggcccaggtcgtcatcatggacgaacccacctcgtcgctggagccccgcgaggtcgagaccctcttccgggtcatcgagaacctgcgtggccagggcatcgccgtcctctacgtcagccaccgcatggacgagctctaccgcatctgcgaccgggtcaccgtcctgcgggacggccgccacatccacaccggcgaactggcaccgctggaacgcatgcaactggtctcgatgatgctcggccgcgacatggccgaggtccggcgcgacggcctcaccggcttcgccgccgaaggacacgacgccgcccgcacccctgtcctcagggccaccggcctcgaccgccgccaccaactgcacgacatatccttcgagttgtacgccggtgaggtgctgggactcggcggactgctgggctccggacgcagcgagaccgcgaaggcgctgaccggcgcgctgcccctggacggcggggagatcaccgtcgacggcaagcgcctcggccgccccaccccggccgcggccatccgcgcgggcatcagcatgctccccgaggaccgcaaggccgagggcatcgtccccggcctctccgtccgcgagaacatcgtgctcgccgcgatgccccggctctccaggggcggcatcgtctcccgggcccaacaggaccgcgtcgtcgacatcttcatgaagcggctgcggatcaaggcctccagccccgagcagaaggtcggcgaactctccggaggcaaccagcagaaggtgctgctcgcccgctggctctgcctggaaccccaggtgctgctgctcgacgagcccacccggggtatcgacgtcggcgccaaggccgaggtgcagagcctgatcgacgaactcgcccgcgagggactcgccgtactgctgatctcctccgacatcgaggagctgatcgagggcgccgaccgcatcctcgtcctgcgcggcggcgcggtcgccggtgaactcgccggcgacgaggtggacgagagccgtctgctcgaagtgctcgccgaccacacgcccgattccggtgggaaggccccggccgcccaggaggacctccgatgaccacccaggccaccctgccacgccccgccgcgaagccactggcccggctgcgcgaccccgcctggtaccaggagtacggggtgtacgcggccgtcgccgtcgtgctgctgttcaacgcactgttcaccgagcacttcatgacggccgacaacctgcgcacccagctcgtccaggtcgcgcccatcgtgatcgtcgcgctcggcatggccctggtcatcggcaccgagggcatcgacctctcggtcggctccaccatggcgctcgccgccgccctgctgccgctctacctcggctacggactggtgcccgcgctcctgatcgcgctgctcgccggcgcggtcgtcggcgcgatcaacgggacgctcgtctcgctcgtcggactgcaacccatcgtggcgaccctcgccctgttcgtcggcggccggggtctcgccctcgtgatggccgacgggcagctcaaacagatcgtcaacccggacatcctcgcgctgggcaccggctccttcctcggcatcccgacggtcgtcctcatcgcgggcgtcctcgcgctcgccgtggcgttcctggtgcagcgcaccaccttcggccgccagatcgtcgccatcggcggcaaccgctcggcctccgccctgtccggactgcccgtcaagcgcgtcctgatcggcgtctacatcctgtgcggggtgatggccgccctcgccggcatcctcgccaccgcccggctcaccgccagcgatccgtcctcgctcggcaccctcatggaactctccgccatcacggcggtcgtcgtcggcggcaccccgctgaacggcggctccatccgggtgctcggcaccgtcgccggggccctgctgatgcagctgctgcgcgcgaccctcgtcaagcacgacctgcccgactccaccgcacagatcgcccaggcggccatcatcatcgccgccgtctacgtcgcccgggagcgtaggtcccgatgaacaacaccccaccggccaccgtgcccgcggcgaaggccccggcacccctcaagaacaccccctcgcgccccgagctccgccccgagcgctccaccggatcgcgtgtcggcgaactcgtccagcgccagggcgtcctcgcggtcctgctgaccgtgatcctcatcgcctcgttcgtctacccgacgttcgcgagcctcgacaacgcccgcggcgtcaccgtccaggcctcgttcctcgcgatcgtcgccctcggcatgaccctggtcatcatcaccggcggcatcgacctctccgtcggctccgtcttcgccctcggcggcgtcctcgccgcctgggcctccccatggggcttcttcgccgccctcctcgtacccctggtggtctgcggcgcgatcgggctgctcaacgggctgctcatcgcccgcgcgaacatggcgcccttcatcgtcacgctcgccaccctcctcgcggcgcgcggcatgctgctcgccttcaccgacgagggagccaccacctacctggtgcccaaggactccgccttcgccgagctgggccagggcagcgtccggggcttcggatatccgatcctcgtcgcgctcgtcctcttcggggtgggcggactcctgctgcagcgcacctcgttcggacagaccctgttcgccgtcggcggcagcggcgacgcggccaccctgatgggcctgcccgtcgcccggacgaagatcctcgtctacaccctcagcggactgctcgccggactcgccggagcgctgaacgccgcccgcctctcctccggcgtcaccatcgtcggcgtcggcatggaactcgacgcgatctccgccgtcgtcatcggcggcaccctcctcatcggcggcgcgggatcgatcagcggcaccctctggggcgtcctgctgctcgccgtgatccagaacctcatcaaccagatcggctcactcaactcctcgtaccagtcggtggtcagcggcggcttccttatcgttgtcgtggtggcgcagcgttacctcgcgcgcagccggagaaccacctgaaccgtacggatcgggccgagtcggaccaagcaacaaggagtgccgtgggcgtcagcctcaaggacgtagctcaacgggcgggcgtgtccatcaagaccgtgtcgaacgtggtcaacaactatcagcacgtcaccccgaagatgcgggccaaggtccagcaggcgatcgacgagctcggctaccggccgaacctcaccgcccgccatctccgcaagggccgcaccggcatcatcgccctcgccgtccccgaattcggcaacccgtacttcgcggagctggccggcgaggtcgtcgacgcggcggcccgtcacgactacaccgtcctggtcgaccacacggcgggcctgcgggagaaggagctgctggtctgccagggattccgctcccatgtcatcgacggcctcatcctcagccccatccacctggagaccgaggacctgatggcccgcaccgagaccgcgcccctggtgctgctcggcgagcgtgagtacgaggccccctacgaccacatcgccatcgacaacgtggccgccgcccgcgaggccgtcgcccacctcgtcgccctcggccaccgcaggatcgccttcctcggctcccgcaccggccaggaacgccagcccgcccacctccggctgcgcggctggcgcgaggaactggccgcctccggcatcgaacccgacgaatccctggtcgtcgtcaccgacggttacggacgcgaggacggtgctgcggcgatggcctccctcctcgaccggggcgagcggcccgacgccgtgttcgcgtacaacgacatgatcgcgaccggggccatgcgcaccatcaccgaacgcggcctcgccatcccggacgacatcgccgtcgtcggcttcgacgacatc

SEQ ID NO: 3203 - DNA, 9597 bp, Unknown
  Kingdom: Bacteria, Phylum: Actinobacteria, Class: Actinobacteria, Order: Streptomycetales, Family: Streptomycetaceae, Genus: Streptomyces
gcggcgcagctgctgcctctactggcggtgtccgggcggtgggctgtgcggggactgcgtgttcgaccgggcgcccggacagggagcggaggcgcggtagccgtacgccgccgtatccggtccgggaccgtcaggaaggcagtacggcgtcgatggcggcgtccacggacggcaggacgggcagggcgctgtcgaggccgatcatctcgatcaggcggcgcatgaacggggacggtgctgccagtcgcagccggtcacccagcgcggtgtgtccctgaaggagcacgttcaccgtcgtcgagtccgcgaagccgacgccggagaggtccacgacgaccgggccggagccgtcgtcggccgctgcggtcagggcgagtcccaacggtgcgacgctgtcgatatcgaggtcacccgacacggtgaggaccgacgcgtcccgctcctgccgagcggtgattctgacggctctgtcttcgttgggcgatgaaagcacggaaggcacctcggacgggtcggaagggggcggagagccgttctgccggacgggtcggcatggttccgtccctggtcgcggcggggtacggggtaacgatagaagtaacagttgtcatttgacaacattctccatcgggtaacaatctgatccccgacggttgctcggccggctgtcgacggcggagagccgatgaacgcggaagcaggagctggatgaggctaggcgctgtcggcgacatcatcgcggagtggaggcgcggccgtatccctttgcggggaaaggcgttccgaagcggcggcgtggaaggccgcgagtccctcggcgagggcggcgagtgcggcgggatccatacgctccagtacggcgttcagttcgccggcgcgcagggcccggtactcttcgagaagggtgcggccgcgcagactcagccgcagttccacttcgcgccgactggtcggactgggcgcccgcaggacgagtcccatcgcctccatccggtcgcagagcctgctgacggagggagcacgcgagcccagggcttcgcccagcgcgcgcagattggtgccttcctgcttctcgatcacgagcagggcccgaagctgggagggcgatacggttcccgaagccgccgattcctgcccccggccccacagcacctccagcagctccgaggcggcgacggcgtcggcggacgcctgttcgcgactgctcgggcgaaatcctcggtggggcattcagccactgtgtcacccgtcaggcctgcttgtcagcccggccccggcccctaccacgtcgcaggacgaagattgcgcgagagaccgtgaacagacgaacggacatcgaggccgcggtacgggccgccgcgccgcacgccctgctggccaccctgcgcaccaagctcagcagtgtctacggggccctcgcggtggaactgcacctcgccgactacggtctgcgggtcctcaaatccctggaccggcccgacgacgagaacgagccgctgtccctccacaacagccccgagggccgggcgttcggcagccaggagccccgcgaacagcaggtccggcacgacgacgccgtcgaccaccacctgcccgtgaccgtacggggtgaacggctcggcatcctcaccgtccggctgccccaggcgctgtccaccccggagctggtcggcgagctgacccacatggccgacctgctgggccacgagatcctcgtcgccgaacgggacaccgacctgtaccagcgcgcccggcgcaccacccgtctcaccctcgccgccgagatgcagtggcaactgctgcccgcccgcgcctgcaccgccgccgagttcgcgatcggggcccagctggagcccgcgtacgccatccacggggacaacttcgactgggccgccgacgccgacgagctgaccctcgcggtgaccaacggcatgggcgagggcatacaggcctccctcctcaccaatctcgccgtcaacgccctgcgcaacgcccgccgggccggcatcggcatcgcggaccaggcggccctcgccgaccaggccctctacgaccagcaccgcggcgcctcccacgtctccaccctgctgctccgcttcgagctggcgaccggacgggtcggcgtcgtcgacgcgggatcgccgcagctgtggatgcagcgcggccgggaggtccgccggatcgaactggaggcgcagctgccgctcggcatgttcgaggagtcgcagtacacggtccaggagttccacgtggagcccggcgaccggctgctgctgctcagcgacggcgtctacgaggcggtgtccccgctcggcgaggcgtacggggagcgcgcgctggcccgcgccatccagtcgacacgcctccttccggccgccaccgtcccgcgcgcgatgctcggcgaactggcggagtaccggggcacggagacgctcgacgacgcactggtgctgtgcctggactggttcggccggccggaggaccagggcgggtcctaagccgtgtcgaaggcgcggcgggaggcctcgatgtggccgatgtgctcatgggtccagtcgcacatcacatgaaccgtccggcgcaggccctgccccggctcggtgagggtgtactcgacccgcggggggacggtcgggtgcacgcaccgctcgaccagtccgtagcgctccagcatccgcaggttctgggtgagcatcttgtggctgatgccctcgacctcgccccgcagctcggtgaagcggagggtgccctcgcccagggcctcgatgatcaggagcgcccacttgttggcgacgtcggagaagatctcccgcgccagcgagtccgcgcgccgcagatccgcgtcttcgggcgaaccgctgaactgcttggtcaccatcaggttcccccgtcaccgaaaagtgcgttcttccatgtcagcggccactctcctacggtttccgagtaaccacaagtgaccgggaaccgccggtccggtggagaagagggggcgcggcccccaggacgagaggcgggcaacatggccatcaccctggtgaacccgagcgggctgccggagatcggcgcctaccagcaggtgtcggtcgcgaccggatcgaagctggtcttcgtcgccgggcaggtcgcctgggacgcggagggcgtcaccgtcggcgagggcgacctcgccgcgcaggtggagcagtgttacgtgaacatcggcacggcactcgccgcggtcggcggcaccttcgcggacctggcgaagctgaccgtgtacgtcgtggactgggcgcccgagaagatgcccctgttcctggaaggcgtctcccgggccgccgcgcgactgggcggcgttcccgtaccgcccggcacgctggtgggcgtcgcggccctggacatccccgaacacctggtggagatcgaggccgtcgccgtgctcgacgcctgagggacgcccgccgggctcaggtgctgagctggaactccgcccggatccgcttgcccaccggcacccgctcggccgtgagacggtcgcacagcgccaccacgatctccatgccgtgaccgccgaggcgggacgggtcgggggcgtacagcacgggcatcgcggtgctgctgtcgtacaccgtgacgctgatgagctgcgcgttgccctccagttccaggagataggggccgtggctgtagcggtcggcgttggtgaccagctcgctcacggccagcatcaggtcgctgcgcgtgtgttcgccgatcggggcgaggcactccaccgcgagtctcgtcaggaagcggtcggcgagcgcacgggccagcgcgatgcagcccggctcgccgtcgaagacctcggcgctgagcagtacctcggcggaagccagcccctgacccgggtcttccggtggggaggtgacctgttcgttcatgtgctccagccagggcgccgcagtgaggtcggagaccttttccgccattcgtctacccctggcgaacgatcccactccaggagatccggaccgatcctacgcacgtccgggcagccgcaccacggtcacgaagaactcgtcgatctggcggaccgccgcgatgaactgatcgaggtccaccggcttcgtcacgtacgcgttggcgtggagcttgtagctgcgcaggatgtcctcctcggccgaggaggtggtgagcacgaccacggggatgagggagagttcggggtcgcccttgatctgctccagcacctgccgaccgtcgtacttgggcagattcaggtccagcagcaccaggtccgggcggggggcctcggtgtactcgccgcgccggtagaggaagtccagtgcctcctgtccgtcgcgcaccacgtgcagggtgttgcggatcttgttgtcctcgaaggcctcacgggtcatcagctcgtcgccggggtcgtcctcgacgagcaggacctcgatgggttggacaggggtgttcacgaaggatctcccggctggctggtgagcagggcgggagcgagcagctccgccgtggtgtgcgcgggcgcctcgggcgccacgggcagggtgaagtggatgcgggtgccttcgcccggttcgggctccagccagatccggccaccgtggaactcgatgatcttccgacagagcgcgaggccgatgccggtgccctcgtactcgtcccgggcgtgcagccgctggaagatgacgaacaccttgtccgcgaactcggctgcgatccctatcccgttgtccgacacggtcaggtgccagttctcgtcctcgcgcacgcagtcgaccgagatccggcacgggaccccctcccggcggaacttcaccgcgttgccgacgaggttctgccagaccatggtgagcgtggtcgcgtccccgagcagttcgggcagggactccggccgctggatcaccgtccccgactcctcgatcgcgagggtcagattggccagggcgcggtccagggcccggtccagatcgaccggtttccagctctcctgcacccggcccacccgcgagaacgtcagcaggtcgttgatgaggacctgcatccgcttggcgccgtccaccgcgaaggcgatgtactgcttgccccgctcgtcgagttcttctccgtaccgcttctccaggagctggcagaaggaggcgaccttgcgcagcggctcctggaggtcgtgcgaggcgacgtacgcgaactgctccagctccgcattggaacggcgcagctcctgtgtctgttccgcgagcagggactcgcggtcccgcgcctccgccagttcgtcggccagccgccgccgcatgtcctccaccgtccaggccacggcctggacgtcggacggccccttgatctcgatccgcgttccgaaggctcccgacctgacatggtcggacgcggcgcggagccggttcagcgggacgccgaccacccggtggagcagcaggctcagtgccgccacggtcagcacgaagacggtgaccagcgcgatcagcacccggtcgcgggtggtgcgcgccgtgccgaggtcggcgcgcgcccggtcgcgggcctcggcgagatgcccctgctgggcgccgtacgcctgccgcagctggtcgaagtccgccttgctgcgctgcaactgcgcggaggtggcggcctcgctcggccctttctcccggaccgtcgcgatcagcggctcggccttgctccgccgccacttctcggcggcggcggcgatggtgtcgaggtcgtcggcgtaccggctgccggggcccatcagtcgccggacctgcgcgaggcgctcctgctcggccgccttccccgcctcgtagggttcgaggaaggagtcgtcgccggtcagcgcgtatcccctgatcccggtctcctggtcgagcagggcgttctggagctggaaggacgcggatctggcgggctggatgcggtcgaccagctcggtcgtgcggtcggagatccgggccatcacgagcccgccgatcaccagacaggcgcagaccacgacgatgaatccgccgagtatgagatggacccagttctgcaccgacagccgcgcggcgaggccgcccggcgccggtttctccgtcgtcatgtcaccgctcatcggattccgatccccagcccagatgcagaacggccacatcgtccgcgaggccgccgtagggggcggccccctccgctgcccccgcgaccagggcgtcgacgaacgcacgggccggcagatggccgttggcccgcgccatcgcgagcagaccttcctcgccgaggcggctgtcgggtccgtcgcgaccctcgaagaggccgtccgtgaagagtacgagacccgcaccgggcgtcagcgggatgtcgaccgtcggccaccggccggccccgggcagcagcccgagcgccatgccgccctcgggctcgacccaggtcacgtccgtgccctcacgcagcaacaggccgggatgaccggcccgcagaacctgcgcgtgccgttgcccgggcgggaacgccagcgaggtgacggtggcgaacacgtgggagtccgagcgctcggcgaccaggatctcctccagcagggctatctgctcggggtgggacgtaccgcacagcacggcggtacgccaggccacccgcaggcacacgccgagtgcggcctcggcggcgccgtgcccggacacatcgccgatcaccgcgtggaccgtgccgtccgcggtctgcacgacgtcgtagaagtccccgctcagcagcccgtggacccgcccaggctcgtagcgggcgcgcgcccggaagaggtcgtcccgcagcagggggacgggcagcagcccacgctccagccgggcgttctcctgggcgatcagccggttggcgcgcagcgcggcggcggcccgttccacttccttgcgctgcagggcgtagcggatcgcgcgcgcgagcacctccgggtccaggcggcccttgaccaggtagtcctgggcgcctccggcgaccgcgcggagcccggtgccggactcctccagaccggtgaggacgacgatcgcggcgtcgctgtcggactccagtatctgacgcacggcgtccaggccgtggacgtcgggaagatgcaggtccaggagcacgcacacgggggtggtggccgtgctcaggaaggcgcgcgcctcggccagggtcttgcaccaggtgagggcggaatccagctcgctgtcggtgagcatctcctcgacgagcagcgcgtcacccgcgtcgtcctccacgagcaggatcgacgcgttcagactccacagcggggcctcggggtggagcgaggccccgacctgctgggagggaattccggagatgcccacaggaatcggcgctgtgcccacgggcgactcggtcaaccctccaccccctcgtgcgacggcgcggttcgtccggcctgatcgtcaggaagcataagcgagcgagggaccccgcagggtcatgcctcgacgctcatccccttgcgcagctgcttgacgatcctgctgagcagccgcgacacatgcatctgggacacacccagctccgcgccgatctgcgactgcgtcatctcggccccgaaccgcatctgcacgatccggcgctcccggtcatcgagctgttccagcagcggggccagggtgtgcaggttctcgacggtctccatggccggatccgtctcgccgaggacatcggcgtacgcccgctgctcctggccggagtcgctgtccgcggagggagtgtcgagcgaaccggccgaatagccgttggcggccacgagcccctcgatgatctcctcctcggggaggtcgaggtgggtggccagctccttgacggtgggatcgcggtcgagctccgcggagagctgctccttcgccttggcgaggtccacccgcagctcctggagccgccgcggcacatgcaccgaccaggtggtgtcgcggaagaagcgcttgatctccccgacgatgtagggcacggcgaaggtggcgaactcgacctcgcgggacaggtcgaaccggtcgatcgccttgatcaggccgatcgtgccgacctgaatgatgtcctccgagtcgtcgccaccgcggttgcggaagcgggaggcggcgaagcgcaccagggagaggttcatctcgatcagggtgttgcgcgcgtactggtgctcatgggtgccctcctccaggacctggagccggtcgaagaagatcttcgacagggcccgtgcgtcctgcggggcgatctttccggcgtcctcgacccacggcagttctccggtgacgtccgctgtccgcgcaccggtccggccgtcgctgtcgctcagcggcgtcgttccggtggctcgcactgacatcgccgtcatggtgtcgccctccctgctgtccaatgtgtcggacggtcgcctgcccggtcctcgcgaagtcatgcgtccttattccgcttctttgcggctgcctccttccggcgccccttccgggcccgcttcgccggaggccgctcgtacgcgcgtcgtacgccgcccgacgtcgctcgaacggagcagtggcccgcgcatggcaaacttgggcggggtgtttcggcctgcggtgatccatgatccgcggcgagaagatgacagaggaacggcaatgacggtgacagaggacagcccggagctcgctcccggaatcgaggagttcggtcccggtatcgacccggagcggctggccgtctgcctgagcgtgctcgacgagctcgaccggatcgaggtggaccacccggacgccatcgccgtccgccgggccaccgccgggatctaccgcaccgtgaagcagcgccgccgccaggagcgccgcgcggcgaagaccgcccacgaccgggccgtcaccgaggccacggcgaccggctcggccgagcgcatcgacgacgagacgcagggcgtgctgccctcctcctccgcccaggccgagatcgcgggcatcctccagcggccccggtcctgctacatctgcaagacgcggtacgtcgaggtcgacgcgttctaccaccagctctgccagtcgtgcgccaaggagaaccgctcccgccgcgacgcccgtaccgatctgaccggacgccgggcgctgctcaccggcggccgggcgaagatcggcatgtacatcgcgctgcggctgctgcgcgacggtgcgcacaccaccatcaccacccgcttccccaacgacgcgatccgccgcttcaaggcgatggaggacagcgacgagtggatccaccggctgaagatcgtcggcatcgacctccgcgacccggcccaggtcgtcgcgctggccgactcggtcgcggccgagggcccgctggacatcctgatcaacaacgctgcccagaccgtgcgccggtctccgggcgcctacagcgagctggtcaacgccgagtcggccccgctgcccgcgggcgagctgcccgtcgccgaggtcatcggcacgttcggcagcggcaccgtcgaccgggtcgcagccctgcccgccgcccgcaaggagagcctgagcgcccaggacgtgacgggcctcgccctggtcaccggctccgcctcgccggcccggatcgccgccggcaccgcgatcgacgcgggcggcctcgtcccggacctgcacgacagcaacagctggatcc

SEQ ID NO: 3204 - DNA, 7631 bp, Unknown
  Kingdom: Bacteria, Phylum: Actinobacteria, Class: Actinobacteria, Order: Streptomycetales, Family: Streptomycetaceae, Genus: Streptomyces
ggcaccgactccggctgctccccgtcgcgcatacgctgcgcggcgccggtcagcgcgtgcagcgggcgcaccagccgggctcccgcgaacaccgacgcgcccacggtgagggccaggacgagcgccgcagccccggcgatcctggcggtgttcgcgggggagaggtcgaacccgggcagcgtcgcgccgccctcgtcgccgatgaagagaagggcgggggaggccacgtacgagctgagctgttcgctccgggccgcgctcacacaggacgcgatggcccggtcgttctccccggtgcgctccggcgtcacgacggacggcgtggcgtcctccgcagcggcgtcgcgcggcgtcggcaccggcaccggcaccggcgccggctgcggcaccagcggtccgggctcgcccggcacggacgagaaggacggatcgccccaggacaggtcgctgttcagctgtacgccctcgcggccctggcgcttgagacaggcgtcggccaagtcggtgagcgcgtcgagcgccttccgttccgaacgggtgggcgtgtccagggcggcgagatcgcagcgggtgcccagcgcgcgttcggggtcgttgcccacgatctgcacccgggggcggccgctcgcggcgaccaccacgtccgaggcgatccccgcccggttcaggcactccaccttgtcgtcggccgtccgccgcagcacccggctgtcggccgccgacagccggaacggccccaccgcccggggatcgatgcggtcggccgcagcgccctgcccgtcggcgccgcgcgccgccagaaccgtgtccacggacaacgggtcgaccaccgcggacgcctggggcgggagcgccggggcggtcgccgccgtcgcggagtccgccagcggctgcctgccctgcgtggtcagggcgacccggcggcccgactcccgggccagctcccgcaccgtcgcaccgaccccgtcccaggtcgggttgcgggcggcgtaatccagcagggtgtcgtagatccgggcgtccgcggtgaggttctgcccctgctcctgcctgatcgcgccggaggtggtctgcacggcgatccaggcggtggccgccaccgaacacgcggccaccagcgccgaaacggcgagcagccgccccagcaggctccggcgcagcggcagccgggcccggccagacgtctcccgccggccgtcactcccaccgtccccgccgcgcgccctacgcacgccgggtggccttcgccgggtcggtgagcttgtaaccgacaccgaacacggtgagcagccgctccggccgccgcggggcccgctcgatcttcttgcgcaggttcatgacgtgcacgtcgacggtccgggcgctgatgtagcggtcgaacccgtggagttcctccagcagccgctgacggctgaacacccggtccggtcccgccgcgagggccgcaaggatccggaactcacccggggtgcactccaccgttccgccgcccacggacacctggtgccgcgccgggtcgaccacgagggcgccgacgcgcaggacggggtcctcggccaccggctccggggaggcggcccgccgcgtacgccgcagcagggtacggacgcgggccatcagctcgcgcgggctgtagggcttggtcatgtagtcgtcggcgcccaggtcgagtccgagcaggaggtcgtcctcggtcgagcgggcggtcagcatcagcaccggcagttcgcggttctcggaccgcagcacccgcaccacgtccaggccgtcggcccggggcatcatcacatcgagaacgagcaggtcgggttcctggtgccggacggcgtcgagcgcggcgaggccgtcgcccacgatccgtacggcgtgtccttcccgttccagatagcggcgtacgagctcggcctgcttctcgtcgtcctcggcaactatgacgtctgcgcacacgcccccgatcgtagagcggccagaacgcggtgcgagccccgggcggctcccacgccgcccgcgtcccggacgtgatcccgaccgggtccgacggctgccggcgcccggcggagccctcgcgccgatgccgaccttgtgatcaaaggtgagcagatgtcataggggaaagggcggaaggtgaggtcgaatcgttcgcagttcgggcgagaatgagcgcgaacagctccggcggttcacgcaacctccttatagtggtgccgcgttgatcgtatggtcgcaacgcgcgaagccgccgctcctggagtccgtacgatgacgaacccctcgtccgccacgcccgcgtccacggccggtaccggcggaggctgccccgtgggcgtcggtacgggtgccgtcccgctcggcgggcccggcttccccaccgaaccgcaggagctctaccggtcgatgcggcgcgaccacgggcccgtcgtcccggtcgagctgcccggcggttttccggcctggctggtgatcggctaccgggagctccaccaggtcaccagcgacggggagctgttcccccgggacgtctccctgtggaaccagtggggacacgtccccgccgactggccgctgctgcccatggtgggcacccccatgccgtccatctacttcaccgcgggagccgaacaccgccggcacgtcgacatggtcgtaccggctctcgaaggggcggaccccttcgagatccggcagcactgcgagcagttggccgaccggctcatcgacaccgtgtgcaaccggggaaccgccgacctcgtcgccgagttcgccgagccgctgcccgtcctcgtgctcgcccggctcgtcggcttccccgacgacgagggcgccgacatcgcgcgggtgctcaaggacctcgccgacggcggccccggcgctcagaaggcgcacctgcgcttcggtgagcacatgcagcgcctggtcgcggccaagcgggcgcggcccggcgacgacgtgacctcccggatgctcgcccaccccgaaccgttcacggacgaggagtacgcgctcgacctgatggccatcacggccgccggacacctgaccaccgccgactggatcagcaactccacccggctgatgctcaccgaggaccagttcgccgacgccctgtccggcggccggcacagtgtcgccgaggccatgaacgaggtgctctgggaggacggccccacccagatcctggccggccgctgggccgcgcgcgacacccggctcggcgggcggaacatcgcccgcggcgacatgctgctcctcggcctcggcgcggccaacgccgacccgcacatccggcagcaggtcaccgcctccgccgtccgctccgggcagggcggcaacagcgcgcacctggcgttcagccacggcgagtaccgatgccccttccccgcccaggagatcgcggagatcatcgcccgtaccggcatcgaggtactgctggaccggctgcccgacctcgaactggccgtccccgcgaccgaactggtccgccggccgtccgccttcctgcgcgggacgaccgcgctgcccgttcgcttcactcccgtacgcacgacaggagacgcgttgtgaactgcccgcacactgccgccgcgccggccgaccggggcgccgggaccgtcgtcatcgaccccatggtccaggacctggacggcgagaccgcacggctgcgcgacgccggggtcctcgcccggatcgacctgctcggcgtcccggcctggacggtcacccggcacgccgaggcacgccggctcctgctcgacccgcggctggtgaaggacatcgacgcctgggacctctggcggagcggcgcggtgacccacgcgtggccgctgatcggcatgatcgacgccgggcgctccatgttcaccgtcgacggggccgaacaccggcggctgcgcaccaagacctcgcaggcgctcaccccccgccgcctggaggcgatccgtccggagatcgagaagttcacccaggagctgctggacgcactcgacgccgcgcagggggacgacggggtcgtcgacctgaaggcggtcttcgcccagccgctcccgatgcgggtggtgggcatgctcatgggcgtggacgagtcccagcacgccatgctcaccaggcagtacaaggcgttcttctccatgctcaccccccaggacgaacgcctcgcgctgctcgccgagttggacgtcttctacaccggcctcgtacgggagaagaccgcccggcccacggacgacctcaccagtgcgctgatcctggccgaggagggcggcgagccgctcaccgaggaggaggtggtgggcaacctcaaggccatggtcgccgccggacacgagaccaccatcggactcgtcctcaacgccgtacgcgccctcctctcccaccccgaccagctgcgcaaggtgctcgcaggggaggtcggctgggacgcggtgatcgaggagacgctgcgctgggacacccccacgacccacctgctgatgaggttcgccaccgaggacatcaccgtcggtgacgaggtgatccgcaagggcgagggactcgtcgtctcctaccgggccatcggacgcgacatcgagcagcacggccccgacgccgacgccttcgacatcacccgctccacgcggaaccgccacatgaccttcggacacggcccccacatctgccccggcgcggccctgtcgcgcgtcgaggcgtccgtcgcgctgcccgctctgttcacacgtttcccgggactccgcctcgccgtcccggacgaggagatcaccaagcttccggtgatgacgcagaacgacatgaccgccttcccggtcctcctgggctgacggcggaaccggcgcgccgggggaaggaggctgtatgccgtccggaccggggttcctggcgctcgcgccgcatcgctccggcacggcctccctcctgtccgacgcggcacgccgacgcggcatggacgtgaccgtgctgcccgccgacggaatccccgagcggtaccgggagagggagaacgggcactactacggaggcccgcgcttcggcgcccgggttgcggagccgctcggggtggcgctcctggagccgcacgacgggtggctggacgcccttccggtcgccttcaccggccggagcgtcagccgggtgcccctctccgaggcccgtcgccgtaccggcccgctcttcgtcaaaccgcccaccgacaagagcttccccgccgccgtccatccggacggcgcctcactcccgcagccgccgccggactccggcgacccgctcgtccagatcagcgaagtcgtctcctgggaggacgagttcagactcttcctgctcgacggcgagatccgcaccggatcgcgctacgccgtgcacgggcggctcgacgcggtcccgctggccggccacccccaggaggccgccgtgcacgctttcgccggccggctcaccgaggagtgcggggacaccctgcccggagccgtcgtcgtggacatcgggcggatgaaccgccccggccgggcctccgactgggcggtcgtcgaggccaacatggcctggttcagcaccgtgtacgccgccgatcccgaccgcgccctggacgtggtgctccggtcggcgggccccgtcgggctggtccgcgagcgggacctgacgttccggcgggcccgccccgccgagcccgcgtccagagggtgaggcagcgctgcggacggggccaacggggcacgcgaggatcctggttgccgaagattcaatcgtggtaacttcgcggacagccatgtgagttggaccgactcggcgggggatggtcggcgatgaatgctgtcccgcacgggcgcccgggaccggacctggtgcagaccctggtcgatgcgctgaccctgctcgactgtgtcagggaccggagtcagcgcgtcgagttcgtggacgctgtggcgtacaggctcggcgccgaactgacctacccggacagcacaccccggatcgacatgatgcatctggtccgtaaggtgatccaccggcccggcggtccggaggcgatcgtctacgcggtccgcgccgtgtccggcagggacgacgccgagcggatcgccgccgaggcgggcctccggaccgaggccggccggccgggaccctggcccgcgcccgtcttcgccgatgacgtcgcccgtcaggcgcgtcggctgctcgtcgaggcgaaggacatcgacggcgggcgcctggccgccctcctcggcgaggaactgcccggggacctgccggacaacggaacaccggccgaactcttcgaccacgcactggacatgaccgcgctcgccgacggcctcccggccgccgtcgtcctcgtcgaggcggccgccgccctgtcggccgagcagggcgcaccgctgtgccggtgggcggaccgctgggcggcgggggtccccggggcggcggaggcgtcgggtcgggggcggcggcgcctggagcggcccgccgcccccgacccgacggtgccccggtgtctggtcgtgatggtcgaaccggcccgggacggttcaccggacgtcttcgtccggcactgggtcaacaaggtccacggctactggcggccggagctgtgccccatggagaccgtcaccctggacaccctggccggagcggtcgagcgcgccggacagcgcccgggacacggcgcgccggaccagtccgtcgcgcagcggctccacgaggtccgcgagccggccgaacactccccgggcggcgggcacggagggcagcacggcgaccgcggcgacggccagccagaggagaccggtcggcggacgtccggcgaggaagccgtcgtcgagcgcgcgggcgaccccgaacccgccgaggaaggtctgggcgaactccagcagggaccagccggccagccgcaggaccactccggtccgggcccgcaggaaaggccgggcctcgcggccgacccgccgcagcgctgtgtcgcgccgggggtgagcctcgtcctgcgccgtgtgccgggggtgtgctccgtcggccttcaccgggcctccgctccggcggccggcgtgacgggcgtacggctcgcgggcgcggagccctcggcgggtacgtccgtgcggaagaccgcccggtagtccggatccgcccagagttcgtcgtggcggcccgtcgcgcggatccggccgtcctccagccaggcgacccggtccgcccgcgcggccgaggagagccggtgggcgacgatgacccgggtgcagtgcccggcccgctcgtagagcgcgcgccggacgtggtgctcggtcacggtgtcgaggccggacagcgcgtcgtcgaggatcatcaggcggccggggtgggcgaacgcgcgggccaggccgaggcgttgacgttcgccaccggagagcggcgcgtcggcgaccggagtcgcgtagccgaacgggagcagcgcgaggaacccgtcggcgcgggccgcgcgggcggcgtcgcgtacggctccgggcgacgcggtccagggcccgtaggcgatcgtgtcctcgacggtgccgccggggagggccggtcgggcgaaggcgtacgccacctcgcggcgcagccgggccggtgccatgccgtccatcgggacgccgtccagcagcacgctgccggtgtccgggtcgagcagtcgcccg

SEQ ID NO: 3205 - DNA, 4058 bp, Unknown
  Kingdom: Bacteria, Phylum: Actinobacteria, Class: Actinobacteria, Order: Streptomycetales, Family: Streptomycetaceae, Genus: Streptomyces
tcgacccgatcgacggcaccaagaactatgtgcgcggcgtgccggtgtgggccacgctgatctcgctgatggaggcgggcgaggacggcttccagccggtgatgggcgtggtctccgcgcccgcgctgaaccggcgctggtgggcggcgaagggcgcgggcgcgttcaccggccgcagcctcacctccgcgtccaggatgcacgtgtcgaaggtggagcggatcgccgacgcctcgttcgcgttctcctcgctgtccggctgggaggagcagggccgcctcgacggcctcctcgacctcacccgggcctgctggcggacgcgggggtacggggatttctggccgtacatgatggtcgccgagggttccgtggacatctgtgcggagccggagctgtcgctgtgggacatggcggcgaccgcgatcatcgtgcaggaggcgggcggccggttcacctcgctggacggggtggacggtcccggcggcggaaacgcggcggcctccaacgggccgctccacgacgagctgctgggctatctcaaccagcgctactgaccgccccctggtccgagcctgtccgaaaccgtacggtccgcgaggcgcgcctggggcgcgttgtgtgcttttcgcacgccctcctgcgcgcttcgcccaccccttgtcgacccgccccaagggtgcaactctgagagtccccccacttgtgaacttgtgaatcggctcacagagtcggctcgccgaggaggtggctcgttccatgctcgtccgtgacgccatgagcaccgtggttctcaccatcggccccacccatacgctccgccaggcggcccgactgatgtcggcccgccgtatcggagcagctgtcgtccatgatccggacacctgcgggctcggcatcatcaccgagcgcgacatcctgaacgcggtcggatcgggactggaccccgaccgggagaccgcgtccgcccacaccacgaccgacgtggtgttcgccgccccggtctggaccctggaggaggccgcggaagccatgacgcacggggggttccggcatctgatcgtgctggacggcaacggcccggtgggcatcgtgtcggtacgcgacatcatccgttgctggtcacccgcacggcgtacggtcgcggccgccggctgacgcccgccgggcgtcggacagaccggtgggccggacccccacgaggggatccggcccaccgtcgacggcaggcgtccggtcagccgcgaagggcctggaccgcggcttccagccgcttgccgaagtcgccgtccgcctggcggaagttgttgatcgcgcgctcggcgatgtcgtcgcgcgagaccttggagatgaacccggcgaggttctcgatcagccgggtcttctcgtcctccgagtagagccggtaaaggttgcccgcctgcacgaagtcgttgtcctcggcgtggacggcggcctcggtgttcccggtggtgccggtgaccgggagcggctgccacagcgggcggtccgcctggaacgggccgccgaagctgttcggctcgtagttcttggcgccctggtgacgaccgtcgtagaggacgccgtcccggctgttggtccgcgcctcggtggcgtgcgggcggttcaccggcaggtggtcggcgttgatgccgacgcggtagcggtgggcgtcgccgtacgcgaagaggcggccctggagcatcttgtccggggacgggccgatgcccggcacgaagtgggcggggctgaagatcgactgctcgacctcggcgaagatgttctgcgggttgcggttgagctccagcttgccgatctcgatcggcgggtagtccgcgtgcggccacaccttggtgaggtcgaacgggttgaagcggtagccggccgcgtccgccgcgggcatgatctggacctgcaccgtccaggacgggaagtcaccgcgctcgatggactcgcgcagatcgcgctggtggctgtcggggtcctcgccggcgagcttgttggcctcgtcctgggtgaggttcttgatgccctggtcggtcttgaagtggtacttgacccagaagacctcgccggcctcgttgttccactggtaggtgtgcgagccgtacccgttcatgtggcgcagcgtggccggaataccgcggtcgccgaacagccaggtcacctggtgcgtcgactcgggcgacagaccccagaagtcccagacgttgtccgcctcctgcgagccggtgtaggggtcgcgcttctgggtgtggatgaagtcggggaacttgatggcgtccttgatgaagaacaccggggtgttgttgccgacgaggtcgtagttgccctcttcggtgtagaacttcagcgcgaagccgcgggggtcgcgcacggcgtcggcggcgcccaggttgcccgcgacggtggagaagcgcaggaaggtctcggtctgcttgccgacctcggagaggaacttcgcccgggtccactgcgagacgtcgcgggtcagcgtgaaggtgccgtacgcgccggccccgcgggcgtgcaccacccgctccggaatgcgctcgcggttgaagtgggcgagcttctccagcagcgcctggtcctggacgagaaccgggccaccgacgccagcggtctcactgttctggttgtcggcaaccggcgcgccggcctccgtagtgagcggtccctgcgtcacgtgcgcctcctgcgtcatgtcctgcacttcagtgatcggccggcctcggtcgccggtccgatgttccgcacagcctgtcccttggcctatgccggtctcgatcctacaatggacaatgtctaagtcaagtgaacatccaaagtcacacccgatcgggactcggtccctccactgttaggctgggctccatgagcgacctgctggaacgacttcgtggacgcggctggcgcatgacggcgcagcggcgtgtcgtggccgaggtcctcgacggggaccacgtacacctgacggcggacgaggtccacgcgagggccgtttcgcggctgcccgagatctcgcgcgccaccgtctacaacaccctcggcgagatggtgtccctcggtgaggtgctggaggtctccaccgaccgccgggccaagcgttacgacccgaacgcgcaccacccgcaccaccacctggtgtgcgcccggtgcggcgccatcagggacgtgcaccccgcgggcaacccgctggcggacctgccggcggacgagcgctacggcttcatggtctccggcgtcgaggtgacgtaccgcggcatctgcccgaactgcgccgccaccgcctgaccccgcaactccgggcccgcctccgggcgggctcgcggccgtcgcgtccgcggacatgacgaaggcccggatcccttgggatccgggccttcgtctttcagtagcggggacaggatttgaacctgcgacctctgggttatgagcccagcgagctaccgagctgctccaccccgcgtcggtgaatgcaacattacgtcagcaggtcggacggcgcaaattcattcaccccgcccccgggaggcggccttacgcggttccggtttgcgcggttcccggtgtcacgccgttccggtttacgcggtcagctcctggtgcagcgcctcgcgcagccgcgcggcccgctcggccacctcggccggacccagctccaccgctcgcgcgcaccagcgctgcccctcggtcagctcaccccgacgcgcggcgaggagcgccaggcgcagcgcggcacggccgtgtccggcggcggccgcacggctccaccacagggcggcctcgcgctcgctgccctcgcgggccagcagcagcccgaggttgaaggccccgttgcggctgccggcctcggcggcctcccggtaccagtgggcggcgctctccacgtccccgcgggcggcggcgagcatgccgacccggacctgggcccggcggtggccctgctgggcggcccgctcgtaccactcctcgcactcggtcttctccggcatcggctcgcccagcgcgggcggtcccggcggcggctggcgtgcgtccagcaccccggccagccg

SEQ ID NO: 3206 - DNA, 2617 bp, Unknown
  Kingdom: Bacteria, Phylum: Actinobacteria, Class: Actinobacteria, Order: Streptomycetales, Family: Streptomycetaceae, Genus: Streptomyces
gggacggtctgggtctcgggggtgccggtcttcggcgcgtccggctgtgccgtgctgggggtgctgtcggtgctcgttgccgcgggggccgccgtctcggacgagccggccgccttggtccccatggccttgtcctcgccgccacaggcggtgagcgagagagcggcggcgaggacaaggccatggggaccaaggcggccggctcgtccgagacggcggcccccgcggcaacgagcaccgacagcacccccagcacggcacagccggacgcgccgaagaccggcacccccgagacccagaccgtccccgccggggggaagcacgcgggcggcaacggcaagaagccggagaccgcgccgaacgagaaggccgcagcgtcgatcccggcctgcacgaccacgaactccacggtcaaggtctcctcggtgagccgcccgatcaaccacctgctgctcacggtgacgaacaccggctccaccgactgcgccgcctaccacgcgccgttcctccgtttcgacgacgcgcaggccgtctacccggtctacgacgacagccagccgcaggcggtcgtcacgctctcccccggtgacaaggcgtacgcgggcatcgcactcctcggagagcccggtgagaacgagccggtcaagagcgccaacctcggcgtcaccatggtcgacaggaacaacgagccgaagaacgagtccacgctgaagctcccggcggagacctacacggacagcctgggcttcgtcacctactggcagtcggacgtcgagaccgccctgatgtactgagcggacgcaccagtccgggccagcgcctgacgtgcggtaactgtgcgcgacccgtacacatttcttgtacgggtcgcgcgtgcgtgaagtgggttccggggtgggagtgggaaccgtatgcaccccagaaagcgacagcgtaagaacgcgtcgacgatgaagctcgtgggcaagctgctggcccgcttccgcaaggaggcgggcctcacgcagaccgaactcgcccgagcggcaggcgtacaggaggacacgatcgcctccgtcgagcagggcaggcgctcgctcgtcccggatctggcggagacgatcgacgatctgctggacaccaagggagcgctggcgacggcggtcgacaacatgccggaagtcgacctgatcccgctgtgggccgaggactacatcgacatggagcaggacgcgctggcgctgtcctggtacgacaaccaggtcatctagggactgctccagacgaaggcatacgcgcaggcggtgttcggcaacaaggtcccggtctacagccaggaggagatcgagacgcagacggcgacgcggctgcaacgccagcagatcctggaccggaagaagcctccgaccaccagcatcgtgatctgggaaccggtcctgatgatgaagctgacctcggacgaggaccaccgggagcagctccgccacctctacgcgatggcccaactgcctggggtctgcctccaggtactgcccctcgacagcagggtccacgcgggcatcgacggccccttcattctcctggagaccccggaccaccaacacgtcgcgtacaccgaaacgcagcgcggcagccagctgatctccgaccggaacgaggtcagcatcctcgctcagaaatatgcgatgctgcgagcccaggcgctcagccctgtggagaccctgcgcctgctggcccgcttactgggagagacatgagcaccgcactgaactggttcaagtcgagctacagcggcagcgaaggcggcgcctgcctcgaagtcgcctacgactggcggaagtcgagccacagcgccgacgaaggcggggcctgcgtcgagatcgccgcccaccccgccgccgtccacgtccgcgactccaaggacatcgagggcccgacgttcaccgtcgcgcccaccgcctggtcggcgttcgccgcctacgcggcaaccgcctgagcccacaccgtcgttatcccgcccggaccgtctcgtaacggagcagcacgaccccgttcccgaaggtccgggtctccagcagccggagcatctgccgctcctccgcgtcccggaagaacgggcggccccggccgaggatgacgggatggatgtagatccggtactcgtcgatcaggtcgaaccgccggaacgactccagcaggtccgccccgccgaccacgaggtcgcccgacgcggcgtcccgcagcgagcgcacctgctcggggtcgacctcgtgcagcagggtcgcgttcggccccacgctctccagcgtccgcgagaagacgaacttcggcatggaccgccagatccccgcgaactcggccatcggcccctcactcgcggggtcctgatcggcggtcggccagaactcctccatcagctggtaggtcacgcgcccctcgacgaagccgcccatcgtccggaggtagtcgttgaagtgctggtgtacctcctcgtcgacggtgtgccagtcgatgtcctggtcgggcccttcgaagaacccgtcgagggagagcgagatggacgtgacgatcctgttcaccgggggctcctgtcggatcggcccggtcgccgggaacgacgaccgggccgatccgacag

SEQ ID NO: 3207 - DNA, 3375 bp, Unknown
  Kingdom: Bacteria, Phylum: Actinobacteria, Class: Actinobacteria, Order: Streptomycetales, Family: Streptomycetaceae, Genus: Streptomyces
gtgggcgacggtccgctcggggccgtgacgcggctcgtccgcaaggccgtccgccccgatctcgtaccggagtggctgccccagatccccggggcggcggcccggcggctgccgcgtacggaccgcgtcggggcgagcgcggtctactacccggcctgcgtcaaccgcatcttcgccgggccggacggccgccccggcctttccctggccgaggcgatggtcgccgtgtccgggcgggccgggaagccggtgtggatcccggaggacgtcgcggggacgtgctgcgcgacgatctggcactccaagggatacgacgcgggcaacaggatcatggcgaaccgcatcgtggaggccgcctggggctggacggcgggcgggacgctgccgctggtcgtggacgcgtcctcgtgcacgctcggcatggccgaggaggtggtgccctacctcagcgaggacaaccgggcgctgcaccgtgaactgaccgtcgtggactcgctggtgtgggcggccgacgagctgctgccggagttgacggtgttccgcaccgccgggtcggccgccgtgcatccgacctgctcgatggaacacctgggtgacgtggggcagttgcgcgccctggcggaggcatgcgcggacgaggtcgtggtgccggacgacgcggggtgctgcgcgttcgcgggcgaccggggcatgctgcacaaggagttgaccgactcggcgacggccaaggaggcggccgaggtcggcctccgcgactacgacgtctatctgtcggcgaaccggatgtgcgagatcggtatggaacgggccaccggacagccctaccgctcggcgctgatcgagctggagcacgcgacccggccgaccgtcaggtaggccgttcgacgagggcgcgagcgccccgtccggcctgcacaactgagcgttgcgaggccccgattggttgcaccagtcggggcttcggcgtgccgtgaagaaagtccatggtttgaggacgagagtccaaatacttcccttgcgcaccatcagcctcaccctccagggtccttaccgagacccggtccccgcgctcgccatccgtacgggggccggacgcgctcgcgcacgtctgaacccccaaacccacctggaggctcgatgaacgacgacgcccggcccgcaccggaaccgcaggacgtacccgcgcacagcgacgaggccacgcggcaggaccccagccgccgttcggtgctgtggaccacggcgggcgtggccggcgccggactcggcctcggcgcactgggcgcggggaccgcctcggcggccgaggcgaccgcccgctcgaccgcggaaacggtcgccgccgctccggcccggcagggccgcaccatggcgggcgtccgcttcgaggggcgctccacgatccgggtcggcatcgtgggcctcggcaaccggggcggcagcatgatcgacctgttcctcgccgtcccgggcgtcgaggtgaaggcggtctgcgacccggtccgggacaaggcggagaaggccgccgccaaggtgacggccgccggtcagcccgcacccgccgtctacgccaagggcgaggacgactacgagaacctctgccggcgcggcgacctcgacttcgtctatgtggcgacgccctgggaactgcacttcccgatggcgaagacggcgatgctgaacgggaagcacgtcggtgtggagtgccccatcgccatgcggctggaagagctgtggcagttggtggacctctccgagcgcacccggcggcactgcatgcagctggagaactgctgttacggcaagaacgagatgcgggtgctgcgcatggcgcacgcgggtctcttcggcgatctgctgcacggagcgggcgcctacaaccacgatctgcgcgggctgatgttcgaccccgactactacgagggtccctggcggcggctgtggcacacccggctgcgcggtgacctctaccccaaccacgggttcgggccggtcgccaactacatggacgtcaaccggggcgaccgggccgtgagcatcacgagcatcggcacgccggccctgtcgctcgccgagtaccgcaaggagcacatgccggccgacgaccccagctggaaggagtcgtacatcggggccgaccggacgatcagcctcgtacagacggccaagggccgggtgatccggctggagcacgacgtgtcgtccccgcacccctactcccgtatcaacagcctcggcggtacgcggggcgtgttcgaggactacccggagcgcatctacctggagcccacgaacacgaaccaccggtgggacgacttcaagaagtacgccgagtgggaccactggctctggaaggagcacgcgaacccgccgggcggacacggcggcatggactacatgatggtcttccggctgatgcagtgcatgcggctcggcctggtccccgacttcgacgtgtacgacgcggcgacctggacggcccccgtgccgctgagccatctctccatcagggccaagggcgcgccgctgccgatcccggacttcacccggggcgagtggaagaaggcccggtccggcgtggactccgagaagcccgcggagtgacgccccccggggtcccgggccgcgtcggtccgggaccccgcagggctgcggagaggaccggaaaaccggttgccccggaccgggacgaacagggaaccttgcacgtcaccccgttcttcgaggtccatcaggatctccgtttcacaagccctgggacgtcatgcagattcgcgaccttccgtattcggatcccggcgaccccgatgtccgttcaggccctcgcttcctctactggctcgggcgcaaccagctcgcggggcaggtgaaggccctctcctgggggctgctgcaccagctgggcatcgccggtctcccggtcaccgtgggtctcgccgtccaggccgtcatcgaccgctccggagggcggctcgccctggccggcggcctcatcgtcgtcctcggcatcctgatcgccgtcggcgacaccatgctccaccggaccgcggtgaccaactggatcaccgccgccgcccgggtccagcaactgctcgcccgtaagaccgccgagctgggctcggcgctgacgcggcgggtcgcggccggtgaggtcgtcgccgtctcgaccggcgacgtggagaagatcggctggttcgtcgaggcgctctcccgtttcgcggccgccgccaccgctctcgtggtgatctgtgtggggctggccttctacctcccgtccctcggtctgatggtggcgctcgccatgccggtgctcgccctggccgtgctgccgttgctgccgcgcgccacccggcgcgccgacgagcagcgcgagaa

SEQ ID NO: 3208 - DNA, 3354 bp, Unknown
  Kingdom: Bacteria, Phylum: Actinobacteria, Class: Actinobacteria, Order: Streptomycetales, Family: Streptomycetaceae, Genus: Streptomyces
cgcgctcaagacccccgacgacctcgacacggcccgcgcgctcatttccgagcacgcaggcgcctaaggagcgagcatgtcgaagatcaagcccagcaagggcgccccgtacgcacggatcctcggggtcggtggctaccgcccgacccgggtcgtgccgaacgaggtgatcctcgaaacgatcgactcgtccgacgagtggatccgctcccgctccggcatcgtcacccgccactgggcctccgacgaggagaccgtggccgcgatgtcgatcgaggcgtccggcaaggccatcgccgacgcgggcatcgaccccgagcagatcggcgcggtcgtcgtctcgaccgtctcgcacttcaagcagaccccggccgtcgccaccgagatcgcccacaagatcggcgcgggcaagcccgccgccttcgacatctcggccggctgtgcgggcttcggttacggcctcaccctcgccaagggcatgatcgtcgagggctccgcggagtacgtcctcgtgatcggcgtggagcggctcagcgacctgaccgacctggaggaccgcgcgacggccttcctgttcggcgacggtgcgggcgcggtcgtcgtcggcccctcccaggagccggccatcggcccgaccgtgtggggctccgagggcgacaagtccgacaccatcaagcagacggtggcctggaacgacctgcacgtcggcgacgtctccaagctgccgctcgactcgaagggcgagatcaagttcccggccatcacgcaggagggccaggcggtcttccgctgggccgtcttcgagatggcgaaggtcgcccagcaggcgctggacgcggccgggatcgccccggaggacctggacgtcttcattccgcaccaggccaacatgcggatcatcgactcgatggtgaagaccctgaagctgccggagcacgtcacggtcgcccgtgacatcgagtccaccggcaacacgtccgccgcctcgattccgctcgcgatggagcggctcctggcgaccggtcaggcgaagagcggcgacaccgcgctcgtcatcggcttcggggcgggtctcgtctacgccgcgacggtcgttaccctcccctaggcacaccggaccttttggtccgtacgtacgaaccctgaagaaacccaccgaaggagcgccaagatggccgccacgcaggaagagatcgtcaccggtctcgccgagatcgtcaacgagatcgccggtatcccggtcgaggacgtccagctggacaagtccttcaccgacgacctggacgtcgactcgctgtccatggtcgaggtcgtcgtcgccgccgaagagcgcttcgacgtcaagatccccgacgaggacgtcaagaacctcaagacggtcggcgacgccgccgactacatcctgaagcaccagggctgatcccagcccggctgtgtcgccacccggcggtggcgccgctgattcacgaccctctacacgtggagaagattttccagtgaactcgaccaatcgcaccgtggtcgtcaccggtatcggcgcaaccactccgctgggtggcgactccgcatcgacctgggaaggtctgatggccggccggtccggcgtcaagcctctcgaaggcgagcgcttcgccgaactgcccgtccggatcgccgccctcgcggccgtcgacccgggcgacgtccttccccgcccgctggcccgcaagctggaccgctcggcgcagttcgcgctgatcgcggcccgcgaggcctgggcggacgcgggcttcaccgccaaggccggcgaggacgagagcatcgcccccgagcgcctgggctcggtcatcgcctccggcatcggcggcgtgatcaccctgctcgaccagtacgacgtgctgaaggagaagggcgtacgccgcgtctccccgcacaccgttcccatgctcatgcccaacggcccggcggccaacgtcggcctggaggtcaacgcccaggccggtgtccacacacccgtctccgcctgcgcctcgggtgccgaggcgatcgggtacgccgtcgagatgatccgtaccggccgcgccgacgtggtcgtcgccggcggcaccgaggcggcgatccacccgctgccgatcgccgcgttcgccaacatgatggcgatgtccaagaacaacgacgagcccgagaaggcctcgcgtccgtacgacaccggccgggacggcttcgtcctcggcgagggtgcgggcgtcgtcatcctggagtcggccgagcacgccgccgcgcgcggcgcgaaggtctactgcgaggttctgggccagggcctgtcggccgacgcccaccacatcgcgcagcccgagcccaccgggcggggcatcgccgccgcgatgcagaacctgctggactccagcgacctcaagccgtccgaggtggtccacctcaacgcccacgccacgtcgacgccgcagggcgacctcgccgagatcaaggcgctgcgcaaggtgctgggcgacgacctcgaccatgtcgcgatctccgcgacgaagtcgatgacgggtcatctgctgggtggcgcgggcggcatcgagaccgtggcgacggtcctggcgctgcaccaccgcatcgctccgccgaccatcaacatcgacgagctcgacgaggcgatcgacgcggacatcgtgcgcggtgagccgcgggtgctgcccgaggggccgatcgcggcgatcaacaactcgttcggattcggtgggcacaacgtggtgctggcgttccggtccgtctgacgcttgacgcagtgaagcccgcttcccggggtccgggaggcgggcttcctcgttcttcggggctccgccccggacgccgctcctcaatcgccggaggggctgatgtgctcccggtcaccgcgaggccagggggcaccggagggactcgatcctgcgccccggcagctagacgacctggtgcagccagcgaacaggcgcgccctcgcccgcgtggcggaaggactccagctcgtcgtcccacggcttgccgaggagcgaggcgatctcggtctccaggtcgctctcgccgcgcaccgatcgggccagcgcggcccgcagccggtcctcggggatcaggatgtcgccgtgcatgccggtgacggcgtggaagataccgaggccgggggtggagctgtagcgctcgccctcggcggtggcacacggctcggcggtcacctcgaagcgcagcaggtcccagccgcgcagggcggaggcgagctgcgaggcgatgccggcgcggcccttccaggagaactcggaccgccaggtgccgggggcggccggctgtctgatccagtccagctggacccgcacaccgaggacgcccgccacggcc

SEQ ID NO: 3209 - DNA, 712 bp, Unknown
  Kingdom: Bacteria, Phylum: Actinobacteria, Class: Actinobacteria, Order: Streptomycetales, Family: Streptomycetaceae, Genus: Streptomyces
ccgcgttgggcagcaggttgctgtacgggactgcggtgcgtgccatgagagagggctccgatcaggcggacgggtcgatgtaggcgatggccaggccgtcgggacgcacgagcttcgcgccgtacagggccaggcccttcaccgcgtcgctgaagctggactcggggcggtaggcctcggtcttgttgatctgctcggcgaacgagatggcggactgcactccggcctggacgacggcgacgccggcggtcggctcgggggtgttgttgctctcgtagatcggccgcccggccgacggccccgttgcgcagggtctcggtggtgccggacttgtcgtagccggtgaagcggtcgtccagcaggaggctggcgtacccctccggcgggacgatcgcgtaccgcccgctggtgggcacgttggcccgcttcatcctggtgcggagcggcacgaggaccttgtcgtagaagtgcttggggtcggtgtacgtgttgatcggggccccggtggagccgagcacgttggcggcgacgactccggtgtagaggctggcgacgtagcggtcggtctcgtctgcgagcgcgtaggcggcctcggacatggcctgcggcatcacgttgcccttggcctgccgcttgttgacgtcgtcgaccttgaacgcccagtacttcgactggtcgatgaccagggtgcgctgggcgtcggtcagttcct

SEQ ID NO: 3210 - DNA, 6407 bp, Unknown
  Kingdom: Bacteria, Phylum: Actinobacteria, Class: Actinobacteria, Order: Streptomycetales, Family: Streptomycetaceae, Genus: Streptomyces
cggatgaggtcggcgtggccgcagtgccgggcgtactcgccgatcatgtgggtgtagatccaccgcagcgtgacccgggcacccatgaacgggctggtgtcgtcgagcgctcgggccgcgcagttctgccgggcccttgccacttcggcctcccactgcgcgagcgcctgctcgtaggtggagtcctcggcgagatcccagccgccgtcacggccctcggctccgcccccgccgccggccggaggggcgaagagcggcggggcgtcctcctgcgcgagcacgcggcggaaccagttccgctcgacctccgccaggtgctggagcagtccgagcagcgtgatcggcgagggcgtcgcggacgcctcgcgcaggcccttctcgggcaggtccgcgcacttctgggcgagagtggcgcggtagaagtcgagccagctctccagggaggtgcgttcgtcggcgaccagagggggcatcgggcgttcggaagtgctcatggcctccatcgtggcagccgggtccgacaacggccgcgccccgcaccaccggacccggttcatcccttctgccacagcagtaacgatttcggcacacatatctcggttacgcgggttttctgtcacagccggtcgacagccccacgccgtctgccgtccggggtcgttcacccgagcacaggccgagtgatcgtcagcctgtgctgcggagcgcagcagagcagacaagcgctgagaggtgtcactgatggccgacagaacgctctggtcctacaaggacattgccgcgcacatccaggtccagccggacaccgtccgctcctatcgcaagcacgggctcctgcccccgcccgaccaggtgaagaacgggaagccgtactggtacggagacaccgtccgcgcctgggtagcctcccgcccccgcaaccggggccgctgaggccccggttacgggcggtgctgagcaaccggccacacggcggaccgtcatttccggacaggagcccggaagagagccgtccagaggaacggctccccgaagagcggggaccgagggccctcgtcgttcatacggcggagctcgatctccgtcagaccggagaagacgcggcgcagagcctcgggcgagtaggcgagcccgccctgcagacctcccgtccggtagagctcggcgtccggcagttccgagcccatcccgccctccccggcggcgaagcaggtgagcgcgaagtggccgccgggagcgaggcaacgctccaggagggcgagatagctgacacggcggtggggcggcaggtggtggaagcagccggagtcgtggatcaggtcgtagggcccggccagggcggcccccgccgccgtcagcgcgaacgcgtcaccgcggtggaaccggacgccacgggtccccgccccgtccgcccgctcccgggcccaggcgatcgcctccggggaaaggtcgaccgcgtcgacgtcgaagccgagcgaggcgaggtgcagcgcgttgcggccgggtccgcagccgaggtcgagcgcacggcccggggtgatcagcccctggcggagatacgcgtccaggctctcgtcgggcttctccacgaagaacggcaccttcttcgaccggtccgcgtagaagtcgtcccaccaggacgctccgttggctgtccaccggtccgcggcgggggcgaacagcccgtccatcagcgccagtacatcgtccgtcgtggtcacgttccggtccatccgggcccccttttccgatgggccaattctaggcagccggaggacgaaatcccaggtcagcggccttttcccgatgccacctgcgggcttctgacgccttccgggacaggccgggagaccggcccccggactccacccgttcggtgccgggcgggcccgccgcgggccggtccgggggtgttcccggccttcccgagggctgtttacgaacgacttccccaactcgccccctgagggcgccctgtcagcgtctcgccggttcggcgagcgtcgcacccgcctcggaggcggcatcccccgtgggctccgcctccccgggaccgccccggccgcccggagcctccggagtgacggcgtcggccggggccgcatccccctcgctgaggccgaacctgcggtggaaggcgcgcaggggtgccggggcccaccaggtggagcggcccatcagcttcatcaccgcggggaccagcagactgcgcaccaccatggcgtccatcaggacggcgagggcgatgccgagtcccagcatcttggtgttggtgacccgtgaggtgccgatggccaccatcacgaccgcgaggatcacggcggctgccgtgatcagtccgccggtgtgccggagtccgaaggtgacggagtgctcgtggtcgccggtgcggtcgtactcctccttgatccgggatatcaggaagaccccgtagtccatggagagaccgaaggcgacgcagaacatcaggacgggcagcgtcgtctcgatgtcgcccgtactggtgaaggcgagcagtccggagagattcccgtcctggaagacccagaccaccgctccgaacatcgcggtcaggctgagggcgttgagcacgaccgcctggagcgggatgagcacactgccggtgagcaggaagaccaggagcagggtgaccaccacgatgatccccaccgcccagggcagccggtcggctatggcgtccttggagtcgacgaggaccgctgccgcacctgtcaccgaggtgtcgagggaggaggcggagggcacggccctcaggtcctgtacgagctgctgggtctcctcgccgacggcctcgccctcaggcagcacgctgtagtaggcgacggagtccccggtgaccgggccgtcgacccgaaggacgccgggaagctgctcgatccggtccttcagccgcgcgtactcggcgggggaaccctgtccctcggccagcacctccaggccgccgccggggctgccggggaagccgtcgcggatgtgttcctggacgacccgggactccgcgccggccggcagctgacggtcgtcggccgtgccgaacttgacgcccaggaaggggagtccgagcagcaggaggccgacggtggtgacgacggcgaagacgggcgccctgcgcatcaccagcacggccagccgcgcccatccccggcctggcgacgcctcttcccccgcgccttccgggctctccttccggcggcggaacagccggcgcagatccagcgcgttgatccggtggccgagcagcacgagcgcagcgggcaggaggatcagagcggcagcggcggccaggaggaccacggcgatcccggcgtaggcgaaggaccgcaggaagtactgcgggaagacgagcatggccgacagggacaccgccacggtcagcgcggagaacagcaccgtacgcccggcggtccgcagcgtcgtgcccaccgcggtccggggatccgctccgccggccagctcctcgcggaagcggcggacgatgaacagggcgtagtcgatggcgagtccgaggccgagcgccgtggtgaggttcatggcgaagaccgagacgtcggtgaattccgtcaggcctcgcagcacggcgttggtgccgaggatggcgacgatgccgacaccgagcggcagcatcgcggcgacggcgctgccgaagaccatgaccagcaggacgagcgtcaccggcagggcgatcaactcggcccgcagcagatcctcctggatgatcgtctgcatctcgtgctgcacggcgacaggcccgccgagggagaccgtcaccggtccccgctcccccgcgaaagcgggagctatccggtcgagggtctcgcccgccgtcttctcgtctcccccgatccgggcggcgatgaccgcctcgcgaccgtcctcggagcgcagggcgggtgacgcggtctcccagtaggacccgacgcccgagatccccggctcggccttcagccgctcggccaggcgggcggcctcggcggccaccgccgggtcgtcgacgtccgcggaaccgctgtcgaccagaaggagcaggttgggctgggaggcggggaactcccgcgccagcacctcggtcgcgtaggtcgactcggcgtcgggggcctgccagccgccgctgcccatccggtccgccaccccgctccctgcgaacacggcgagtgcggtgatcaccagcgcggccagcagcgcgagccgcggccgggcggtgacgaaccgggtccagccgccgaccgtaggcggcgcggaacggttgacttcggacatggtgcggtgtccccttcaccgagacccgggcggcacagggcagcatgggtcggtcgttgccacttaccctggcaaacacgagtagtcgctcgcgtttcactagaatgcgagcgagcactcgcgtttgtcaaccgcatcatgagagccggggattgaccgtgtcggaggccaaagccaccaagggcgccgcagcggacggagcggacggcggatccaccgtgggcacaccacccgacggaacggcgggctccacccgcccgcgccgccgccaggcccgcggcgaggctcgcatcgcccaattgctccgggccgccgccagcgtcttctgcaccagcggctacaccgcgtcgagcaccaacgccatcgcccgcgaggccggggtgtcgccgggcacgctctaccagttcttcccgaacaaggaggccatcgccgtcgagctgggcgaccagctgctcaaccgctggcgggacacctacggcgccgccttcacgcagagccatatcgagctgccgctcgaccggatgctggacgccatcctcgacccgctgatcgccttcaactgcgagaacccggccttctccgtcctgatgcacggctcggagatccccggccggatcaccgaggagcacgacacactgcacaccacgatgctgacgcgggtcgaatcggtgctcgccggctacctcccggacgtgcccgccgaccaggtccgccgcatcgccgacatggtcttcatgctcttcaaggccggactggacctgatcatggcccacgagggcgaggagcgcgcggcctacatccaggagctgaagacgatcatgttccgctacctggacccgctggtcggcgacgacgcgccgcaccgggccgcacaccgggtcccgcacacgccatagacgaccacgggacccgcccacggcgccgccgggacgcattcataccccctaggggtatagtatgagtgtgacgggacgccggggagttctccgcgaccccctgcaccccgccacgccgccgtaacgtgttcgcgaagaggagaacgtcatgaccgccgagacagagaccccccggtccaccggttcctgctgctcgcccaccggttcctgccacgacggtacggccgacgtgcagatcgagcagaccgacacggtcaccaccgtgtaccaggtcaagggcatgacctgcggccactgcgagggctccgtgtcggaggagatctccgggatcgcgggcgtgacctcggtcgcggccgtcgccgccaccggcctggtcaccgtcacgtccaaggccccgctggccgaggacgccgtccgcgccgccgtcgacgaggccgggtacgagctcctcggcccggccgcctgaaggcctgcccggagcagcagcaccccgttcgccgtcgggccgtcccctaccagtcgatactggtggggtacggcccgatctgcgtttctcaggagttccggacatggccagcacagcagcagccgattttccggccgccgacgcctccgaggccgagctgatgatcggcgggatgacctgcgcctcgtgcgcggcccgcgtcgagaagaagctcaaccggatggacggcgtcaccgcctcggtgaactacgcgaccgagaaggcccgcgtcaccttcggggagggactgaaactgggggacctcgtcgccacggtcgaggagaccggctacacggcccgccccgtcgcacagccggagcggaaggcgcaggcggcgggcgatgcctccactcccccggccgcggacccggacacgtacgccggcgaggcccgccgtacggacaccgccacggacaccgccaccggtccgggcaccggtccctacgccgtcggcccggctcccggggccgccccggagttcggcacggaccttgccgtccgggacgccgaggcggagcaggaggcctccatcggcgcgctccggcaacgcctcgtcgtctccgccgcgctcgccgtccccgtcgtcctgctcgccatggtcccggccctccagttcgactcctggcagtggctgagcctcacgctcgccgcgcccgtcgtcgtctggggcggcctgcccttccaccgtgccgcctggaccaacctccggcacggcgcggcgacgatgg
